United States Patent 9,328,346 (POLYCOMB-ASSOCIATED NON-CODING RNAS) - sequence listing, part 143

SEQ ID NO: 192188 - RNA, 25324 nt, Homo sapiens
uuguuuugugcucuuaucacaaauacuaggcauaaagaagaugcuuauuauugaacagcaaaugcuuaaaaagaccugcaggccagacgagguggcucaugccaaucauccuagcacuuugagaaggcugaggcuggaggacugcuuaagccuaggaguuugagaccagccugggcaacacagcaagaccccaucucuaccaaaaaaaaaaaaaaauuaaagaguccuauagagaauucuuauacuccaaugugaagacaacauuggaaagggccaaguuucucaugcccuccaacuaagaaaccccuaauaaaaaaugaagugacacuugaacaggacuuaaggauucuacaguuggucuuuggcagcaguauguuuuaggaaauguaaugcggcggguggggcggugacuuagccaguuaugcuuuuaaauggaacugcaauaauaaaagugauacuagugcagaaaguaucuguauuagaauucuagaguaagucaagagcucacauucauuaaaauaaugacacaacuccacggggguggggagaacagcaguaaagcaaccacauacuauacuauuagacuggcaacauugagacugaaaauauccaugaggagaauacugacaucuuagugguaagcauuuccuuuuaacccgguaauuccaguaguaaggaucauacaaauguaccgcuaggaagagguaacguauaugaucaucaaugggagaacaguaaagguguuacuguggaauucccgacaggcuuucacuuggagggggaauauuugaacacaaguuuaaacaacccaggguaagcacacaaugcacuaugcacugaaagguauacguuuccgcuggguguuuauacauuucaaaguuaaaagcauacaccuuacccaaaguuucagaaaccugguuugcaaaucugaguucauguguguguguuuuuguuuuuuuuuuaaagccaugaucauuuuuuccauuuuuauuugauguuuccaaauauaaaaaagucaggauucuuacaucaauuaucucaaaugagaccaugcaaagcaauucaguguauacaacaaucauuuuuccccuucaguucugcugcuuuauacaacagugugauugacagaaaauuggauggcaugugccuggucagaaaaugucaucuguuuacaaaauaacaucaugcagcacaguuucuacuuugucugcaagucaauucacaaaaacuacuuauuuucuguuuuuuauuugggaggcacauggaacugaaaaauuuagcugcccaauuuuauucaacuaccccaccaaaaaaaaaaaaaaaaaaucacaaaugacagucccaacacucugcaaauuuuggaggguugagauaguagacacuauuugucauacucagcagaguuaacuauuuaacagaaauaaaucucccuagggccuuuccucucauuuugcuagacuggguuccaggagaaucgugaagaaccccucauguaaaauuugaagugugaaaacuguguuguugcauuaugcagauuuuugcuaguugcauagacuaaagacguuuugcuaaauggcacugaaaauccuuaccgagugucacuauucaguccaaguguuucugaccaaagaaaauuauacaacaauauuuauaggcuaacuuuaaagagaugguugacguuaauacuguacauauuuuacaugucaaauacauaguccaagaguuuauaaaauaaauucaugcaucauuaccuuauuaccucuaagaauaucauguacaagaugggcacucccccacccccccaguacuuaugacagcauuucagguggaagcagucuuauauacaaaaacaauccaguuucucugcuauguuaaguauauaauuuaaggaaauuucagagauuacugaccaaaaaaaucuuaguccauugaagauagaaagugucaauuugugggauuuaaaauguuuccuuuauaaaagaacacccagaauauguaaccucuguacaaagaaaaaaauauaaaaauucuggaugaucauguuugaucacacuacguacuugaaauguugcugguuaaaaguuuuucugcuuuacucauuccuuugacagcauuaauuugugaacauuuauauucaguucagcuguauuuauggcacaagaucucauuuccaaaauggcacuaauuuuccuuaaguguaacagcacucuauuuuuagcaguaauuauauuuuuaaagguuaauuuguagaacaaauguuuuaacuauacuuuuuuucuacucuauacuccccaguuacaauauuuacaaagggcugaagucuauauaaaaaaaugaucuuuggcugggcaugguggcucaugccuguaaucccagcacuuugggaggucgaggcaggcggaucacgagguuaggaguuugagaccagccugaccaacaugaagaaacccugucucuacuaaaaauacaaaauuagccaggcauggaggcaggcgccuguaaucccaacuacucgggaggcugaggcaggagaaucgcuugaacccgggaggcggagguugcggugaguugagauugugccauugcacuccagccugggugacaaagcgagucucaaaaaaaaaaaaacaucuuuuacuuucccccaucccucauuuuagucaaacuucucccaccucauuucugcccugguuggggaagugcaagaguuucagauaagguaccuauguguuuuagaugggauucuugauuuuaagugaguauaaaguaaaagauuuaauucuuaguucagguauguuccagugccucgaaaguuaguuaugugacaaauaguaccuguugacaaccuagaaaagaugagacauucuaaggugcccuaacaaucuucagucucuaacagcugaacaggaaggccauuucacucaacugugaugcgaucaucacugacuggcauuuagaauuagauuucaagacuccacuccugugggggccacuaaauaacugaauacauuuuaagagcaaucuacacugagggaaauaacgguucuaagguauucugcaaagaaagaguaucgauaaugggaacuggcaacugagcaugcuaaaucaaauuccaugaauacaguuuucauaagaugucuuuacuacaugcauuuugcuaauauuucccuaaaauauucaccaacucuacagaguuauacuuuguguuaagguacuauugaguuauaagggaaauagccguaucagguagcuagugacauaauaccaguugugaaaauucagacaaaaugagucgacaaauccccaaaaauggcaaauuaagcccugugacaaaauaaguuauuggaucauacagaaauagcccaaaucuggaaauuuugaauuaaaauuguaauccuguaaaacaaguuuuggggugaauggauuucuuuaauaccaauaauauuuuuaauucccaccacagauggauuugcugaauaugcuaaugcugugaaugagaaaacaauuuugggguagguauacccacaaguaaucugaugacaaaauaaaccacagacugaugucaaauggacaaaaaacugaaaauaugcugugagaaauagacaaccaaaauaauauaggggguugugggguguggcacaguuaaggcaucuaaacaaaaauuccacauggcuuuggcuuauuaaaauauuuuacacuauuuuuuuaaaaaaagauuugaaagcaucugaaaaacaugcaaauuguuugaaaaccuugcauggcaaauucagacaguuugcaagcgucaaucagauguuugacgaggaaacgaaagaagccucuccccaugagacugcacauggugggagaggccuacccaguucucucuaucuuacacuagauggcaacccagaggucugugcagcgguuacaaacaaggcauuauuauccggaagggaagggacuguagaauuuccauuggcuggggaacaacccagcuuuagcuuuuccagauacucugcauguacagguuuaugacacuggagaacuuugauagcaucuucuacuuugaaccacucucucuuccuuccuagagaaaagaaugacauugguuacaagacaguccauuuuaaaaaguaagccauauaaguaauguccacuuacuccccgauaaaugacuuagacaacaauauguuggggaauaauuaagaugaauaugcaucucuacauuugaauuaucuucccugcucuaaaugaaaagugaccaaaaaaaaaaaaaucuaggauggaaacuggacacaggaauauaagcaaagaguauucagauaacaaaagggaacuuaccuauauuaacagaaucuucccaaucuucuguuagaacagaguauucagauaacaaaagggaacuuaccaauauuaacagaaucuucccaaucuucuaauauuucagugacuguuagaacauaaacauauguucugugcuuucggucuugguucugcuugaauauaaaaagaaaugcauuuuaaucuacaggagcuagccauggacacauuuuccaagggaaaaaaauuagucuggcauacugcugauuagcauagcguauuucccagcacaggcaaguauauucaguuguacaguccaacacaaaagugacuuuauauaagacaaaacauuuaaaaguuaaacagaagacuagaacuagagcuucaucauuacugguggugaaauuggcucucaauacuacuuuuuuuguagaagucuggagauguugcccaggcugguccacuccugcccucaagggaaccuccugcuuuggccuucccaaaaacugagcuuacagguaugaggacccagccuccaguacuaaacuuuaaacacuuauuucuauauaucugauguucuuuucuuuuuuuuuuuuuuuuuuuuugagacagggagucucgcuuuguugcccaggaguacaguggcgugaucucagcucccccacaaucucugccucccagguucaagugauucuccugccucagccucccgaguagcuggaauuacaggugcacgccaccacgccuggcuaauuuuuguauuuuuaguacagacgggguuucaccauguuggucaggauggucuuaaacccugaccucaugauccacccaccucggccucccaaagugcugggauuacaggugugagccaccuuaccuggccuaucugauguuauuuucauaaagaaaaucuuaagaguugaaugcaaucuuauuaaaauaauagaccugcauucccauaguuuuuauccuauccccucuucccuggggcuaauccugacaaccuuucaaugacauggaaaacugcuuccuuuaggaccuuuguaagagcaaacagcaccaguuccuuuaagcacuccuccugcaggccuaucaaggugcacauaaagaauagcccauggccuggagcagaagcucacgucuguaaucccaguacuuugggaggccaaggcgggcagaucacuugaggucaggaguucgagcccagccuguccaacauggugaaaccccgucucuacuaaaaauacgaaaauauuagccgggcgugguuguaugccuguaauucagcuacuugggaggcugaagugaaggaucgcuugagcccaggaggcggacguggcgaugagcccagaucaugccacugcacuaaagccuggaugacagaaugauaccccaucuaaaaaaaaaaaacauaaauuaaauaaaacaggcaacugagcuuguuucuggguuaaaaauuaaacaaguuggccuuccuucauccugauuaaaguuagccuucuuugccauaguccacgacuuuagauaauuguccugauuuuggccacaaacaaccugaaaaaucuacucaaaacaguggguuuuuacagcugggaaggauuaucuuuuuauaucugagaaggaauaaaaacaacaauaaauuagaggcaacugucaauuaacacaucauucauuauuuuuaagaaucaguuguuuuauuucuaugucucacaaaucaguacauuuauuaugcuauauucacaaauucacaaaaaucacugggaugaaugggcagggcaauccaauuuucccuuauauuuucuaaggggaaagguauuuuuugauugacgugugcuguuaaacaguauuuguaaagcacuuaauacuguuaccuucccauauuauuuaagcuuuauuuauaaugugagacauuuucuucaaacaccuugucagcauauugacaaauguguuauuuguaaaaaccucaguauguuuuucaguuuaaccaggagauggugcuauuuaacugggugaagcaacugcugaauucuggaaaagacugaauucuacuugaacgacuuuucucuuuguuuuuugagauggagugccgcucugcaaccuccaccucccggguucaagccauucugccucagccucccaaguagcugggacuacaggcgugcgucaccaugcccggcuaauuuuuguauuuuuaguagagacaggguuucaccauauuggccaagcuggucuugaauuccugaccuagugauccuccugccuuggccaacccaaaguucugggauuacaggcaugagccaccacgcccggccaacuuuacucuuaauuacuguauuccgguaaaagucaucaucaauucuaccaagugcuacaaaaucgggauuuuuucugaauuccuaaggcuuaaaaauaaaauuuauaugguucuacuauaaaggcuguacuaaccuauaaacagcacccugaaaaaaggaaagugaccauguuucugguauacuguguaucuaggucugaaucuuggaugaagauacaucuggaccuccuuucucccuggcuuccagagacugccuaucacauucaaauucccucccugaaaauucuauucugccuucaguaauaagagaauauaugaaagagaauucuauucuuuuagcaucuguucuauguaccugagauuuauaucuucguacaauccuuuaagucacuagguguaucauauaauauuugcuaagggcaauggggacauuuccagauaaaacacaugagaccuaagcucuuaggucauacuaaaaauauuguaccuccuaaaagaucuauacccuaaacagucuacaguggauuaagauaaacauuucaguaucagcuccacuguauuuucaaacagaaguaaucacuaccauaauaaugcuauauaaaagugauggcagccgggcacaguggcucacgccuguaaucccagcacuuugggaggccgaggugggcggaucacuaggucaagagauggagaccauccuggccaacauggugaaaccccaucucuauuaaaaauacaaaacuuagcugggcgugguggcgcgugccuguagucccaacuacuugggaggacgaggcaggagaauugcuugaaucugggaggcagagguuguaguaagccaagauugcaccacugaacuccagccuggcgacagagcgagacucugucuuaaaaaaaauuaauuaaaaauaaauaaauaaaagugguggcauaugaaaaaguggcuuuuacuucccucccuaccuaauccuggacugacugccuacugcuagucugagagaaaugucugguucaggcugcugccacauuauuugguugguuaggaagaaaucauuaauucuauuaucagcaaagugaagauuacuuuuuaacucaccucaaauaugcccagaagucugccuaguuuuccuuugacuccagccuauuaaaaaaagaugaaauauaaaauguuuaccuuuuuauaacaaaauguauauaaauacaaguuacacucuggcuauuuacuuaaaucuaauuaaauacaauaccccuccccauaccaacucacuaucuuccugcuucugugaaguuuuuauugucauuuacuucaucagcggcaaggacugaucaaaaauuaguauuucuggcugggcgcuguggcucaugucuguaaucccagcacuuugggaggccgaggcagaaggaucacuugaggucaggaguucgagaccagccuggccaacauggugaaacccugucccuacuaaaaauacaaaaauuaaggccagguguaguggcucacgccuguaaucccagcacuuugggaggcugaggcuggcggaucaccugaggucagggguuugagaccagucuggccaacauggugaaacccugucucuacuaaaaauacaaaaauuagccagacgcgguggcacgugccuguaaucccagcuacucgggaggcugaagcuggagaaucacuugaaccugggaggcggagguggcagugagccaagaucgcuccacuguacuccaggccuggcaacagagcgagacuccaucucaaaaaauaaaaaaaaaaauuaaaauuaaaaauaaaguugcaucaggcaaaaagcacuccuggacccgucucgcugucuuaguguuauguagcaaagggccuuguuuuuaaaacuccgaaacagaauuugugugaaagaacaucucaccuccucauaaacuucccucacggcagcaccgccagguuccuccucggguuccauuccuccuccugggacaauccacuggucuggguaccggcugcuacucaccagcagcaccuguaaggugaaccauaacuguauacuuccagccugagaagcacuucguauauaaacaacauucucaaaccucugcaagguuauaacucuauucuagauuaaaauauuuuaaaauuuaauuaaaauuaggggguacgcauuacaccacaaaaaugcaauugacaaccuuuguuaaacaccaucuuucugaaaucagaauuaacauuaacauggucacacuaccaaaucaccuuaucuaaugaaauaaacuacuggugguaaaacucucaaauuauuggauaauaacaaaggauaaaaacagaaacuuggcugggcgcgguggcucacgccuguaaucccagcacucugggaggccgaggcgggcggaucaagaggucaggagaucgagaucauccuggcuaacauggugaaaccccaaaccccgucucuacuaaaaaaauuagccaggcaugguggcgggcgccuauagucccagcuacuugggaggcugaagcaggagaaucgcuugaacccaggagguggagguugcaaugaacugagaucgugccaccauacuccagcaugggugacagagacuccaucucaaaaaaacaaaaaacagaaacuuggcuuauuagccagaguuguaugcacugaggucuauggucacauaaguuuauuuaguuauggaauauuccaaauuuaaggaaaugaccauagguagguuaccuuguuuccucaccuaaaaaauaagaauacuaagaagauaacagaugugugagaaagaaauagggaaaugcacauaaagacgauucuugauacagagugcuuguuacuguuaugauuagguggcaagaagcauccuucacauuuuaaaccugcauacauaggcaaaagucacuucauucuucuaacaggcagcuaucauuuaugaucuagaacaggacuggcagucugcagcucaccaccuguacagucugugagccagaaguauuuuuacauuuuaaaauuaugugaaauucaaauuucaguguccacagauggaauuauuagaaucgagucacuuacucauuuuuacauauugucugguuguuuuaaugaugcaacagcagagucaaagcaguugugacagagacuguguggcccucaaaacuuaaaauguuugucuggcccuuaauuuggaagucuauggaccccuuaccaagaauagcauuaagauugaaauguggccgggcgugguggcucacaucuauaaucccagcacuuuaggaggccgaggugggcgaucaccugaggucaggaguuccacaccagccuggacaaaacauggugaaaccccgucuuuacuaaaaauacaaaaauuagccaggugugguggugcaugccuguaaucccagcuaaucgggagacugaggcaugagaaucacuugaaccugggaggcggagguugcagugagcagugagcagagauugcaccacugcacuccagccugggcaacagagcaagacuccaucucggggaaaaaaaaaaaaaaaaaagacugaaaucuacaaauuguuacaaaaauacccuauuaccuuagacaaguauccuagauuuuauuuaacagguaacagguauuacauacccaucuuuuaaaugaauaucuggccgggcgcaguggcucaugccuguaauccuagcacuuugggaggcugaggugggcagaucaccugaggucaggaguuccacaccagccuggacaaaacauggugaaaccccgucuuuacuaaaaauacaaaaauuagccaggugugguggugcaugccuguaaucccagcuaaucgggagacugaggcaugagaaucacuugaaccugggaggcggagguugcagugagcagugagcagagauugcaccacugcacuccagccugggcaacagagcaagacuccaucucgggggaaaaaaaaaaaaaaaaaagacugaaaucuacaaauuguuacaaaaauacccuauuaccuuagacaaguauccuagauuuuauuuaacagguaacagguauuacauacccaucuuuuaaaugaauaucuggccgggcgcaguggcucaugccuguaauccuagcacuuugggaggcugaggugggcagaucaccugaggucaggaguucaagaccagccuggccaacauggugaaaccccaucucuacuaaaaauacaaaaaauuagccgggcgugguggaaggcaccuguaaucccagcuacuuaggaggcuguggcaggagaaucacuugaaccugggaggcggagguugcagugagccgagaucaugccacuacacuccagccugggcaacagagcuagauucugucucaaaaaaaggaaaaaaaaaagggggggggggaaacaaaggaauauuugugggcuagcuuagguugaacuucacuuaaguuaaaaucaacucaaggugagcgugguggcucaugccuauaaucccagcacuuugggaggcugaaguggguggacaucugaggucagggguucaagaccaaccuggccaacauggugaaacccuaucucuacuaaaaauacaaaaauuagcugggugugguagcacauuccuguagucccagcuacucaggaggcugaggcacaagaauugcuugaauucaggaagcgaagguugcagugagccgagacugcaccacugcacuucagccugggcaauggagugagacucugucucaaaaaaauaaaaaauaaaaauaaauaagucaauuugaacaaaaguguccacaaaauuaucuuaguauacuaccuucaaguaaauuuaaacaguucucccucgaaaacacauaggguuuaucacgaaguuuaauucccagugugcauagagaugaugaugauaacuaagacagggucucacuuggacauccacguuggagugcagugacacaaucucugcugacugcagccuucacuucccgggcucaagugauccucucacuccagcuucccgagcaguugggaguacaggcacccaccaccaggccuggcuaauuuuuguacuuuuuuuuuuuuuugaaauggagucucguccuaucauccaggcuggagggcaguggcauggucuuggcucacagcaaccucugccucccggguucaagugauucucccaccucagccuccaaaguagcugggauuacaggcaccucccaccaagaccagcuaauuuuuguauuuugaguagagaugggguuucgccacguuggccagacugaucucaaacuccugacuucaagugaucugccugccuuggccucccaaagugcugggauuacaggaguaagccaccaugcccagucugauuuucguauuauuuuguagagguggggucuugccauguugccuagacaggucucaaaaccaugggcucaagugaucuucucaccuuggccucccaacugggauuacaggcaagagccaugacugauuuuuuuuucuuuuaaaugcaugccagcacuucuaucugcccugcucccucccugcugccaggagcugcuggccuuuaagaguucucagccagcacaggaguccucucucauuugacuaaguuaccaggaacuuuuccaaacuggaaaguuucaagcugacaauucagcaacucccacccuucucucaagcccccaaaaugcugaguuaaaagagaguaucuauuuaggcauagaaccuccucuuagaaaagcagcauuccaggccaggcaugguggcucacgccuguaaucccaucccagcacuuugggaggccaaggcgggcaggugugagaacagccugggcaacacagcaaaacucccucuacaaaaaaauacagaaaucagccaugcauggugacaugugcccauaauaccagcuacucaggaggcugugguggaagggaucaccugagcccaggaggucgagguuacagugagcugugaucaugccacugcacuccagccugggcgacagaaugagacugucucaaaaaaagggaggggggguuauuacauuaucaaauuauacccagaugagacuuuauagaaaauuagaaaaagaaaauuaaaaauccaaaagugcaugcaagggucucuaaguucaaauucuacuuucaacagagaaacuacaaaucagauuucaaaaccuuuguauuuuauucaaaauuggaggcuuacagaggaucuauggcaaccaaaggcacuggcccucuaucaagacuggcaagugaauguuaguuuuuaaguuaaauaaaaauguuaagaguuugucucgcaucacuggaaaaguaaacagcaacuacugguccggacugcagaguuacaggccucuuuuucuggucacuagguuuggguuaggaauaaacugguuucuauugccuagaugaaauucuuguuacacaauucuaugcucucuaagcaacuuccuggauuacguuaauaaugggacauaacgcagguggcuagccgccugaaaaguacaucaucacuuaguaaauaguaaauagggaguucaaaaucauccauauucaaaauguugcaguccugaauaaaugaaaugcaaagucucauguaucuaggucauugacuaugauguuuccaguucuccaagacagagcuaaauuacaggagauuaauaauguugaaaaaccauuaguauaagaugugucugcuuuucugaagaaacauuuuaugcuucagauuuuuuuuuuuuugagacagagucucgcucugucauucagacuugagucuaguggugcaaucucggcucacugcaaccuccgccuccuugguucaagcaauucccucccucagccucccgaguagcugggauuacaggcucccaccaccaugcccagcucauuuugguacuuuuaguagagaugggguuucaccaucuuggccaggcuggucuugaacuccugaccucgugauccaccugccucggccucccaaagugcugggguuacaggugucagccaccgcgcccggucuaugcuucagauuuaaaaccaauccugcaucuacaagacaucagcaugacuaaacuuuucuuccaaaaaugaguaauauggaacccuugugucucaacaucucucuuucauaaauuacuuuuuagaaagccucaugaaaauaguauauaaauuugauaagugauuuagcacaauccaguaauuuaugauauaagaaucucggcucacugcaaccuccgccuccccgguucaagcgauucuccugccucagccucccaaguagcugggauuacagacaugcgccaccacgcccagcuaauuuuguauuuuuaguagagacgggguuucuccaugcuggucaggcuggucuugaacuccagaccucaggugaucugcccgccucagccucucaaacugcugggauuacaggcaugagccaccacacccagccaaauguaucuuucaaaaaaaaggccgauaaauuuaaaugaguaauuaucuaugguccagaaaugauucacaucuaaacuacuagcuuaaggcagaugugcuaauauccaacuuuuggugaugguaguuuuaaaauccagcauguuucauuaagcacuugucuacucaucuaaauugacaaaccugcagauagaauugggcuccucugggcccuugaucugccaauuaauuccagucuguccuaaacucugcuacuuuugaaccuuucaugcuuuugagggucuacagcuaacacagucaccacuagcaucauauggcuaaauuuaagauuaaauaaaauuuaaaauucaauuccuuaguccagucauauuucaagugcucaucucaagggucacauauuggacaucuacagccaauuaaugguauauccuuuucagaacagguaaaauauguaacuguuaguuauuuauccacuuaaauuuucaugcaaaaccuuaccacuuuaaaaugcuuuucgaaagaaaaucagaaucaugaaaaugggcuagcaggaaagaagcaucaugcacaugguauccaaacuaaauccauucacuuuugucuuuacaaucuucagccucuagaaggacagagaacagacugacuccugucaaaaagugacaauucagcacaaguucuccaccuuaaagagaagcacuguggagaaagaaguugcugauuuuguuccuuaucuacuaauugugugauacucaacaagaauuguaugugaugaaaagauacugaauauacaucuuucccucaaagagcuuauauucuuggaggugggguuggaauacagucacauagaaugcucaauauuuugugucuaaaaacugcaagaacacauacaucuauauaaaucuauaucauuauaaauuguggacaaacgauuuagccuaauccaguaacuuaucauccaagagucccuugacaucucaggaagaauaaauuuggucagaccaauaacuucaaauuaucuuuccauaaaaugaucgcuuuaaauggguacuuaauaucugugauauagaaaugacuggccaucuaaacaacuagcuuaugaaaagaggucucacacagaugucauggugacagauuugaaagucugucuguuucauuaaguacuugccuacucaucuugaauaguucauuugaguguucaaaugagggcaaggccacaucuggggggguggugguggggagaaggcagugacuaagagugagcaagaacugagggauacacuccagauaagagaauagacuggaugauggcguaugucugccaggguggaaaaauaugaacagcauuaguagagagaaggacaauuaaaacaguccccugccugcccccaaccccaauaacagugaaaagucuuuuaacuuaaggccaacuagugugauagcuaggccauccugugaucaccuggggucugucaugcacuuggaagcgguccccagcacuagaucuagaccaguacagaugaaaaaaaguugguaucacauuggagcauguuuauauuuuaauuaggcagacaacagaggacacuaacaacuuuuuaggcaagggguugagauuaagaugaaaacauaacucaguguuuccuaagaaccgccacaccugcucuauuguucagugcuauaugaccauuucucuuuccagaaaaacauuucaccaaguuaaaaagccugagauuauaaaagagaaacuggggaugguggugaggaguugcaccguaguggaguacugucacuccagaacuaucaggaacucaagaauuacagcuuuucuguugaauucacuuggaaucuguugaaaaugaaaaucaucaauguagauuuuucuggacuacauuuuuauggaacuacuaaagcaauucagcuugaaaaaacacguuuuguaaagagcaugcaaauaaaacagucuagccgggugcaguggcucauaccuguaaucccagcacuuugggaggccgaggcaggaggaucacuugaggucaggaguucaagaccagccuggccaacauggugaaaccucaucucuaccaaaaacauaaaaaguagcugggcaugguggugcacgccuguaaucccagcuacucgggaggcugaggcaggagaaucacuugaauccaggaggcgguuugcagugagcugagauagcgcaacugcauuccagccugggcaacacagugagacugucucaaaaauaauaauaauaaaaaaaaaucagaguucauucaguauuguuuuccagaggccaaaauuaauaagaagguguacuuucauuaucaaagauuuagcuauguucuuccaguuaagaguuuuccaaccuagacaaaagauuugacauaucugcuaauacaaauuuuaaguguuccacaaaaauuugagaaugaugaaaauaucuaguauagucaauaauggaaauuuuguuucuuacauaaauuuuggagauacuaguucugagcaguccguguuuuuacuaguuacauacucacauuuuucagcuucauuauaucuuuucuacuaaaacucugugggaaaacucaacuauuaauagcuucuuuuuuuuuuuugaaacagggucucacucugucacccagguuggagugcaauggcgugaucucggcucacugcaaccuuugccuccuggguucaagcaauucucgugcguaagccuccugaguagcugggauuacagguacacaccaccaugcucggcucauuuuuuuuguauuuuuaguggagacugaguuucaccauguuggccaggcugguuuugaacuccugaccucaaaugauccacccaccucggccucccaaagugcugagauuacaggugugagccacugugcccagccugaacuauuaauaucuucuauaggccaggcacaauggcucacacccguaaucccggugcuuugggaagccaaggcaggcggacugagucuaggagcucaagaccagccuaggcaacauaggaagacccugucucuacaaaaaacucaauaaauuagccaggcaugguggcauguaccuguaguccaagcuacucggggggcugaggugggagaaucaucugagccugggaagucaaggcugcagugagccaugauugugccacugcacuccagccuggcuaacagaagugagauucuaucucaaaaagaaaaaaaaaauuauguauauauauauauauauauauauauauauaaaaagauuuacuauauauauauauauaaaaucuauacaugcagaaaucuaaaaucaaauuucagcacaauuuauuguaagguuuuuuuuuggcuuguuuugggggcgccauuugcugaaucauagcaacauaaccauaaugguugcuuuucuugcaauaauauugauuucaaauaauaggcagcugcuccuaagccccuccuacaaaaguggaagaaucucaaucucuagaacccuaucacaaugcauuauucuucaacacucacucuaaacgcacacaacagccaucuacacauuucuaucacacccccaaagcuacuaguauaguuagcaugcuaauuaaugcucuaaagauggguuauaaaagcucauucuacaaagacacaccaacaguugacagagccacacauggucauucauagguuugaaauucccuucucugaguagacuagauuuucuguauccaucaagauacuggucuguuacauuagcgaugacagagaugaaggaagaugcauucaaccuuccagauaaaucagagcugugacuauaugaaagauuuacgaaaaggaggcuacucauucuaccagguugcagagccagaccuggagcacacucagaccccaaagccaacgcuauuaguguggugaaaagugaagacaucucuuccuacucuauucaaccuaucuucgcauaagcauucuuucuuccuacuacucuacuaaaucuuacucccucuucccauguauuagauaauuaccagaaaaaaacaccacucaccuggcacugcugaagaguuauuuugucuuuuccuagauaccuaagguuuuaagcauuuggagaaaagcauuuaucacuuuaagaauaguguauuggccggccaugguggcucacgccuguaaucccagcacuuugggaggccgaggucaggaguaagagaccagcuuggccaacauggugacuaaaaauacaaaacuuaacuaaaauuuaaauacaaaauucaacuaaaaauacaaaaauuagccaggcgugauggcaugugccuguaaucccagcuacuuggaaggcugaggcaggagaauggcuugaaccugggaggcggagguugcagugagcugaggucacgccucugcacuccagccugggugacagagugagacucuuaaaaaaaaaagaauaguguauugacaguagucaacaggaaaccaacccuaaaucuuauuggauaaaagucuaugaauuagaaugaucuauugcaagccugcucaaccuguggcccguggacugcaugcaguccaagaugguuuugaaugcagccaaacacaaauuuguaaacuuucuuaaaauauuauaaaauauuuuugcaauuauuacuuuuuuagcuuaccagcuaucauuaauguuaguguauuuuauguguggcccaagacaauucuuccaaugaggcccagugaagcuaaaagaucggacaccccaggccaggcacgguggcucacgccuguaaucccagcacuuugagaggcugaggugggcagaucacgaggucaggagaucaagaccauccuggccaacauagugaaacgccgucucuacuaaaaauacaaaaaauuagcugggcgugguagcacacgccuguagucucagcuacucgggaggcugaggcaggagaaucgcuugaauccaggaggcagaguuugcagugagcugagauugcaccacugcacuccagccuggugacagagcgagaaaaaaaaaaaagcuugggcaccccugaucuauuuuauagaaucuauacccuuuaucaccugacggguccuccucgcuggugauguauaaaagggugcuguucaagggcuauguaaugcauuuaugccuucagaggcuguagguccuugggccucgaauucccauuuguguuucagcuuuuacccuuaaagaugcaauugucauggcuuggcucuaggaacuccaaccacuauagauaccacuucuguucccgggaaggggagcggaggagccauccagagaaccucaagugaccccuaagaaugaagagguuuauuaugaaaauuguagcuauucagaaacuguuuguuguuguugcuguuucugagacgcugucucgcucugucgcccaggcuggagugcaguggcgcaaucucagcucacugaaagccccgccuccuggguucaagggauucuccuaccucagccuccggaguagccagcacuacaggcacacaccaccacgccuggcuaauuauuguauuuuuaguagagacgagguuuugccauguugcccaggcuggucuugaaccccugaccucaggugauccacccaccuuggccucccaaagggcugggauuacaggcgugagccacugcaccuggccuacucagaaacuguuucgagguugcuauucuuucuuuccaaauuaucauaaaucaggguaucaugaaugguugaaacuacguuaaccuaauucuacuacacuuaaccaaaauuuagccaaaauuaggccagccguguuauuagaaacacccacuaugcacauagacauuuuaaaagaacauagguuaugaaaaugguuugauacaugcuaaacagcuaccuacuauuaagaaaauuaguacuucuuuuuggaccagaggcagaguagaccagaaauaacaguucuuucuucuaaacuauguuuagcuccaacuuauaugggauugguagauaaguauuaucaauaauguuguaaaucagguugaccauggauuuuuuaccuagcaggucaauguuuuaaagugacgggguauaagcuuuuuuucaauuagagaaaagcuugagcuauaccaagacccuaagaaaaaaaaaaaaaauccaaugcaaauucuacguuaaugccugguuuaaugacgggaaaccuucugggagagcuggaggcacagaugaagaaguuggugacacuucccuguguuuaaaaaaggcuuccaagccgggugcaguggcucaugccuguaaucccagcacuuugggaggcugagguggguaaaucacaaggucaggagaucaagaccauccuggcuaacacagugaaaccccuucucuacuaaaaauacaaaaaauuagccagguaugguggcggcugccuguagucccagcuacuugagaauggcgugaaccuggaaggcggagcuugcaguaagcugacaucgcgccacugcacuccagccuggaggacagagcgagacucugucucaaaaaaaaaaaaaaaaaaaaggcuaccuuuggauaguacuuauuuuugaugaaaguggucuccauuugaaagaaauaccuucaaggacuuaacucugaagaacuaugagccccagaguaugugugaaaaggguggacugacuguugauucuaaguauaaaaaugcuaguugagauuuaacucuaguaauauuuugaauuaguauuguugcucaucggagcucugguuuuagguuuucagacuugaccuuucccaccaaagcuuuacugcaugauuuuguacagcucaagauuuuucaggaauauauauucagcauuauagcagaccaucuguagaagacagccccuggcucauagagcuuaaaagcuaauuagggcagcaaguccuauggaagaguagugguuuuuuuuguuguuuuuuuuuuuuuuuuugcaggcagggucuugcucuguugcccaggcuggagugcaauggcaugaucucggcucacugcagccuccaccucccagguucaagggauucucaugccucagccuccugaguagcugggauuacaggcacaugccaccacgcccggcugcuuuuuguauuuuguauuuuugguagagacaggguuucgccauguuggccaggcuggucucaaacacuugacuucaggugaucugcccaccuccgccucccaaagugcugggaugacaggcaugagccaccugccuggccuguagugguuaguccuucagacugauuuguuaaugccucucuugcaacuaugucuggauuucacacaggaucaagucauucuacuucuccccuuagcagucuaaaccuauuuugcugccagaucacucucaagcuugaacacaucuacuaucucaauguucuuuguucaaaacuaaguucaaaacaaaacuuuguucuugcguagcaacuucucaaccuuacauuugaaguguugcaaauuuuucaacuauuacugauucuaugcuaucccuaagcugcagccaaaucuaucacagccccaagucuugcucuauuugggacgccuggucccuccucucccagucacccacauccaacuccaaaugacucacauuggaucugaaccccagaauacccgaccgcacuuuucccuuacuuuauuucccuuuccauugaucccuuguccaaccuuucccuacagaaugauucuuaggagcuaagaccucaucucuucauccccuuuuaaacuaucauauaugcaaauacauucaacagaauccauuucugauuaccuauuuguaaaagcauugucaucuuucacuguacaagcacaguacccagcuacucuacagggcaauuagcugugggccugucuagaagcccagcggccaaaacugagggugcuuccccacagaaauaacuagcuggggagguaggucaaauaaacaaaacauuuagaaacaaaggaccagagcucaaaaggaucugccagcuucugugaccuugggauagguuacuucugcuaccuaauuucuuccuaaacaaauacuaauacuuauuuacccuacagaacagaaaaagauaaaauggaaaauauuuaauauauaaagccaccuuaaaagaauaacucugcucuuagaacaaccuucuuuccuagaacaaucuguuuuaaaguagaaacuuacugagaacuucaguacaggaacagccagaugggagcgccacguagcuuuuuuggggucaaauugcaauuacucuuuuacuuccauuuguacucuauauaaacauuucauccucaaacaaaacauacauuuaaaucuucuaaccaggaucuagguguuuuucauccaguagagggaaacauuucucaccuauuaacuagagaggugggcucaagcugguuuucuagacuguccugggaagucuggcaaugcaauuucaacagagugaaggcaaauucauagagaaacaauagaaucuccaggaaagcuaacagaguuuauucuguaauaaucauguaauagauaaagccucaacuacacacaaucacagaaaugaaaauucugaagagcuaaaccagauguuaaaauuggcugugcauuucacuuaaggagaauucuagagucuucccucagaucauauccucuaacaagaugacucacucucuucaauucucaaccuacagguuaucagauuuacaaaguuuuauacaauggauuuuucuaauacauucuccaaaacuugcucccuacuucaccuuaccuaaugacacgggucucuugacucaacuagaggcuaugaauuuaguauuuauuucaguagaaauaauauccaagcauaaaaauaaucauuuauuuuuauugcuaaaguaauuccuaaagcuucuaucagucuuugcuuuaccauaagcacaauagagaucaucauuucaauuuccaucacucauauuuuccccuagagucuaguauuuuuacaaagccugaauuccaaguucacauuauggcaacacuucagucaccacuuucagauaggcuuccaaacuuagccucacaaaaaucucacucacucaacaaacagagcccaacaucaggaguaaggacuggacccugaauccugacucuaccacuuccuaauugugucauuugggaagguacuuaugcucugcaacugucuccucaccuauaaaaugggaguaacuucacuaccucccaguguuaaaaggauuaaauguauaacaaguuuucuucuggcagcgccuggcacauuguaagcacucaauuaagaauaucauuacacaauauugaggaaaccagacaagauccuugaucuaucuugaucccuuuuggcuaucauuucuuuuauauuuaaaguuuacuacuuugccucaacauggccccuuuccgcuaaggcuuuaucuuuuuuacagaacacacuuaaugcuuguugacuuguucauuuuguaaaaguuaauaaccuuucccuuugcaguuucuagcucuccuaagcagacccaucucaaaggcuggggccguauuucucugcacacucguuugggauucaagucuaauacguaaagguuaugagugagcacagagcaacccauuuaaagggcuugguuucuuuucaaaaaaaaauaaaggcaaaacaaggguuugaagggcaaauuucgagaacuuuucguuaacauaacaagaacuaagccacugaguguauucugugucauauucaucacaacuacagggacuagcaguaaggaagccauuaaauucccaucuccagccuuagccuaguauuuuauacacgguugguuaugaaagcagaacucagaauguuaauuuuuuucaccuauguaauuuaucuuaagaguggcaauaccaaaaggcuacuauugcccuaagcaaacuucaacaguuagccauuuuaaauaaauacuacugaauuaaguaaaaaucgcucuccagggaaaccccaagggucucauucucagcccaaugcagauggguaaauuauccaagaacgacugcucugagaacgagaaaggcuacuccuuuccagaugucaagccagacagcaaagaacccuuuauacauaagcugagagcuggagauuacugucugaaaauggcagcuuugcccaucucuaguccaucgucucccuuuuggcauuauuccacauuuuucacuaaccauuuuucugcagucagaaaacuuuaagaagggaaggccguuuuaaaaaugaggcauaauuaugccaacagcuugcggguucauggacccacaagaauugccaagacuagacucaauuccaagcacgaggacugucuguuacuccacaaacaugcuuagaucgaauccgagaccgcaaacggcuguaacauggaaggaaaauauguaaaagaggcacaagggcucugcugcaacacucacgccauuuccacccuccucucgcugagcacucgagguuuauccggcuuucaacucaauucgcacguuaagauggugacucccgcuaggcgagacuuacgcggcccgggaccuucccggggaccaggcgccuucucgagugcccagauggagaaacuggggcugggcgagcccccuuugucucaucuaucagcccagagaaaggaaggaagaagugagggaggaaaggagugagggaggaaaggagggagggaggaagggggcuaaucccucccagccccgcagccugcgcaggggcggggagcgaggggaagcacccgggcccuagaccccggcgccccggagggcagcgugcggcgccgggcgcccuaccucguccuccugcucgcuccggaagcacaggcacgccgcccgcuucuugaagcccucgcggucguagguccgcgucugguugggcuugaacuucaucauagaggcgggcuccugcugcugcugcugcugcuccggccgccgccgugggggcccggccgccgccaccccgccggggagugggggcgagggcgagucgggcgcaggagcgcccgggagcgcuagucggugcgggaggugcggcgaggccggucagucccggggccggcggccgcuccgacgcgggcgggacgggacgcuagcgcgggucacuggaaccagggugccgagaugaaagcuccgccucugcccaguuguccgccgcucuccauggagcccgacucccgcucgccuccgcucccuccggccguagccgccaggggaagggcggcuagaggcgcgcgccacgcggagacaguugcgaagacccgcucccacugagcagcagcaccgcggcgacc

SEQ ID NO: 192189 - RNA, 37772 nt, Homo sapiens
gaaucuacaauaagacaaauuucaaaucaaguugcuccacuauacugcauaagcaguuuagaaucuuaagcagaugcaaaaagaauaaagcaaaugggaggaaaaaaaaggccgauaaaguuucuggcuacaauacaagagacauaucauuaccauaugaucuaaugugggugucagccggauuguguucauugagggaaaccuuauuuuuuaacugugcuauggaguagaagcaggagguuuucaaccuagucacagagcagcaccuacccccuccuccuuuccacaccugcaaacucuuuuacuugggcugaauauuuaguguaauuacaucucagcuuugagggcuccuguggcaaauucccggauuaaaagguaugguuuucaauaauuguccugaacucugcuacagacuaauaaaacuucggucaaguugcgagcaaaagggauuauuuggugagaaaaagaaaaggaaaaaaaaaacuguuaaacuuuuauaguuuuuaugcaacauuuuaaacaaguauuauuugaaaacagaaguuaaauauuugauaaaaugauugaaugcauuguuuuauuucuuucucuucuguuuuugcaaagaugcuucuuaaaaaacuguaaccuaacaccaugacucucuauauuaauguuuuuguguuuguauuaaugaauguuuagcucuucaagagaugguaaccgaaaaguauucugaaguagcauaucuguaauugaccuauauauuuaaaaaauguauuuuucuccugaauuuuugauugcuuuaaggacuuuuaaaagcccagaagaacugaacucuggugauuagcugaaaauaccuaauguauauuucuucaaccccagaaaugaacagaaauuaucaccagagaagugaaaauaaacauugaaaauauuuauguuauuaaaugccuaagauacuaaaaacgcuguauaauuucuuaaauguaaagugucccagucaguaucuucacugcaagugaaauuuuaagauacauucacuauaaaaugaggauguggguuaauuuucuaauuuuaaaacaggguaacacagugaccacugauuaagugggcucccagugauguaaauaccuguggcuuuuuuuuuuccuguugcuguuucuaaccagaaaagagccaaaugccuccuauaguaacccuuguuuguggauaaaugccgccuuuauucuuuauuuuaaaauuacauauauuauaauugaaguuuuuaaucaucuagugcuguaggauuuuaauuuuguuuugcauuuauagcuucacuuaucucuugaggguuaaauuuugacuuugaaagugacaccagaggcauagauaacauaaugcaaauguugaucuggaugacauacuucauuuaaugggcuuaacuaguuuuaggaaccagaaauuauuauuuuugguaaaacauuuguaaacuauggcaacuagcuucaguggaguagugauauuacauuaguaauuagcaucuuggacauugucaugcauuuuuagacuacuuaaaacaguuucaguauaauuuaaacagcauaucaucucaauaacaaucucuuugguuacuacuuggacagcugcucuuugcucuuuauauuucugauuaauuaaggaaagaaggaaaugacgaaaggaauuaucaguauugacagcccacauuaaauguuuuaagaugcugggucuugaaguaccaugacacuaauuuaaaacagaugauuuuauggaagauuuugcacaaaguuucuggacaugcaauuauuuuuucacaguacagucaggguuaaaugcacacacacacauacacucucucucugucacacacacaugaacacacacacauacauucucucucucucacacacacacacacacgagcaaaugaaaaugaaauaaaggucggugauugaaguuauaagcugccugucuauauucagcuucaaucaaaaagaauauuguuuggagaauuuguaccauuuuaacaggaguaaacaaacauaaauuauaauacuauuucucucagcuaauacucaacauuuucuuuuuguggguuguuagugaaacaaccaggcauguucugcucuggagaaaagauuucaaagugacaucugcauuaacugucguugcuauuuauuaaaucugcaaugacuuugcuucauuuuucuuuuaaacuuguaagacauuaaauaugcaaggcuagcaagcuugugguaaaccauaaacauugcauuuuuaaugggaaacagauacaaaaccacucccucagauacaauccaaaggaacaggcugccaaaacaaaagucuucucuuaaagggauacucaguaacugaaugagagugggcugcuagaagaagcuuaauguugaacuuaaaguggcagugugaauaauaaucuuuaugauauuuuguuaaaugaaaagccacaagccuguauucaacaugugcugccuuagacacauaucaguaguaaauauaaacuaagaacaaacauguaagaaacugaaaaacauuuguuucuucucuagagaaucuaggcaaaaauucccagaagauaccuuaagguuagaucauacaaagaucuuucuuuucucuucucuucuuucuuucucucucucucucucuuucuuucacuuucuuccuuucuuucuuuuucucuuucuuucuuuccuuuucuuucuuccuucuuucuuucuuucuuccuuccuucuuucuuucuucuuuuuuuuaauaugcuacaauuggauaaugacucaaaacagcuguaagauucuacuuacgaacguacagcuuuaauauggauucgucuaaguguacaauucaagguagagaugaugggacuaaauaucugcuaugaugggacuaaauaucuacuauguuuuggagauaucagaaugguuucaaugcaauuuaaaaaauauuucaucucccaaaugacuuugcugcuauauaaucaaguacuuuuguuauucagauuuauuacgauuuugucacucagauuuauuuagugcacuucaguugauuuaacaacauagauucgugcuuguggaaugaauggauaaauauggaauacauuuaucaaaacaauacuuguuuuuuuacaaaaugcccuguuagcaaaaugagaucauauauacaucacauaaaaaucagaauuuuccauauguguuuauuagcuuauuaaacauaauguuugagaaacuaggaaauugauuuauuuuuuaaagccgaucuugcuuauaccaaguugagguuuucaaucugcuuuuuuuauaucagaaauucgauacugaaaaaaagcuaauuuuguguuuuaaaaaaucagacugauugcuuggaacaaauggaauaaaucgucuugucaauaaagugauggucaauugagucauuugugugcaaaauauugugcaaggcccggguacagaacaaggaauaauaagacacgcccugaaggaguacaucgucuagugagggacagaccaagcacgcaaaacaaauugcaauauaaugugauaaguucuuuaaaagagguaagagcaacgugcuuugggagcagagaagagggagaaagcagcaucuugccuggaugagccaggggacacagaagagaagcccacuaucucauuuaaucuuuacaacucucuugcaaggucgguauucuacauggcaaguagcuuugauugucaggguucaggugaggacugggaauggagugacaaugaaaaggaauguggcuagagcuauuaauucauaccaauuuaugaguggucugacauacagcacagggacuguggacaguauugauaagccauaggaaguuaauaaaugguuuauaguagaaauuaauaagacaaaauugaauuuuuagacgaugacucaggcagcaaaauggaagauggacugaaauagaggaaauaugcaaggcagagaugaauuagaagcucuuguaguaguuuagggagagaugagaagggccuggaucaaaauaauugugguaggauggagagaugugacuggcuuccagagauauuucugaagcagaaauuggagaucuccuauguggauagagauaauuuuaucugaccauguguuaagugagcauugaaaagcccaacaugauuuauuaccaugacaauuuugcaaaugauuuggauauauaguauaucaucuuaguuuagacccaaaauucaaacaagcagauuuaaauaauacucagauuucucauccuaaguaaauagcugugcaaaugauacuauaauguaccugauugucuuucaauacauuuuuaaugcucugcuuccugauaacaaaugaaauauuauuuugcaucuuuucucugugcucacuguauuguggcauauuauauaagaaacgacacacagauuaggcagugcuacucuucuuaaaucucucauuuguuuccuagguucccugguugugaaaauacaugagauaaaucaugaaggccacuaucauccuccuucugcuugcacaaguuuccugggcuggaccguuucaacagagaggcuuauuugacuuuaugcuagaagaugaggcuucugggauaggcccagaaguuccugaugaccgcgacuucgagcccucccuaggcccagugugccccuuccgcugucaaugccaucuucgagugguccaguguucugauuugggugagugggaugcaguuucucuuuaccuaccuuacuuguuuuauucuugggaauggcaacucugagaguuuagcauuuucaguuuuaaucucucuaaauuugagagacagugccaccuaaugaggaguaaaggaagcagaacaggauagaaagaaaaguagcguuguuguucucucuuucucucucucucucccucucugucccucuuccuuuuuuccuccauuacuuugcaaucuuggacaaaucauuuuuaaaaauauuucugagcuuuauaucccuucuucuacaaaauaaaauuuugaauuaaaaaagucuuauguucuaaaauuucagaguaaugguuuaaucuuaauucuauaauaugcuuuuauaaaauauuagauauuaagaaaaucaggucagucucucuacuauucacuuagcccagacaacagaguuucaacauuacuaaauuguaaaauaaucaguuaucaaaagcaaaacacaucaaauuuuaugacaaaaucuuaucuuucaaguaucaaaauacucccuuaaucucugagucuuaguuuugucuuuacuuuugacauuuuguaauccagcugcuuauauucuuuagaaaguuucaaaggaaauauuuaucacuaagguaugguguaaauauucaauauaauuguguuacauauaucuuuagccuaacacccuaaagacaguuugauuuaucaucuuuucagaaaaauuuggucuggaaauuccaagagcauuacacuuagaagauaaaucuccagaaagauugaagcucaguggaugggccaaaggggaaugaacucaguuuacauggcagcucauucacauuccuccuuuugaagggguguauuuucuuacuggagaugaaaagaaaaaaaaaucuuuauaucaugauuccgccauguguacuuccuucuggaagaaauuccauacuaugaucaggcacuucuuucagaaguccuauauuuacucagaacaugcuuucuagcaguaguuugcagaagaaaaaugcaacuucuacaauuggaauaaacugccuauaggaacccagaaaaaauauaaaguauauucaguaguaacgacugaaaaacacuugaaauagcuucuucaacacauauauuguauagcuauuuaaaacccaaauacaaauguuauaugaagacuuucaaaaggccgcaggauaauuccaauggaucuauuuguucagucauucagaagcuauaucgggaacccaucauggaugagcucugcucuaggcauggggagaaaggaugaggaagacaaauauggcccuaguucuuguggaucuuauguucuagugguggugacuauuacuuuuugaauuguguauuugccacaggggagauuggauuacucuucagaaauuuuauaagcaucuagagaugaccugcauuauugccuugggcaggaaaauaacaggguugaaaaaaaucugaacaaagaaaucaccauuugauggauauacacaggauaaucuuuucugaaguuacuaaaauggcgaaguucccaaaaaauguaaugcgaauuaaauuucacuuugccucugagaaaaaguuaaaagaauuuauuauuacucucgcuacauguauuaucaaaaaugaaggguugauauuuuuaaggaaagaagaguuggccagucacuuuagugaaguuuuauuuuuucguaaauauaguuugccuuugcuuccaugaaaaaauagcucauaaaccuugacccugaugaaagcacugggccaguuuuccaauucucuguuauguaaaaaggcauaagucaauuguucaaagugaaacaacaacaacaacaacaaaauguagucuuaggaagcagcaaguucacugacuugggaucuuuaugacaguuuuguuguugccauugauauuguuuuguuuauuuuuuguuuucagaugagaaaguuuucuacauguuaucuuuuuucuaggagcucaaaguguacaucauuccuuuauuauagcuagguuuacugacucauauacuaaggaaguagcuaaaauuauaaaaauaauuuguuuuuaaaaccauauuuaacuaagggaacuaaguaaguuccaaugagcaguggucucaugcaagguauuuucaauauuuuaaaauuuacagaugaauauuuaaauauauuauaaaaguuuuaaucagcuaucucuaagaaaauacauuucuuaaagggaaaugaaauucacuugacuuuaaauaaaacaaaugaacucauuucauguuuuuaacuauuaucuaacucuuccuuacuuuaugaugcuggcaagcuguugagagccuugacaucuccaucugcagaaaaaucacagucuuagaaauccuauuaaucgugugagguaccugggucauaguagcagcuucaugcaguguuaaaauuauaugaugauuauaugcaguaacagaugaagaaaaaaagaaagaaagcaggagaaaugcaccaccucauucauuguaaaugcaguauaguugauuuuuuaauuuguuuuauguccucuagugaucuaagcaugaagcuugaauuauuauaauaaagaaaauaaaugcaaugcaguuggggauggcaaauguuaaugcuuaucuguaucaaagacuaacacugucuucaggauuauccuugguggauuauccuuggcagacacuuaaugagcagagagaagcuacaauguugaaggacaaaaguccuuugucaucuuauuaucgaaauaauguuuaauacaaauaaacuuuuuaaauuaaaauguuugacuacuuuuuaccacuaagaaauauucuuggcaaaguuaaacaacaucaaaauuuuaaacaauucuuucaaagcuaagaaguaaaaaccuaugaaauuaaaauuauguaauuacucugcaggauaauuugaugccucuggaaaaaugcauggacuguuuuagucccuaauucuaauuuaucacaguaguauuaacacgugcuuuuuuuuuuuuuuaagaggaugagggauugagacaguaaacaugaauuccucauagauauuggccaaguuguuucauugaacuuguugcaacuuaccuuguaauuggaaccacaauuuuaugagacccauaucuugucuucuuuuaucuaucauguuaagaaauaaaccaguucccucuuaauuauagcauuuauuucaaaaagcaauguuaaaaauaaauguagaguuagcaaauucagaagucuuucaguuacuuuauaauaauaaauccacaauguaacucauucuucuaaaaaucaaaaaaauuuaaaacguucugauuuugaugggauuuucuauuuuauaugcuuggcauccugaagaagacagcuucccuuacuuagguacucuuuggcuuagccauucaucuuuggaucaagugucaccagguaguauaauuugguauggacuuaacaccucauuacugaaaugcaaaucaguccugacaagucaaauaagaacaaguauugucuuuugacuagucuccaaaauuaaaauaauaauucuugauguauuucuuauaaacaaauuucagaagaguuaaaaugccucuuaaaacuauuuaauaguggaaagaacuugggcugugcaguuaaacaccucugaucucaaauucugcuuugcuguuuacuaccuguaaccuugaaacuuucaaaacuuuguuuccucauuugauaaauggaaauauaucuuauuucacuggguaagaauagaaaaauauaugcacaaauguuuauuauaguaacuuacauuucacuuaccauuucaggcaaaguuggcuaagaacaugaggcuguuucugauauuuccuuuuauuuuuauguauuaaugagaauaauagguauaggccauauacuuauuagagacucucaaugacuuauacuuauuauucucaauucauauuauaucauauuauacucauugaaaauaagccauauacuuauuagagacuuauuuagagucuuauuagagacuuauuaagagucucuaauaaguauauggguugucaagcuagacacaaaauaguaccaucucucuccaccucucuaaagaggaccacaucaucuccaaauguaaauagacaagaacaaaaaaaauugugcauuuacuaggcaauugaauguucuccaaaccaauauuccuuugaacaaaaugaguuuguuugauuugagaacaaugaaguauuuggcuauuuuauaaucauaagugauucauacccccacacacuuagcccucuagaaauggugccagaagaugaaacacauuuaauuuugccauauagaagcauugcaaauaacuacugguuucuaauaauguaccuuauaaugcaaauaauguuuuaauuuuuaaaaauaucagaaaaaguacaaccuuuuaaauuauguaguugcuucuucuucauaaucauuuuucuugaacuggugaaaaauuuugucagaaguuaccacuugggacauauuguacuacagcuucucgcuuggcuggagaaacugguuuuccagaagcagaccuuauacaagagguaaaugaaccauuagacuucucccaugaaaucaacccagaaaaauaaauuaggacuauuuuguagaggaacagacagaaugcuagaggcucaguugccuuuaucauuuaugucuggcucugcagcagcaggggugugaggugcuccucauucagaguuucgaaugcaccaaaaggguguuuccaaaacaugauaugggaaggaggcugugcacagaguaugaccacuggauugccuaaauugacauuggguaggaguggaguaugggugaucuucagaugaagcaagaguaaugcucaaugugaccugguuaaacaagucuccugaauccagggguuaaagauggagaggaggaagagagggagucaagaaggucaaagggagcgucugucucccugaccugaaugacaacuaacauagcccuuguuuccuucuugguccccaggagggagagagaggcagcugugugggaucaaggcauuuugugagauugcagcugugauucauuuuccuuuggaagaacaucccuagcuccaggggauauggugggaauugguuagcuaaaauaucaauucccuggguaaaagaggaaaaccaugagacccucuaaucuuaacuuuucuccuucaaaagaguggaaaaagauuacauaguuccucaaaaauuaaaaaaaaaaugagucugcaauucagucuuaauaaaaagagaaagcccuuagcauauauacuguaacaguaaagacucaguuacucuugacuuagucuguggacugcuuuaacuucuguagcuugccuacuucugccuuuuuuacuguaaucuacauuugcuuugauuauucuauaauaaucaauuauauauacauaucugugauuauacaauaucuuuuaucuuuuuauauaucuauuuuauuuuuuuucacuagaaaagaaguauugcaauaauuuaucuucguacaaccucuacacaacaaacugccuuauacuuuguagacucuuuacacaucacugaacgauugaugaaugaauacacgaacauaugcauggcuugguucuugaauuaaugcuuggaugaauauucuacaauauucuugacucuagcaagcugcaaagagaagggaacaugccugauugagaaacaaaagugauuucucagugcauccuugcuccuucccuuuaaggacaacuguaaaaccaggaagcuuagaaauuccuugaguuugacuggaaagagaauagaauuaaagagaagaaucaucuauguaugaagccuggucuaacugauaacgcagucagauugccauuuuuaagauggaaaaaggggaacaugcuugccuugagcagaaaaguuuuugguggggcuggagcuccuaaauauuauuuuggucauuugcccaaaaacugaaguacaccaccaaugucccaauuaugaaguugaauacagaauuauaaaaaaaaauuguugaaagucaauaagaauaaaucuuagaauuuggacuccugccacauggcagaaaaaaagcaugauguuuuaagacaaccuggccuuuguccaacaugauguuuaccagauugcugacauuuucuagcauaacaauacuauucaucauugggauaaccaaaagaagggaaauaaaaaaaaaaagaagucuauuucuuacuagucuuuauucagaaaugauuuuuuugguaauaucuuaaguaguaucuuauuugcuuuaauaaauaacuugauuuuaaagaagauaaaccuccuuacaaaaacugggagagcaaaugucuaauccaggcuaccuugaaaauaguguguuuuaguggaaaauuuagaauuauguuaaauaaggcugcucaaugaaaaauaaauguaggaaaccacuaugcuccuguuacuacagcugagugaauuuuaccccaaaacaugguggcuuaaaaaaaaauuuaauuugcucacaacuugagguauggaaaauuugggaagggcucugaagggcuguucucacuuggggucacucuugcauuuguagucaaauguuacccgggauuuauaaucuuaagaaggcuagccugggcuggacaccuguucacucucauaacugacaguugcugcugcugucgcccacaagcuuggcuguuguauccucuggauugccucagacagccucucuuuuuuccuauggccccuggcugucccagagcaagcaucccagaauuggguagcagcuguacaaccuuuucugaccuagucucaaauguuaugguguuucaggcuauugauuccuagaggcaucacaaggccauccugaauucaaagggaagagagaggaauuagaugcuaccuccuaaugguauugggauaaaugcauauuguagaagagcaugcaggauagaaaauuuaauguaugccaucuuugaaaaauauaaucaucuacauauuuacuuacauuuauauacauuucuaaugagaaguuugagcauaauuauguauuauguagagaaagcccacagauauuacaugucccccaugaaggucauuauuuaaugauuacaaacuacauuaagauguuaaauaauuauaauuaaauuaauuuacaaauuaacuucauaguuacuuaauucuucuacuuaagauugugagaaaaguauuaagucguaccuuaaugacuuuguuuucauuauggaacauuuuuuggacauaaauugaaccuggcuaauugauacauauaauuuaaaaugcuaacauuuuacuuuuuauaucauuuuaugaauaaccauaaaauucaucaguaucaauaggaauuauuuaguuaaaaaucacauacaauuaauacaaucauaggcuuaaaggcagaauuuaaauuuguuuauuuaaaaguuaaaaaaauuaagguaggauaacuguuucauagaauacuaucuguuuuuauauuuuuugaagauuagguuuaguucaaauaagcuuuuugcaauuaucaaaaauaaucucugguccucguguauuucuaccacaauuuacuuccggcuugguguuuucagaugaggaaauggagccugaggaaugcuaacuuacagauuccggucaucucuccuuaacagccaaguugauuuuaacccgagccauucugacucuaaugauguacaaacaaagaguaauauuuuauagauuugcaaaagaguguagcauuugcuaccauuaaaauaggguuaaauugaccaggagcaguuuuugaggagucuaauuacucauuggggaucaugugcuuccuaaacugaaggcuuauccaaaagcccugaacuugguagacaagcaccccaaaggcccugaacuucaugggaacaaugaugaaugcagaaagaccaggaaauaacugucaagacaaaaacauuucaggaccaagaucuuuagaugaacaccuugugcuugacauaccugaaaaacagauuucagccucuaggauaauaugcauaguaauuguacagaaaagaaagaguuacagaugaauaaucagaaagauuauucagaaggauaaugagagcaacacccucuauuuugcuuauuaauaauaaucauagguagcaauacuugagacgcugcuaugcacuaugguaggagauuauuuuguagcauagcuuauugaauucucacaaaaauucugugaaagacuuaagaaaacugaggacagaggguuuaaacaauaugucuucuaauuuucuuuuucuuuuuuuuuuuuuuuuagacagagucuugcucugucacccaggcuggagugcaguggcgcgaucucggcucacugcaagcuccgccucccggguucacgccauucuccugccucagccuccugaguagcugggacuacaggcacccaccaccacgcccggcuaauuuuuuguauuuuucaguagagacgggguuucaccguguuagccaggauggucucgaucuccugaucucgugauccacccgccucggcuucccaaagugcugggauuacaggcgugagucaccgcgcccggccucaauaugucuucuaaucuuaaagauaaagaagaggaaccagaauugaaauucacauaacagucuuauaaaaaaauguuauuauaggagcauguuuaaauaugaaaauucugcagaauaaaaugaccccauuggguacccaccacagagcuucaaccagugucaacuaaugccguuauuuuucuaucuccacccacuuccauaucauuuugaagcaaauuccagauauaugauuuuaucuaacaauacacuuaccaguauguuucucugaaaaauaaagcucucaaauaaaauagccauaguuuauagcuuauuuauaugagucaggauccagaugaaguacauacauugcuuuuuuuaaaaauagcuucuguuuuuugguuuuuuuuuuuuuuuuuuuuuuugacaggaucucccccuguugccuaggcuggagugcaguggcaugaucacagcucacuguagccucaaccuccccaggcucaggggauccuccuucccgaguagaugggacuacaggcuugugccaccaugcucagcuaauuuuuuguaaagauggggucuugcuauguugcccaggcuggucuugaacucagaggcucaagcaauccaccugucugagauuccaaaaguucuggaauuagaggcaagagccacagcacccagcuaaaacaucucuuaacucuccuuuacacuacagauucacaauuucuucauuuucuuuuggaauuuagaggauuaaucagauucaggauuaauuguuuguuuuugaaaauacaaaucuaugaauggggauuuguuucuucauuuagaagcuucuaacugaugcuuuuccaggagaaauauaugccauguagagaaacucuuacugcuggaguagucacucuauuagacagaaaaaucagucuucuugagauauguaugugacaaaaggugcuucacaaauauggcaaagacacugaagaaaguaagagcaauuuucaggugcagauaaugggaaugacauauuugauaguaaguagcauucauuuauaaaauauuccuggaaacaggaaaaaauauaauuauuauaaccaguuguauccuaauacuucugaggaaaauaaaaacuccuaugauagcagguuauagggagaugguuauaacagaacauggcagaaaugaucucaaagccauacucauaaacuuuucaucaugggacagcaaggcagauagacuuuaaaauuaauuaaucagaaaggcacuucuuguuuucaaagcagccagagcaaaaugcugaugagaaacaguaauuaguccuccuuacucaggaaaaaaauaaauaaacuaacaaaacaaacaaagacccugaaaugcaggacaguauaguuuaaacuuauacaucuauggccuguaagaaguuuagaggugcaagauuacuguuauacagggguggucagcaugaauauuacagaggagagggauaacggauaugcuucaagggauuguuagaauggaaauagaaauaaaugaauaaguggaguuuuacauaaaauaugcauugcaugaacaaaaauugaguagcuaggaaugaguguaauaugcucacggaauagcuguagaucagcauuagaaaauaugcacaaugaucacaugcauaaauggcacaccacggcuaggcacgguggcucacaccuguaaucccagcacuuugggaggccgaggcugguggaucaugaggucaggagaucgagaccauccuggcuaacacggugaaacuccaucuuuacuaaaaauacaaaaaauuagccaggcacugguggcaaacgccuguagucccagcuacugaggcaggagaaucgcuugaaucgggaggcggagguuaaagugagcugagaugaugccauugcauuccaggcugagcgacagagcaagacucuugucucaaacaaaaaaacaaaaacaaaaacaaaaacaaaaaacauaguucuggagugaggacucaaacuauccugguucuugaucuacuuuagccaugaggcaccuuagauaagcuauuuaacuucuuuggguuucuguuuccuuaccuaugaaaugagaagauuagacugccuuaaaauucucugauuucugggauaaguaaaauuuugaauguugaacgaguuaauuucucauuaaagucaauaccaaaccuaacaaaagaagagccugccaucugcuaucauaaucauuuuuuaaagaagguguauuuaaaaguagaaauggaagugaaggcaggaaauggucucagauggucucagaaauugugugugugugugugugugugugugucugucugucugugugugugugucugagauaauuuacauuaaaacuaaccacacugcuuuuauuguuuuuuuuuuauuuugauauggauugcuaaaaaccucaucauagagucuaccuaaucagcauuugggaaccauagauuagcugauauuuaaggacccuucccuuugugacauucagagaacucauaauaacuagaguaaauucuucauuauacucugucucuugucuuugagcaagcuaguuaacacuccaaugccuuaucuaccccuuacagguacagcauauuacugggucugaugucagaacaauuauuucaggggauacagauagguaugccagaaaaaaaagucaugcuggaagccaggagaguugucaucuaauccacauuuugucauuccuaacuagauaagcuuguucauguuaugaaacuuuuuaaaauaauugaaaguaugagauuaccauacugccuuaccuaucucauuggguuauuguaagguaaauaauaacauauuuucauuuuuaaaaauaaacucuaaaacuaaauuauuaauaaaaaauaugugaaauccccccaauaaacauaaauuuacuaauucagagcagguuguagaacuauaauuuuaaucauugaaaugacucuccaagaacuaaacuacaagaauuagaauccugaggaugguauuccuuuuuucugaaucucuagaaauaagauguauauaaauuaccuuaaguaguuccuaguguuauaaaauuuuaggaugacaacauaagugaaagugucagccauccagacacaucauucuuucccuacacauuugaaauuuuaucugcaguuucgcauugacaaaauguugagagucacuagaauuuaaguucgccaaugaauaaaagcaagcguaaguggaaauuaggacugugaugaaggugcccaagaaggaaugauaaaauguaguaacuacguuccaaaugaaaagaaguuugucuuuucuggguuggagaacaccaauuaacaaagauuuggcagaaaucuaccauuccuaauugcaugaaauuagcaaauugacauuuccgaaaauggcagugauuacaacuguacagugucauuaagcaaccuccuacaagguagcuguucugguguuuuaccguucaucacugaaaacacuuaacucuuguuauuucuaugggaacugugucuauaagaguuacacauuuauguaacauauuuauguaaguucagaauuacuuguauuuugauacuuaaacuuauaaagauagguggucacugaauuaagaacaagauuccaccugcaaccccaacuaucaauggagcagugauauuauaaauaaaaaaauauuuggaaaagacucagaaauagguagcuucagguacguuuucuguaacuuucauggaagaaaugaagacagucaaaguauggcuaccauggugguuuacaaguauguuuacauaaaacucaaaauugaaaagugauuuucucgacauagcgguuauuauacccuguuguaauuuuauuuuaauugaaaacaguaaacugaauuauauuuuuaugaagucacgggcaauaucugccuugguccugcuauauucccaggaucuaauaaauucauggugcccaagagguauucaauaaaggcuuguugaauuuaugaaaaaauaaucuucaguacuucaaguuucagauaugauggagagauugcuucuaccaaaggcuaaaaaauauuucugauuuguguuaugcagucuuaaaauacagaaaugaucacauuaauuugaguuaauagaauaucaaauuuuuacuugauguccuacuucaauaugaaacaaugaaaaaaagaaaggcaaaaggccuuauuuaauaauuuucucuauuaugauucaugaugauuuauucaaaaauaacugccuuuuguauaauucugguucauccuuauaugacuagcugaaugacuacuaaaauauuuuuuaauaccaggaccauuugguaauucaaugaauuuacauuuacaaacuaaaaacaauaauacacucagcuagaccaaaaucuaaaguccaaaaguaaugcuucauaaaauuaauuucagauaugucauacuacccaauuuauuucauucuaacuagccauauaucuauuggucauaaaauaucaacugaaauggauauuguuuuggcauuccaaugaaaacuaaaagaaccguuaucccaaaauguuggauaaauuuucaagauccugccacaaguugauuauauguuuauaugauuuuaacuguagaucugugacaggguuagguguaucaaaaagaucuuuauuacugaugauuuggcuagaguaauuauugacacgguauuuauguaaaaauguauaaauuugccaaucacucgugcugacuacuuaucaaaauaacuacuuuucaauacaacaacaaagagguaaaacauauagauuugagccacacccuaaugcaacacaaauguuccccuaaugcagaggaauaauuccaugaggaaaauaucauguugaguuuauuauuaaauacaaaaagucauuugacuugguugcaaaagauaaagcaaaaauuuuacccuacaaugaauguaauucuuagaagaagaaaaauauguuguuacuguuaagaugaucaucauaacauuaauuucuugguaaauauaugcugugugauucuguagccacauguccuuucuacucacagcacacuccuauuacucuuaugcuaggucuggacaaagugccaaaggaucuucccccugacacaacucugcuagaccugcaaaacaacaaaauaaccgaaaucaaagauggagacuuuaagaaccugaagaaccuucacguaagaacuauuuuuuuuuaacucacaauaagauaagacucaagguauuuuucaaaacacuaccuagauaaggccaagaguacuauguaccaacaaagaagcacauuaguguuuauuaacuucaccuuuuuuuuuuuuuuuuacuuuuuuuuuauuaauucugccccaaacacuguuuuucuuuuucuuuuuuuuuuuuuuuuugaauuaugcuucuuuuuuuuuuaauuuuuuuuuuauuauacucuaaguuuuaggguacaugugcacauugugcagguuaguuacauauguauacaugugccaugcuggugcgcugcacccacuaacgugucaucuagcauuagguauaucucccaaugcuaucccuuccccuucccccgaccccaccacaguccccagagugugauauuccccuuccuguguccaugugaucucauuguucaauucccacguaugagugagaauaugcgguguuugguuuuuuguucuugcgauaguuuaccuuuuuagcagugguagggaagcaaagcaucauauuuauuaaccacuaacaauuuaccugacuuuuuuaauacauauaccccauauaucuuagguauuuucuucauaaaaauacuuuagaucuuaauucucucucacguuuucaggaauaaaaauugucuuucaaauuaaauuguauuuuaauaguggaacaaaacacaaaauggauugauccuaguauuauuuuauuucuuuguuucuuuuguuuguuuucaugcauuuucuaagagaggugugaaugauguucuaaagucucaaagauuggaaucaagugaaaaaaagauaauuauucauauuucauuuagcgaaauauaauucuaucuucauauauauguuucuugcuuuaucuuuaggauuaugcaugcuguguccuuaucuguauguuuauuuugauuuucucuuaucucucuacucuaucauaauguucagucuaucagucaggauuucaucagaaaagagaugccacucacaaagggguuucauggaggagacuuuauugaaaccucuauuugcaaaggggcaugggaacccaacaaggcacugugaagcacccagucccacaaaggucuagaagaauuugagggucucagagccaugggagagcuggguaguuccaccucuuaauuuccugccugugucuugugugguugcaucuacuucagaccaaaagacaagggcauuugauuaaugcauuccccagaggucagcuucccaggacuugaagaagggccaaaaaagggcaaagaaugaauauugugguaguugggagagaauaugcuauacaagggaaaugaccaacccaauaaaauagagguaagccuugcuaagagaaccuucuguaacaguaaaugcauuguuuguucacacagaacaccagaaucacuauaaaaugcauuuucucacccaguucucuaucuguagaaugagugugauguggucuuccaucaaaauaugagugcacauuaaauauaaauaaggcagacuucaauguccaaaauauauacucuggaaaucucacugugucuacuuccauucugguagaccacucugaagcauugagucugguucuuggcauuuuaagaaaggcauucaagaacaucuagagaaggaugaccauggagauaaagaaucuggaaauuaggucucauaggcaccguggauggagagguggaugucuaaacucaguguugagggucacuaguggcacauuugaagggccauguugaagaaaaagaaugguauuuacuuguuucaacuacaagaugacagaauccuccuagugaguagaaguuuuacagaagcagauuuuuauucaauauuaaaaauaaaaauuaaagaaucagaauuuucagacaauacagagacuuaccuagugauuuguuaccugccuguggagauuagaguucacagcuucguauaaugaaugucauaggaauacauucuuaauguugggagcauaaacauaccaaacucuaauuucauaucuacuuauuuauucuagucauuauagaaaauaauugaggaagauaugucaugagaauaggcacuacuuacuaaaguauaaauauaaaucaucugauauacauuagaauaaaaauauagauacaaaggaaauaauauaaaauagaauaaacuggucauaauuauuacagaguuacuauaaugaagauaccauuuaguuauaaacuuuacaauagccaagaugggaaaagcaguaaacauuuagccauuagaagaaaauauaccagauuuuuuuaaaggaagaaaaauuuuuuucuaaaauuuuaagacucuacaaggaaccauuuuaaaaaaugcagaaaggccgggugcaguggcucaugccuguaaucccaggacuuugggaggucaaggcggguggaucacaagguuaagagaucaagaccauccuggccaacauggugaaacccugucucuacugaaaauaaaaaaauuagcugggcaugguggcgcgcuccuguagucccagcuacucgggagucugaggcaggagaaucgcuugaacccaggauggggagguugcagugagucgagaucacgccacugcacugcagcccuggugacagagugagacuccaucucaaaaaaaaaaaaaaauugguagauaaaacagugccaugaucaauuuauugacguguccaacaauauaagcacaauaugauaugaguagugaguguuauggacuuaaaguaaaagaaaaaauuaggcaucauuauuuauccaauuaccagacacaguuuugagagaauaugcgaggaaggaguuuuagacgaucagcagaaguuugaaggacuuucuguacaagaagaaagcaaaggcagaagaaaauaagaaacagacaaauaaaaauacgaguuggcuagagugaaagaaacagcugaagcaauggaggauaaggacaagcuggagguuccgaccuuugggucucuuuccgcugaugagaaccuuauucaccaacucccccucacuucaccuuaagguuucaccgggaaugagcugauggggaaaccagcaagguuuucagugacuauuuaagcuacuguuggcauaaguuuaaaaaggagaccauaaaaaaugaauauuauuaaauuuagauuacuaaaauauuuuuaaaacuuuuauuuggauaaguuugccuuauagcuacuguuuuaaaggaugaaacauucuuacugucaucucaacuuccuguacauuuaaguauacuuggaauauuuuuuaaaaaaacccuuuauauccuuaaguaagugacaucuaguguccaugacauucucauuaaaucuggcauuuguaauaauguguuguuucuuuuccuaagacuccuucuguuuuuaggcagccaucaucuugacaaucucuuucuuucuacuucaaaguauacaucagaugaauaaagagaguucauuagagccuucaaccauucagaggauguuaagcagcuauuuuucucuuacuguuucauucaugauccuuucuauccuuguuauuuugcaaauaaacaucauaauuucaccuagcaaagccacacuuaaggaaggagagaaaugaaaauuuagcaaggauuaaaauagaaagaauuuaacagaaucauguucccuguaugugcuucauuaugagugguguguguuacauaagaguaauuuuauaccuauauauagugggaaaaacuauauaauuguucuauaaaauaauggaaaauuaagugugguaaugacaacauuuaauauauuuucuuugaauugaagcuuaauaaguugaguaaggaaaauuuuuuuaauuaaaaaucagcaaaaauugucaaagacugaacaaaagcaaacacuuguuuagcaauuacuauauauacuaggcacuauucuuaguaccuuauauacauuaacuuauuuaauucuuauaacuauucuuaugagguagucacacuugauaucuccuuuaaaugggcacagaaagguuaaguuacaugcucauagucacaggccaaauaagacccagagcuugagauucuaaacucagaauucuggcuugaguaugugcacuaauaauugccuauaaauguaacagucaccaaaaaagccuuuagaacaauauuugguacaguguaagaccuacauaaauggcuuuggagaaaaaaaucauauuaaaagucagguuuuaaaaacauuuaacauaauacagauuuuucagaucauguuuaauacaucuaauuauaucacacuuucaaaauggucuucuauggauaggaauugaauaucuccuuugcgauuuucauuaggcauccacaauuuuggaugucuuguaaugauauaugucaccucacuccacucagcuggcucuggcuuuucccugauuuuuuguuuguuaaugucaauuuuuuuaugaccuuaacucccacaaguuuuugaacuuuugauuauuaaucgcaguguguuagaauuguguaucaaucaaccaaugcaucuuucaggauuaguuaaaugauuauguuacuuaauaagaaguuuuaauucaucgaguaaugugaacuauaugaggauauacauauauuaauuaaucagcuauuaccuuuagaaaacauucuugcauuucugagacuaaaaauacucgcuuuccuauuauagguccccuuuugccccuccacauuuucauauaugcgaaacauauacuauaauugaaaaugcaaaauuagaccuuaauaaguuauuuuaaguuccuuauaauuaguuaauaaaguggcuugaaauaauaaaaccaugugguuuuguuagacauacagauaauugaaaaagaauaaaauaguccaaaaauaggccuagcaauuguuauaagcauaauaauaaugaauuagagguaauuucuuauauaaggagaacucagaaauaaaaaucaaauaauuacccaaaauauuaacguauuugucauauaaaaccuuuacacauaaaaaaaggcaaaaaaaaaucaggagaaaaauauguuaaggcucucugugucauauugaccauaucuuuauuuucuaaaucaauuauuaaccuauauuaaaauuuaauaaacaugagaaguauuggugaucaagcaaucuccucucuccaaaaaauacaauaaaugguaggaaaauaaaaaaaaaauaguuuaaccuuuuuaaaugacaaggaaauacaaagaaaagcaaugagcuacaacaugauauuauuuuggccauacucuuaagaaacauaauaucaaauauugcaaggcuacgggaaaauuuuaguuccuugcauugcuggugauagcauaaauugguaucauccuuuuguagcggaauccauguucaugaucaaugaagauggacuuuuaaguuaaaaagcugacugcgggauggaugucuguggcauugauuauuuucagguaucuagggucauuucaauuguuagcaguauuuauuauuuaaaaauuacauagauauauacacguacauauacauacauacaugucuguguguguagagugcauguauguuuauguauauauuauauaucuuauuacauuucccuucucuucauuccugauuuucagguccucauauuauaacuuuuuuuuuuuuugagacaaucuuucccagucaccaaggcuggagugcagucgugugaucucagcucacugcaaccucugccucccagguucaagugauccuccugucucagccucccaaguagccgggacuaccggcacccaccaccacgcccagcuaauuuuuguauuuuugauacagacgggauuucgccaugcuggccaggcuugucucgaacuccuggccucaagugauccucccaccucagccucccaaagugcugggauuacaggcaugagccaccgcaccuggccuauacacuucuuaaguaaagaaauaauacuuacuuaauuuuuuucugauuucuugcaauuuuuuagauuucucugcuaucccuaugaauggaaugaacaaacaugcccuuguuuuacauguauguggaagguuuuggauuuaaagagauguuuuucuucacuaucuacaggcauugauucuugucaacaauaaaauuagcaaaguuaguccuggagcauuuacaccuuuggugaaguuggaacgacuuuaucuguccaagaaucagcugaaggaauugccagaaaaaaugcccaaaacucuucaggagcugcgugcccaugagaaugagaucaccaaagugcgaaaaguuacuuucaauggacugaaccagaugauugucauagguacagacauuuuuauaacuuuaagaccaaaacucaaguuuuuaucuuaagagauuucaacuggguuuuaagugcaggaagguaaauuagcuacaagcuacaugccuggagccuaugugauuuauaagaacagggccaagagaaauugggauuuugaaucuggaccuuacagugauguuuuuauguauguccuugaguaucugagaauauggagaaaacccuagggcugaaguuacccuaccacacacacaauaugcaaagaugaguuuaaauagugcuuaacuacagauauuuugagauaccuuuccguuuuggggaccuguuguauucuaaacacucauaaaucauuugcuuuaaaaauauguuauggcugggcgcgguggcucaugccuguaaucccagcacuuugggaggccgaagcaggcggaucacgaggucaggagaucgagaccauccuggcuaacauggugaaaccccaucucuacuaaaaauacaaaaaauuagccgggcgugguggugggggccuguaguaccagcuacucgggaggcugaggcaggagaauggcgugaacccgggaggcggagcuugcagugagccgagauggccccacugcacuccagccugggugacagagugagacuacgucucaaaaaaaaaaaaauuucucuaaacauauaguaaaaauuguaauuuuauuauuggcuuauaaaaugcuagauugaaauucuuuaacaaaauuuuaaaauaccuuaggaaaauaauaaauaacguaagaugggaauuguaaacuugcuuuaguugauuucugggcaaaccuguguaugcaucuuaaauaauuuuauugguauugcuuucacuaauagucuuuuucauaagucauuauuauucauaagucauugucuguuuggcuuuuguuuuaauaagggaaauuuuuauccuauuuugcuauucuccugaggagcaugcucuuuaacuucacuuuuguuuuuuagucaaguugauauuaaucccuauuucuuuauagguugcuugcugaaacagauacuacagugacuaguaauauccuaaaauuuccucuaaaagccuugcacuuauuacauuuguagaacugggcaccaauccgcugaagagcucaggaauugaaaauggggcuuuccagggaaugaagaagcucuccuacauccgcauugcugauaccaauaucaccagcauuccucaaggugauagaagauucuccaaaacauuuugaaaaauuuaaauucaaaggcuuuaauuaaaaaaaaaaaaucuuguggaaacuggaauugucaccuaagaggccaaccuuauuuccagcaaauucucuauuacugcuaguguuucauccaguguuuauauuuccagcaaauucucuauuacugcuaguguuauauccagugauucagucuggaugaccacggggccauccaggcucacuguagagauggguagacuccuguuaaugucuaguuuaagacacaacuuaaugcacagugauuuuauaauauuguaaaaucacaaagaaaaaguacauuuauuuaaaaaauagcaugccuugguguuuguaaaaaaaaaaaaaaagauauaugggaguaccucugaaauugauccaauuuuuaucuugagucugcaauagcuuagggaauuuuuuuuuccuuuuuaagacacuccaguuauuaauaucugaaugauagugguaguuguguguugugaagaguguagauuuuggagucaguuugcuugagcccaaauuaccauaaagugguucaaagacuuugaaaaaguuauucauuuguccucuaucucuuuaucugucaaguggaaauaauacugcuauccacuucauugaguuguuuuaaaguuaaauaaauaauuagagaaauauuuagcauauagauaaguagggaauuaauauaacucucuauuaugcauuaaaaauguucugaacaaucaguauguguaggcgauguaccaaacacuuaagacagggcagggaacaggauaugcuacaugccuuuaggagcuuacucucuaaaaccaagccagacaaauacacagcaaugaccacauagccacaaggguaaguucauuguuccaagggauucccaggagaggcacaaaagccagucuuugugaauuacaaaaggcaucaaaccaccaauaauaaauuccucuaacuugcacaucgucccuacucuggguuuuucagucucacagaagcccucuauauuaucuaguuuuccccucagucugucccuuucucaacuuagaugccuuguucuugagugcguacaaaauguagacauuuggccacagaaaacaccaguuguccuuuauuguucuuuuacagaaauuucaacuccugagaguacauauuccauaggaugcuuucuuaccaccccuugcccuccuccuagucuuuugaauacagagcaugcuuuugacuuccuuaguagcaacuacuggcauagauagauacauagaugauaaagacugauuuauaauucauaaagcacuuucauguugagucuccaauuuuuugcauguaacaaguaaucuuuugcuauccccagugcaggaaugaaauauuuauaucucagauagauauaaauuggggauugauauagauagauagauagauagauagauagauagauagaucuuauuaaaauucuugcugaaauuuauuucaugcagccagaugacuuacauuuagcacaaucucagacuuugcugucccucuuaaugcaugcuccaaaauauccuucacugauaccuuuuaucauuucaugaucucuuuuccuuuacuuugcuaugucuucuaucuaucccagguauucuuuccucaucauuuauagcuugcuuuuauuuacuaccgcuuaauagaaaaguuaaguaacuacaauuuauuaagcauguauuuaguuccggguaucaugccaaaugcuugucauggagucuucuauaugauucuuacaacgucccuauauaguaggguuauaauuccuguuucauaaaaguggaaaaugaggcuuaaacagguaaagaaaauuguaauuaaguucuuagagcuaggaagcggcagagauggaauuguguggugcugaugucagaacucguguguuuaacuauuucacucuguuggcauauuaaguccuccuuucuauucaucguuaugcuuaucuaauacaugauuccaccuugcuuaggcugggauaccuaugccugaauaucagcaaccuccuggugauauuuucucccaucacucauggaaauggaaaggcaguagaaaguaguguagagacuauaaaaaucauacacuuagaucaaccugggugagagaccuaacucagucauuuaguuguacugugacuuuaggauaauuauucugcauuucuauaaccucagguuuguuagauguuacauggagcuauuaauaacccugucuacuaggauuauugugaggauuacucuauagaaguaaggcuuguauuguacacgcaaguacuuggcccaauguaaaccucaauauauuuuaucuuaaaaaaggaaaagaaaaaagaaaauuuaaaauaaaugaacaaacaaauaaauaaaauaacuggaguauggguucuuuaacucaaugccacaguugcagaagcuaaugaugcacuuuacaaauuugucuaucucaaaccuauugcaagguuuucucccauagucaaacuucuucuuagcuauaacuuuacauuugggaaacugacaucccaaaaagggagacacuuugaaacuaaguaaggccgaugguugugauagcaauugguguacuggaggcacugcauuaaaaaauauacauuuugcauuacuuuguaauuacuuuguaacuuugagucuuauuuauuuaacugugaaaagggauuagugaccaauaauuuauguuuugagaggcuuaaaggauuugaaguaggaaaagugccaaggucaauguucggugcguaacagacauacaauaaauagauguuccuuuuccuagcagcucuaacacaaaauaugcuaccauaggaaacuaagaaucauuuucaagucaaauauggacuaaacuauuuuauuaaauggacaauauugacagaauucagugugaugugauaaaaauuuuagacaaaaugaaaccugugguuuuucaauucugugucuuuauagacaaauagccaagacuuucugccaaucagauguucuuucuacacuuaaccaauuugcuauuuucucuguaucuauugcuauuaaguggaacaauauguuauuuuaaaagcuguauaaaauauaauacagccucagaugcuaggaggaaaugaaaauaaaauauuuaaacuuuuauauuuauaauacucgaucuuuggaaaucacagccaugcaaguacuaucuagagguuuaguggguacuuuggauguaaaauuauuaccccaggugcuccacauauggcagaucacuugauuauagaccucuccacuccuucugcauaaacauucuggauuuaauaggcauaaguaaauguuagcuguuucuacacagacauuuugcagagguauuugaugcuuuuauggaaaagucaauuaaggcuaagaccagcacaguauaucaguguuaauuuuuaaugaugcucauuaaugaaauagacaauuaaguuuguacauggguuuaauuuauacguaaucucuucauuaugguucgaauagugacuuucccacuuuauaauuacuaucuuuuaucaacgucaguuuuagcccauuaacaaagguggaagagaauaaugagacucagcguugacuucaguucuucuauuccaagaacaaaaauugacuacaugauagaaaucauccagguuuuuguuaaagucaaccuaagagaaaaauagcaagggcuuccacuacuuccaaaagcacacauuauuauaaaagggaugaaaaaaaaagauaaaaguaaagcugauucuuugaaacugugugucuuuuagaaaauugauggcauaugucuucuuuaaguuuguccacauucuguacuuauaauguuuaucugcuaauuuaacaucuuuaauuccacauuccaggucuuccuccuucccuuacggaauuacaucuugauggcaacaaaaucagcagaguugaugcagcuagccugaaaggacugaauaauuuggcuaaguaauaauauucuuucaugacauucuaucagaacaauggcuagguauauuagugcuuauaugauaagaauuauaaacaugaugauugauuuuugaguguacuacauuucacugcuguuguuguuucuauaaucucaaacuucagcauauccaauuauuucuugagaagaagccaaugaaauagugcccuuacuaaaaccaccaagaucagcuucauauuuuauuaauacuauacuguuuauagauuaguuauauuuuauacacaaagugugugauuaaaucaauaugugcauuuaauauguucuaacuuauuugcaucaaacagaaaguuaaguaaauuauaacacaguugcuagaauuugaaaauccauuaaaaugaaaucuaccaagacagagaaauauugagcaucacacaaauuacuauuuuaauaauuaugagauucucuaacccccucuucucugaaaaguuuaaaauaaaauaucucugggcauuuaauguagaucaacaaaagaaaagcuuuuguuguuguuguuuuugcuggcccuucuuaaugauuuuuuuuaaaauaagugauacuaguacuuguccugguuucaaacauaacuucaaucuggcaaacguuuucacuugucuucaaggaacacuauguucuuuuugaucuguacauauugcugacugucccuacagagaagcacacuaucaugccagauuuacucauuccuguuguuauauauaaauuucaugguggauaaauaaauauaaaauauaucuuugaauguguauauauauauauaugcauguguguguguauaaucaacuccuuuacuagguaaaauauucuuugaugggaaaagugguuuuugauccaugagaccucugucccucacaaugccuagcauaauaucaugcacauaaguuuucaagaauauuuguuuauuaaauauacaaauaaauguuugaauaagugaacaguuuuuaaaaauaaacuauuaggaauauuauguuccaauauuaugguugaccauaauuugauguuggaacuuaggauauuauaaggaauaggagacuauguccaaucacguucugucagaugaaucucaaagacaguaacuuugagccgagaccuuaacaauaaauggacuuuguccaggcucagagagguuggagaaagcacuccaagaacugggaagaguaagugcaaaaacaaaaaauguccuuuccuauagacuugauuaacuacacaaugcuuguaagaaaggcauccaugugugguguuugcuuucauuucugcuuucuguugcagguugggauugaguuucaacagcaucucugcuguugacaauggcucucuggccaacacgccucaucugagggagcuucacuuggacaacaacaagcuuaccagaguaccuggugggcuggcagagcauaaguacauccagguaaugcaaagccacugcuuaugugaggaauauccaaaaagcaagacccccacccugcuuaugggaugcugggaagcaggaagcucuucuuagaaguuuuuuuuccagagugucuuaguuagaauuucuaugacaaaauaccauaaaaaaaauuaaaucaugaagcacaauuuacauuagcuagauuucaauaaaguuuuugauuuagaaguauggagaugaaacuuaaagucuucuguaaugcugauauuuuuuucaguagggguggugauguuggugccauagugaguagggggaguuugaagccacaaguaaaauaaaaauucuuuuuuuuuacugucacuaauuuuaauuuucaaauuauucaagaauugacuggaaagagcuucuuuggucuagcuccugauucuuuuugacauggccucaucauuuuucuuuauuuccucuaaaaaaaaaaugagauacguuugcagaaugugcagguuuguuauauagguauacgugugccauggugguuugcuggcccuacugacccauccucuaaguucgcccgcucacccccuacccccuguuguguguuuuguuacccucucuguguccguguguucucagcauucaacuuccauuuaugcgugagaacaugcaguauuugguuuucuguuccuguguuaguuugcugaggaugauggcuucuaguuucauccauguccuuguaaaggacaugaucccauuccuuuuuauggcugcauaguauuccacgguguauauguaccacauuuccuuuauccagucuaucauugaugugcauuuggauugguuccauguuuuugcuauuguaaaauagugcugcaauaaacauuaugugugcauaugucuuuauaguagaaugauuuauauuucuuuggguauauacccaguaaugggauugcugggucaaaugguauuucugguucuacauccuugaggaauugcuacacugucuuucacaaugguugaacuaauuuaugcucucaccaacaauguaaaagcacuccuauuucuccacagccucaucagcaucuacuguuuccugacuuuuuaauaaucaccauacugacuggcaugagauaauaucucaucuccagccacagggaaucauuaaucuauuuuaucauuuuuguuuguuucauagaccauaguuuuguguagauuccaggaauacuuuaacaucuagaaauuuuauaauuuuaacuccuguauuugguuuuauaaucuaauuuugagauaauccuaguauaugauaugagucuaauucauuuucuguaugugauagcaauugucccaaugucauuuguuggaaauaauauucuuucuccaaugaauugucuugucacuguugaaaaucacucgaucauaaauguaaggguuuauuucuggacuuucaauucuauuacauuuaucuauaugucuagucauaugacaguauuauacccuucaauuacuguagcuuuugauuacguuuugaaauuagaaaauguagguucuccaacuuuguucuuuuuuuucaaaguuauuuuggcuauucugguuccuuugcauuccauaucaauuuuaggaucuacuuuuucauuucuggaaaaauauucuuguaaggcuuugaaagguauuguuuugaaucuacagaucauugggaagaauuacuaucuuaauaauauugagccuuccaagucacaaacaaggguuauuuauaucuucuuuucuuuuucucaacaguuuuugucauuuuuagcauacaugccuugcaauucuuuuacuacauucauuguuuuucauucuuuuugaugcuguuuugaauuguuaauuuuuuuauuuguuugcugcuaauguauaaacauacaauugauguuuauauauugagcuauccugguacuaugccaaauuuguuuuuaguugcaguaauuuuugugaguuccuuuggauauucuauauucaggauauauuauuuaaaaauagacagcuuuaguuauuuuauuuggauucuuuuaggucucccccucccccacaacccacccuuugcauuggcuggaaucgccagugcaauguugaacaaaggugaugaaauuagacaucuuugccuuauuugcuaguuuaggaggagggagcauucauuuuaccauuaguuacgauguuagccacaggucuucuauagaugcucuuuaucaaguugaggaaguucccuucuauuucugauuuacugaaaacauuuauuaugaauuuuuuucuuacauguuuuuccugcuucuauugagauaaucaugcgaguuuuggccuuuauauuuuugauauaguguauuacauugauauuacuuugauugauuuucauaaguuaaaccaauuuuacaacccugagauaaaucauguuugguccuauagcaugaaaucauuuuauauguugugaaauguagcuuccuaacauuuugugaaagauuuuuuguccauauucauaagagguauuugauuacauuuuuuuuucuuaugaugaauuuugucuggcuuuggucuuagaaaauauugaccccauagaaugaguuuggaaucuacuuuuauuuuguucuacacagacuaauacuuacgucuugauauuuuguucucucacuuucaauauuaaccauaaauugcucaccaaacaccccuuccuuuacuugcuaaucacuacuggaauauagaggaugguaaaugacaacaagaaacuuccaaaauaugagaaccauaaaccauacauauaaguguugcuuucacuuuaauauuccuuguuucuguuuuuauaugacaucuacuaauucgcuuuucagcccuuacaaaaacaaagccguuuucaccagcacaugaaugugaauguccuaguggguagaacaauauuucaaauuuuuuuuuuuuuuuuuuuuuuuuuuuugagucggagcgucucgcucugucaccuaggcuggacugcauacaauggcacaaucucggcucacugcaaccuccgccucucggguucaagaaauucuccugccucagccucccgaguagcugggauuacaggcacgugccgccaugccaugcuaauuuuuguauuuuuaguagaaacgggguuucaucauguuggugaggcuggucuugaacaccugaccucaugauccauccgccucggccucccaaagugcugagauuacagacauaagccaccacgcccaggcuuucaaguuauguuuuaagggaguacuucauagguuuuauagcucacuuaagaucuuguugguggcaggacgcaguggcucaugccaguaaucccagcacuuugggaggcugaggugggcggaucacgaugucaggagaucgagaccauccuggcuaacauggugaaacccccucucuacuaaaaauacaaaaaauuagccgggcgugguggugggcgccuguagucccagcuacucgggaggcugaggcaggagaauggcgugaacccgggaggcggagcuugcagugagccgagauugcgacaccgcacuucagccuggauaacagcgcgagacuccgucucagaaaaaaaaaaaaaaaagaccuuguugucuuaguguuauauucuaaccuugcuuguaugauuucagagaaguugcuucuugaccuacagaacucauauccucaaagugaacuguaaacucauuucuaacauucuuuguauaauuccgguuuuuagggacccuaagaaaaucuauggccaaauuaccauuaucuuaaacaugauuguaaaacauaauucagaaaaaaaacucugauuaauuauauugcacuguauucaaguaaaacguauuacguaaaauauguauuuguuaaaacuuccuaggucuauucuaaaugcugugauguuuaaauauuuaagaauuucuuggaguuugugauucuuuauuucaauuccaguacuuuaugcucucuuuuucuuuuucacuacacagcacuuucucauucuauaucauuuuguuaaaagguguauauauuuuuuguccugaaaacauaauauuucauguagacccaauauagucauguagaccugauauaugaaauaacauuuauucauucaacacauauuuauugaacaccuggucuguucuaguacuggagauacagccauaaacaagcagaaccauucuugucucauggagcuuuuacucuagaggagagaaacaaacaauaucaaauaagcauaauaugcuacauauugauaaugcuaugaagaaaaacauguaacguaauucugccccagagaauggcagaaugggauggucagggaaggucucucugguaagaaaaaacgacuuacaugaggcaacaagccuugaagacaccuuagagauuauuccagguugaguaaacgguguugauaacuuaagaagagaucaugcuuugugcauuagaagagcagcaaguagaccagaugacuggcuuuuacaguaagagaaaaggaggucagaguagaaggaugucagaucauguaggauuuguaggccccuuugagaacuuuagauuuuauuauucugcaugagauuggaaaccacuggaguucugaggcaaagaacauauaauuugguuuacuuucuaaagcaauugcucugagagcuuaaaaaaagaauaaaauuuaggaaggcaaaaggggaagcaggaauaauaaucagggcaacuucaaucauuuggaaggaaacaauggugacuuggacaagguugucggaguagagguggagagaacuagauuaaguguacauuuugaaggcugagcuagcaagauuuguuguugauuauguagagagcauaagagaauuggagcucaaggauaaugacaauguauauagccugagcaucugaaaugauuggcaugcaauuuacugagauggggaagacaagacuaaagaagggaaaagcaaauuuucaaaaggaagggagaaaucaaaaguuuaaucugagaaguagucaguuauucaaaguggggccugucgugguggcuuacgccuguaauccaagcacuucaggaggcugagguggccggaucacuugaggucagaaguucuagaccagccuggccaacauggugaaaacccaacucuacuaaaaacaaaaauuagccgggcauggugugugugccuguagucccggcuacucaguaggcugaggcaggagaauagcuucaaccugugaggcagaggcugcaaugcacugaggucaugccacugcacuccagccugggugacaaagcaagauuccaucucaaaaaaaaaaaaaaaaaaaaaaagugaaggauuaaaaaauaauaaaaaaaauaaaauguuuaccugaagggccucaacauauuuagagaauaauaauuauuuucuaucguuucauguuguagguugucuaccuucauaacaacaauaucucuguaguuggaucaagugacuucugcccaccuggacacaacaccaaaaaggcuucuuauucgggugugagucuuuucagcaacccgguccaguacugggagauacagccauccaccuucagaugugucuacgugcgcucugccauucaacucggaaacuauaaguaauucucaagaaagcccucauuuuuauaaccuggcaaaaucuuguuaaugucauugcuaaaaaauaaauaaaagcuagauacuggaaaccuaacugcaauguggauguuuuacccacaugacuuauuaugcauaaagccaaauuuccaguuuaaguaauugccuacaauaaaaagaaauuuugccugccauuuucagaaucaucuuuugaagcuuucuguugauguuaacugagcuacuagagauauucuuauuucacuaaauguaaaauuuggaguaaauauauaugucaauauuuaguaaagcuuuucuuuuuuaauuuccaggaaaaaauaaaaagaguaugagucuucuguaauucauugagcaguuagcucauuugagauaaagucaaaugccaaacacuagcucuguauuaauccccaucauuacugguaaagccucauuugaaugugugaauucaauacaggcuauguaaaauuuuuacuaaugucauuauuuugaaaaaauaaauuuaaaaauacauucaaaauuacuauuguauacaagcuuaauuguuaauauucccuaaacacaauuuuaugaagggagaagacauugguuuguugacaauaacaguacaucuuuucaaguucucagcuauuucuucuaccucucccuaucuuacauuugaguaugguaacuuaugucaucuauguugaauguaagcuuauaaagcacaaagcauacauuuccugacuggucuagagaacugauguuucaauuuaccccucugcuaaauaaauauuaaaacuaucauguga

SEQ ID NO: 192190 - RNA, 37242 nt, Homo sapiens
ugcuugcuuuacgguuuuauuuugccuuucguuuguuagcucauuuuauaauuuguuacuucugaacaccuuccaagugcuggugcuuucagauaucuaccucaaaguauuauuuguaaaugucaaaaagucccucuuacauauaauugaaagcuggcuacaugguagacaauaugaucacaaacuuuuaaacaauuuuuuaagcugaagaaauacuuuuucuuuuuauaaguaucaaaucaaaauguaauucagcauccacccauaaagcgcaacuaaaaacuuuucacaaugccauuaacaacuugugguuaccaucauaagccuacagaccuacacacuaauuaucuuuaaaacccuuauuaggcugggcguggcggcucacgccuguaaucacagcacuuuggggggccaaggcgggcagaucacuugaggucaggaguuugagcccagccuggccaacauagugaaacuucaucucugcuagaaauacaaaaauuagcggggcguggugacagggugcucuaaccccagcuacuugggaggcugaagcagaaccacuugaacacagccaggaggcagagguugcagugagccaagauugcaccacuguacuccagccugagccacagagcaagacuccgucucaaaaaauaaauaaaaauaaaauaaaacccuuauuaaggauuuaaaaaaucuuaauuauauaaugccaaaagcuaguccccgucuggcuuaggggcccacaagcuccugcuuuaaagccaguuuuuuuguuuuuuucugauguacuuacauuugugccucacaaucaagagguucccagcuugguggaacuuucaaagaugaggcagaaaacuaaacaggcaauuacaaucuuacuuuucacgcugacaagugguacgguggcuagcccaaacuccccucccugucccagcuaccucccuuauagaccauucacgaucacuuaggccaggcugccaugugaccuaagagaagacagggagaacacagcauuucuuacuccuacuaacuugcaacaucauucucucaaguugcucucauuggaggcucccaacugcuucaagcugcccagugauauuuguauuucuaaagugggcaggcauggccauuccagaaaaagaaacacauucagacuugugccuuuuguuacccaaauauaugauauucaaauaauuucuauuuuaacaacucauaaaaauuuaagaucaaauaauugcauucuugaaacaauucuuaaucauuuauuuucaacacguguacuauaaagaaccuaagaaaucagacaauuuuaauaacccauaaacauguugaauccauuugcagauuuaaauuuuguaaaaauagcugucacugccuccauauaucaaguguacuauguuuauaaucacauuuaugcuaccgauacuccucagaaaaaaacagauucugcuugguucuagcuucaguauuaugaacuccaauaaugcuuugaggaccuccaaaggaaaaaaacagauucuacuagguucuagcugaaauauuaucaacuccaaauugaagcugaaguauuaucaacuccaaauaaugcuucgaggaccuccaaaaaaaagagauucugcuugguuguagcugaaguauuaucaacuccaaauaaugcuuggaggaccuccacagguaaacuacuaaucccuuuggccauuuauugagacagacagagagagagagagagaguuuugaagcaacaauguaccauuaguaaaguugcugugcagaauuaccucaguccuauucuaagcuuacaguucaguugauuuuauugucuucaccuaaguauauacaauucacauaugggagaaaaacacuaaaucaagaugguuauuuucacuguuuugcuuaagauucauauuuaaauauaaaucaagaaguuaauccacaguuugagagauacuuauauuagaaauuuuaaauguuaaauacauaauuguaaauaugguguauguacuguuucacauacaauggguauugaucaaaucaguguaauuagcacacccaucagcucaaauaucauuuauuuguagcaagaacauucaauacauuaacuauagucacccuacucucucucucucucucucucaauaaauggccaaagggauuaguacuuuuaccuuuggagguccucaaagcauuauuuggaguucauaauacuucagcuagaacuuauuccuucaaauuuaacucuguacccauuaaaagugguuuugugugcaauuaacagacacauguucuacccauacauuguuuuccaaaauuauuguguggcuuuaaaaaaaaaaaaacccacacaacaaauugcaaaaggcacugagauaacaucugcuucuagaucauugcuaggcucgaaaaauaaagcuuguucuaccaggaaugacaaguuagaacuuaguauuugccaaagcagaaauuauauagugucaguuauuucaggcaaaccuuauucggcucucauccccaacuaucugucagaacaauuaaaagagaucaaaacaguccagcauaacuaggcuucauuauauaaggccauuuuguucuaagacacuaauaaaccaaaauaagaaauauuaaaaucaaaauaaaagauauuauuugagcuauuuucauacaaacuguugguuccuuauauccucccuucuauaauaaagggcauauuuuacugcaaagaaaauuuuacuuuauauauaucacuagccauaaauuuuugaaugucauuaauuacauguugucuaguaccauuaaccaaauagcguaacuauuuuauguccacauuucacuucuguauuuacaaacauaucaguaaagaguuaacaaugagaugcgaucaaacauccauauuaucuguuuuguagacagcaauguagaugauuuuguaaucaccuuucaucggagugaccuuauauaaaaaauaagucaauaauuuagagguucuaagucuccaaaggagauuuucaaauguaaauauagaaaugguuauagauaaugagauuuuuaggaaaccucugccaugucugcauccuguuaacuguuauaucaucuuuucuuccagcugcguuccuuugccugcaacaggggucaagaugaguuuugccugacuucuuugauguccugaacuuuccguaguccuuuuucuugaauuuguucauuauaaauauagcuuggcauuuguuugaucuuuucaacugucuucacugcaucaguaguuuuauuccauaguucuugcagauauuugacaggcuuguuacuauauuuuucaaauucaaauccacuguaagcucauuauuagcaguugcuuuacagaaugcuuuaguccaccuaaccuuuugagaauugcacuucuuuuaaaguuuuugugacauuuauguuuauacaaucugaacaccuugcaacagcugcagaugaacaucaugauguggucaggguagaugggucccaaagaaacuaacacuucucagugcugagcucggaugggccuccacugaccaaacacggagcuugagaggaagucaagagguaucuuggaauuccacaugcugacccugucauucuugaaggaaaaugaugcauaauuucugaauaauucagaaagaacuuaacaaucuuuccaguuaguuuuuaaauaacaauucuguuuaucaaauuucugaauuaacuuuucugaauucacggguuucuaaaacuggccuuaagcaaaagucugaaaccuaggcugggaaccauguaacccaggccaagaagguacuuuaaagugucuuagaguuguuuuucaacuuagggggaaacaacagauuccauuaaaucccauaaaggauuuuuuugugugugaaaaagggccugauguaaucuagguuagacucaggaggcuuuaacaaguuuugucuuacggguaaaugguggcuauuuucacagauaacaucauuacucccaucccuuacuaugguuuauacaaaagaggcuggagaauaaguacauuuuuacagccgggugugguggcuaacgccuguaauccuacuuagcacuuugcgaggccaagacaggaggaucucuugagcccaggaguucgagaccagccugggcaacacagggagacccugucucuauuguuaaaucaagaaaaccuaaaaaacauuuucauuuacauagcaccaaauauaagagccuuuuuuuuuuuaaccuagaaagaguauuuuggagagagaaacuaaggaucagaagguuuaagaguaucaaaaaucugaggccaggugccucacaucuguaaucccagcauuuugggaggcugaggugaguagaucacuugaguuuaggaguucaagaucagccuggcuaacauggugaaacccugucuuuacuaaaaauacaaaaaaaucagcugguauggugguacaugccuguaaucccaguuacuuggaaggcugaggcaggagaauagcuugaacccagaaggcggaaguugcagugagccgagaucacuccacugcacucuagcaugggugauggagcaagacucugucucaaaaaaaaaaaaaaaaaaaaaaaaaaagaguaucuaaaauuuaaauacuaauucuuggcuggacaugguggcucacaucugcaaucccagcacuucgggaggccgaggcgggugaccucacuugaggucaggaguucgugaccagccuggccaacauggugaaacccuaucucuacuaaaaauacaaaaauuagcugggcaugguggugcaugccuguaaucccagcugcuccagaggcugagccaggagaauggcuugaacccgggaagcggagacugcuagaucaugacacugcacuccagccugggcgacagagagacucaucucaaaacaaacaaacaaacaaacaaacaaaaaaacaaaaaacuaaaucuuucacacauuuucucuuuauaucaaagguacuaagugacauuuaggccggacgcgguggcucaugccuguaaucccagcacuuugggaggccgaggugggcggaucacgaggucaggagaucgagaccauccuggcuaacacggugaaacccugucucuacuaaaaguacaaaaaauuagccaggugugguggcagaugacuguaggccaagcuaauugggaggcugaggcaggagaauggugcgaacccgggaggcagagcuugcagugagccaagaucacgccacugcacuccagccuggguaacagagcaagacucggucucaaaaaaaauaauaaguuacauuuaaaugucauauacauauuuaagaaaaaaaaaaaccaaguacuucucauuuaagacagaguagaaauuauuuaaaauuaggaguugguguaaaggaugagcuacauauucaagucaaauuauaguaaguauucacuauuccacuaccaaaguaggucaauuauacuaaagagaagaaaucuaugugaauugaggcauuuucucacuuugauauaugugaauaaauuucagguugucuaaauuccuaggguuauauaguuagaaauauauaauucucuuauagacaggucaacuaggggaaauaaguuagcacaaucauuugaauugguugucuacauacugggcagggcuuauuccuuuucuuuagcuucuuugcacauguaaagcaggccauaagauguccuguuuugccauggacaaugcaaccauuuuuaggucgaccuugacaaaucacacaagguucaauggcauuaaggggcaaacuagauuccacacucucuucuuugucuuggguuucuucccuuucaaacucuuucacaucuucuuggcugcuauaaauaaugcuacuagaaguugauggcugagaauagucuucacuuucuugugauugugaagcuuguguaauuuuaucaucauuuuccucaacacaugacucucuggaaucauucacuauaguuuuuuuacaaucaggaacaucaaagcccucuucagcuuguguugaguuuuccaguuuggcuuucucagagauuuccccuuuaucuuucccuuuaucuucaggaagccaauucucacgaagggcccaacaucuguugcaaugugauggaagggggggauucauuucauugcaugaagugcauuuccaauaguccuucaaugaaauaagacacacagucaguuucuguaacccuuuaacugcucagucacaggaaugcuagcaacuuugcuaugucuaagguaaaguauaucauagggcucaauauucaguguuucauguuuuauauaaaauagucacuguaaacagcaugaggacuauaguuaguuauauauugguauacuggaaauuuacuaaaagaauagauuuuagguauuuuaaccauacacacaagaaagguuaacuauucaagauaauggauuacauuaauuugcuugacuguagugaucauuucacuauuuacaugugugucaaaacaucacguuauaugucucaauuauacacaaaacagauuuuuaaaggucaauauguaacagucucuccuaaaguagaguaaguacacccauuuuuuucacccuuaccauccugaaaaauucuaaacuaaaaauauauuaacugugaugugauauuaaucauguaccuauaaaguuaucuguuucaggauacaaaugcaguugcuuccuuuaguugaagcaagucuaugggaucuuuuacucugucaugcagccuauauccacucccuuaaaggcucaacccuaggcgcuauuccaagaguccaucccaucaaucuagaugaaaccugccuccucgagaaagacuuccuaauccaccagugacuagaacuaccuuagaaguacucuaaaaccauggcuuaacugaguauucccuaacuccauccacaagagaaaugcuaaaacauuuuucacagcaaguauugcugcuaaaaccuaucauccuuggucacuaaccguaauauccuuuccuuuaccugucuauccuuuccuguguucucaucuuuguaacugcucaaugcuucuuccuuuucccaacguuuuaucccacaaaccuuuccaccaugcaauuuggauaacaaacucucccacauccccagccuuuuuacauaaccuaucuucuugccuuagcugaagcaugguucuugccugaggacauuuaacaagugaaaacucuuaaguaagagguauuuccguaaccauuuugagauugccucacaaaugauguuaagacaggagcaauaaagauagacuauucauucuucuuuuuucaaguuauagaaggggguuuuucacagcucauaaaaccaaagaaaaaggucuugcaauaugggaguaaaagugcaucaaaaaguccaauaaauuccaagaugaauaucuaaaauaauuugagucuuaaaauagauuuaaaaaauuaaaaguaucuaaaauauuuuacucaacuugacaucaaaugauucaauuaguuauuuauuuucuaauacaguaaaaauuuuggaaacucuugaauuuucauccuuuuuugcacuugaauaauuaguaacugucuauaacucagaaaaaauggaauuuauuuccuauucaaauauaauaaaggcaauauuaagaacaaaaacuaaagcacaauaguuuuaaaaaaaccuauaauaccucaggaacucagugaaguaugcaugagauguaaacauuuaaguguuaauuucuuuaauggcaaauccuaccacauucuauaauacaaaucaguaauaaaaauguuuacauuuggcugggugugauggcucacaccuguaauccuugcacuuugggagacugaggcagguggaucacuugagcccaggaguucaagaccauccugggcaacauggugacauuucuacaaaaaauacaaaaauuagcuggggugugauggcaugcaccuguuauuccagcuacucaggaggcugaggugggaggaucacuugagccugggaggugggggcugcagugagccaugaucacaucacugcacuccagccuggaagacagggcaggacccuaucucaauugaaaaaaaaaaaaguuuacguuugacaagguuggcaaaauguugguaauaguuaaagcugggugaugaguauacuggagauacacugaaauuuuccaaaauaacaucaaaauguacaaauucagcugggcagugacucaugcuuguaaucccagcacuuugagagaccaaggugggcagaucacuugaggucaggaguucaugaccagccuggccaacauggugaaaccccaucucuacuaaaaauaaaaaaauuagugggguauaguggugcaugccuguaauuccagcuacucaggagacugaggcacgagaaucacuugaaccugggagguggaggcugcagugcacugagauugcaccacugcacuccagcuugggagaaggguaagacccuguuuaaaaaaaaaaaaaaaaaaguucaaauuccagcaccuaaaaauaaaaauuauagcuacaggucucaucacaacaaauaaaagaaaaaugcuuuaaauuauucagacuuuacaaaaacauuuuaacuuuauaaaaaucaguucauuucagaaagaagcuagauauagucuccuaaucuugaccuuaaugaaauuuuuauuucuuaaaaaaguagauguauacuuacagcuaaggaaauuucaggaucuucuucaaaugaaucuguaucacucuccccugccugauacacaguaacuugauauaccuaauaaaacacauucauuagcaucaauucaucgcccuauuuccuucaaucagaaggcuuccuaguaauaaguccuaaacaaauaucauguacuacaauauaugagaaagccuuagacaauaucaaauagaguaagugaguguaaagggggaaaaaauggaggagagagaaauccuuacccacaaugguaaaagucaauacaaaggauguuuaggaugaauaaaacaaaacauucagcuaggugguuuuacuucauaaauaacuaauauggagauauuaaauaauagggaaauagcuagaaauguuaaaggcagucacuucugggaaacagaucucuaaggguacuacuugacuuuaacuguaugcauguuuuacuuuuauagaaaguaaguuaauauuaaaacaguaguugaauuauauguuuuuaaaagugaacagaccauuauaauaagcauguucauugaggucuauugacuucuuggcaauuaguaguaauauaauaauauaaaucagaugauaaagaacuaugaaauccucaaguccacaaaccaauguguuaguuuaaacaaaucaagagguaaagauuucaagugaaaucugaauaauauuauuucaaucucaaagucaaugaacauagaaaauauuuaauaauuuuccaauauaauuagaggggaaaaaaaauacuaccucaucaucuucaucugagaguucuuguccuucuucacuaaggcuauaaucuucugagucgagagauucaacuucaaauucuacacuaaacugaucugaaacugaauccugauccaaccaaucaccugaauguucacuuacaccagcaucaagauccuaaaacaagaaaaaaauauauaacuuaauaaacaucaccucuugaccucuguaucuguuuccuaacucaucccugugccucugcugcugccagcaggguguaacaguugggggaugggccugcugcucugauccgggacuucccgagggagaucggcgggcagaagacuaggccccccagccagccaucccggagccgguugccacgcacauuuccuccucagauccauccugcauacugaaacuagauuaagguuucaagguuauuacuacauuauuuucccuguucaaaaccccacugcauaaaggaaaaacaccaaagccucuuggcaucgaaaguaccuacagugugacuguauuaacaucuucgucugucuucaacuagacaccccuccucccuuacuaaauauggauaaucccgccagaucuagauugcuuccucaacuaaucuuggcauuucaacuuccacacuuucccccucuaacuagaauaauuucaguuucaaaauccuauucauccuucuuugacuaagccuuugucaauaccauaacugaaaaggcucuuccaccuuuaauuauccuuacuacuuguauaauaaugaauuauauagucucacacauaaauuaugcaaaacauaauuuugcaggcauguuucucaucugaauuauauauacuuugagcuaaaaccugucacucaucuuucuauguccaaauugguagaauacacguaacaagacacaacacuuguaauacuuauggguuuuuuuucuuagaaaaaugucucgagucauagauacuuauguuuuuuaauaaacuuugagauuuucuuuuaaagagccuuuagacaauuaaaaaaaauucuguagcugcucaucugauucuucguuucaggacuucaauaaauuguauaagaaccuaguaagaccuucagggcaauaauauuugcugucaguggcuaaggguaggagcauauauaagcagaaggcuacaauuggaaaaagucuagaagucgggauauggcuuauucuacacuugccacuaaguagcuaauuuaaccuuaaacaacaucauuuaacuuauuuuauuuauuuugagauggaaucuugcuccaucacccaggcuggagugcaguggccugaucucagcucacugcaaccuacaccucccaaguucaagcaauucuccugccucagccucccaaguagcugggacuacaggcgcaugccaccaugccuggcuaauuuuuguauuuuuaguagaggcagggcuucaccauguuggccaggcuggucuugaacuccugaccucaagcaauucaaccgccuuggccucccaaaguguuaggauuacaggugugagccaccaugcccggcccuuuuuuuuuuugagacaagagucuugcucugucacccaagaugaaaugcaguggcaugaucucagcucacugcaaccuccgccuccgggguucaagcuauucuccugccucagccucccaaguagcugagauuacagguguccacuaccacacccggcuaauuuuuauguuuuuaguggagacgggguuucgucauguuggcugggcuggucucgaaauccugaccucuagugauccgccaccucggccucccaaaaugcugggauuacaccugugagccaccucgcccagcccauaucauuuaacuucuaaaggcuguagcuacuucaucuagaaaaggagcuuagauuaaaugauuuccauaucuguaucaguuuuaaaaacagaaacaaaguauauuauuuuacagccucugacaucaaaagacuuuuuuagaguaauguuaggaaggagaguaaaagcaacauucaucaaguugcagcucaaauuccuaacaagggcucuacuaccaaucagauuagaaucacaagucaaguuaggauacaauuaacacuaacaaaguaacccaacaaaccaaauacuucaacuaacuaaagucuuuagugcacuaauuuuagaauaaggggguaaaucacaagaaacauuaaaucucagaaaacauacucuacgguaggggucugcaaacuguggcccaucacccaucgacuuuuauaaauaaaguuuuauugaacacagccaugccuauuuguugacuuguugucuacaguugcuccugcauuacaagagcggggcugaguagcugugacagaaaccauggcccggcagagcccaaauaauuaacuauguggcucuuuacagaaaguuugccaacuccuguccuaggauacuauaaaaauacuauaaaaaauaccaugaaaaaaugcaauauugggagugguuuuuaaaguuuuggcuaauguucgcaaaagaaugccccagaaacuauuaaauuaucucucucuauauauauuuuuaaaauauauaaaauaaauauuuaaaauauauauuuauauuuauauaaauaguaauauauauaauauauacaggugccugcccauuuauauuuacauaaauauauauuuuuauauuuauauaauuauauuuuuauauuuauauaaauauauauauuuauauuuauauaaauauauaauuauauaaauauauauaacaauguaauauauaauauacauuaauauauaauagauuuauaauuauauauuauauauuuauacauuauuuaaauauaaauauauauauauauauauuuuuuuuuuuuuuuuuuuuuuuuggagacagagucucgcucugucacccaggcuggagugcaguggcaccaucucggcucacugcaagcuccaccuccuggguucacgccauucuccugccucagccuccccaguggcugggacuauaggugcccgccaccacgcccggcuaauuuuuuguauuuuuaguagagacgggguuucgccguguuagccaggauggucucgaucuccugaccuugugauccgcccgccucagccucccaaagugcugggauuacaagcaugagccacugcaccagaccuaaauacuauauauuuaaaaagcaucaggcuggaggugguggcucaugccuguaaucccaauacucugggagccaaagcaggagaaucacauaagcccagcgguuugagaccagccugggcaacaggccaagaucucaucucugaaaaaaaaaaaguaaaaaaaauuagccaggugugguggugcacaccuguagucccagcuaacucucaaggcugaggaggaaggauugcuugaacccaggagguugagguugcaguaagccaugaucaugcgcugcacucccgccugggcaacggagugagagacugucucaaaaauuuaaaaaauauauauuuuuuuaagcaucagauaggcuugcucugcaaagaucuuagaucuuuguagucaaaaauaccuagaauuguuugaauuccaauugugacaauuaguuguaggaaccuuaaacaaguuauuuaaaaccccagucuuagcuaaaaauggaaucugaggcugcaaagaugacagaagaucauaauauaaacugcaugguguacagucuagaacacagucuuaguuucccacaauuuauuaaaccccaaagaaagaaaagaugggagaggaaugcacuuuccuuuaacucccuucacaaacuggugaaugaugacacccaaugaugacuacaacauucucaaaugagggaaauuaaaacgaagaagaaaaaaaaacuggcccuaccaaaagcuuucacaacuagggacuuaaccugaaaaacgagauuuuguuguuguuguuugagauggaauuucguucucguugcccaggcugcagugcaauggcgugaucucagcucacugcaaccuccgccucccggguucaagcgauucuccugucucagccuccugaguagcuagauuacaggugcccgccacuaugcccagcuaauuuuugguauuuuuaguagagauggguuuucacaacauguuggcgaggcugguccugaacuccugaccucaggugauccgcccgccugggccuuccaaagugcugggauuacaggcaugagccaccacgcccggcugagauuuuuuauagauaggauuuuuuaagagaaugcaggacaggacuaacaaaaagaaaaaaagaaauaccccucuacuccacacgaguuauuaagaaauuauuuuaggcaaauggagaggaaaagugguccuuggaagguuuuucguagcuccagaaaaauuucuugucuagcauaaaagcccuggcucuuaaaggcuggcaaccuuuaagaugcaaaugcaagaggguccacccaacauggcgauucccaccguuguccucuugcccuugcuccaucagguaccuaacagcauggccgcccccacauaaccccguguguaaaaugucauggcauccugcauuuguguauuaaaggacuggggugggagggccaguuuucuugagggcuaaaugacaugccuggucaaaccaauccucugagcccuaugcaaauaagacaccacccccuccagccgucacauaaaacuggcuaguauugucagaauguaaggucuccucuuucagcuuuagagccccccucccucugucuguguaagggggagcuucuuccuucugccuucucccuucuugccuauuaaacgcucugcuccuuaaaaccacuccacguguguccgugucguuuuaucuaauucaacucaaaacaaaaaaccugguguuccucuacuccucaaagccauaucaguaacaaggcagugucccagguacaaagcaggaacaaggacucuaaauaucauucagcuagaauucugauauaacuuuaacaaaaacuauacauuaaauagggguccgggcagguggcucacaucuguaaucccaacacuuugggaggccaaggcaggcagaucacuugaggucaggagcucaagaccagccuggccaacauagugaaaccccaucucuacuaaaaauacaaaaauuagccagguguggugaugggagccuguaaucccagcuacucaggaggcugagacaugagaaucgccugaaccggggagguggagguugcagugagccaagauugcaccacugcacuccagccugggagacagagagacucaaucucaauaaauaaauaaauaggguauaauaauucucuuuuuaaccaaacuuguagguuggauacucaucaaguuuuaauuggauucaauuuuaucacauauauuuccgcucaagagccuauuuuuuccacuggauuuauuaaauguuuucauuuuugucauuaaugaucuaucucccaaugaaggcaagaaccauaucuaccuugacuaccacuguaucugcagugccaucucaacuguauggaauuugguauaaacuuaaauaucuacaaaugaagaaccugcucucagacugagcaggagcucaucaugccaucuagcggucuacauaaguaacagcuccguuagguacaguaacucuagagggcagguaugcguucauacaaucacugcuuuggaagagaaaaaaagauaauacaggaaguaacaagaauagguaaaagacuaggauuacuaucacaauugguuccacuuccuacaucuucuagaguacuauacaaugauuacuaauacccagaauaauggccaugagacacugccauauuaccaaaaaauguauccaauccuuugguuuccgugggcgacauuggaagaauugucuugggccacacauaaaauacacuaacaauagcugaugagcagaaaaaaaauuguaaaaaaaaaaaucauaauauuuuaagaaaguuuaugaauuuguguugggccacauucaaagccauccuggcauauggcccacaggccauggguuggacaagcuugauuaaagacauacaaaacaaaauauuccauuugucaagcauucuuguuaacaaaaaaauuuuuuaccaaacuucuuucagugacaucucuuaagaaaugcugcucacuaauauuuuggaagucuguauuaguaaugagaaaguacugauacucucccgucauccaugcaauaauaaaccugcauuuuuuuuuuuuuuuuuugagauggagucucgcucugucacccaggcuagagugcaguggcacaaucucagcucacugcaaccuccaacuccuggguucgagcgauucuccugccucaggcccccaaguagcugggacugcaagcaugcgccaccacgccuggcuaauuuuuguauuuucaguaaagacaugguuucaucuuguuggccaugcuggucuugaacuccugaccucaggugauccacccgccucagccuccgaaaguacugauuacaggcaugagccaccgcacccagcccaguauaaaccuguauuuuacagcauaaguaaauagaacuuaccugaugucuagaccuauuuggcaaauguuaaguucagacuaugcugacuuuuuugcugauggcuguaauaaaauauauuuuuacucuaaauagucaaauuugccuuaaaaugcuaaaauauuuaacugaaccaaauuuuugguuuuguuccuuuuuuaaaaaguguaacucucaaauucucaaacaacucuauacuccaauuuauuugacuguacuauuggugcagugguccacaaauauucucuaauacauacagugacauugauaauuacuaauacuacuacuaauuuuaccaauaccgguguuacuccacuauuuuccacauuucucacaauaccuuggguugaagguggagaucaauauaguaguuuuauuuuaaaguaaaauuuagcacuguguuuucuaucaaucucguaagacacauguacauucuauccguauccuuauuaggacugccaggacuagacuuugaacaguaagagucuugccuuacuuaaaaugagaacauuaccggauucgauggcgucccuguagauucacugcuacugcuucuuucacaacauaucucccuuauuacacacagagccaggcuuucaucaaaggaaagggaaauacuaucagauuuguggcguuuucuuugucguucaccagauaauucaucugaauuuucuucuggauauguaaggaaaaaaaauaaauugcuguacugugauuuagaaaauugagcuguuuugaguaccuauuuguacagaaacuuaguuucaauaaaauuaguucaaaaguuaacacuguuuuauugaaucuguccaacuguuacagcagaacacuaucuguguguauuuauuuauuuguuuauuuauuuauugucugagaaagggucuugcucugucacccaggcuggaguacagaggcacaaucucggcucacugcaaccucugccucaugggcucaagugauccucccaccucaaccucagccucccgaguagcugguaccauaggaacgguaccauaggaaugcaccauuuuguauuuuuugcauagacaggguuucaccauguugccuaggcugagaauacuauuuuuaaaaagcuuucuauucuucuuucagaacuuuaucuccauacaucacaauuuaaucuaucuaauaaaguuuuuauuaaccaaaaaaucuaggaauuuuuuucugucaaaaccaaacuuuaaaauauaagagcucaucuguuuuuuuccgaaaagagccaaaguguuuaauuuacucauaugguauucuuaauguuucaauuucuucaguacccuacacuuuuucuuuugagacagagucacacucgaccacccaggcuggagugcagugguacauucucagcucauugcaaccucugccucccagguucaagugauucuugugacuucagcuuccaaguagcugggauuaaaggugcacaccaccaugccuggauaauuuuuguauuuuugguagagacaggguuucaccauguuggccacacuggucucaaacuccuggccuuaagugauccuccugccucagccucccaaagugcugggauuacaggccuaagccacuaagcccggcucuucaguacccuauauuuuaaacagaaaucaaaaccaguaaaaaguuuccauuucauuuuaaauaauaaauuaucucugaaugggucagaauguuagacaaauccguuagacauaaaugagaauacuaccuuauacuagacauaaaaaugaauuccagguggauuaaagaucuaaauauaaagaacaaaaccauucaaguaccuauaacaaaauauucuuauaaugcugggguggagaaguauuucauaauacugcaaaguccucaauaaaaagacuaucaagauuagaccaugucaagguuuacaugacaaaauaaaauaccaaacaaaaguuaaaaggcaaaggucaaauucgaagauaauaucugcaacauauauaguaaaaauuacccauaguauacauauuauacaaaguccuaccaaaucaagauagacuguauuuucuuuuaaggaaacaggaaaaagcaagucacagaagaaauacaaaugacuaauaaacauaugaaaaaucuugagucauguacuugaguaauagaaaaaaaaacucuuaccuccuagggaucaaagaaaugcaaagugaaaugauaucauuuuucacccaugagaaugacaaaaauuaaaaugagauaguaucacagauuucugaaaggacuuuuuuuaucauuuucuugagacaaagucucacucuugucccccaggcuggaguauaauggcacaaucucggcacacugcaaccuccaccuccuggguucaagcaauucuccugccucagccuccugaauagcugggacuacaggugcccaccacugugcccggcuaauuuuuuuuguauuuuuaguagagacgggguuucaccguguuagccaggauggucucaaucuccugaccucgugauccucccuccucggccucccaaggugcugggauuacaggcgugagccacuggaccuggccgggauuuuuacguuuuaucgagaucacaaguucugcacgugaguucuuaaucauguuuguguucccuauuuuuaaaaaggugaucuuggccgggcugcaauuauaaauaaugcuguaauuaguaucucuacauauaaaucuuugaauuuuuuauuacauccuuaggauagauuacuagaaauggaguuacuaggauaauguuaagaacucuaagacuuuuuuuucuuuucuuuuuuuuuuuuuuuuaagagggagucucacucuguaccccaggcuggagugcaguggugcgaccuugguucacugcaaccuccacaucccagguucaagcgauucuccugccucagccucccaaguagcugggauuacaggcgccugccaccacaccuggcuaauuuuuguauuuuuaauagagaugggguuucaccauguuggccagguuggucucgaacucuuaaccucaagagauccacccgcuucggccuuccaaagugcugggauuacaggugugagccaccgcaccaggccaucuaagcuuuuuuauaauccgaaaaauuuaaucaauuuuuacccacuuuuaccaauuuacagaccaacaguuuaucagugcuaauacacaaguuauuagcacugaugaguaaggaugaguaaaaauuuuauuuuuacuaauuugauagaucaaaaggacacccuuuuggcauuuuuuacuaucuguaaagcuaaaaaucaccaaaauucacccucuccccauauuuauuagucauucguauuuacugugagaaauuuuugugaacugucugcccuuuuugcuauuugaaguuuuaauguuuuccuuauugauuugggaagacuuuuuauguaauacagauauuaacagucaaauuuaaagugacuaucuuucaaauauguuguauucuauuuuucauuuaacuuuuaaacucauuugaaauucauuuuggcauaagguacagaucuaacuucaccuuuuccccaaguaacuaccauuuguucuaguuccaccucugcccuagacaccucugcccuuccugucuucugcccgcauguacgagauucuggucuggguucauuuauucuguuucacugaucugacauucucuuucaucugaaucauacggucuuaguuacugcgacuuccucaggcaacagccuucucgucuacuacgucuacuaacuguucucaacuauuuucucucugucaacuauuuucucucucucucuuuuuuuuagacagucucacugugucgcccaggcggagugcaguggcgugaucucggcucacuguaagcucugccuccccaguucaugccauucuccugccucagccucccgaguagcugggacuacaggcacccgccaccacauccagcuaauuuuuuguauuuuuaguagagaugggguuucaccauguuagacaggauggucucgaucuccugaccucaugauccacccgccucggccucccaaagugcugggauuacaggcgugagccacugcgcccggcccuuaucucuucauuucuaaaaugcuauuuacuuucuguuuuaaaacucauagguauguacuaccauuuauuaaaaauaacaauuuaaaaauuuaacuguuaaggugacuaagaauaauggugaaaauagaguuuauaugccugucuccuauuaucuuucuuuuuagacgaagucucacacgguuacccaggcuggagugcaguggcgcaauuucggcucacuguaacuucuaccucccggguugaagugauucuccuuccucaaccuccugaguagcuggauuacaagugugcgccaccaggcccagcuacuuuuuguauuuuuuuuaguagagaugggguuucaccacguuggucaggcuggucucgaacuccugaccucgugauccgccagccucggccucccaaagugccgggauuacaggcgugagccaggcgugagccaccacaccccagccaccuccuacuaucuuaacagagaguuggcuaacuauaaacuccaguggggcacaguaaacugugccugcuguagucagccagaaaaauauugcuaaauaagcaauuuguaaaucaaauaaaaucacgaaugaaaaaaacucagagguuaauucaucucaaccaaaaaaagggaacaauuuaauuaagucuaaaagcacuaauuucauuagagaaagaauaucaaaaagcugugugaaugcgucaaauaaauauucauauauaccugucucacuaauugcucuccuucuagaugagguagauggucuagaaaccaaaugugaagaugaagguuucucuuccugaagcucuuguacaagguccuaagcauuuaggaaaaaaauaaaauacaacaaacuuaacauaaccaguaagcuaacuuguuguaaauaaccuuuccaauuugcaaauaauauuacauuagaaugagaaauuuacuuagauuaccuuuugaucacucccaccuucaaggugacaccuguucucacucacagauguaccugaguccgaugauucugagagaaaagaaaaaggaucagaaacuugguggugggcggggggcggcggggcgcuacucaguagauaugcuaucagucuaacacaaacccuuaugcaauuuaaccuuucaauaaacauuaaacauguauuuuccagguggcauccucauacuaaauguugcagauguaaauaaaauaauucaacuuuaauguagaagaguaaaguauaaucaagacauuaaaagacuguuagauaaauuagcagagagacaggagagucauuauuuugguagggacagggagugucugagaaacaaagaaucaggaaauauuuuguaggacaauaugaaaauagggcuaggaaaggccauuccagaccaagaaaacgccaugugaaaaaguauccaaaagcaaacuaacaacaguuccuguugcaggacaccacaagcaguucauuauuacuggaauguaggcagguucagacuguaaaggauccuguggucuagccaaagcaggacucaugcugucauucccuuaucacugcauucuuccccgcagauacuucagaaucuuccuuaaugcgauguugcagccacucaccauuaaaaaggauuuuuguccaagaaaugaaacugauuucuagcucacagaaaauauuacauccagagagcaauaaugaaccccuaaaugguaauuuuaagcagaagagugacaaaucacucuagcaaaacauaagaaaaagagggcagaggcaggaaaaccaguauuagacaauugcaauaauacaaacuaaaaacuauuaaagccuaaacuaaggcauggaaaacaaauuccagagaaauuaaauagguaaaaaccaacaagaccugguauuugauauagaaggcaaggaagaaaggaguuaagaugauuccaagauuccaacuugggugaauaaaugagugguaccauucacuaaaagagaaacuuuagaaagauaaacagauuggaugggaagauaacaaacugaguuauucaggcacauagguuucauuuguaguuggauauacagacuuugagcucaaaagucaaaguuucagaguugggauauacagacaauuaucaucaaauacccuuuacuaccccccuuggaaacauuuucaucuuaacagugaacucaugccuggacauuaacauuuugaaauuaugcauuaucauagauuaauuuucucuuuauacuauggguaaggcauuacacuaauuuucuuaaguuguacauaauagguuauauuguccaggaauuuuggauuaguauaaacagaugcuacaaaaaagauguaauaaaaaggaagcccuaggcugggugggugcaguggcucacacuuguaaucccagcacuuugggaggccaaggugggaggaucaccugaggucaggaguuugagaccagccuggucaacauggugaaacccuuucucuacuaaaaauacaaaaauuaaccggacgugguggcaggcaccuguaaucccaccuacucgggaggcugaggaaggagaaucacuuaaacccgggaagcagagguugcagugauccgagaucgcaccacugcacuccagccugggugacagagugagacuccaucucaaaaaaaaaaaagugacaaaguugagaacauggaauaggaguucugaaguuaauucuacugauaucuaaaccaaacucagacugcaaauaaguaauuuguaaguuuccaucucaauaauacaauuuuucuaguaaugugccaaaguuuauuuaaacaaaugaaggaaugaauacaucaggguuacauacuucagaaaacucaaacuacuacuacaaauacuacaauuguauauuuagcuaucacacaauuucuuaaagagcuuuaaaacaacagguauacauauguaaccaaccugcacauuguacacauguacccuaaaacuuaaaguauaauaauuaaaaaaaaaggaaauaaaaaggauacaaucuaaagcucaaaaaaaaaaagagcuuuaaaacaauaaaaugccaaaucaucagccuaauaacuacuuuuauuuugggauaaaauggagauacuuuucugggcuuuaaauccuaacuuuggaagaauaaguauucaauucaacacauuuauuaaauaccauauuaauaaaacacuauagugugugaugcacaaugcaaaccugaauaggacacagguaacaaaaauauaaacaagugcaacagccagacgcaguggcucaugccuguaaccccuaaacuuugggaggccgaggugagaauaucucuugagcucaggucaagacuagccugggcaacauagcaacaccgucucuaccaaacauacagaaaaauuagccaggcgugguggagcacaucuguagucccagcaacuugggaggcugagggggaggaucauuugagcccuggagguggaggaugcagugagccaagauuaccacugcacuucaagcagggugacagagugagagcccaucucaaaaacaaacaaaaaaacccacaaguaaaacaaagcaauuuuacaauaaaaucugaauauggaauagaggaaguacaagggaguggucaauucauucuaggaacuaaacaagcuccugagagguguuuuuuuguuuuguuuuguuuuugucuuuuuuaagagaugaggucuugcucugucaccuggacuggauggcaugaucacaguucacuacaguccugaccucccagccucaaaaaauccuccugccucagccuccugaguagcuaggacuacaggcaugcaccacuauaccaagcugauuuuuguaguuuuugcagaguuaggauuuugccaugcugcccaggcuggucuugaacuccucggcucaagugauccuccugccuuagccuccuaaagugcuggaauuauaggcaugagccaucacaccuggccuaagagcauuucuuaacuguaguucgaggaugggcuuuaggagcaguguaguguauuagagacagcucuaagcagcacucaaaagcaaacugugagaccgggugcaguggcucauaccuguaaucccaggacuuuggaaggccgaggcaggcagaucacaaggucaggaguucgagaccagccuggccaacaugcugaaacccccucucuacuaaaaauacaaaaauuagccgggcgugguggcauacgccuguagucccaucuacucgggaggcugaggcagaagaauugcuugaaccugggaggcggagguugcagugagucgaaaucaugccacuacacuccagccugagugacagagcaagauuccuucucaaaaaaaaaaaaaaaaaaaaagcaaacuguguacaucucuucccaacuccauguuuuuagccuucaaaugagaguauuauacuauggaagucagcaagcacauaaaucagggcuuuucucauggaaaguagguuguaaaacacuuauugacuuacccauguauauauacaugugcaucuuucuggaacaagaacccaaugcuuuuaucagcuuauuaaagagagaugugacccaaaaauaaccaguuaagaaacggaaguaggaacauaaaauuccacuuccacaaauugguaaacaaaauuuugucuauaaccaaagaaaaagacucauccuucauccuuacacaugguccuaccuagguaacaauauuauuucccaaagccuuucaauacauuuucaagguagaucacuccuaaacaggagcuuuugaaauuacagaccuuucaaaauaaauccuaacucugauaucccaagucuaaauugaucuaacaggauauuuaacuuuacauuagaaccucaguaugugguuuuaguucauauguacuucuaauaaauuuaucauacuuuuauuacaauauuuaauuaaagcaacuuuuaaagagaaucacaauuauaaaacauaugcacauaaacaaaaaugucuuuaaaacguuuuuaugguauuuauccaugaugcucaaaauuaacuuacccugcugauugacuacuaccaaguuccuguagaucaugguauauauuuuccuuguagacagaaaaaaaaaaaauaacaagagauguacauuuuagaauaaaaauuuguauuaagcuggaucuaaccagacuucuacauacauacuuaguaugaacuacugcacacauucaaaaccaaauuuaucauuggcaagcuuguaggcacuuaaaagcacaauaauuaguagcacaaugauuauguacagcuacuuuuaauaauuacuaaagucucucuagcugaaagauuucacacuaccaauuccugaaaugugcuuuguuuggacuuuaccagaagacccccaaaaaaugaguaugcaagcaggaagagguugaacauacuuauuuucaaacaggaauguuuuuagcucugugcuuaguagcaaacugccaaaaaaaagcauugaguuaugcaaaauccauuaaauacaaacugccaaaaaaacuauugaguuacgcaaaauccauuaaauaggaauuugauuauaaucuugacuuucaucaagcuucaacuuccuuucuugaucuuaaaacguauuaacagaggccgggcgcaguggcucacagacaccuguaaucccagcacuucggaaggccgaguccggcagaucacccgaggccuggagcucaagaccagccugaccaacauggagaaaccccaucucuacuaaaaauauaaaauuagcugggcaugguggcgcaugccuguaaucccagcuacucaggagacugaggcgggauaaucacuuaaacccgggaggcagagguugcggugagccaagaucacgccauugcacuccagccugggcaacaagagcaaaacuccgacucagggaagaaaaaaaagaaacuuauuaacagauaaagcaguacucauucauucaauaaauacagacugaaaaccuaccacguaccagucacugguacuauguaccagacacgggggaaaacaaagaaugaaacagaaauguauaugcccucaugaaguuuauauccuaacaggaggauaauucauuuaccccaguauucguugaugucacaauggauuuuuccuuuuguuuuuaaacuaaggauuuaagagaguguuugucacaaaauauuguuucucacucaauauuaagaggaaauaugaaucccaacuaucuuuuuucauccuugggaauaaggauacagcaaccuaaacccacaauauuuuuaauucauauccuuuucaagucaguaauuucuccuauuucuuaucucucaacauuuagaauucaaguccaaggaaaucauacuuccaaacauuauccgaagauucaauauucagaccaggcacaguggcucacgucuguaaucccagcacuuugggaggccaagacaggcagaucacuugaagucaggaguucgagaccagccuggccaacauggcaaaaccccaucucuacuaaaaauacaaaaaauuagcugcucauaguagugugcaccuguaaucccagcuacucaggaggcugaggcaagagaaucgcuugaacccaggaggcagagguugcagccugggcaacagagcaagacuucaucucaaaaaaaaaagaaaaaaaauagaagauucaauauucaauagguaaagaaaucaccaauauaccaauauaguuauuuuuaaaauuuauaaaauuaaaccauauauaccaaggccacguauaaaaugacaacauauauggauauuaaacagaagugacucaucaauaaaaaauaauaauuauacauauauuuguaauauauauaauuauauuauauguauauuauaauauauaauauacaaauuauaauacaaauuaagaagcuagaugaaauuuaaauauaguacuauauucauaacuagguuaaaacacacaguugcacauaauacacaaaugacugguaaaaauaccuuuuguuaacaaacuacaguccuuuuuuuuccuuuacuuuucuuaguuuucugucaucuccuaauguucaauaauaauauauacuauguuuacaauaauaagguuguuuuaaaguuauaaaaucccuugcucagcugaggaaguuauguuuuuuaauaaaauaaaaucccauuuaauuaucaucuuuucagcuauacuauugagcauuaaauacuagcagaagcuaguuaauugucucaggugaacguauucauuccauuuauuaauguaaugaaugcuaaggcucaacacggauugccugugcuaaaccaaaugugacaaagaauuccaaauguaggccgggugugguugcucacaucuguaaucccagcacuuugggaggccauggcagguggauuaccgaagguuaggagcucaagaccagccuggucaacaucgugaaacccugucucuacuaaaaauacaaaaauuaggcauggcagcaggcaccuguaaucccagcuacucgggaagccgaggcaggagaaucacuugaacccaggagacggagguugcagugagccaagaucaugccacugcacuccagccugggccauagagcaagacucccucucaaaacaaacaaacaaaaaaaagaauaauuuuagaaaaauauauauuaaaaaaauuuuuuuuucagaugcaguuuugcucguugcccaggcuggagugcaguggcgcaaucucggcucaccucaaccacaaccuccaccugccugguucaagugauucuacugccucagccucccgaguagcuggaauuacaggcaugcaccaccacacccagcuaauuuuguauuuuuaguagagacaggguuucuccauguuggucaggcuggucuccaacucccaaccucaggugauccacccgccuuggccucucaaagugcugggauuacaggugugagccaccgcaccaggccuauuucuagaaauauuaccuggguuaaauucugcugguuaagugccauaaugauaggugacaaugaaaaugaucuccaaaauaacuaaggcucaaauguaagccuuuaccacguggugguauacuguuucuggaauaaaaaguuauaauagcuacagcuaauacuugaaugcuuuguaugugcccaaaacuaugcuuuuuuauacaacgucucucuucaagagcuuuaaccuccacaugaaguauuuaauuaucccuauuuuauaaauggggaagcagguuuaaaaagguuaauuuaucuagucacaaaacuaguaaaugauugggcuagguuucaaacacugguuuauaagaugccagagcucagguucucaaauaauaugccgcagagcuaaaaaauuaaguuucagcaugucuuuaauauguuucaacaguuuuucucugacaaaagugaaugaggguagaggugaacugaaauguuagcccagauggcuuuuuacaauggacuaaacugaagaauuaccugugcucuuucacagagaagcuuggcacgccaaacaaaucuccuagaagaucauuugaacaauauacaauauguuguugcuucucaucauauaaucguuuagucauaauauacuggccaagauaaaaaagaaccugaaauacaaauaugauuucugagcauuaaagaaaacuaaauguuaguuguaaauacauuuaauaauauccuauuuaucugaauagggguaaacaaccaggaaccauauccacaacuauguagaacaaccauuuuguacuuagaagcuacuuuuggcugggcgcaguggcucacaccuguaaucccaguacuucgggaggccgaagcggauggaucacgaggucaggagauaaagaccauccuggucccaucucuacuaaaaauacaaaaguuagccaggcaugguggcagacaccuguaaucccagcuauuagggaggcugaggcaggagaauugcuugaacccaggagguggaggcugcagugagccgagauugcgccacugcacuccggcuuaagcaacagagugagacuucaucucaaaaaaaaaaaaaaaaaaaaaaaaaaaagcuacuuuuaagccuuuuccauuuaauuugacagaagcagaaauaacugcuucucuauuuacuuaagcaaaccuuaaaaugugagguuuuuuuccuuguagacuuuaacucugcccagauacuuagauacuaacauauuaggaagggaaaaggcagcaaaauaaaaaacugauagccaaaaaaguugcagaaacaaaaaucaacuaaaauauggcaguggucuggagccacuuaguaaauagucauaaauacuauaaaccucaauagccucugaggucaccagaggaggaagacagaaaaacaaucaaucaaugacagcuacaaaacaguuugagagaauucugagaaugaaauaaacccucuaagguaucaauuuacuccauauuaugauaaauaaucaaaauaaugacuuugaaccauuaauaaaaguuaaauuauauucccugugcugcauuaagacaagaaguuggcaauacauuuuuaagauauccagauauaaaccuauuaacaacuaccuaaauacauauggcauuuuacaguuuacaauguacuuuuauaaguauuaucucauucugauauuucauaagauuauuaucacuguauuagaaaugaagaaauugcguugggcacaguggcucacaccuguaaaucuagcacuuuaggaggccgagguaagcagaucccuugagcccaggaguuccagaccagccugggcaacauagugaaacuccaucucuacaaaaaaauacaaaaauuagccaggcauagugguacaagccuguaguccuagcuacugcagacacugaggugggaggaucaccugagcccacgagguccaggcugcagcgagcagugaucaugccacugcacuccagccugggcaagagagugagaaacugucacauaaaaaaaaaaaaaaaaaaaaaaaagaagaagaaacuggccccagcucuucugacucuuaauccaacgcucuuuuuacuacccauacuagcuuucacuaccuuccugugugccccagaacaaagauccuauaacugagaacuauaucagacaauacauacacuacuguuacauaguuuagcauaagcauucuaagucuuuaugauggccuuggccaauuuucucauuucuaucuacugcuaaauccauacuuuuuuguuuccuuaacugauuauccaaugauaauaaggucaaucccaaauuagccuuaaaaauaccauuuaaccuggcccuuuccuacaaacacugucuuuggauuuaacuggcuaagcaggcaucggccuuaaaggaauauucuuaugugacuguggauuggacagauugcuguccagcagugggaaaggaaaaaggaagagaacuuagauuuauucuaccaaacauccuuuaaggaaguuucuaaaaguauagcuggagaggaaaaagaaaaauggaagcucuuccugccccacuauaccguuguaagaaagaaacuuaaauguuuuaaguaaucugagucccauaaacuaagugggagagacagagaacaggcauauuucaaucacacugaaauucugccuaagguugcucaaucugucacugaaaaucaugcuucugugcacaaauuuaaagguggggaaugcauuaaaaugcuggaaccauuagauagaauauauggucaugaaucagcucaccucuaucccagaaagaucaguauacuguacucauguaucucuagugcagaaguucuuaaccugggauccagggaugcccaagaaguccuuggauagaauucaggggguccauuaauuuggaugggaaaaaaaaaauucuauucuuauuuucacaaacuucuaacuagaauuuagcuuuuccuucgauuauaaauguaggcaacaaaucacaacaguauuaauaccugugauuucaucaccaacaaaaaucagagguguuuuccuaucauacuguacuuauggcaaacauuucaaaauaugacuuauauuccucacuauaucaagauaauauuuauuggccaggcaugguggcucaugccuauaaucccagcauuuugggaggccaaggcaaguggaucaccugagacuaggaguucaagaccagccuggccaacauggagaaaccccaucucuacuaaaaagacaaaaaauuagccaggcgugguggcaggugccuauaaucccagcuacuuggaaggguaaggcagaagaagggcuugaaucuaggaggcggagguugcagugagcugagaucgugccacugcacuccagcuugggugacagagcgagacuucgucucaaaaaacaaaaaaacauuauauuuauuauaucuucuucuaaaucuuaguauuuauuauguuaauaacaaaagcacacauaucacaaacuaguuuacuauuuugguaaccguauuuuaguauguuuccuuuguaauucuauacauuuuauuucauacauuuaaaaacaugauucugggaaggagucuaccaaaggguugacagcauaaaauggucaagcacccuuacggggcuuccauuuaucugaguuccuagcugagaaaugaaacucgaguauaauuagaauuuucagcuuuaaaauauaguccaaacgaccacaaaauuaaauguugcugcuuaaugaaaaauccuucuauauggccaauuucuccacauggucuugaaaacuuuaaguauggcuacauguaacuagugagauacuacuuaucucuugauucagcuuaccucuuucauaguauaagugucuuuuugugcaccaacagacuuuaauaacuucaaaagcaauggcuuuggucuaaccuauaaagagaaaagaacugcuauuauacuuccaaaauuaucccagaacuauaggcccugcagcaaacauauccaucaaguucaauaaaggggauuuggaaaaaaugcuggggaggaucuaaucauuaugcaaguaucauggaaucaucaaguaucaguugugaucacagacaguauccaauccaaaagagcaaagauuacuuuuuccuucagcuauuuauauuaccugcuuacugccuuacaaacaaccauaaauuacugagauccaaugagcuuaccguacugauccaacgagcuuauugcaagcuaacuuagagaaucaaagagaaaugaauaaaucuuuagaguggguccuguuaucaaucuucucuuucuaaagauuagguuccugaaggcuagagaaccuaacuaacuaacccaagcugacaaggguaauuaagaacagaucagagauaacaacccaggucccucaacuacaacucagcauuuucuuccuacuauaucaugcugccucuuaguuagucuacauuucaaauaucuacuugacaaacauuuauugagcuucuacuaugcacuggacagugguagguacugcaaaagaaauuacaaauaagacauaugaccuguaugcaaggagccugccaacuagauuaggggucaauuuuuuucuguaaagagccagacuguaaguauuuuaagcuuuucauacaaaugguucuauccaaguaaaaagcauggcuacuauguaaaccaacgggcaugguugcauuccaguaaaauuuuccuuacagaaagaaaggcagcuggcugggagagguggcucuugccuauaaccccagcacuuugggagacagugcuagagguuugcuugaggcuagguguucaagaccagccugggccacacugagagacuccaccucuacaaaaaaaauuuaaaaacuaaaacaaaaacagguaacaggccaaaguuggcugacaggcuaacauuugccugccccuuaucuagagguuuuacaaauggucuugagaaaaauaauugucaugggggaggggaauguaauauacuaugcacuuucucccuuccuuuugguuuaucaaaaucugcaaaacucaaguaucuuuacagcuugccacuaccacacaaacugguaccucugcaccucucuuuaauaugccccgguccucugucuaacuuuaaaaucugacagcacccccauuggggaugccuuaaaaacagauuuuuaaaaauugccuauuuccagcuaaucaauaaaacaaauauuauuuaacaauugaaaaauuuaaaauacauauagaauugaauuauuaauuuuucugaucacuuuuuuuuuuuuuaacugugcuuacauaugcacuuuacuuucaggcuaaagaauggacucucucaaaaaagauuuaaaaauaaccuuuuuucuccugaauuuuuauuauaugcuauauuagcuucaaauuagauaaaauaauucaaaguaaaaaucuguaauggaagccaggugcaguggcucaggucuguaaucccagcacuuugggaggccgaggcaggcagaucaccugaggucaggagugugagaccagccuggccaacacagugaaacuccgucucuauuaaauauacaaaaauuacccaggugugggccaggcgcaguggcucaugccuuuaaucccagcacuuugggaggccaagacaggcagaucaggaggucagaaguucaagaccagccuggacaacauggugaaacccuaucucuacuaaaaguacaaaaauuauccggguguggaggugggugccuguaaucccagcuacucgggaggcugcggcagaauugcuugaacccaggaagcagagguugcagugagccgagaucaugccacugcacuccagccugggcaacagaccaagacucagucucaaaaaaaaaaaaaaaaaaaaaucuguaauggaaagccaucaguauauuagugacuuaaaagacauguauuaaugagaaaacagcuauaaaagauaauagcauuuguaaucuuacauugaagaacaagaagguaaauuacaggugaagaucuaaauauuuaaaaaauuuaaaucuagaagaaaauauaggaauauauuugcaagaucuugggacaggagaguucuuccaaagcaugauaugaaauucaaaagccaacaaauuuuacuucacagaauuguucucaauggggaaaagacaacauaaaauuaaaugcuacauuaguaaacaacaaaaguuaaauauacuugaaacacauagagcuacuccaauuacuaagaaaaauuuuaaaaaacuaaaaggaaaauggacagauaagacuaggcaagucccagaagaaauaaaugacuuaacaaaauggaggccuggugcagugauucacgccuguaaucccagcacuuugggaggccgaggcaggcagaucaccugaaguugggaguucaagaccagccugaccaacauggaaaaaccccaucucuacuaaaaauacaaaauuagcugagcgugguggcgcaugccuguaaucccagcuacuccagaggcugaggcaagagaaucgcuugaacccgugaggcagagguugcaaugagacaagaucucgccauugcacuccagccugggcaacaggagugaaacucugucucaaaaaaaacaaaaacaaaaacaaaaaggaaaggugcccagccucaccaagaaacuagagaaaaaugaauuuaaacaaugguacaguaccuuuuaucaaaaaaauaguaauaauaauaaaagaggccaggcgcagugacucacgccuguaaucccagcacuuugggaggccgaggcgggcggaucaccaggucaggggaucaagaucauccuggcuaacauggugaaaccccgucucuacuaaaaauacaaaaaauuagccgggcgugguggugggcgccuguagucccagcuacucgggaggcugaggcaggggaauggcgugaacccggggaacggagauugcagugagccgagauugugccacugcacuccagccugggagacagagcaagacuccgccucaaaaaaaauaauaauaauaauaauuaaagauuggugauauucaguauuggcaggagugaaacuguuagagccuuuuggugagcaaguuaccaguagcaaucaaauaguaaaauugagaacucaggaguucuaauucucuaaaaucuuuuucuuuucuuuuuuuuuuuuuuagacggaguuucgcucuuaucgcccaggcuggagugaaauggcgcaaucuuggcucaccgcaaccucugccuccuggguucaagcgauucuccugccccagccuccucagcaggggauuauaggcgcgcgccaccaugcccgacuaauuuuuguauuuuuaguagagacagguuuucaccauguuggccaggcuagucuugaacuccucaucucaggugaucgguccgccuuggccucccaaagugaugggauuacaggggugagccaccgaggccagccuauaauucuauaaaaucuuucuuacagaaauagucacacgggaugcauguacaaagcggcacuaucuguaauacucaaaaacaggaggcaauuuuuaaaaaccuaucaguaaaggcauaaauaauuuuuaaaaugguauacucaugcuguggaauacuaugcagccauuaaaaagaauucuguagacuuuauuuauugacaaggaugcaagucacagaacaacuacaguuucaucuuguuaguacaacaaacaggacaauaacauagauuuaaauucaaauguaaauauauguggguacgcacacaaaaaaucuaaaaggaaacauggagcaaaaagccuggaauuuucagguuuuacuuuaaaauuucucuaaugacaaaaaucuuuaaaacaagcacgaauaacuuuuuugacuuuuagaaaccauuuuuaaaaauuaaauacugggaggucaaaaaggaaaaaaaaaucagucacguaacaaacguaacuucaaccacgcuuaacaauguaauggaacuaauuuuuaaagcaaauguggcaaauggcuaaaaaaauacugaccaguucuuaacaguuuuuaacuccacgcaguuacgccagagguagcacacuuuaagcuaugcacauacaauuuuauuuacagagccaugcuacaauugagguauacgaaauuuaguuuaucacuucauaaaauaaauuauucuuaaaaguuacacgagacaaaaauacuaaccagggucucuuguuccgaagcuggaaucugugaggugguuacagcaccaucaguagguacagacauguugguauugcacauuugccuacaaggaaaaaaaagacacgaugaaaacuggaaaucaugaaacaucuguggaaaauacaucauauauaaagaacauaaacaacaguuaaaacuaaagcuacaagcaagucggugcuuaccuggaucagcagagaaaaaguggcgugcguccgugcccacaggucuacccuccaaucgccacugaacacagcugggaaaaugcaugguuuaaauagccccagcuggagacaagucaggacuuaacuccuuuuacugcaguuucggaacgugucugaacuugaccagcucaagaggaaaagcugagucaaccugcccacugaaccggcccaaucccgcccagacuacgcgcagcguucacacuagugacccgacaggcaccugcgaucauccggaccucccgcgccgaagcggccccgcagcccccggcccccgugaccuuuacccugaacucccgcggagaccuccgaaccacccccacccccaccgccgcgagagccguccgaaaucccgcccuccucccuggcggcgacugccuagccccaguccaacaaaaccuccgcaaagccacgugccccaugccccgcgccccgcgccccgagcccccagccacgaaccgcacaaaggcugcgaacgggcagaggcugggaaccagcgauagaggggacaccgucagagcccagacccaaaagugaccgcucgcugccgggccaguaccugcuccucaccauccgggguuuucgcgcuuggagucgggggucccucaagacuccccaguuuccuucacggggcgcgcggaagcacgacgcccugggccucggggaucauuccacucuccgggccagggcacugggcgcucguacgcacuaauccggggagggacggugcuccuggcugcgaaagcagcaggaucucggucagaggggucgcggccgccccucgggcucggcuucuugcuccaucuuuccgacacacagggccacacaggccccagaagcagccaagcucgccgcggugc

SEQ ID NO: 192191 - RNA, 37242 nt, Homo sapiens
gcaccgcggcgagcuuggcugcuucuggggccuguguggcccugugugucggaaagauggagcaagaagccgagcccgaggggcggccgcgaccccucugaccgagauccugcugcuuucgcagccaggagcaccgucccuccccggauuagugcguacgagcgcccagugcccuggcccggagaguggaaugauccccgaggcccagggcgucgugcuuccgcgcgccccgugaaggaaacuggggagucuugagggacccccgacuccaagcgcgaaaaccccggauggugaggagcagguacuggcccggcagcgagcggucacuuuugggucugggcucugacgguguccccucuaucgcugguucccagccucugcccguucgcagccuuugugcgguucguggcugggggcucggggcgcggggcgcggggcauggggcacguggcuuugcggagguuuuguuggacuggggcuaggcagucgccgccagggaggagggcgggauuucggacggcucucgcggcggugggggugggggugguucggaggucuccgcgggaguucaggguaaaggucacgggggccgggggcugcggggccgcuucggcgcgggagguccggaugaucgcaggugccugucgggucacuagugugaacgcugcgcguagucugggcgggauugggccgguucagugggcagguugacucagcuuuuccucuugagcuggucaaguucagacacguuccgaaacugcaguaaaaggaguuaaguccugacuugucuccagcuggggcuauuuaaaccaugcauuuucccagcuguguucaguggcgauuggaggguagaccugugggcacggacgcacgccacuuuuucucugcugauccagguaagcaccgacuugcuuguagcuuuaguuuuaacuguuguuuauguucuuuauauaugauguauuuuccacagauguuucaugauuuccaguuuucaucgugucuuuuuuuuccuuguaggcaaaugugcaauaccaacaugucuguaccuacugauggugcuguaaccaccucacagauuccagcuucggaacaagagacccugguuaguauuuuugucucguguaacuuuuaagaauaauuuauuuuaugaagugauaaacuaaauuucguauaccucaauuguagcauggcucuguaaauaaaauuguaugugcauagcuuaaagugugcuaccucuggcguaacugcguggaguuaaaaacuguuaagaacuggucaguauuuuuuuagccauuugccacauuugcuuuaaaaauuaguuccauuacauuguuaagcgugguugaaguuacguuuguuacgugacugauuuuuuuuuccuuuuugaccucccaguauuuaauuuuuaaaaaugguuucuaaaagucaaaaaaguuauucgugcuuguuuuaaagauuuuugucauuagagaaauuuuaaaguaaaaccugaaaauuccaggcuuuuugcuccauguuuccuuuuagauuuuuugugugcguacccacauauauuuacauuugaauuuaaaucuauguuauuguccuguuuguuguacuaacaagaugaaacuguaguuguucugugacuugcauccuugucaauaaauaaagucuacagaauucuuuuuaauggcugcauaguauuccacagcaugaguauaccauuuuaaaaauuauuuaugccuuuacugauagguuuuuaaaaauugccuccuguuuuugaguauuacagauagugccgcuuuguacaugcaucccgugugacuauuucuguaagaaagauuuuauagaauuauaggcuggccucgguggcucaccccuguaaucccaucacuuugggaggccaaggcggaccgaucaccugagaugaggaguucaagacuagccuggccaacauggugaaaaccugucucuacuaaaaauacaaaaauuagucgggcaugguggcgcgcgccuauaauccccugcugaggaggcuggggcaggagaaucgcuugaacccaggaggcagagguugcggugagccaagauugcgccauuucacuccagccugggcgauaagagcgaaacuccgucuaaaaaaaaaaaaaagaaaagaaaaagauuuuagagaauuagaacuccugaguucucaauuuuacuauuugauugcuacugguaacuugcucaccaaaaggcucuaacaguuucacuccugccaauacugaauaucaccaaucuuuaauuauuauuauuauuauuuuuuuugaggcggagucuugcucugucucccaggcuggagugcaguggcacaaucucggcucacugcaaucuccguuccccggguucacgccauuccccugccucagccucccgaguagcugggacuacaggcgcccaccaccacgcccggcuaauuuuuuguauuuuuaguagagacgggguuucaccauguuagccaggaugaucuugauccccugaccuggugauccgcccgccucggccucccaaagugcugggauuacaggcgugagucacugcgccuggccucuuuuauuauuauuacuauuuuuuugauaaaagguacuguaccauuguuuaaauucauuuuucucuaguuucuuggugaggcugggcaccuuuccuuuuuguuuuuguuuuuguuuuuuuugagacagaguuucacuccuguugcccaggcuggagugcaauggcgagaucuugucucauugcaaccucugccucacggguucaagcgauucucuugccucagccucuggaguagcugggauuacaggcaugcgccaccacgcucagcuaauuuuguauuuuuaguagagaugggguuuuuccauguuggucaggcuggucuugaacucccaacuucaggugaucugccugccucggccucccaaagugcugggauuacaggcgugaaucacugcaccaggccuccauuuuguuaagucauuuauuucuucugggacuugccuagucuuaucuguccauuuuccuuuuaguuuuuuaaaauuuuucuuaguaauuggaguagcucuauguguuucaaguauauuuaacuuuuguuguuuacuaauguagcauuuaauuuuauguugucuuuuccccauugagaacaauucugugaaguaaaauuuguuggcuuuugaauuucauaucaugcuuuggaagaacucuccugucccaagaucuugcaaauauauuccuauauuuucuucuagauuuaaauuuuuuaaauauuuagaucuucaccuguaauuuaccuucuuguucuucaauguaagauuacaaaugcuauuaucuuuuauagcuguuuucucauuaauacaugucuuuuaagucacuaauauacugauggcuuuccauuacagauuuuuuuuuuuuuuuuuuuuugagacugagucuuggucuguugcccaggcuggagugcaguggcaugaucucggcucacugcaaccucugcuuccuggguucaagcaauucugccgcagccucccgaguagcugggauuacaggcacccaccuccacacccggauaauuuuuguacuuuuaguagagauaggguuucaccauguuguccaggcuggucuugaacuucugaccuccugaucugccugucuuggccucccaaagugcugggauuaaaggcaugagccacugcgccuggcccacaccuggguaauuuuuguauauuuaauagagacggaguuucacuguguuggccaggcuggucucacacuccugaccucaggugaucugccugccucggccucccaaagugcugggauuacagaccugagccacugcaccuggcuuccauuacagauuuuuacuuugaauuauuuuaucuaauuugaagcuaauauagcauauaauaaaaauucaggagaaaaaagguuauuuuuaaaucuuuuuugagagaguccauucuuuagccugaaaguaaagugcauauguaagcacaguuaaaaaaaaaaaaagugaucagaaaaauuaauaauucaauucuauauguauuuuaaauuuuucaauuguuaaauaauauuuguuuuauugauuagcuggaaauaggcaauuuuuaaaaaucuguuuuuaaggcauccccaaugggggugcugucagauuuuaaaguuagacagaggaccggggcauauuaaagagaggugcagagguaccaguuugugugguaguggcaagcuguaaagauacuugaguuuugcagauuuugauaaaccaaaaggaagggagaaagugcauaguauauuacauuccccucccccaugacaauuauuuuucucaagaccauuuguaaaaccucuagauaaggggcaggcaaauguuagccugucagccaacuuuggccuguuaccuguuuuuguuuuaguuuuuaaauuuuuuuuguagagguggagucucucaguguggcccaggcuggucuugaacaccuagccucaagcaaaccucuagcacugucucccaaagugcugggguuauaggcaagagccaccucucccagccagcugccuuucuuucuguaaggaaaauuuuacuggaaugcaaccaugcccguugguuuacauaguagccaugcuuuuuacuuggauagaaccauuuguaugaaaagcuuaaaauacuuacagucuggcucuuuacagaaaaaaauugaccccuaaucuaguuggcaggcuccuugcauacaggucauaugucuuauuuguaauuucuuuugcaguaccuaccacuguccagugcauaguagaagcucaauaaauguuugucaaguagauauuugaaauguagacuaacuaagaggcagcaugauauaguaggaagaaaaugcugaguuguaguugagggaccuggguuguuaucucugaucuguucuuaauuacccuugucagcuuggguuaguuaguuagguucucuagccuucaggaaccuaaucuuuagaaagagaagauugauaacaggacccacucuaaagauuuauucauuucucuuugauucucuaaguuagcuugcaauaagcucguuggaucaguacgguaagcucauuggaucucaguaauuuaugguuguuuguaaggcaguaagcagguaauauaaauagcugaaggaaaaaguaaucuuugcucuuuuggauuggauacugucugugaucacaacugauacuugaugauuccaugauacuugcauaaugauuagauccuccccagcauuuuuuccaaauccccuuuauugaacuugauggauauguuugcugcagggccuauaguucugggauaauuuuggaaguauaauagcaguucuuuucucuuuauagguuagaccaaagccauugcuuuugaaguuauuaaagucuguuggugcacaaaaagacacuuauacuaugaaagagguaagcugaaucaagagauaaguaguaucucacuaguuacauguagccauacuuaaaguuuucaagaccauguggagaaauuggccauauagaaggauuuuucauuaagcagcaacauuuaauuuuguggucguuuggacuauauuuuaaagcugaaaauucuaauuauacucgaguuucauuucucagcuaggaacucagauaaauggaagccccguaagggugcuugaccauuuuaugcugucaacccuuugguagacuccuucccagaaucauguuuuuaaauguaugaaauaaaauguauagaauuacaaaggaaacauacuaaaauacgguuaccaaaauaguaaacuaguuugugauaugugugcuuuuguuauuaacauaauaaauacuaagauuuagaagaagauauaauaaauauaauguuuuuuuguuuuuugagacgaagucucgcucugucacccaagcuggagugcaguggcacgaucucagcucacugcaaccuccgccuccuagauucaagcccuucuucugccuuacccuuccaaguagcugggauuauaggcaccugccaccacgccuggcuaauuuuuugucuuuuuaguagagaugggguuucuccauguuggccaggcuggucuugaacuccuagucucaggugauccacuugccuuggccucccaaaaugcugggauuauaggcaugagccaccaugccuggccaauaaauauuaucuugauauagugaggaauauaagucauauuuugaaauguuugccauaaguacaguaugauaggaaaacaccucugauuuuuguuggugaugaaaucacagguauuaauacuguugugauuuguugccuacauuuauaaucgaaggaaaagcuaaauucuaguuagaaguuugugaaaauaagaauagaauuuuuuuuuucccauccaaauuaauggacccccugaauucuauccaaggacuucuugggcaucccuggaucccagguuaagaacuucugcacuagagauacaugaguacaguauacugaucuuucugggauagaggugagcugauucaugaccauauauucuaucuaaugguuccagcauuuuaaugcauuccccaccuuuaaauuugugcacagaagcaugauuuucagugacagauugagcaaccuuaggcagaauuucagugugauugaaauaugccuguucucugucucucccacuuaguuuaugggacucagauuacuuaaaacauuuaaguuucuuucuuacaacgguauaguggggcaggaagagcuuccauuuuucuuuuuccucuccagcuauacuuuuagaaacuuccuuaaaggauguuugguagaauaaaucuaaguucucuuccuuuuuccuuucccacugcuggacagcaaucuguccaauccacagucacauaagaauauuccuuuaaggccgaugccugcuuagccaguuaaauccaaagacaguguuuguaggaaagggccagguuaaaugguauuuuuaaggcuaauuugggauugaccuuauuaucauuggauaaucaguuaaggaaacaaaaaaguauggauuuagcaguagauagaaaugagaaaauuggccaaggccaucauaaagacuuagaaugcuuaugcuaaacuauguaacaguaguguauguauugucugauauaguucucaguuauaggaucuuuguucuggggcacacaggaagguagugaaagcuaguauggguaguaaaaagagcguuggauuaagagucagaagagcuggggccaguuucuucuucuuuuuuuuuuuuuuuuuuuuuuuuaugugacaguuucucacucucuugcccaggcuggagugcaguggcaugaucacugcucgcugcagccuggaccucgugggcucaggugauccucccaccucagugucugcaguagcuaggacuacaggcuuguaccacuaugccuggcuaauuuuuguauuuuuuuguagagauggaguuucacuauguugcccaggcuggucuggaacuccugggcucaagggaucugcuuaccucggccuccuaaagugcuagauuuacaggugugagccacugugcccaacgcaauuucuucauuucuaauacagugauaauaaucuuaugaaauaucagaaugagauaauacuuauaaaaguacauuguaaacuguaaaaugccauauguauuuagguaguuguuaauagguuuauaucuggauaucuuaaaaauguauugccaacuucuugucuuaaugcagcacagggaauauaauuuaacuuuuauuaaugguucaaagucauuauuuugauuauuuaucauaauauggaguaaauugauaccuuagaggguuuauuucauucucagaauucucucaaacuguuuuguagcugucauugauugauuguuuuucugucuuccuccucuggugaccucagaggcuauugagguuuauaguauuuaugacuauuuacuaaguggcuccagaccacugccauauuuuaguugauuuuuguuucugcaacuuuuuuggcuaucaguuuuuuauuuugcugccuuuucccuuccuaauauguuaguaucuaaguaucugggcagaguuaaagucuacaaggaaaaaaaccucacauuuuaagguuugcuuaaguaaauagagaagcaguuauuucugcuucugucaaauuaaauggaaaaggcuuaaaaguagcuuuuuuuuuuuuuuuuuuuuuuuuuuuugagaugaagucucacucuguugcuuaagccggagugcaguggcgcaaucucggcucacugcagccuccaccuccuggguucaagcaauucuccugccucagccucccuaauagcugggauuacaggugucugccaccaugccuggcuaacuuuuguauuuuuaguagagaugggaccaggauggucuuuaucuccugaccucgugauccauccgcuucggccucccgaaguacugggauuacaggugugagccacugcgcccagccaaaaguagcuucuaaguacaaaaugguuguucuacauaguuguggauaugguuccugguuguuuaccccuauucagauaaauaggauauuauuaaauguauuuacaacuaacauuuaguuuucuuuaaugcucagaaaucauauuuguauuucagguucuuuuuuaucuuggccaguauauuaugacuaaacgauuauaugaugagaagcaacaacauauuguauauuguucaaaugaucuucuaggagauuuguuuggcgugccaagcuucucugugaaagagcacagguaauucuucaguuuaguccauuguaaaaagccaucugggcuaacauuucaguucaccucuacccucauucacuuuugucagagaaaaacuguugaaacauauuaaagacaugcugaaacuuaauuuuuuagcucugcggcauauuauuugagaaccugagcucuggcaucuuauaaaccaguguuugaaaccuagcccaaucauuuacuaguuuugugacuagauaaauuaaccuuuuuaaaccugcuuccccauuuauaaaauagggauaauuaaauacuucauguggagguuaaagcucuugaagagagacguuguauaaaaaagcauaguuuugggcacauacaaagcauucaaguauuagcuguagcuauuauaacuuuuuauuccagaaacaguauaccaccacgugguaaaggcuuacauuugagccuuaguuauuuuggagaucauuuucauugucaccuaucauuauggcacuuaaccagcagaauuuaacccagguaauauuucuagaaauaggccuggugcgguggcucacaccuguaaucccagcacuuugagaggccaaggcggguggaucaccugagguugggaguuggagaccagccugaccaacauggagaaacccugucucuacuaaaaauacaaaauuagcugggugugguggugcaugccuguaauuccagcuacucgggaggcugaggcaguagaaucacuugaaccaggcagguggagguugugguugaggugagccgagauugcgccacugcacuccagccugggcaacgagcaaaacugcaucugaaaaaaaaauuuuuuuaauauauauuuuucuaaaauuauucuuuuuuuuguuuguuuguuuugagagggagucuugcucuauggcccaggcuggagugcaguggcaugaucuuggcucacugcaaccuccgucuccuggguucaagugauucuccugccucggcuucccgaguagcugggauuacaggugccugcugccaugccuaauuuuuguauuuuuaguagagacaggguuucacgauguugaccaggcuggucuugagcuccuaaccuucgguaauccaccugccauggccucccaaagugcugggauuacagaugugagcaaccacacccggccuacauuuggaauucuuugucacauuugguuuagcacaggcaauccguguugagccuuagcauucauuacauuaauaaauggaaugaauacguucaccugagacaauuaacuagcuucugcuaguauuuaaugcucaauaguauagcugaaaagaugauaauuaaaugggauuuuauuuuauuaaaaaacauaacuuccucagcugagcaagggauuuuauaacuuuaaaacaaccuuauuauuguaaacauaguauauauuauuauugaacauuaggagaugacagaaaacuaagaaaaguaaaggaaaaaaaaggacuguaguuuguuaacaaaagguauuuuuaccagucauuuguguauuaugugcaacuguguguuuuaaccuaguuaugaauauaguacuauauuuaaauuucaucuagcuucuuaauuuguauuauaauuuguauauuauauauuauaauauacauauaauauaauuauauauauuacaaauauauguauaauuauuauuuuuuauugaugagucacuucuguuuaauauccauauauguugucauuuuauacguggccuugguauauaugguuuaauuuuauaaauuuuaaaaauaacuauauugguauauuggugauuucuuuaccuauugaauauugaaucuucuauuuuuuuucuuuuuuuuuugagaugaagucuugcucuguugcccaggcugcaaccucugccuccuggguucaagcgauucucuugccucagccuccugaguagcugggauuacaggugcacacuacuaugagcagcuaauuuuuuguauuuuuaguagagaugggguuuugccauguuggccaggcuggucucgaacuccugacuucaagugaucugccugucuuggccucccaaagugcugggauuacagacgugagccacugugccuggucugaauauugaaucuucggauaauguuuggaaguaugauuuccuuggacuugaauucuaaauguugagagauaagaaauaggagaaauuacugacuugaaaaggauaugaauuaaaaauauuguggguuuagguugcuguauccuuauucccaaggaugaaaaaagauaguugggauucauauuuccucuuaauauugagugagaaacaauauuuugugacaaacacucucuuaaauccuuaguuuaaaaacaaaaggaaaaauccauugugacaucaacgaauacugggguaaaugaauuauccuccuguuaggauauaaacuucaugagggcauauacauuucuguuucauucuuuguuuucccccgugucugguacauaguaccagugacugguacgugguagguuuucagucuguauuuauugaaugaaugaguacugcuuuaucuguuaauaaguuucuuuuuuuucuucccugagucggaguuuugcucuuguugcccaggcuggagugcaauggcgugaucuuggcucaccgcaaccucugccucccggguuuaagugauuaucccgccucagucuccugaguagcugggauuacaggcaugcgccaccaugcccagcuaauuuuauauuuuuaguagagaugggguuucuccauguuggucaggcuggucuugagcuccaggccucgggugaucugccggacucggccuuccgaagugcugggauuacaggugucugugagccacugcgcccggccucuguuaauacguuuuaagaucaagaaaggaaguugaagcuugaugaaagucaagauuauaaucaaauuccuauuuaauggauuuugcguaacucaauaguuuuuuuggcaguuuguauuuaauggauuuugcauaacucaaugcuuuuuuuuggcaguuugcuacuaagcacagagcuaaaaacauuccuguuugaaaauaaguauguucaaccucuuccugcuugcauacucauuuuuugggggucuucugguaaaguccaaacaaagcacauuucaggaauugguagugugaaaucuuucagcuagagagacuuuaguaauuauuaaaaguagcuguacauaaucauugugcuacuaauuauugugcuuuuaagugccuacaagcuugccaaugauaaauuugguuuugaaugugugcaguaguucauacuaaguauguauguagaagucugguuagauccagcuuaauacaaauuuuuauucuaaaauguacaucucuuguuauuuuuuuuuuuucugucuacaaggaaaauauauaccaugaucuacaggaacuugguaguagucaaucagcaggguaaguuaauuuugagcaucauggauaaauaccauaaaaacguuuuaaagacauuuuuguuuaugugcauauguuuuauaauugugauucucuuuaaaaguugcuuuaauuaaauauuguaauaaaaguaugauaaauuuauuagaaguacauaugaacuaaaaccacauacugagguucuaauguaaaguuaaauauccuguuagaucaauuuagacuugggauaucagaguuaggauuuauuuugaaaggucuguaauuucaaaagcuccuguuuaggagugaucuaccuugaaaauguauugaaaggcuuugggaaauaauauuguuaccuagguaggaccauguguaaggaugaaggaugagucuuuuucuuugguuauagacaaaauuuuguuuaccaauuuguggaaguggaauuuuauguuccuacuuccguuucuuaacugguuauuuuugggucacaucucucuuuaauaagcugauaaaagcauuggguucuuguuccagaaagaugcacauguauauauacauggguaagucaauaaguguuuuacaaccuacuuuccaugagaaaagcccugauuuaugugcuugcugacuuccauaguauaauacucucauuugaaggcuaaaaacauggaguugggaagagauguacacaguuugcuuuuuuuuuuuuuuuuuuuuugagaaggaaucuugcucugucacucaggcuggaguguaguggcaugauuucgacucacugcaaccuccgccucccagguucaagcaauucuucugccucagccucccgaguagaugggacuacaggcguaugccaccacgcccggcuaauuuuuguauuuuuaguagagaggggguuucagcauguuggccaggcuggucucgaacuccugaccuugugaucugccugccucggccuuccaaaguccugggauuacagguaugagccacugcacccggucucacaguuugcuuuugagugcugcuuagagcugucucuaauacacuacacugcuccuaaagcccauccucgaacuacaguuaagaaaugcucuuaggccaggugugauggcucaugccuauaauuccagcacuuuaggaggcuaaggcaggaggaucacuugagccgaggaguucaagaccagccugggcagcauggcaaaauccuaacucugcaaaaacuacaaaaaucagcuugguauaguggugcaugccuguaguccuagcuacucaggaggcugaggcaggaggauuuuuugaggcugggaggucaggacuguagugaacugugaucaugccauccaguccaggugacagagcaagaccucaucucuuaaaaaagacaaaaacaaaacaaaacaaaaaaacaccucucaggagcuuguuuaguuccuagaaugaauugaccacucccuuguacuuccucuauuccauauucagauuuuauuguaaaauugcuuuguuuuacuuguggguuuuuuuguuuguuuuugagaugggcucucacucugucacccugcuugaagugcagugguaaucuuggcucacugcauccuccaccuccagggcucaaaugauccucccccucagccucccaaguugcugggacuacagaugugcuccaccacgccuggcuaauuuuucuguauguuugguagagacgguguugcuauguugcccaggcuagucuugaccugagcucaagagauauucucaccucggccucccaaaguuuagggguuacaggcaugagccacugcgucuggcuguugcacuuguuuauauuuuuguuaccuguguccuauucagguuugcauugugcaucacacacuauaguguuuuauuaauaugguauuuaauaaauguguugaauugaauacuuauucuuccaaaguuaggauuuaaagcccagaaaaguaucuccauuuuaucccaaaauaaaaguaguuauuaggcugaugauuuggcauuuuauuguuuuaaagcucuuuuuuuuuuugagcuuuagauuguauccuuuuuauuuccuuuuuuuuuaauuauuauacuuuaaguuuuaggguacauguguacaaugugcagguugguuacauauguauaccuguuguuuuaaagcucuuuaagaaauugugugauagcuaaauauacaauuguaguauuuguaguaguaguuugaguuuucugaaguauguaacccugauguauucauuccuucauuuguuuaaauaaacuuuggcacauuacuagaaaaauuguauuauugagauggaaacuuacaaauuacuuauuugcagucugaguuugguuuagauaucaguagaauuaacuucagaacuccuauuccauguucucaacuuugucacuuuuuuuuuuuugagauggagucucacucugucacccaggcuggagugcaguggugcgaucucggaucacugcaaccucugcuucccggguuuaagugauucuccuuccucagccucccgaguaggugggauuacaggugccugccaccacguccgguuaauuuuuguauuuuuaguagagaaaggguuucaccauguugaccaggcuggucucaaacuccugaccucaggugauccucccaccuuggccucccaaagugcugggauuacaagugugagccacugcacccacccagccuagggcuuccuuuuuauuacaucuuuuuuguagcaucuguuuauacuaauccaaaauuccuggacaauauaaccuauuauguacaacuuaagaaaauuaguguaaugccuuacccauaguauaaagagaaaauuaaucuaugauaaugcauaauuucaaaauguuaauguccaggcaugaguucacuguuaagaugaaaauguuuccaagggggguaguaaaggguauuugaugauaauugucuguauaucccaacucugaaacuuugacuuuugagcucaaagucuguauauccaacuacaaaugaaaccuaugugccugaauaacucaguuuguuaucuucccauccaaucuguuuaucuuucuaaaguuucucuuuuagugaaugguaccacucauuuauucacccaaguuggaaucuuggaaucaucuuaacuccuuucuuccuugccuucuauaucaaauaccaggucuuguugguuuuuaccuauuuaauuucucuggaauuuguuuuccaugccuuaguuuaggcuuuaauaguuuuuaguuuguauuauugcaauugucuaauacugguuuuccugccucugcccucuuuuucuuauguuuugcuagagugauuugucacucuucugcuuaaaauuaccauuuagggguucauuauugcucucuggauguaauauuuucugugagcuagaaaucaguuucauuucuuggacaaaaauccuuuuuaauggugaguggcugcaacaucgcauuaaggaagauucugaaguaucugcggggaagaaugcagugauaagggaaugacagcaugaguccugcuuuggcuagaccacaggauccuuuacagucugaaccugccuacauuccaguaauaaugaacugcuugugguguccugcaacaggaacuguuguuaguuugcuuuuggauacuuuuucacauggcguuuucuuggucuggaauggccuuuccuagcccuauuuucauauuguccuacaaaauauuuccugauucuuuguuucucagacacucccugucccuaccaaaauaaugacucuccugucucucugcuaauuuaucuaacagucuuuuaaugucuugauuauacuuuacucuucuacauuaaaguugaauuauuuuauuuacaucugcaacauuuaguaugaggaugccaccuggaaaauacauguuuaauguuuauugaaagguuaaauugcauaaggguuuguguuagacugauagcauaucuacugaguagcgccccgccgccccccgcccaccaccaaguuucugauccuuuuucuuuucucucagaaucaucggacucagguacaucugugagugagaacaggugucaccuugaaggugggagugaucaaaagguaaucuaaguaaauuucucauucuaauguaauauuauuugcaaauuggaaagguuauuuacaacaaguuagcuuacugguuauguuaaguuuguuguauuuuauuuuuuuccuaaaugcuuaggaccuuguacaagagcuucaggaagagaaaccuucaucuucacauuugguuucuagaccaucuaccucaucuagaaggagagcaauuagugagacagguauauaugaauauuuauuugacgcauucacacagcuuuuugauauucuuucucuaaugaaauuagugcuuuuagacuuaauuaaauuguucccuuuuuuugguugagaugaauuaaccucugaguuuuuuucauucgugauuuuauuugauuuacaaauugcuuauuuagcaauauuuuucuggcugacuacagcaggcacaguuuacugugccccacuggaguuuauaguuagccaacucucuguuaagauaguaggagguggcuggggugugguggcucacgccuggcucacgccuguaaucccggcacuuugggaggccgaggcuggcggaucacgaggucaggaguucgagaccagccugaccaacguggugaaaccccaucucuacuaaaaaaaauacaaaaaguagcugggccugguggcgcacacuuguaauccagcuacucaggagguugaggaaggagaaucacuucaacccgggagguagaaguuacagugagccgaaauugcgccacugcacuccagccuggguaaccgugugagacuucgucuaaaaagaaagauaauaggagacaggcauauaaacucuauuuucaccauuauucuuagucaccuuaacaguuaaauuuuuaaauuguuauuuuuaauaaaugguaguacauaccuaugaguuuuaaaacagaaaguaaauagcauuuuagaaaugaagagauaagggccgggcgcaguggcucacgccuguaaucccagcacuuugggaggccgaggcggguggaucaugaggucaggagaucgagaccauccugucuaacauggugaaaccccaucucuacuaaaaauacaaaaaauuagcuggaugugguggcgggugccuguagucccagcuacucgggaggcugaggcaggagaauggcaugaacuggggaggcagagcuuacagugagccgagaucacgccacugcacuccgccugggcgacacagugagacugucuaaaaaaaagagagagagagaaaauaguugacagagagaaaauaguugagaacaguuaguagacguaguagacgagaaggcuguugccugaggaagucgcaguaacuaagaccguaugauucagaugaaagagaaugucagaucagugaaacagaauaaaugaacccagaccagaaucucguacaugcgggcagaagacaggaagggcagaggugucuagggcagagguggaacuagaacaaaugguaguuacuuggggaaaaggugaaguuagaucuguaccuuaugccaaaaugaauuucaaaugaguuuaaaaguuaaaugaaaaauagaauacaacauauuugaaagauagucacuuuaaauuugacuguuaauaucuguauuacauaaaaagucuucccaaaucaauaaggaaaacauuaaaacuucaaauagcaaaaagggcagacaguucacaaaaauuucucacaguaaauacgaaugacuaauaaauauggggagagggugaauuuuggugauuuuuagcuuuacagauaguaaaaaaugccaaaaggguguccuuuugaucuaucaaauuaguaaaaauaaaauuuuuacucauccuuacucaucagugcuaauaacuuguguauuagcacugauaaacuguuggucuguaaauugguaaaaguggguaaaaauugauuaaauuuuucggauuauaaaaaagcuuagauggccuggugcgguggcucacaccuguaaucccagcacuuuggaaggccgaagcggguggaucucuugagguuaagaguucgagaccaaccuggccaacauggugaaaccccaucucuauuaaaaauacaaaaauuagccaggugugguggcaggcgccuguaaucccagcuacuugggaggcugaggcaggagaaucgcuugaaccugggauguggagguugcagugaaccaaggucgcaccacugcacuccagccugggguacagagugagacucccucuuaaaaaaaaaaaaaaaagaaaagaaaaaaaagucuuagaguucuuaacauuauccuaguaacuccauuucuaguaaucuauccuaaggauguaauaaaaaauucaaagauuuauauguagagauacuaauuacagcauuauuuauaauugcagcccggccaagaucaccuuuuuaaaaauagggaacacaaacaugauuaagaacucacgugcagaacuugugaucucgauaaaacguaaaaaucccggccagguccaguggcucacgccuguaaucccagcaccuugggaggccgaggagggaggaucacgaggucaggagauugagaccauccuggcuaacacggugaaaccccgucucuacuaaaaauacaaaaaaaauuagccgggcacaguggugggcaccuguagucccagcuauucaggaggcugaggcaggagaauugcuugaacccaggagguggagguugcagugugccgagauugugccauuauacuccagccugggggacaagagugagacuuugucucaagaaaaugauaaaaaaaguccuuucagaaaucugugauacuaucucauuuuaauuuuugucauucucaugggugaaaaaugauaucauuucacuuugcauuucuuugaucccuaggagguaagaguuuuuuuuucuauuacucaaguacaugacucaagauuuuucauauguuuauuagucauuuguauuucuucugugacuugcuuuuuccuguuuccuuaaaagaaaauacagucuaucuugauuugguaggacuuuguauaauauguauacuauggguaauuuuuacuauauauguugcagauauuaucuucgaauuugaccuuugccuuuuaacuuuuguuugguauuuuauuuugucauguaaaccuugacauggucuaaucuugauagucuuuuuauugaggacuuugcaguauuaugaaauacuucuccaccccagcauuauaagaauauuuuguuauagguacuugaaugguuuuguucuuuauauuuagaucuuuaauccaccuggaauucauuuuuaugucuaguauaagguaguauucucauuuaugucuaacggauuugucuaacauucugacccauucagagauaauuuauuauuuaaaaugaaauggaaacuuuuuacugguuuugauuucuguuuaaaauauaggguacugaagagccgggcuuaguggcuuaggccuguaaucccagcacuuugggaggcugaggcaggaggaucacuuaaggccaggaguuugagaccaguguggccaacauggugaaacccugucucuaccaaaaauacaaaaauuauccaggcaugguggugugcaccuuuaaucccagcuacuuggaagcugaagucacaagaaucacuugaaccugggaggcagagguugcaaugagcugagaauguaccacugcacuccagccuggguggucgagugugacucugucucaaaagaaaaaguguaggguacugaagaaauugaaacauuaagaauaccauaugaguaaauuaaacacuuuggcucuuuucggaaaaaaacagaugagcucuuauauuuuaaaguuugguuuugacagaaaaaaauuccuagauuuuuugguuaauaaaaacuuuauuagauagauuaaauugugauguauggagauaaaguucugaaagaagaauagaaagcuuuuuaaaaauaguauucucagccuaggcaacauggugaaacccugucuaugcaaaaaauacaaaauggugcauuccuaugguaccguuccuaugguaccagcuacucgggaggcugagguugaggugggaggaucacuugagcccaugaggcagagguugcagugagccgagauugugccucuguacuccagccugggugacagagcaagacccuuucucagacaauaaauaaauaaacaaauaaauaaauacacacagauaguguucugcuguaacaguuggacagauucaauaaaacaguguuaacuuuugaacuaauuuuauugaaacuaaguuucuguacaaauagguacucaaaacagcucaauuuucuaaaucacaguacagcaauuuauuuuuuuuccuuacauauccagaagaaaauucagaugaauuaucuggugaacgacaaagaaaacgccacaaaucugauaguauuucccuuuccuuugaugaaagccuggcucuguguguaauaagggagauauguugugaaagaagcaguagcagugaaucuacagggacgccaucgaauccgguaauguucucauuuuaaguaaggcaagacucuuacuguucaaagucuaguccuggcaguccuaauaaggauacggauagaauguacaugugucuuacgagauugauagaaaacacagugcuaaauuuuacuuuaaaauaaaacuacuauauugaucuccaccuucaacccaagguauugugagaaauguggaaaauaguggaguaacaccgguauugguaaaauuaguaguaguauuaguaauuaucaaugucacuguauguauuagagaauauuuguggaccacugcaccaauaguacagucaaauaaauuggaguauagaguuguuugagaauuugagaguuacacuuuuuaaaaaaggaacaaaaccaaaaauuugguucaguuaaauauuuuagcauuuuaaggcaaauuugacuauuuagaguaaaaauauauuuuauuacagccaucagcaaaaaagucagcauagucugaacuuaacauuugccaaauaggucuagacaucagguaaguucuauuuacuuaugcuguaaaauacagguuuauacugggcugggugcgguggcucaugccuguaaucaguacuuucggaggcugaggcggguggaucaccugaggucaggaguucaagaccagcauggccaacaagaugaaaccaugucuuuacugaaaauacaaaaauuagccaggcgugguggcgcaugcuugcagucccagcuacuugggggccugaggcaggagaaucgcucgaacccaggaguuggagguugcagugagcugagauugugccacugcacucuagccugggugacagagcgagacuccaucucaaaaaaaaaaaaaaaaaaugcagguuuauuauugcauggaugacgggagaguaucaguacuuucucauuacuaauacagacuuccaaaauauuagugagcagcauuucuuaagagaugucacugaaagaaguuugguaaaaaauuuuuuuguuaacaagaaugcuugacaaauggaauauuuuguuuuguaugucuuuaaucaagcuuguccaacccauggccugugggccauaugccaggauggcuuugaauguggcccaacacaaauucauaaacuuucuuaaaauauuaugauuuuuuuuuuuacaauuuuuuuucugcucaucagcuauuguuaguguauuuuauguguggcccaagacaauucuuccaaugucgcccacggaaaccaaaggauuggauacauuuuuugguaauauggcagugucucauggccauuauucuggguauuaguaaucauuguauaguacucuagaagauguaggaaguggaaccaauugugauaguaauccuagucuuuuaccuauucuuguuacuuccuguauuaucuuuuuuucucuuccaaagcagugauuguaugaacgcauaccugcccucuagaguuacuguaccuaacggagcuguuacuuauguagaccgcuagauggcaugaugagcuccugcucagucugagagcagguucuucauuuguagauauuuaaguuuauaccaaauuccauacaguugagauggcacugcagauacagugguagucaagguagauaugguucuugccuucauugggagauagaucauuaaugacaaaaaugaaaacauuuaauaaauccaguggaaaaaauaggcucuugagcggaaauauaugugauaaaauugaauccaauuaaaacuugaugaguauccaaccuacaaguuugguuaaaaagagaauuauuauacccuauuuauuuauuuauugagauugagucucucugucucccaggcuggagugcaguggugcaaucuuggcucacugcaaccuccaccuccccgguucaggcgauucucaugucucagccuccugaguagcugggauuacaggcucccaucaccacaccuggcuaauuuuuguauuuuuaguagagaugggguuucacuauguuggccaggcuggucuugagcuccugaccucaagugaucugccugccuuggccucccaaaguguugggauuacagaugugagccaccugcccggaccccuauuuaauguauaguuuuuguuaaaguuauaucagaauucuagcugaaugauauuuagaguccuuguuccugcuuuguaccugggacacugccuuguuacugauauggcuuugaggaguagaggaacaccagguuuuuuguuuugaguugaauuagauaaaacgacacggacacacguggagugguuuuaaggagcagagcguuuaauaggcaagaagggagaaggcagaaggaagaagcucccccuuacacagacagagggaggggggcucuaaagcugaaagaggagaccuuacauucugacaauacuagccaguuuuaugugacggcuggaggggguggugucuuauuugcauagggcucagaggauugguuugaccaggcaugucauuuagcccucaagaaaacuggcccucccaccccaguccuuuaauacacaaaugcaggaugccaugacauuuuacacacgggguuaugugggggcggccaugcuguuagguaccugauggagcaagggcaagaggacaacggugggaaucgccauguuggguggacccucuugcauuugcaucuuaaagguugccagccuuuaagagccagggcuuuuaugcuagacaagaaauuuuucuggagcuacgaaaaaccuuccaaggaccacuuuuccucuccauuugccuaaaauaauuucuuaauaacucguguggaguagagggguauuucuuuuuuucuuuuuguuaguccuguccugcauucucuuaaaaaauccuaucuauaaaaaaucucagccgggcgugguggcucaugccuguaaucccagcacuuuggaaggcccaggcgggcggaucaccugaggucaggaguucaggaccagccucgccaacauguugugaaaacccaucucuacuaaaaauaccaaaaauuagcugggcauaguggcgggcaccuguaaucuagcuacucaggaggcugagacaggagaaucgcuugaacccgggaggcggagguugcagugagcugagaucacgccauugcacugcagccugggcaacgagaacgaaauuccaucucaaacaacaacaacaaaaucucguuuuucagguuaagucccuaguugugaaagcuuuugguagggccaguuuuuuuuucuucuucguuuuaauuucccucauuugagaauguuguagucaucauugggugucaucauucaccaguuugugaagggaguuaaaggaaagugcauuccucucccaucuuuucuuucuuugggguuuaauaaauugugggaaacuaagacuguguucuagacuguacaccaugcaguuuauauuaugaucuucugucaucuuugcagccucagauuccauuuuuagcuaagacugggguuuuaaauaacuuguuuaagguuccuacaacuaauugucacaauuggaauucaaacaauucuagguauuuuugacuacaaagaucuaagaucuuugcagagcaagccuaucugaugcuuaaaaaaauauauauuuuuuaaauuuuugagacagucucucacuccguugcccaggcgggagugcagcgcaugaucauggcuuacugcaaccucaaccuccuggguucaagcaauccuuccuccucagccuugagaguuagcugggacuacaggugugcaccaccacaccuggcuaauuuuuuuuacuuuuuuuuuuucagagaugagaucuuggccuguugcccaggcuggucucaaaccgcugggcuuaugugauucuccugcuuuggcucccagaguauugggauuacaggcaugagccaccaccuccagccugaugcuuuuuaaauauauaguauuuaggucuggugcaguggcucaugcuuguaaucccagcacuuugggaggcugaggcgggcggaucacaaggucaggagaucgagaccauccuggcuaacacggcgaaaccccgucucuacuaaaaauacaaaaaauuagccgggcgugguggcgggcaccuauagucccagccacuggggaggcugaggcaggagaauggcgugaacccaggagguggagcuugcagugagccgagauggugccacugcacuccagccugggugacagagcgagacucugucuccaaaaaaaaaaaaaaaaaaaaaaaauauauauauauauauauuuauauuuaaauaauguauaaauauauaauauauaauuauaaaucuauuauauauuaauguauauuauauauuacauuguuauauauauuuauauaauuauauauuuauauaaauauaaauauauauauuuauauaaauauaaaaauauaauuauauaaauauaaaaauauauauuuauguaaauauaaaugggcaggcaccuguauauauuauauauauuacuauuuauauaaauauaaauauauauuuuaaauauuuauuuuauauauuuuaaaaauauauauagagagagauaauuuaauaguuucuggggcauucuuuugcgaacauuagccaaaacuuuaaaaaccacucccaauauugcauuuuuucaugguauuuuuuauaguauuuuuauaguauccuaggacaggaguuggcaaacuuucuguaaagagccacauaguuaauuauuugggcucugccgggccaugguuucugucacagcuacucagccccgcucuuguaaugcaggagcaacuguagacaacaagucaacaaauaggcauggcuguguucaauaaaacuuuauuuauaaaagucgaugggugaugggccacaguuugcagaccccuaccguagaguauguuuucugagauuuaauguuucuugugauuuacccccuuauucuaaaauuagugcacuaaagacuuuaguuaguugaaguauuugguuuguuggguuacuuuguuaguguuaauuguauccuaacuugacuugugauucuaaucugauugguaguagagcccuuguuaggaauuugagcugcaacuugaugaauguugcuuuuacucuccuuccuaacauuacucuaaaaaagucuuuugaugucagaggcuguaaaauaauauacuuuguuucuguuuuuaaaacugauacagauauggaaaucauuuaaucuaagcuccuuuucuagaugaaguagcuacagccuuuagaaguuaaaugauaugggcugggcgagguggcucacagguguaaucccagcauuuugggaggccgagguggcggaucacuagaggucaggauuucgagaccagcccagccaacaugacgaaaccccgucuccacuaaaaacauaaaaauuagccgggugugguaguggacaccuguaaucucagcuacuugggaggcugaggcaggagaauagcuugaaccccggaggcggagguugcagugagcugagaucaugccacugcauuucaucuugggugacagagcaagacucuugucucaaaaaaaaaaagggccgggcaugguggcucacaccuguaauccuaacacuuugggaggccaaggcgguugaauugcuugaggucaggaguucaagaccagccuggccaacauggugaagcccugccucuacuaaaaauacaaaaauuagccaggcaugguggcaugcgccuguagucccagcuacuugggaggcugaggcaggagaauugcuugaacuugggagguguagguugcagugagcugagaucaggccacugcacuccagccugggugauggagcaagauuccaucucaaaauaaauaaaauaaguuaaaugauguuguuuaagguuaaauuagcuacuuaguggcaaguguagaauaagccauaucccgacuucuagacuuuuuccaauuguagccuucugcuuauauaugcuccuacccuuagccacugacagcaaauauuauugcccugaaggucuuacuagguucuuauacaauuuauugaaguccugaaacgaagaaucagaugagcagcuacagaauuuuuuuuaauugucuaaaggcucuuuaaaagaaaaucucaaaguuuauuaaaaaacauaaguaucuaugacucgagacauuuuucuaagaaaaaaaacccauaaguauuacaaguguugugucuuguuacguguauucuaccaauuuggacauagaaagaugagugacagguuuuagcucaaaguauauauaauucagaugagaaacaugccugcaaaauuauguuuugcauaauuuaugugugagacuauauaauucauuauuauacaaguaguaaggauaauuaaagguggaagagccuuuucaguuaugguauugacaaaggcuuagucaaagaaggaugaauaggauuuugaaacugaaauuauucuaguuagagggggaaaguguggaaguugaaaugccaagauuaguugaggaagcaaucuagaucuggcgggauuauccauauuuaguaagggaggaggggugucuaguugaagacagacgaagauguuaauacagucacacuguagguacuuucgaugccaagaggcuuugguguuuuuccuuuaugcagugggguuuugaacagggaaaauaauguaguaauaaccuugaaaccuuaaucuaguuucaguaugcaggauggaucugaggaggaaaugugcguggcaaccggcuccgggauggcuggcuggggggccuagucuucugcccgccgaucucccucgggaagucccggaucagagcagcaggcccaucccccaacuguuacacccugcuggcagcagcagaggcacagggaugaguuaggaaacagauacagaggucaagaggugauguuuauuaaguuauauauuuuuuucuuguuuuaggaucuugaugcugguguaagugaacauucaggugauugguuggaucaggauucaguuucagaucaguuuaguguagaauuugaaguugaaucucucgacucagaagauuauagccuuagugaagaaggacaagaacucucagaugaagaugaugagguaguauuuuuuuuccccucuaauuauauuggaaaauuauuaaauauuuucuauguucauugacuuugagauugaaauaauauuauucagauuucacuugaaaucuuuaccucuugauuuguuuaaacuaacacauugguuuguggacuugaggauuucauaguucuuuaucaucugauuuauauuauuauauuacuacuaauugccaagaagucaauagaccucaaugaacaugcuuauuauaauggucuguucacuuuuaaaaacauauaauucaacuacuguuuuaauauuaacuuacuuucuauaaaaguaaaacaugcauacaguuaaagucaaguaguacccuuagagaucuguuucccagaagugacugccuuuaacauuucuagcuauuucccuauuauuuaauaucuccauauuaguuauuuaugaaguaaaaccaccuagcugaauguuuuguuuuauucauccuaaacauccuuuguauugacuuuuaccauuguggguaaggauuucucucuccuccauuuuuucccccuuuacacucacuuacucuauuugauauugucuaaggcuuucucauauauuguaguacaugauauuuguuuaggacuuauuacuaggaagccuucugauugaaggaaauagggcgaugaauugaugcuaaugaauguguuuuauuagguauaucaaguuacuguguaucaggcaggggagagugauacagauucauuugaagaagauccugaaauuuccuuagcuguaaguauacaucuacuuuuuuaagaaauaaaaauuucauuaaggucaagauuaggagacuauaucuagcuucuuucugaaaugaacugauuuuuauaaaguuaaaauguuuuuguaaagucugaauaauuuaaagcauuuuucuuuuauuuguugugaugagaccuguagcuauaauuuuuauuuuuaggugcuggaauuugaacuuuuuuuuuuuuuuuuuuaaacagggucuuacccuucucccaagcuggagugcaguggugcaaucucagugcacugcagccuccaccucccagguucaagugauucucgugccucagucuccugaguagcuggaauuacaggcaugcaccacuauaccccacuaauuuuuuuauuuuuaguagagaugggguuucaccauguuggccaggcuggucaugaacuccugaccucaagugaucugcccaccuuggucucucaaagugcugggauuacaagcaugagucacugcccagcugaauuuguacauuuugauguuauuuuggaaaauuucaguguaucuccaguauacucaucacccagcuuuaacuauuaccaacauuuugccaaccuugucaaacguaaacuuuuuuuuuuuucaauugagauaggguccugcccugucuuccaggcuggagugcagugaugugaucauggcucacugcagcccccaccucccaggcucaagugauccucccaccucagccuccugaguagcuggaauaacaggugcaugccaucacaccccagcuaauuuuuguauuuuuuguagaaaugucaccauguugcccaggauggucuugaacuccugggcucaagugauccaccugccucagucucccaaagugcaaggauuacaggugugagccaucacacccagccaaauguaaacauuuuuauuacugauuuguauuauagaaugugguaggauuugccauuaaagaaauuaacacuuaaauguuuacaucucaugcauacuucacugaguuccugagguauuauagguuuuuuuaaaacuauugugcuuuaguuuuuguucuuaauauugccuuuauuauauuugaauaggaaauaaauuccauuuuuucugaguuauagacaguuacuaauuauucaagugcaaaaaaggaugaaaauucaagaguuuccaaaauuuuuacuguauuagaaaauaaauaacuaauugaaucauuugaugucaaguugaguaaaauauuuuagauacuuuuaauuuuuuaaaucuauuuuaagacucaaauuauuuuagauauucaucuuggaauuuauuggacuuuuugaugcacuuuuacucccauauugcaagaccuuuuucuuugguuuuaugagcugugaaaaacccccuucuauaacuugaaaaaagaagaaugaauagucuaucuuuauugcuccugucuuaacaucauuugugaggcaaucucaaaaugguuacggaaauaccucuuacuuaagaguuuucacuuguuaaauguccucaggcaagaaccaugcuucagcuaaggcaagaagauagguuauguaaaaaggcuggggaugugggagaguuuguuauccaaauugcaugguggaaagguuugugggauaaaacguugggaaaaggaagaagcauugagcaguuacaaagaugagaacacaggaaaggauagacagguaaaggaaaggauauuacgguuagugaccaaggaugauagguuuuagcagcaauacuugcugugaaaaauguuuuagcauuucucuuguggauggaguuagggaauacucaguuaagccaugguuuuagaguacuucuaagguaguucuagucacugguggauuaggaagucuuucucgaggaggcagguuucaucuagauugaugggauggacucuuggaauagcgccuaggguugagccuuuaagggaguggauauaggcugcaugacagaguaaaagaucccauagacuugcuucaacuaaaggaagcaacugcauuuguauccugaaacagauaacuuuauagguacaugauuaauaucacaucacaguuaauauauuuuuaguuuagaauuuuucaggaugguaagggugaaaaaaauggguguacuuacucuacuuuaggagagacuguuacauauugaccuuuaaaaaucuguuuuguguauaauugagacauauaacgugauguuuugacacacauguaaauagugaaaugaucacuacagucaagcaaauuaauguaauccauuaucuugaauaguuaaccuuucuuguguguaugguuaaaauaccuaaaaucuauucuuuuaguaaauuuccaguauaccaauauauaacuaacuauaguccucaugcuguuuacagugacuauuuuauauaaaacaugaaacacugaauauugagcccuaugauauacuuuaccuuagacauagcaaaguugcuagcauuccugugacugagcaguuaaaggguuacagaaacugacugugugucuuauuucauugaaggacuauuggaaaugcacuucaugcaaugaaaugaaucccccccuuccaucacauugcaacagauguugggcccuucgugagaauuggcuuccugaagauaaagggaaagauaaaggggaaaucucugagaaagccaaacuggaaaacucaacacaagcugaagagggcuuugauguuccugauuguaaaaaaacuauagugaaugauuccagagagucauguguugaggaaaaugaugauaaaauuacacaagcuucacaaucacaagaaagugaagacuauucucagccaucaacuucuaguagcauuauuuauagcagccaagaagaugugaaagaguuugaaagggaagaaacccaagacaaagaagagaguguggaaucuaguuugccccuuaaugccauugaaccuugugugauuugucaaggucgaccuaaaaaugguugcauuguccauggcaaaacaggacaucuuauggccugcuuuacaugugcaaagaagcuaaagaaaaggaauaagcccugcccaguauguagacaaccaauucaaaugauugugcuaacuuauuuccccuaguugaccugucuauaagagaauuauauauuucuaacuauauaacccuaggaauuuagacaaccugaaauuuauucacauauaucaaagugagaaaaugccucaauucacauagauuucuucucuuuaguauaauugaccuacuuugguaguggaauagugaauacuuacuauaauuugacuugaauauguagcucauccuuuacaccaacuccuaauuuuaaauaauuucuacucugucuuaaaugagaaguacuugguuuuuuuuuuucuuaaauauguauaugacauuuaaauguaacuuauuauuuuuuuugagaccgagucuugcucuguuacccaggcuggagugcaguggcgugaucuuggcucacugcaagcucugccucccggguucgcaccauucuccugccucagccucccaauuagcuuggccuacagucaucugccaccacaccuggcuaauuuuuuguacuuuuaguagagacaggguuucaccguguuagccaggauggucucgaucuccugaccucgugauccgcccaccucggccucccaaagugcugggauuacaggcaugagccaccgcguccggccuaaaugucacuuaguaccuuugauauaaagagaaaaugugugaaagauuuaguuuuuuguuuuuuuguuuguuuguuuguuuguuuguuuugagaugagucucucugucgcccaggcuggagugcagugucaugaucuagcagucuccgcuucccggguucaagccauucuccuggcucagccucuggagcagcugggauuacaggcaugcaccaccaugcccagcuaauuuuuguauuuuuaguagagauaggguuucaccauguuggccaggcuggucacgaacuccugaccucaagugaggucacccgccucggccucccgaagugcugggauugcagaugugagccaccauguccagccaagaauuaguauuuaaauuuuagauacucuuuuuuuuuuuuuuuuuuuuuuuuuuugagacagagucuugcuccaucacccaugcuagagugcaguggagugaucucggcucacugcaacuuccgccuucuggguucaagcuauucuccugccucagccuuccaaguaacugggauuacaggcauguaccaccauaccagcugauuuuuuuguauuuuuaguaaagacaggguuucaccauguuagccaggcugaucuugaacuccuaaacucaagugaucuacucaccucagccucccaaaaugcugggauuacagaugugaggcaccuggccucagauuuuugauacucuuaaaccuucugauccuuaguuucucucuccaaaauacucuuucuagguuaaaaaaaaaaaggcucuuauauuuggugcuauguaaaugaaaauguuuuuuagguuuucuugauuuaacaauagagacagggucucccuguguugcccaggcuggucucgaacuccugggcucaagagauccuccugucuuggccucgcaaagugcuaaguaggauuacaggcguuagccaccacacccggcuguaaaaauguacuuauucuccagccucuuuuguauaaaccauaguaagggaugggaguaaugauguuaucugugaaaauagccaccauuuacccguaagacaaaacuuguuaaagccuccugagucuaaccuagauuacaucaggcccuuuuucacacacaaaaaaauccuuuaugggauuuaauggaaucuguuguuucccccuaaguugaaaaacaacucuaagacacuuuaaaguaccuucuuggccuggguuacaugguucccagccuagguuucagacuuuugcuuaaggccaguuuuagaaacccgugaauucagaaaaguuaauucagaaauuugauaaacagaauuguuauuuaaaaacuaacuggaaagauuguuaaguucuuucugaauuauucagaaauuaugcaucauuuuccuucaagaaugacagggucagcauguggaauuccaagauaccucuugacuuccucucaagcuccguguuuggucaguggaggcccauccgagcucagcacugagaaguguuaguuucuuugggacccaucuacccugaccacaucaugauguucaucugcagcuguugcaagguguucagauuguauaaacauaaaugucacaaaaacuuuaaaagaagugcaauucucaaaagguuagguggacuaaagcauucuguaaagcaacugcuaauaaugagcuuacaguggauuugaauuugaaaaauauaguaacaagccugucaaauaucugcaagaacuauggaauaaaacuacugaugcagugaagacaguugaaaagaucaaacaaaugccaagcuauauuuauaaugaacaaauucaagaaaaaggacuacggaaaguucaggacaucaaagaagucaggcaaaacucaucuugaccccuguugcaggcaaaggaacgcagcuggaagaaaagaugauauaacaguuaacaggaugcagacauggcagagguuuccuaaaaaucucauuaucuauaaccauuucuauauuuacauuugaaaaucuccuuuggagacuuagaaccucuaaauuauugacuuauuuuuuauauaaggucacuccgaugaaaggugauuacaaaaucaucuacauugcugucuacaaaacagauaauauggauguuugaucgcaucucauuguuaacucuuuacugauauguuuguaaauacagaagugaaauguggacauaaaauaguuacgcuauuugguuaaugguacuagacaacauguaauuaaugacauucaaaaauuuauggcuagugauauauauaaaguaaaauuuucuuugcaguaaaauaugcccuuuauuauagaagggaggauauaaggaaccaacaguuuguaugaaaauagcucaaauaauaucuuuuauuuugauuuuaauauuucuuauuuugguuuauuagugucuuagaacaaaauggccuuauauaaugaagccuaguuaugcuggacuguuuugaucucuuuuaauuguucugacagauaguuggggaugagagccgaauaagguuugccugaaauaacugacacuauauaauuucugcuuuggcaaauacuaaguucuaacuugucauuccugguagaacaagcuuuauuuuucgagccuagcaaugaucuagaagcagauguuaucucagugccuuuugcaauuuguuguguggguuuuuuuuuuuuuaaagccacacaauaauuuuggaaaacaauguauggguagaacaugugucuguuaauugcacacaaaaccacuuuuaauggguacagaguuaaauuugaaggaauaaguucuagcugaaguauuaugaacuccaaauaaugcuuugaggaccuccaaagguaaaaguacuaaucccuuuggccauuuauugagagagagagagagagagaguagggugacuauaguuaauguauugaauguucuugcuacaaauaaaugauauuugagcugaugggugugcuaauuacacugauuugaucaauacccauuguaugugaaacaguacauacaccauauuuacaauuauguauuuaacauuuaaaauuucuaauauaaguaucucucaaacuguggauuaacuucuugauuuauauuuaaauaugaaucuuaagcaaaacagugaaaauaaccaucuugauuuaguguuuuucucccauaugugaauuguauauacuuaggugaagacaauaaaaucaacugaacuguaagcuuagaauaggacugagguaauucugcacagcaacuuuacuaaugguacauuguugcuucaaaacucucucucucucucucugucugucucaauaaauggccaaagggauuaguaguuuaccuguggagguccuccaagcauuauuuggaguugauaauacuucagcuacaaccaagcagaaucucuuuuuuuuggagguccucgaagcauuauuuggaguugauaauacuucagcuucaauuuggaguugauaauauuucagcuagaaccuaguagaaucuguuuuuuuccuuuggagguccucaaagcauuauuggaguucauaauacugaagcuagaaccaagcagaaucuguuuuuuucugaggaguaucgguagcauaaaugugauuauaaacauaguacacuugauauauggaggcagugacagcuauuuuuacaaaauuuaaaucugcaaauggauucaacauguuuauggguuauuaaaauugucugauuucuuagguucuuuauaguacacguguugaaaauaaaugauuaagaauuguuucaagaaugcaauuauuugaucuuaaauuuuuaugaguuguuaaaauagaaauuauuugaauaucauauauuuggguaacaaaaggcacaagucugaauguguuucuuuuucuggaauggccaugccugcccacuuuagaaauacaaauaucacugggcagcuugaagcaguugggagccuccaaugagagcaacuugagagaaugauguugcaaguuaguaggaguaagaaaugcuguguucucccugucuucucuuaggucacauggcagccuggccuaagugaucgugaauggucuauaagggagguagcugggacagggaggggaguuugggcuagccaccguaccacuugucagcgugaaaaguaagauuguaauugccuguuuaguuuucugccucaucuuugaaaguuccaccaagcugggaaccucuugauugugaggcacaaauguaaguacaucagaaaaaaacaaaaaaacuggcuuuaaagcaggagcuugugggccccuaagccagacggggacuagcuuuuggcauuauauaauuaagauuuuuuaaauccuuaauaaggguuuuauuuuauuuuuauuuauuuuuugagacggagucuugcucuguggcucaggcuggaguacaguggugcaaucuuggcucacugcaaccucugccuccuggcuguguucaagugguucugcuucagccucccaaguagcugggguuagagcacccugucaccacgccccgcuaauuuuuguauuucuagcagagaugaaguuucacuauguuggccaggcugggcucaaacuccugaccucaagugaucugcccgccuuggccccccaaagugcugugauuacaggcgugagccgccacgcccagccuaauaaggguuuuaaagauaauuaguguguaggucuguaggcuuaugaugguaaccacaaguuguuaauggcauugugaaaaguuuuuaguugcgcuuuauggguggaugcugaauuacauuuugauuugauacuuauaaaaagaaaaaguauuucuucagcuuaaaaaauuguuuaaaaguuugugaucauauugucuaccauguagccagcuuucaauuauauguaagagggacuuuuugacauuuacaaauaauacuuugagguagauaucugaaagcaccagcacuuggaagguguucagaaguaacaaauuauaaaaugagcuaacaaacgaaaggcaaaauaaaaccguaaagcaagca

SEQ ID NO: 192192 - RNA, 65417 nt, Homo sapiens
cugccgucguggaagcaggauuuccgcgguuguguaacggccugucgcaggcgugcagggaccuggacuccgccucguccccggggcucgggcagccgagccauggcggggaacuguggggcccgcggcgcgcugucggcgcacacgcugcuguucgaccugccgcccgcgcugcucggagagcucugcgcuguucuggacagcugcgacggcgcgcugggcuggcgcggccugggugagucggcggggaccggccgggggcggcgggggagcccagcgcgccgcggggcccgcucggcgucgcccugcauggcuggggucccucgcggggcuggcgcggccuccgggaaguucccgccagggagccggcccccuccuuuccuggguuggaugcagagacucccugggacccagaugccuucccucccuucucuuucaaagaauuuuggguaucgcugcaaagucaagggagccgaggccugggaaagacagauaaccagcgugaaagcaucuucuguucguccgcgaugccacccucacuggguucgcaauguaugaugucuucugguccuugcaaaaucaccccagaacaucauuuuaguauugagacauuuuuagaacuuugagauacuuauccuuugguguuuucaaugcaucccuaagccccuaacuuaauuacaagugaaaugcuaaaguaaacuacgguuugcaaugaacgcggcuccuaauuuucuuaauuaaaucuuauuuacccaauuucguugaaugaagguuuaugcuaaaggguggcuuuuuauuuuaaucuaaaaaaauuggcuucagaacuguauuuuaugcagacauuggaaaguugagcaacugccugcuggaaguguugaguguagccagagauaauucggacaaaaaucuucguuuuguuaaguacaggcauuuuugguuagauuugauauuccacaaugucauguuuaauguuuauugaaaagaaucaugauuaugucaaaauaacuuagcuuuaauggucugaaauaggauuuuucuuaccaggacuagcagaaggccuaagaggagaguuuucuuuguuacugaugaacaguauggugacagucuuugaauuguagcaaugggcuucugguuauacaaaaaauguuuauauauuuuaagcucuguaauuuuaaguuauggcccuuaagaaaaaaaaaaaagucugauuucuagaaaacgagauuuccagugugcauuugagggauuuugagggauaaggucacuuccccaucagaucuuuuugagauggauuuuggcguggacaguauuuauacccguugauuuccuagaguuacugacuuugagaaagaaaaguguuuuuaguccaguuuaauguuggugaauggggccaggugggugugguaaauuagugaggcagauuauucucucucuuucuguugauagcauugaaauccagauauucaugcuuuacauggcuugucucauauaacuucuccaauuacucugugagucauuaucaucgccaguguuuuuuuaacaggucaggaaacugguacaaauugguuaaguaacuuguucagguucaccagcuggaaauggaagagccaggaucugaaccaugguagucuggauccaaggcuuauguccuuaaccccagcuacucuacacuucuccccuuacugcuguguucuuucuggccacaucuaacagccucccuaaaguacagacauuucuggcaucaaagaacaauucagugauccauuucaagcaugcagcccuauuuuccuaguggugaaaaugaaugaggaccacccaaaugagaacaaacaaaagcuauuuuuuucaaagcaagggagccagcaccauugcuuguguuuggcagagacucaaaagcagacagaggauggaggagggugggagaagaaggcuucagcuguguccugauuggaggcuguugauauggggaagcuguaguugagcuaccuaaaaggggguauuuuguguguuuguuuagggguacauaauuggcuuucucugguuggcccuaaguuggaaguaggagcaaaaauugaggaaguggucaguaauuauucaaguccuggccauuugagacagguugcuacagggguucuuguuuggcugccugggcuaguugcuacaguuuaacccaguuacugauaguuuaacuuguuagauacuguagacgguagguugguuucuuggacugguugauguacauugccugcagaguucuauuuuuauauauaagcuggccauugucccuuuguguauucauucucucacagggaaagggucuaaaauguuuacuccaugauacuucagcuguaauucauugugcagguggucaugccuacugacugccuggacuacugagcuggcccugaccaggugcugcacaaguucuuggcucagcaagaaggcaaggcuagcccaguucaggguguugaggcaacugccugugcuaaacaugccgaguuuuccugugggcacagcgaagggagaaagaggggaagaggugcagguagggaaaacuugaccuucgagaggggaaggagagugacagaggacugaaucaaagaggcaguccuuuguaugcucaggacagcugacagcccaagcuuaaauguagaaaacaacuguaauauacuaaguaaagcucucucgagccgaucgugauucuugaugacggugagugucagguuauguuuacaaaggcagcucauauagcagccuauaugauaugaccagugugugcaggauaagguaagccagucauucacaaacacaaaucaccuaugcagucuuuuaaauacacagaugcaggucccacuccuagagcugcugauucaggaagucuggguugaggguccagcuucuuucauuuuuugucaagccccaggagugagucugaggcacaaccugauugguaagccauugcuuaggccaaauucucuuuuuuaauagugucuucauauaacagauauuuuacuacauucuuucauuacuucauuuaauuacuuuuauuuuuaaacauauucuacauaguacucuucaaaucacuuuugucaaguauuguuauuaaaaauaauguaaucacaagauaauauauucugugguuaucauugaugacuuuauggcuuuuagugaaagcaagagcccaaaagcccaaaugaaauauguuguuuacguuacagacaugauaacguaguacauacagaaccucuggagacaacucaucugauuacauuaccauagauugguauuuaaauuaaauuauuuggagcagcugacaccguaaaaaccucucaacacuuacgauguacugagaaacgcuuuuugcaaaugauauauaauaggcuguauucaauuuucuuccucucaagaaagaaaagggaaauuauuauauaaaucauuaauaauuacuuuaaaaauuaaauguaaaaucacauuaagugugcauuuguauauucaauaaagauucaaaauaauaguaguaauaauaauaaagcuaccuccugucaaggcuuacuauuggccauugugguaagcauuuuacauggauuaucucauuuacuuauuacaacaauucuaucagguagacacucuuccuauuuccauuuuauagauaggugaacugauucucagagaauuuaaguaacuugccuugagucacagucuucuaaauggcacacuaagauucuaaccagaugaucagacugcauauucuauguucuuuuuuucuuuucuuuucuuucuaaauuuuaaauagauguguuuuuuuauguuauuauuaucuuuuuuuugagauggaguuucgcucuuguugccuaggcuggagugcaauggcgcaaucucaguuuaccgcaaccuccgccucccggguucaaaugauucuccuaucucagccucccgaguagcugggauuacaggcaugcaccaccaugcccggcuuaauuuuuuuuuguauuuuuaguagagacaggguuucuccauguuggucaggcuggucucgaacucccgaccucaggugaucugccugccucagccuccuaaagugcugggauuacaggcgugagccaccgcgccuggccuagauguauuuuuuuaagaacaguuuuaaauuuauggaaaaguuuagcagauaguaggaagaguucccagauacucuacauccuuaguacacuccgcacccaguuucccauuauuaacaucuugcaugagugugcugcauucauuacaauauugacacauuauuauuaacuaaaguccaugcuuuauucagacuuccuuugcuuuuacccgauguccuuucucuguuccaggaucccauucaggauaccacauuacauuuauuugucguauccucuggcucuucuuggcugugaugguuucucagacuuuccucguuuugaggaguauugguuggaacuuauccacuauuuuguagacuguuccucaacugcgauuugucugauguuuuucucaugaucagacugagguuauggauuugggggaggaaaaccauaaaguacugaccuguauccagggucgguacuauuuacaggaguuaucacugcuuauguuaaccauggcugagauggcaucugucagauaucugcccuguaaaauuacuucacuucccucucuuucuguuucuuacuuuuuggaaggaagucaccauaugcaguagagccugcuuuuuuuguguugcuguuguuguuuuggagacgggaucucacucugucauccagggugaagugcaguggcacaaucacaacucacugcagccucgaccucccaggcucaagugauccuucccaccucagacucccaaauagcugggacugcaggcacaugccaccacaccuggcgaaguuuuuguauggauggggccaggcuggucucaaacuccugggcucuagcaauccuccugcuucagccucccaaagugcugggauuacagaugugagccaccgcucccagguaagccugguuuuuugaccacuguguuauuucugucacaaguuaguuagacaauguuaugucuagcucucacuucucuaagcuaacaccccacugcucuguuccucuuugugguaauauuccucaaaagggcuauuuauacuccagguccuccauuuuuccuugaaccccuccagucaggguuucaccucccaccgcuccauugaaaguccugucaucugaagucacuacagcuaaauccaaugguugguucaaaguuuugaucuuauuugauauaguugaucacuccuuucuccuuucuucuugaagugcuuucuccgcucuagaacguuacaugccccugccggacgcggugguucacgccgguaaucccagcacuuugggaggcugaggcggguggauugcuuguggucaggaguccgagaccagccuggacaacauggugaaaccccgucucuacuaaaaaugcaaaagauuagccgggcgugguggcaggugccuguaaucucagcuacuugggaggcugaggcaggagaaucccuugaaccugggaggccaagguugcagugagccgggaucacacuaccguacuccagacugggcgacagagcgagacuccucucaaaaaaaaaaaaaaaaaaauuacaugcuccuugauuucuucucuucuuauagauuuaucucaaugucuuagcgugccccugggcuuaguccauggaccuugucucuucuguuuaucugcuaaauucacguaaauucaaucuauauacuacucccaaauuucuagcccaagucucccucuggaaugucaucuucauccaucuauuugccuauuugacagacaucuccaauuuaacagcucagaaaugcucccccagcccucccaaaguuuucccaucucaguaauggcaguuccauucuucauuuguucaggccaaaaauauuagccuuuugugacuugucacuuucucucacaaaccacauccuaucucucaguaaauaaugcugcugacugugccuucaggaucugucuaauaaucugaccauuucuuaccacugccaccguaaccaucuuggcaccaaccaccaucgguucccaccucuacuauuuuagcaguuggcugacugggcucagacucccugcuacugcccuugaccuccuugagugucuuuucagcccagcagucggcaagccugugaugccuguaaagcauaugcuaucauugcccuauucagaacccucuggcggcuucccaggccagucagagcaaacccugaaguccuguguggcuuuucucacuuucuucucccucuuguuugcuugacuccaaccacauuagccuccuuguuccuugaacacgcaaggaacguucuuccugccaguaaccuguaggcuugcuucuucacuuccuucauguuuuuguuuaacuauuaccuacucugaccacucuuuuguuuuguuuuguuuuuuuaagacggaguuucgcuuuuguugcacagccuggagugcaauggugcaaucuuggcucucugcaaccucuaccucccggguucaagagauucuccugccucagcaucccgagugggauuacaggcgccuaccacaaaaccaggcuaauuuuuuguauuuuuaguagagacgggguuuaacuaugugggccaggcuggucucgaacuucuggccuuaggugauccacccaccucggccucccaaagugcugggauuacaggugugagccaccacaccuggccauggccacucuuuuaaaauugacacccccccccaccacucucuuaugccucuuuuccacuuuauuuuucucuauaucauuuaucaccucucacauacuuuauguauguaaguaucucuauguauauauaaaauaaacuauauauauauguaaacauauauauguuuauuuguuuauucuucaucuagaaauaagcuucaagggagcagggauauuuccuuccuuuguuuccugcugacucucuuagcaucgaaaauuguacuuggcacagagcaggcacucaguaaauauguacauucugaauaaauuaaugaaucaacaaaugucuauuaaaaaccuuguuggguugucuauuaaaaaccuuguugggcagaaucuuugauaaagcacuguaaauacaauguccuagucccugcuuguaagaauuuuccaauuuaguguaggcaacagaccuauaaaaguuuaacaagggaagaauguguggggaaauaguauugauauucaccugggaaugaaauuacauagcuucugacugaaaccuugguguugagggugaauuaucucccagagguaguuaauguuagguuccuaccugugucuaggauuaagagagcaggacagacagaggggcaccugagaagucacacacagcccuccgcaguuaugaguccuacucaggcaugggguaaaacauacacaugagcuuaaguaugaauaagaacuauuucuuauaaaauauauuaacuaguaaguguuaaugcuaacagucugguaugaagaauagaucuaacuuauaauuuugacuuuuguuuuacucuuuuggaauuaaaaaugucuuuaaccuuaaaaguucuuuuaaaaaauugucuaauuuuuugcaugcuuuguagaaagaaagagacaucuuuccuuuuucccuuacagugucuaaaaacaagcuuugugagaauggagucuuaauuuugcagggguuuuggcaugugguuguaugcaaauacaaagauuccaaauacggauguguugcauuauuugaaaaaaccccuucagagacauauuugcauauggagacgugauuucugcaacugaaaacagucaguccugcacucucaaaacagccuucaaggacuuuugagcaucugauuucugaacuucuuagguugacuuuuuggcuuaugugacuccaauacgacuuucaacaaagauuuguguuccaaaaaaugguuuuaaacaaugcuuaacuaacagcauguuuuucuuaauuuguauuuucaguuuagaaugcuuuuaacuuuaucaacauaauuagucauugagaacuuuucucuguauuuuuauuugauauguacugcgaguaaacaaaguccuauauucugaaaggggacacguaagggagaguugaagaaaaugauaaauauugaagaauguaauuaacauguugagaguuugcauuccuguuguaucagauuggagcuauuuuauagaauuggaucuaaaugaaguauacauuuuauggaugcuaaaaauacucuuuagcaauguuucuauucagaaugcaucaucauuagagaaaagcuauuaagguugcagugugaaucaccaguuggaaaaagagaaaacauauuucauuuccaguccggaagcaauccaugcaugcaggcaguauucauuuuaacagucuggaucaguuuuuuaccaugaacuucugcuauuagaaaaaaugccuuugucuaaucuagcuuuccuuagaugugaugcaaacucagaacuauaugccccggucaauguuagagacccuaaaaccccagcucauuuggcaucuguucauucauauuccagcugaaucucagaaaugugcuuaagggaaagcaucugauauuagcaguuucucagccaagucacaggacgggacaucccagagucauggccugcugcacuuuuaaaagggaaauucaggaaucaaaaaaaaaacaaacagagaauggaauuuauggaaaguauggaaugaaaagcugacauucccugggacuugaaauguuaacucuggauuuccuuaauagcuauaaacugugccuuuccuacuguggcaauuguugugagcuagaacauguuuauaccuuuuuauguauaaauauuuuaucugagacuccugcuacuauugccacccgaugcaucuuccaaaagguaaagcuuccaucuuugcaucaccuucucagaaaucugaauuggucccauugcuuucagaaugaaguuaaguucauaugcuaacacucagggccucugucugucaaucagcaaaaauauauugaacguguacuauguggcuaagcauguuucugcagauacaagguaacauggagaccucauggagcuuguucaccuuuucuuuaacgugaacacucugcuccaagcauucuggccuucccucugcccucuuguguugucuucacuguuucuggaacaauuccccauuugacauacccuuuucuauuccuuuagccuaguuaaaccuuaccccacgacacgacacuucuauugcaaagcuaggugguauuugguuacccuuccuuuccuuuccuggcugugguaguccacaaaagcauuuucucccuucagucuuguuaaauuuugugcauaugucuuaucccaaaguuucaaaggguagcaggaacgauuuuagcuuacaaaagaaaaaugaagaagucuauuauuuaaauauucauuacuaugaauuuauaugauacaggaugccuaauacuauguaaauauuagucaauuaauuuucuuuuccuucuccuuuuuuuuuuuuuuuuguuuuuuggaggcagagucucacucugucacccaggcuggacugcaguggugcaaucuuggcucacuguagcuucaaccuccugggcucaagcuauccucccaccucagcuaccgaguaguuaggacuauaggugcaugcacaccaccaagccuggcuaauuuuuaaauuuuuuuagagaugggguuuugccauguugcccagacuggucuuaaacuccugggcucaagcgaugcucuugccuuagccucccaaagugcugggauuacaggcgugagccacuacacccagccucgauuaauguucuaauagaaaauguggaaaccuaaacuuucccuuugcugaaauuugauauuuagaguucucuuguuggaauguucauuuugagagugggaaguguuuuaaagauaagagguguuauaauuaauuaacaggccagggaagagcaagaagauuuauuauauguauuaggugggacuacaagaacauuuguuauuaagaaguuugagauuguucagugaggcuguguuuugccuggaguugugucauaggucgauggcagugccaccacuaaauacauguguuccuguacucacccagaggcccacgggaaugcucuguuuucacuaagaacuuuuuuccuuggaaagcaggauagucugcggggcucagacucauuuauuugucuuguuuucaaucugaaacuguagugauuauuuuuuccuccccaggauaguguacucuauccaauacuucuuuaagaauuggccucucuuuggaaguacucaguuuuagacauggcauagcucaggcuccagaagccaccccuccagaaagccuucccugcuguucucaucuuuaguuagaggccugucuucaugcucaaaccacacuuagugcauacaauuacuguauuacuggcauauagcagauacucaacaaauguuugaacuacacugauuugcaguauuucucuuaagaguuuuuagaaauagcuaaauaaaguguuuauaaaaaaugugccucaaugauauaggcagauuaccucaucagaaagaaauauauuaaaauaacauuaccauauuuggcuaauauuuuugcuuuuuaaaggcuuccuuuuaaaaaugauaagcuaucuaaaacauauauuggcauuuggauagucuuugccucugugaaacaucaucucuucaaagagaugaggaaugaauauauucuugccagaacuugaaauauggaggaagggcaaagacauucuaacucaaugaugucagacauuuuauucuagcuauuuuucuuuccuuacagccuaaacaugcauugaaauagaaugucucaacuuuaucuucucuuguuugauauguaauugcaaaugcugccacucuauuuaacucuguucugguacaaguuguaacagaguaacaaaauucaagauaugaccuuguguauaucagucaggauaaacuaaguuaugcugcaguaacaagcagcaccaaaaaucucagugguuuaacauagcagaggcuuacuuuuugcucccaggaagaacacugagaguccagcaaacucucuuccauguagugacucagcauuucaggcugcuuugaucuugaggcagcccccugucaacuuguagugaauugugcccugguucuucaguguuucuggcuggaagagacacagaggcaugccuaaccugaaagggcagggagauggaauccucuaugaugggauagaggguuggaaguauuggcagcacuaguaaugucuaccgggucaauuuuuagcucauagaaagagggccagucaugguuucauauugugaacacuuucaauuuucaggauuuacucacagccucagugggagcauaaaguugagguaaauugaauauuccagcaaaggcuuauacaacgaaaaauugggcaugggggggaugccauauuaaggcagaagauauuugccuuucugcuggcuugauuucaaauauuauaacugguguagaaacucccuaagaaauuaaugaccuuuggacucuaaaacagacuuuuguguguuuguguguggaaacagagucucacucuguugccuaggcuggagugcaauggcgugaucucagcucacugcaaccucugccuccuggguucaagugauucucccaccucacccuccugaguagcugggacuacaagugcacgccaucacaccuggcuaauuuuuguauuuuuguauuuagucaagaugggguuucaccauguuggccaggcuggucucaaacuccugaccucaagugauccucccgccuuggccucucaaagugcuagaacuacagaugugagccaccacgccuggacccaaaacagacuuuuaacagaagaaaguuucacaagacuuaucauuuuucugagaucugaacaaccauugccuuuuaaaagcacaucugccuuugaagucucccauugguggacaggggaguccuaucuccuaugagaccaccuugguuccugcuggagggcagcuuccacauauugguguguggcaggaugaaaggaugcugagcuccuaaagccaguuaugguggugugucaggggucccccgugaccaccuucagauaacagugggauuuuauccagagacuugcauccaggauccuaaauuuuuuaguuucucuggaagguaaaguuaugaaaggauggugccaucaccaccaaaagcccaaaacacauuguuaauuuuagugcucaauauuccagauugggaauauuaucauaggaacaagaccaccuuuucugucauuugcuuucuuucuccccgcuuugccucaaaguacacuuuaaaauuuggaaguugugcagaaaggcaauauaaauuuuugcuugaagaauccuguuaaaucagggcaccauaaaaacucauauacuuucuguacaguuuuaagauguuuaugccaaaccuuaauugaauuauuuaaagccuaguaugcuaguaaaacauuucccugauuuuacccagauauuagcuuuuaauugcucaaaaguguucaaugggaagacagggggaacaaaacaccauuucucaaaccuucaacagcugaaucuaacuguauuacgaaugaauaauaaccacacugaaggggugaggaagaaaagaauuaaucuaaguacuuuggaacacagcaucuuaacuggaugcgcuuaugcuaaggacagaaauaauuauuguguucugauuuugcuaaugugugucucacagggguauggguuggcaauucugaaagcacuuuaugugcauuguagaauuaaacaaaugaguaaauauauuaucaauaauauuacuguucaagaauaaaguuacaaaugaggaaggacugaaauauacccugugauguuggauuagaaucagaagcaucagaauaaauucuugguauuuaauauaagcgccuacugauagaggaauagagauccacggaugaguguacauaccuacauuuccuugcucugugcucuuggagggccuagaagcaauggaacccuggccacaaugagcaauucuggcaccaggauugagcuucuauacaccauuguccaaucaagaaaccagagaucauuagacaaauaauuccaguccuggaaaggggaaaauacaaaaugagccuggagcaccuuguagagccagaaaauaaggagauacucacaaaaagauagggcuugucaaaagaacacaaaaggccugccgugguaguucucacauguaaucccagcacuuuggaaggccaaggcgggcagauugcuugagcuugauccuaggaguuugagaccagcuggggcaguguggcaaaaccccaucucuaccaaaaaagaaaaaaaaaacccacacaaauacaaaaaugugcugggcaugguggugcagugcacaccuguaguugcagcuacuugggaggcugaggugggaggauugcuugagccugggagauggaggcugcagugagcugagauugccccacugugcuccaaccugggugacagagugagauguugucucaaaaaaauaaaauaaaaauaaaaggaaaaaaaaaaagaacacaagagccaaccaaccuauuggacaaagcuagaauaauuuuagcaacaaaauuauuaaugauaguacuggauuuuaaccuguaugguaaaauaaauauccaugagcccauagauauaaauaaacaacuggauaaauaaauaaauaaauguaggagaagggacagcuguuucuuaccaaacaguucaugaaggaaaaagggaaaauagaaaaaucaccauuaagcaaauauuguaguaauaauugugauaaauaagauccacugguggaugcaaauauuaguggcccaaaucugaggagaagcagaguauuuccauaaucucaaaguaucuuccccgaaauauuuauuaauuauaaagagaaagauaauuuuauaguagagaagcucugcagacagucccuucacugaaugauaaaaauaaacauuauuauugauaagacauugcuaucuuaaaccucuugauauuaugcacugagaaggacaauaucauuucacuguccugaaagacaaggaaagacugagggaccaucauagauuggaggagauuaaggagaaggaacaauuaaauauaauauggaaaacuggauaggaucuuagaacagaaaagaggcauuaguggaaaaacuagugaaauuagaauaagguuugcaguuaucacugauucugaucauuguauugugguuaguaagaugucaacauuagcagaaggcaggugaauauauuccaaauuaguucaaaauaaaaguuauaaauaagaggaaaguuaaaguuauaaauaagaggaaauaaaacauuagguacacaaaaacaaguauuuugauaaaaguacaguaaacaauucuuuguuuauauugcaauuuccacagcagagagacuuucaagcagcuggcuggauguucgucauauugaaaaguauguagaccaagguaaaaguggaacaagagaauuacuuugguccugggcacagaaaaacaagaccaucggugaccuuuuacagguccuccaggagaugggacaucgucgagcuauucauuuaauuacaaacuaugguaaaugcugauucuuauaauguggcucuuaaucuguaauaggaacuguaauuuguaaauucgaauauugcauuuuauccaagacauugacucaugcucugugucaguguuuccuuaccuguggcuuuuaucuggaagggacuuuccagcuucacauuuucuugugacacuuucuucccuuaucaccuaacuuauacaacauauuucuuucuaucacuuuauaguuuuguuuuuuuaacuuacuuuuacuuacaaacuacacuuuuaaaaauguuucauuuuuagcaguuaauagaaucagcucucugucaaaaacucugaaacucuuugagucauaaacaguuggaaucacaauauuugagauacagaucaugcuauucuuuguuuuacuauauauuacaaguuaaaaauauaauuguauuuucccccauauuuaauauuuuauauuguaccuaccuccagaauaaucuggggauguuucuuuuaucuucacugcuguuuuuacaccacagcguuuaacccugccuuacuuguuacuacccauuccacaguagccuaauucuucccuuugucuucucuauuucugggucugugucaugccuuauauuuagaacaacaugaucaauaaaguucaugaaguuuucuccauuuauucuuugucagugaaauaaucuaacaucaccuguucuguuuguuccacuuagauguauucauuucaacaauaaugaucuugggucuuauguuauagacccaaggcucuuagauuggaaacucuuuugaaucaacaucuuuauucuuuggcucuuuucauagaucgcauuuuuaguuuuguguauuugcacacauguucuuugguaauauauuuagugcgcaugagcccuugcgcacacacacacacacacacacacacacacacacacacacacaaggaauccugagagauuuguaccagaaaacuguagcuucacauugacuuuuauuuugaucuuuccuauuauugggauauuaguuccuaauagacuuccaccaugauauuauucauauaacuuggcuaauucccuuugucuuuugcacauuguuucuucacuuaguuuagggcagcagaauacuucacugugaaguugacugagcaagugaaauucagugagucccugggaacuguaaaugcaaugccuuuucauuaucugagccuuucccagccacugaaaccacccacauggcuugcuguucacaauacaaacuuacgccacuuuaauaggacacacagguauguuuuauacuucaguguucuggaauaaauuuuaggguauauuuucacucucuauguuguuuauuugugcagcagagaauaauguggacuguaaguagacaaaaauuccacauucuugguugacucuuagucuguugcacaugcaacauuuauuuuucuuuuuuugaugugagauuagccgauugguaaaaagacuuuacugcccuaguacaaagagauagguaaaucugaagugaagaggaggauagcaccuuacuucuuuacuaaagaaaauagcauuauuuaauuguaauugauugaguugauguuucaaauuaaauaacaauuuugaaaaaguuaauuauguaguuguuaaaagugagaugugaugauuuguuggaagcauaaguguagcuugcucaacaggcguuuccuaucauagcuacucauuaaauuaggaguuggagcuccuaacuaaagaugcauaaaaugauuuaguccuucuaugcugccaccguggacagauuuaucaguuaucuaaauaaucaguuauugcccaccuuuccuugcaauuuuauucuguuuuguggaacugauuuuauuuuagaagaauuuggggcuuuuauauuccagcuuccaggcaucacuuuguagauuuggauuuuccuagucauauugaaaugggccuuuuauuuccucccagguacuaugccuacaauucagguugcugcugcuaggugguuucuucacaucaguaaagcauucucucagaucucaggacauaacaaaauugcucaagaaacuagaaucucuauuuuuuguuauuauauuucuggcaugcauguccuuauguaucacauuuuguauuuauaauucaauguucagcaauuguuuuccaguuuugacacaaaauucgcagcuuucuacuggcuucuucuuaagagagacauuuucaaucuuccauuuuauaugacaaugaaggauucucucucuuuucacaaacagcaaaagaaauaaugacuuuuagugcccauacagcccccagauuucacauuuuuuucuacacaaauucaguauguuuguuauuuuuucuucuugccuaguugcccuggcuagaaccuuuagcauguugaguagaaguggcaagaccagacauccuuaucuuguuccugaccuuaaggguaaaacauucagucuuucaugauuagugauguuaacugucgguuuuuuguagauggcccuuaucauauugaggacauuuucuucuguugguagggcuuuuaucaugauaggguguuggauuuuucagaugcuuuuuugucaucuauugaaaugaacauguguuuuuuguccuucauucuguuaaugugguguauuacauugauugauuuucagauauuaaacaaaucuuggauuccugggauaaaucccauuuggucauuguaucuaauccuuacaugcuucuggauucaguuugccaguauuuuguugaggauuuuugcaucuauauuuguaagagguauuggucuguuguuuucuuguaaugucuuuauccggcauugguaucaauaauacuggucucauaaaaugauuugggaauuguucuaucuuuuucuauucuggaagaauuugugaaggacugguguuaaucuucuuuaaauguuugguagaauucaccugugaagccaucuaagccucggcuuuucuuugugggacguuuuaaaguacuagcucaaucucuuguuaugaguccauguauauuguuuauuuuugcuugaguuaguuucaauaguuugugucuuccuagaaaccuguccaugucaucuaaguuaucuaguuuuuuggcauaucauuguucauaauauuccuuuauaauuccauuuauuucugugaggucaguauugauguccccccuuuuauucuugauuuuaguaauuugaaucucuuucuuggucaguuaagcuaaaagauugucaauuuuaaugaucuuuucaaaaaaacaauuuugguucuaucgaguuuucuuuuuaaaaaaucuucuauuucggccaggcgagguagcucaagccuguaauccuggcacuuugggaggccgaggcaggcagauugccugagcugaggaguucgagaccagccugggcaaaacggugaaacccuaucucuacuaaaauacaaaaaaauuagcugggcguggcagcaugcgccuguaguugcagcuauucaggaggcugaagcaggagaauugcuugaaccugggagguggagguugcagugaucugagauugcaccacugcacuccagccugguugacaaagugagacuccaucuccaaaaaaaaaaacaaaaaacagcaaacaaacaaaaaaauuccucuauuucauuuauuucuaaucuuaauuauuuccuuccuuuugcuugcuucaguuuagguugugcuucuuuuucuaguuccuuaaugugaaaguuuaguuuacugauuugaugccuuucuucuuuuuuuaagguaggcauuugcagcuauaaauuucccucuaagcauggcuuuugcugcaucucauaacuuuugauauguuguguuuucauuuucauucaucucaagguauuuucuaauuucucucaugacuucuuuuuuaauucauuuguuauuuaugauuuuguuguuuaauuuccagauacuugugaauuucccaaauuuccuuuugcugcugauuugugcuuguauuucaauaugaucagaaaauagacuuuguaugauuuuaauccuuacacauguauuugagguucauuuaauugccuaaggucaggucuguucuggaaaauguucaauuuauacuugagaaauauguguauauuuugguuuuggauggaauguucuauagaugucuguuaagucuagcugguuuauaguguuaucaaggaaauuuguuauugauugguuaugcuuucuugcuaguuuucuaagcaaaauaauuuaagaaacacuagaagauaaucuagaaagaagaaagcuagacuagaaaaugaaaguuuucuagucugagacaaaauguuagaaaugacagcaaaauauggcaggguuuuacucuuuuguaggaagcuacauaaauuaccucaguccagacagcacucuaccacauagaaguuauagucgacauuuggggugguaaguauuugucauugauacacacacacacacacacaaacacacacacacgcacacacaccaccuccaauacuuuauggcacaagaugauauaaaaaaauaaacuaacccaggaagauauaauaucauaauuguaacauuuaaaaauauaugugcaaaaaugcugauaauacagcugggcgcuguggcucaugccuguaauccuagcacuuugggaggcugaggcagacagaucacuugagcucaggaguuugagaccaaccuggccaacauggugaaacccugucucuacuaaaaauacaaaaauuagcugugcaugguggcagggguuuguaaucccagcuacucaggagguugaggcaggagaaucacuugaacccaggaggcggagguugcagugagccaagauugcaccacugcacuccagccugggugacagagcgagacucugucucaaaaaaaaaagaaaaaaggcccagugugguggguggcucaugccuguaaucccagcacuuugggaggccgaggcaggcagaucucuugaggccaggaguucgagacuagccuggccaacaugguaaaaccccaucucuacuaaaaauacaaaaaaaauuagccaggcaugcugauaggugccuguaauccuggcuacuugggaggcugaggcaggagaaucacuugacauucucaaguggaggcagagauugcaaugagccgagaucaugccacuguacuacagccugggcgagagugagaguccaucucaaaaaaaaaaaaaaaaaggcugauaauuuuuuuuaaauuuucuucuuugugcuuuaauauuuuuaaugucuaacaacaauuugucuuauuacuuguuuauuauuuaauuauuuaaauuauuuaaaguuaauaauagauuaaggcaacuacuuauguuuuaagugaacaaaaguauguuuguauaacauuuguuaauuagaaagcuauuucacaaauauaauacuucacaaauaauacuuucacaaauuuaucguaauguugcaugggaaugaaacuuuagaaaugaacaauggcuagcaagacauuuauuuucagagucucagaaaggaaaaacauuagggacauaaaauuuuuuuguaucuaccuucccauauuucucuuucaggagcaguguugaguccuucagagaagaguuaucaggaagguggauuuccaaauauauuauucaagguagaguaugugugcauagaaaaugagccuugaacuuuguugcauguauaauugagcauaaggaaugaaauuagcaggcagaaaaaugcuggauuugccggcacuuuuuaaaaaucagaaaugccuuuguucucucauuauucucuauuuaguugaggauuuaggaaauuagagauuuauaaauauuugagaaauuaagagcuuucuguucucagugaucugucagagaugagacugagaacuacuaaggaugcugugauuuauacauuugucuuaacucagcuuuuaauuuuccuuuuuugguugguguuuugcaugucacuguuaguuuuuauuagagcaaacuagcagugaucauuuuuauagcauuaaaaguaauuuaaaauugacuuugacugacuaugacauugaaacuugaguuuuuacuguuggugugaaagccuuaaauauggcaaugaaugcuauuaaauaaagugaaauaacuuugauuucugcuagcuuucuuuuaaauuagguugcacucuguugcacugcauaguccccagggagcuuuggauuuguguugaggcucuguucuuucuagauguaugaaauggaauuacuuuaguauauauuucuucucuuaggaaacagccaaugucaccguggauaauguucuuauuccugaacauaaugaaaaagguaugaaaaaaccaguuuuuuuccaacaauuuuuuuaaaaucauacuuucauuuaagugaauuaagagggagaaauacccaauaaacacaauaaucauuuauauucaaauucgguauaaaauuucauagauauuaaaauaacuucaauuugauugacacuuauaguucuaauagaugauauguuauuauguuaaggcuccauuggcuaaugaagaaugcaauuguggucucuucacacgggggauauuuuaguuuuuuguugguaaaauuugcuauguuugugugucaugggaaaacauuuuuaaaauuauguugagauuuauauaguuuuagaaaugcucacagcaauuacagaaaucuuucaagaugauuguagagcaaugcugaaggucaguaugaaaaucuaguuaucuuccauaucaacuuuccuacuuuauuaguaggaagaauaauuuaguuccaccuggaaucauucugauaaauguuaaagacuauuuaaggcugcguugccuagucuuugccacuagaucugaugcuucuuucauugaaaaaagaauuaggaaaguuagauaaggcuuugguucuucaacaauaaggucuaaaucaaacauuaagugucuucagagaggauuuuguauuagcuauggaaauauagccaaaguuggguucugaaggacauagccaaacuuuuccuuuucaauuuguauuugauuccuguuugcauguuuucucccaaucuccacuuugggugaguuuuuaaaaggcugaaucaucuuucuaauucacucugaggaaguaaauuaggcaguuagaggauuuggcacaugagaaguguuucuaucagucaugcuuggagaauauugcuuagucauguccauauuuccacuuccauaauuuuuuaguaguuuuagguucauagugggucaacagcaacacauugaccuaaugaccagaaaauugaaucuuggaagaauuucuuccacuaagcucuuuggcugaucucuuuugagaggagguaaaaaucacaaugcugcuguccgaagaaacccuuugcucuguggaauggugggaacuagauccaaguaaaugugcagagagcacaugguggucuucggcuuugguuccugggccuuucucuacuaaccuuccacuggacucugauuuguuucuaauauagaaauuuugguuauaauggugauguuccuucuuagcuaacuuaucuucccccuacuuuccuuccuaaggaauacugcuuaaaucuuccaucagcuuucaaaauaucauagaaggaacuagaaauuuccacaaagacuuccuaauuggagaaggagagauuuuugagguauacagaguggagauucaaaaccuaacauaugcugucaaauuauuuaaacagguauggaaagaauuacugucacaggacaucaguuccacuuauuuguucaucuuucauauuaaaauaugucauuuuucaucaacauugaaagggguauuugaaaauaaaauuuuauaaguggaaauaagagauaugauuucagaugacuggagaaguaaagaccugucuugcaagaaugaggaaguuaaaugcuuuccauccccagauguuauagcaugaaagacuuuucugggcuggguguggugguucacgccuguaaucccagcacuuugggagcccaagguggguggaucacuugaggucaggaguuugagaccagccugaucaacagggugaaacccugucucuacuaaaaacacaagacuuagcugggcguggugguaugcuccuguagucccagcuacuugggaggcugaggcaggagaaucgcuugagcacaggaagaagaggcugcagugagccaagauugcaccacugcacuccagccugggugauaaagugagacaccaccucaaaaaaaaaaaaaaagacuucugaaaagucuccaggacuuuguuaaagagggucagguagugcuagccugcccugauuuucuuggauuuuuaggaugagccggguccucuccaggcagccucacaggcuaagccacaguuuggcauuugguacugcuuuauaaauugucuucuaucacaacucagaaggguggaaggaggaggcuuucgaguaggaacaacaaaccaacaaacagaguaggaggucagaagacaguugauugacugcagccaaugaagcaaaaagggaauuccaggaucaagcucaggagucagucagagauagguccacacacaaacacagaagagcugcucuucguuuucuucauaguuggucaacaauaaguaaacauuuacuaaacucuuauauggacugggugcugagcauguagagaugaauaaggcauaguucuguccucaaggagcucacagucucucuggugaaauagccaggaaaacaaaagauuaaacuguuguaaaagagguacuuuagcgagaauuguacaaaagaucacagaagcacauaaaagauagcaacucucacagccauaaaaaagaaugaguucauguccuuuguagggacaugaaugaagcuggaaaccaucauccuuagcgaacgaacacaggaacaggaaaccaaacacugcauguucucacuuguaagugggaguugaacaauaagaacacauggacacagaggggaggggaacaucacacacccagggccuguugggggguugggggaaaugggaggaagaguauuaggacaaauaccuaaugcaugcgggucuuaaaaccuagaugauggguugauaggugcagcaaaccaccguggcacauguauacuuauguaacaaaccugcauguucagcacauguauccagagcuuaaaguaaaauuaaaaaauaaauaaaaaagaaaaaaaaagaaaaagagguuuaauggacucaguuucacauggcuggggaggccucaguaucauggcagaagaugaaaggcacgccuuacgaugcagacaagagagaaguugugcagggaaacucccauuuuuaaaaccaucagaucuugugagacuuauucacugucacaagaacagcacuggaaagacccacccccaugauucaauuaacucccacugggccccucccacaacacgugggaauugugggagcuacaauucaagaugaauuuggguggggacacagcaaaaccauaucagaagucuaucugaaaagguuacauaccauaugauuccaaguauaugacacuuuggaaaaggaggaacaauugagacaguaaaauauggugucuggguguuugguaaggguuagaugaauaggcagagcacagaugauuuuuagggcagugaaacuacucugauacuguaaugguggauacauauuaucauauauuugucaaaacccauagaauauaccacacuaagagugaacucuaguguaaacuacgguaauaaugauaugucaacuuaagaucauugauuuuaacaaauguaccucacuggugugagauguuaauaauugggaagcugugugcaugugugugggaacgccuuacuuuccucucaauuuuuuguaaaucuaaaucugcucuaaaaaauaaagucuacuaauuaaaaaaaaaaaaaaaaaagauagcgacucucuccucccagaggagggcugugucuggcacccagaagaguaucuggccagaguaaccacucaguaaacaguucucaaaaacaaauggggaaaccauccagcuggauuuugaaggaugaguagaauuuuggcaggcaguaaaggaggggaauuacauuccugguggaacaaauagcaguugcagagaccuggagguguguguaugaaaacguaggucuuccucaugaauagcauuucauucagugcagcggacuggguguagggaagauggugagaagaggaugcuggaaagauauuaagucugugggugauuuuuaaguaggagacugaaagauuuguguuguuaaaauaugacuuagauucuagguuagauaguggauuggaaguuggcagaagaauugggggaaagauggcaagagcuagcuggaggcaggcugggcaugguggcucaugccuguaaucccagcacuuugggaggcugaggugggcggaucacuugaggucaggaguucgagaccagacuggccaacauggugaaacccugucucuaccaagaaauacaaaaaaaaaauuaaaaaaaaaauagcugggugugguggugccugccuguaguuccagcuacucgagaggcugaggugagaggauugcuugaacccaggaggcagagguugcagugagccaagaucacgccacugcauuucagugugggcaacagaguaagacccuaucaaaaacaaaacaaaacaaaacaaaacaaaaccaccagacuggaggcagaaagaccugguagagggauauuucagaugugcaaaccaagaaauggacaggguauaaacccguguucccaacccugacuauauauuagaauuaucuaggagcuuuuuaaaaaaaugagccuuuaaaaaaauugacuuuuaaaaaaaugggccuuuaaaaaaaugaacuuuuaaaaaaaugguagucaccaguauuuuuuaaaaggucccaaggugguucacauguguagccacuguugagaguuaaugcuguuagccugggcaaagucagugaggaugcagaggagaaagcaugucuaagagacgaggugaaguggaccacaucugauuaucuguuggauaggaguggggaagaaggaggguuucaaggugauuccgaguuugcagcuugcauuaccguaccguuuuaaaaauuauuuaccuaauuucuccauuucuccaaauugcauuuaguacuacuuaauuguacauagaaaucucaaaauuacugagaagaugaacagucugcuaaagaaacaaccagcuggcccaacuauucaacaaauagaaugugguugcucuagagguggccaagcuaaagccuguuucuuaaugccaaugugucccuggccccaauucguacauugucuuaugguugagccucaggaccccauccccaaaggguccguccagucuacuuuccuacucucucugcagcugccaccaaaucacacucccuuuugggaguuuucuuuccaugagucugaaugguauugauugcuucuagaaccccuucccuuucuuucuuaaagaaagguguuauuuccuggauugucuuugaccccuccagugugguuugggugacacuccuauguguagcaauagcaucaaagcauuacguuauucacccaccucucucaaaggacugggcagcuuuuuuugaagagcucuuauuugucuuuguauccuagugccuuauuacagggccuugcccauaguagcucaguaaauguuugcuggauaaauugaaugcagcauacauacccuuuucaagaauuuaguugcuaguuguuacgaguaaaaauaccugagauuaccaagguguguacaaagucuuacugucucuacauacauuuuaacuuucucuuaaggugguaaaugaaaguauggccggacuuugcccuucugcuuuuaucuccgcccccuauuuuaacccaacaugcacacacacacacacacacacacacacacacacacacacacacuuaucaggaaaaaaugagagcauuuaaugaagccuuagccacagaacauuguuaaagaaaugcaguuuuguaacauugguucauuaccaauuacuuuucuuagagggacugaggugggaaauuguacuagguguguuagaucugugcuucucuaacuuuaaucaccugggaaucaucuuacaaugcagauucugauucagcagaucugacaggagcccuggauuugccauuucucggcagcuccuaaugaagcugggguuuuuuggucauagaccacauuucaagcaacaggguguuagagugcuacauuagcauaaacaaaaaaaccgacuccuucauuuuucagacuggaaaacuauggccuuagggaaguuaagugacugacaaagaaucacaaauagcgaguguuagagaugggcggaaaauccaacccaucuggcucccaggacaauggucuuguaaaauguaaauucugauaaaaugguccuugaaaaugauuuuuuagccugauuuauuguuucugacuuccuaguucaacuuggaaaauaguuuccaaaauuccuguugaauuucucucccuuuauuccugagggcagaacuccaaaacuccaccuucucuagcaauuugcaaaugauagaacguuacaacuggugagaccuaggagcauacuuaauuuaacucuuuugguagaaguuggaaaccugagauccagagacaugcaaugaccuaagauauaugaaggcaucaagaacagugcuagggacagaguagguguucaguacaauguuacugaacucauuaaaauauucaugugucaggcucugggcuaucuucuaaagcuucuugaaaguaaagaguuauauuuuuauuugcuuaguaagcccaucuuuucaaaaggcaaagguaaacuugaacugacauauccaaauaacccaagucauaaacaccaaauuagugaaauuuuguagcagaauagaaauaacacaaguuggauucuuuauaagaucaaguuggggagguucuagcugucaugggauugucuuugaauacauagaauguuuuugaauuuauguaaaugugugcaaaauaugaugaaagaguuaacauggcgauacacugcaugaaaaaccuucaauucaagaacacugguucuagaucucuuuuggggcuaauggauuguugaaaaucuguugaaagcuaaaugucaucuccccagaaaaguguucauauguguuuacaccaaaaaguucaucuaauuuagggagacuauagacccuggguuaagaaucccagaaacagauccuuuccuuaauuuuguucuugucuuucuguauauguaggagaaaaaaaugcaguguaagaagcauuggaagagguuuuuaucugagcuugaaguuuuacuacugugaguauguuuucucuggaauuuccuccucuuugugccuggguuucaucucuguucauuuuuuauuuuacagcacagagcuuggcgugacauguaauaaauuuggguuggauguuagaacuucgaauaaauuuugauaucugcuuuaguauauuccuuaaaguacauuuuaaaauagaucauuuacauaauucacuugaacauauuuuaacaggaaacugucacaaggaaguagguuaaaucaugugugacuaacauggcugaauaguaauacuuagaacauuagaguggucuauauuucaccauuuccuccuuccuuagagaaauuccagucuagaagcuguuucaucaguauaacucuauucaggaagagaguuuuagacaaagaaaucaagcgcuuuugaugugcauauuauuuuucuggaauucacuccugagucugagaguccuuggagacaaauugaaaugacuucguuuucauauacauauucauaucugcagcugugcagccuuccucauugaaggccucuaacccuguagaguucacuugucauccuuuacaaauaggaaacuuuuucagauuuuuuuuuaaccaagaugugaagucgggaagcagggaggaagcugaagagagaaggcauuauacugaauccauuuucuuuuauacugaagaccagaaaucaaaauaguagaggcuaaucaucaaagcuuacauaucacuuagucaauaaaaaaugaaauccaaaauuguaauaguaaaaaguuuuuacaugugaguuuuauuuauuggcuuaugaaaguaagauucaaacauugcaaaauuucaaaaguacaaaagcauagaccaggaaaagauuuucucccaccauuaucauccaaccacccagcugaucuuuccaaaguaacaguauuaccaguuccuuguauauauuuccagagauauuuuguguguaggcaaauauguauuuuguuuucuuauuuuucucccuuaacacaagaggugacaugaacacauuguacacauugcuuauuuucauauucuauuauauucuauacaguaguuuacauaacccacuguucacaauuucuuagauuuguuccaauauuuuauuauaugaaauaaugcugcaacaagaaaaccuuguauauauguuauuucauacuuauuugaguauaucuguaaaauaaauucucauaaauaaaauuauaguaucaaaugguuaugugcauuuuaucauaacaaauuguccuccaauauaaguuauaccaauuuacuuucaaagcagucauaugagagugccugguuuuccauuguugccaaccuaguauuuauucuuaccucuuaauuuucgccaaucugauaggugaaaauaguuuaucaggguagcuuuugaaaaaauauuuaauugacaaauaaaaauuguauauauuaauguguacaaugugauuugauauacaguauguacacauugucuaaagaucaccacaaucaaauuaauacaucuauuaccacccaugcuguacuuuagauccccagaauguguucauuguacaauggaaagguugccugcuuugaccaacaucugucuauuuuucccaacccccagcccuugguaacuauuuuucuacucucugcuucucuacguuugacuuuuuuagcuuccacauauaagugagaucaugcaguauuugucuucugugucuggcuuauuuuacuuagcauaaugucuuccagguucauccauguuguuggaaauggcaggauuuucuucuuuuuauggcugaauaauauuccaucguguguguguguguguaugugugugugugugugugucucacacuuuauucuuuauccauuccucugucaauggacauuuaaguugugucuaugucuugguuacugugaauaaugcugcauuaaacaugagagugcagauaucucuuugagauacugauuuuauuucuuuuacauacguacccugauaugguuugguucuguguccccacccaaaucucauccugaauauacucccauaguucccauguguugugagagggaccuggucggagauuauugaaucacgggggcaguuucucccauacuguucuugugauagugaauaagucucacaagaucugaugguuuuaaaaaggggaguuucucagcacaugcucuguucuuuugucugccgccaugugagaugugcuuuuuaucuuccaccaugauuguggggcauccccagccacauggaacuguaagcccauuaaaccucuuucuuuuguaaauugcccagucucagguaugucuuuaucagcagcaugaaaauggacuaauacauacccagaagugagauuguuggaucuuaugguaguuguauuuucaguuuuuuaaggaaccuccauuauggcuguaccacuuuauauuccaaccaacagcauacaaggacuucuuuuucuccauacccucagcaacucuuguaucacuugucuuuuugauaauagccauccuaauaagugugaggugauaucucauugugguuuugauuugcauuuuucugaugauuagugauguuaagcaucuuuucauauaccucuuagucauugguaugucuucuuugaaaaacuaucucuuugggucauuugcccauuuuuaucagguuauuugcuuuuuugcuauugaauuguaugaguuccucacuauuuuguaucuuaacaccuuauuagauauaugguuugcaaguauuuucucccauuccauagguuuccauuucauuuuguugauuguuuccuuuguugugcagaagcuuuuuaguuugauauaguuccacuuguucauuuuugcuuuugucaccuaugcuuuuugugucauagccaaaaaaucauugccaagaccaaugucaagguaaauuuucccuauguuuucuuccagauuuguaugguuucagaucuuacauuuaaguauuuaauccauuuugaguuaauuuuuguauaugguguaagacaaagguccaauuuuauuauuuuguauguggguauucaguuuucccaacaccauuuauugaagauaauuuucuucuucuguuguauauucuuggugcccuuuucaaagauuaguugaugauauauauguagguuuauuucuguuauuuuuuuuuuuaaauucuauuccauuggucaaugagucuguuuuuaugccggugccauacuguuuuuauuacuauagcucuguaauauaguuugaaaucaggacgugaaugccucuggcuuuguucuucuuucuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggacggucucgaucuccugaccucgugauccgcccgccucggccucccaaagugcugggauuacaggcgugagccaccgcgcccggccuguucuucuuucuuaaacucacuuacuguuuugggucuuucaugguucuauauaaauuuuagcauuuuucuucuauuuuugugaaaaauggcauuggaauuuugauagaaauguguugaauguguagcucacuuugaguaguauggacauuuuaacaauauuaauucuuucaauucagguauguaaugcaucuuuccauuuauuugugucuucuucaguuucuuucaucaguguccuauaguuguuaacgcacaaaauuuucaccuccuugguuaaauuuauuccuaaguguuuuauucuuuuuaaugcuguuguaaauaggaucauuuccuuaauuuccuuuucagauuguucauuguuagcauauagacacauaguugauuuuuauauguugauuuuguauuaugcaacuuuucugaauuuguuuauuguucuaacaguuuuuuugguggagucuuuuggguuuucaucaugucaucuguagacagagccaccuuuaacuugcaccuuuccaauuaggaugcuuuuauuucuuuuuuauugccuaauugcucuggcuaggacuuccagcucuaucuugaauagaaauggaaagggugggcacacuuaucuuuuuccugaacuuagaggaaaagcauucagcuuuucacuguuaagguaugauguuagcuguggguuugucauauauggcauuuauuacauugagauacauuccuucuauaccuaauuuguugagaguuuuuaucaugaaaggauguugaauuuuaucaaaugcuuuugcauuuguugagaugguuuugugauuuuuauuuuucagucuguuaauaugguguaucauuuacauauuugcacauguugaaccauccuugcuucucagggauaaguccuguuugacucugguauuucauccuauuaauguucuguugaagacugggcacaggggcacaugccuguaaucccagcacuuugggagaccaggaaggugggucaccugaggucaggaguucaagaccagccuggccaacaugaugaaaccccaucuguacuaaaaauauaaaaauuagccagguguaguggugcacgcuugcaaucccagcuauucaggaagcugaggcacaagaauugcuugaacccgggaggcggagguugcagugggcugagaucaugccaccacacucuagccugggcaacagagcaagacucgaucuccaaaaacaaacaaacaaacaaacaaaaaauguucuguugaauuuagcuugcuaaauuuguugaggauuuuuguaucuauggccaucauggauauuggcauauaacguuuucucauuguguucuuaucuggcuuugauaugaggguaaugcuggccuacuaaaauaaguuugacaguguucccucgucuuuaauuuuuuaaaagauuuugacagggauuaguauuaauucuucuuuaaaugcuuguuagaauuuacccagaaucucuaugguccuggacuuuucuucguugggagguuuuugauuauuuaaucaaucuccuugguuguuauuggucuguuuagguuuucuauuucuucaugauucagucuugguggauuguauguuucuaggaauccaucuauuucuuuuaaguuuuccagauuguuggcauacgauaguucauaauagucucuuaugauccuuaguguuucugugguaucaguuguaaugucgccucuuucauuuauauuuuauuuauuugaggccucucaaaaaaacaagucucauaguaucaauuuuucugagagauauuaauaauccuuuuauauauuuaagagauauauuuuauuuucuaugaaguagcuuauaauauuccuuaccuauuuuuuaaaauuaggcuuuuuuuagugguucaaaggaauauuuuauaauuccuauuagaaaaucagccuauuuuuauguuaugagacgcaaauaauuuuuuaccauacugucauuucaucuuugcuuauuauaguuuugacauguagaaaugguuuuaauauagguaauuucacucgcgucugugugaagagaccaccacacaggcuuugugugagcaauaaagcuuuuuaaucaccugggugcaggcgggcugaguccgaaaagagagucagcgaagggagauagggguggagccguuuuauaggauuugaguagguaaaggaaaauuacagucaaagggggguuguucucuguggggcaggaguggggugucacaaggugcucagugggggagcuuuuugagccaggaugagccaggagaaggaauuucacaagguaaugucaucaguuaaggcaaggaccggccauuuucacuucuuuugugguggaauaucaucaguuaaggcaggaacaugccauuuaaauaucacuucuuuugugauucuucaguuacuucaggccaucuggauguauacaugcaggucacaggggaugcaauagcuuaacuugggcucagaggccugacaguuaaguuuaucaauguuuucuuuugcggauuccagauuuuauguuauaguuuuugccauuaaaaguuaucaugguuugaggccaggcgcgguggcucacgccuguaaucccagcacuuugggaggccgaggcaggcggauuaugaggucaggagaucaagaccauccuggcuaacacugugaaaccccgucucuacuaaaaauacaaaacauuagccaagcauggugacgggcgccuguagucccagcuacucgggaggcugaggcuagagaauggcgugaacccaggaggcagagcuugcagugagcugaguucacgccacugcacuccagccugggcaacagagcgagacuccgucucaaaaaaaaaaaaaguuaucaugguuuuugccauuaaaaguaaacauuacuuuuuuuuauuuuuauuuuuuuuugagacggagucuugcucugucaccuaggcuggggugcagugaugucaucucagcucacugcaagcucuuccuccuggguucacgccauucuucugccucagccucccgaguagcugggcaaaaaccgcaguaauuuuugcaccaaucuaauaaaauaauucucccauuuuuucccaguacuuucaugguuucauuuuuuacauuuauuugucugauccauuuauuugucuggugagguguuuucugugaacuacaacaacagcuugucuagguuucaaaaauucuaucggcauuuuuaaugcaauuuuaauaacuuuauagauuaaucuggagauauuuacaauuuuauaauguuggcuauuccugggguaccauuuuuauuuugcuaauauuuauuuuguguuaggcccuguuucaagugcuuuacauguguuaauucauuaauccucaugaccauccaaugagauaaauucuccuguuaucuccauuuugcagaugaggaaacugagguagaucuuaccuuuucuauaagauccaaguuauuuccugaaucaucuucucagaugugacuaaggcagaugcagcuuucuccucuuagaauguacuaucagaaaugggauugggagagaagccccuaaguaaacagacaauuucaauaaucuaauuuaagugauaagaugaggaaauacagagcacagaggaggaaaugauaacuugggggaugagcagcagaauagguuucuugauagaaauaauaucuaagcugagaccugaaggaugagguuucuuuaguuuaauauuaaggaaauuaccuuaaacagaauuguaaacuccauagaauguggcuucugauuccuuuuuucccuccuuucucgagggaaggggaaaaagcuaauaauuuuuguggaccuggcuuuuggcuuaaccuuuuauuucauuuucauaagaaccuuggaaauagauguuuuaauuacugauuacaguuaaaggaacaggcucagagcgauuaaauaacuugcccaaguuaacacagcuguuaaaaagaccagagauucaaucccagguuaguuguucaaaucuguuuaccacaccauggggucugcaucauuuugucugaacaaggcacucagaacauuugcugaagugauuuuagaagguaucagaucugcuaaccuucugauguauauaaucuaaaacccuacugauuuaaaaauuuguagcaaaagauuggguggcauggguccauagguacaacaccagcaaacuuucuccaagguaucuccauguuccauaccuugguaaccucuaaaguauccguuuuucuguuugaucaguaauacuuaaaaauaagcacauguucuuuucuccucucugagcaagagaguagagcaccaggccguggcucugucuaucugauguccacuaucuacugccuuccaaaagauuagucucucugaauuauuuuaaguugcaggagaaccaaccagguauacaccgacugugaaauacacuaccucaauuuccuuucaauccacugcuuuucauuucauagauauaguuggaaucauaauagguguagggaucuuguaucacagaagacuuugauauauuuaaaaauaaaaacuucucuauguguauuguguguguguguauguauacauacacacacacacgcuuccuuccuugaagaggaagaaaaggaaucagaaucccccucccccgccacguacacacaauauauguaggaauguguguguuuauaggaaaauuuugcuacugcagaaaugaauaauagguuuuuauaaauagaaucuuuuuuacagauuuauuuuaauauccccaagccugcccagaacauaguagaugucccauaaguaauuuuugaauuaaaccgaguucacaguaugugugaauuucacauuuuauauuucauaguuguuaccugggcucauagugauggcacacacaaucgaggaauagaguuuuuguuaauaagcuaauaaauaauuauuaggaaaaaaaaaagccugagaaaugcauacuacacugacauagaaaucugugauuuaaaaucaaugguauguucucaacaucaaacauuacuagucauauggauuuagacaauaaugcaagcuuugugaagacacugacaucucuuuugagcuguguagcugguaucuagcacaguaccugacauaguagugcucaauaaguggaugaaugaaaauggucuuuauucuuauguuuuggugacuuaaacuuauauacuuaaauaaaucaagcuaacaauuuuaguugcacuguuuuuacuuaauaagucauguugucuuucauauugauaaaaauaaguuaauauugaauaguguugucuaucuuuuguaaacuuuccaacauuacaaaucuuuaaaaaucuuuauuuuuuuaaauuuucugccuuauauuuggauguuuuauuuauauuuacaugauuacagucaaccaaaagcaguaacuaguauuuguuagaauuuuuuuuuuuuucuuuuuugagguggagucucgcucuugucgcacaggcuggaggguaguggugugaucuuggcucacggcaaccuccgccuuccgguucaagcaauucuccugccucagccucccgaguagcugggauaaccaggugcucaccaccaugcccagcuaauuuuuguauuuuuaguagaaacgggguuucaccauguuggccaggcuggucucaaacuccugaccucaagugaucagcuagccucugccucccacauugcugggauuacagguuugagccacugcaccuggccguuagaacucuuuagaccaauuuggaaagcaaaucugugucuguacccaauguguccggcugaauuuauauuccgcuuuaggccuauuccccaucccaccuuacuacccccacaccaguguguuguucauuuccugucugaauaagcaauuugauggcuuuaaaacaucuuuuguuucaagguuucaucacccaaacauacuagaguuggcugcauauuuuacagagacugagaaguucugucugauuuauccauacaugagaaauggaacacuuuuugacagauugcaguguguaguaaguucuaucuauuauucugucugauccucugaccccuugaaucccugggagagcugcugaaaccgucugggagaguugggaggcaagauguguuugcaugaggggaaagccaagaauggguuucccaaggaagcaguacuucuuggauuaauuucuuacuuuuagaaggcugagcaaauaccugaguuaacguguucugugcaacauuuugguaaccauguuggguucuuacucauuauaugguaagaacccagcaaaucuuuuggcaaccauguuauauuauauuugauucuguaccuccagugaguuggcaucaacuacucuuauuccuuaaauaauuuuaauuuguauaacuuuauuaaaguauccuucaauacaaaggaucaccauagcagugacacagacucuaaagagaaagaggcagccuggacaacauagccagauucucgccucuacuaaaaaaauaaauuggcugggcgcaguggcucacgccuguaaucccagcacuuugggagggcgaguugggcgaaucacaaggucaggaguucaggaccagccugaacaacauggugaaaccccgucucuacuaaaaauacaaaaauuagccaggcaccugugaucccagcuaaucaggaggcugaggcaggagaaucacuugaaccuuggagacggagguugcagugagccgagauugcaccauugcacuccagccugggugacagagcgagacucugucauaaauaaauaaauaaauaaauaaauaaacaaacaaacugcuggucaugauggcacaugccugucccagcuacuucagaggcggaggcaggagaguugcuugagcccagggacauggaggcuguagugagcuaugauucugccacuguacuccagcuugggugacacggagugagaccuugucucaaaaaaaaaaaaaaaaagagagagagacagagagagggagagagagaaggagguugaauaaaugucaugauuccucguuagaugucuuuggagguuaaguuuaaaaauugauuccaaauagguuguuucaguuaggaugagaauaaaagcagauugucucaauuacucauacuguuguaccacaaguaacuuaaaaaucuuauuuaaugaacuuuuaagcaguguuaccuuacuagcuauguuuugauuaagcuaauauugagaaguauugaguauuuucguugucuauaaaagaggccuagaacugucaucaguagcagaaggaaacccaucuggaauuaaaaauagguuuuggaaaaccaaaacguugauucacccaccucaccccaccuugcuaucuacuucuauucugguguaugucugcauaaugaauacauagguaguuuuuacucagaaagugcaaccaaaccaauugcuguuguuguuuuagggugacacggccccacucccuuggcacauucgaaucgguauauuaauaggaauauccaaagccauucacuaccugcacaacguucaaccaugcucggucaucuguggcaguauaucaagguaaauuauuccagagcuuuugguuauaccugaaagcuucuuuuauccucacaugugagucauacuucacacuauucucugcuguaguucuccugguauguauguguguguguuaagaauucucaucuagguauuuaaaaauccuauauuuuuauuaaugaaaaugugucuaccaaauuuaaaaagcuauauguauguugccaaaaagagaguuuacauuaucuuugguaauuauuaaugaacaauguaggauagacaauucuguguacagauggucccaauuuaugaugauucaacaaaaugauuuuuuuuacuuuacaauggcacaaaagugauauguauuauguagaaaucauacuuugaguauccccauacaaucauucuguuuuucacuuucaguacaguauucaaugaauugcaugagguagucaacacuuuauuauaaaauagccuuagcacuagaugauuuuacccaacuguaggcuaauauaauuguccugagcacauuuaacauaggcugggcuaagcugggauguucgguagguuagguguauuaaaugcauuuucgacuuaccauggguuugucaggauguaaccucauaaguugagaagcaucuguauuuuaguaauuauuaauggcacuuugugaaaugaaccuguauuuauguacuuuuuuuaaaacugaaguuuaaagaaaaauuaagcaacuuaaauggggauuccuagcaagcuggcaguaguaaauagcaauaaaaauuguuuguccuugagucuccagugucuugcucauccuacugagccugcugucucauaacuuuauauauuaaccuaugacaagcugagcagcaaccccaauguucauuuuugagacaugagaaaauuagaagcaacaucucccacauuucuucuucuagacauaaagaaucauucacccagaguaaauacccccugucggugaauuuuuuucuauuugcccuuuaucuucaaccuguccaaaaguacaugaauacaccuuugcugaauaucaaggaagacugaauuuaaaaggcugcugcugcuucugaaccauuucccaguaucuugaaaaaaacuuguaguaugcuuuugacuugggcagaaaaggagcugauugcuuacuuguuuuucugaugaaaugaacuccauaggaaaagacucuagguuuuacuuaguucuagaggggcggggugaccuacccauagacgucugugccuguugcaguguggcaauccagcaacugcuaauggcuuuguagaaucagcauaaaauuaaugcacacucaugggaccugaauauagagggaccaugagggucuucagucaguggaguuauccguuggaauugcuuucaaagggcugagguggccacccacaaccuaaaacaaucccuccuccacucagcuugcaaccaacacugagcacacuaagugcucaaauauauguuuuacugaguaaauaaauaucuggaauguugcuaaacauauuuguccuuuggucuaaacuuaaaauaaguauuagcuuauuuuaaagccccaagcagcaauagauuaauuuuauuaaguuuccuuuugugugacugaguucaucaaauccuuuccugaaugcagaguuugaagaagaaagaaaagagaagguguugggguuuuggcucuugaugggagauggggacagagggucacuaacugaagcaaagggagcaucagggcagggagggaggcagaggcaagcucugcccaugucccguucuuuuucacagcugaaacugggcaaggugauuuggaugugccuaacagugucucucugcugguauuuggugagagcacaggcuuugggcccucauuuccacuuucucacuguugguucgugucuucagguagguccaggaagugggcucagaagcacagauuuaccugcaggagguuuuuaagggagggcucucagggacagcaaaugaagcgaggaaaggaaaaaggcaggauugggcagcuggagagguugaguugggauauuauugucauagaggccucaguccaugccauggggaagcacugaagcugggguggcgcaucaaagacaucccagaggcaggcagggcacucugagcuuugcaccccugcaucugaccagcccucuuguggagcaguaauguggcugggugaggcagcucccuucuaccaagacaguucccagacuguggcucagcugugagccaucuuuagccaacucuuacugcuggggaaccagagccucccuggaacccaaggagggagccaaguaggguggggaaggacaggguggggaaggaaggggucggggggcgguguggagucauggugggagagugcaccauggcagccaccacagcuaugaaggaagauuugacaggacagaguucugaaaaaugugacucgaagauuuuucuuuuucacauguuugcuccccacccuccucccauccuuuucucuuagcucaguguccccuaauguuuaaaucagagagaccuuccacuuaaaaugcgauucugagcaaauugcuuaaugucucuaagccucaaucuuccucucugcaaaauguuaguaguagaauaauagcuucuaucuccuaggguuaaauggcauaagguccuugacaaagagcacacacaucuucagugguaauuccuauccugacugguugagaaguggugggaguggcacagugacagaggccaaguagugugguggccaaucagucuuuuuacuuaacacucuuaccucuaucgucaauuuauaguguuugaaaaguggacccacugacuaagcucuaguuuaagaaaaauuacuucucuguuaauauguuuacuggccaggugugguggcucacauccauaaucccagcacuuugggaggccaaagugggccaauuacgugaagccaggaguucaagaccagcuuggccaacauggugaaaccccauucucuacuuuaaaaaaaaaaaguguuuauuaaauaucuugacaaucccauucaucuuacuucacaaauauuuauagaacaucuguugugugcagagcauuguguuagaccacagggggagagacagugaugauaauagucuuguccuugaagguucaaccuggugaucagaaagauaacacaaacacaaaauguguagugcaaugguaacuaugcccacugagugguuggucugagaaggcuuccucucguuagagaguuccaagccaagucuuggaaaaagugggucauugcaguggauugguugaaagaagcggagagaauauuccugguggaggcaauaauuuguucaaaggaacagaguaaagaauugccacguauauaguaaaagcaagagaaaucaguugguuggaaaagaaaggacaagguuggagaauaagauaaggugagacuacagaagaaugaggacuguggugagcaggggauggaaugcagcuuuggauucugacuaggcugaggaacuagguuugacaagcugggcucuagugaaagucugcagcuugucuaggauauagguggaaacugaaagguucuagagucucuuagguggucucacaacuuaagaggaggccaguucuuccaggucacuaucccaggaacuugucuggaugugcagaacuauaaaaaucauuuaagcaacacugcuagacagaaugcccaacagguaacaaagauacagaguacccagagagaucugaucagaaacaagaauauuauggaagagacaaggcuugaaaugcaucuagcaauguauuuuauauuuuacuuggugguggggcugcugacaauuguugccuuucugaguguuccaaagaguucaaggacuucaauguaacccauccauagaaugugcccacccaggcaugugucaggguauggagauccauggcugugggcauuuguuugagaacugugguuucacaagggcucaucaaugugucccugccuguuccaaagcaaaucagucccuuccacggccauugaacuuuuggccuuucugcugagccugccagcaaagauguuaauuagugccaacuauaacaguagauuucccccucguguuuggugauaugcacaccuguucucuagaagcuggaaugaaacuaacucaguucauuugggccacugaacaccugucagaugguaaugacagucaguccccagcagccucggccagaugugauuggcugaccuagauuacccuccugaaucucuuuuaaaugaauccuccacugugcucuaaaccuaggccucccugaguguuggucccucuguguguagcucagugcuuuuaggacugagcuguccaaaucccugccuguuuugccuuugucauauuaauuuucuaaaucuauguaagggaagauagcuucuaggagggaugcaguuuuauuguacggcuuugauaauuggcugagaaaaggacaucucaaaaucuguguuaaacaguggccuuuucccagaguaauucagggcucuguuuuuauuggaggagugaacaauggaagaugcuguuaccuuuauuuucuuuucuguauuugggcuucagagugaugagucacaaaagacuuuauccuaacccuuugauauuauuauuauuauuauuauuauuauuuuuaaaaagccaaaauuucagcaacuuuuauugacuaccuuuuaaaagcccuaugcugcuguuuuacaaggcauaauagaccagcucaucuggucaaagcauucuacaucauuaguuugaacuaacuuuuacugaaacagcuacagcaucaaaagaguuaaggcaaauuggaauucauagaaaaggauaagacacuucacacugcauugaaagaaagacaggccgggcgcgguggcucacgccuguaaucccagcacuuugggaggacgaggcaggcggaucacgaggucagcagaucgagaccauccuggcuaacacggugaaaccccgucucuacuaaaaauacaagaaauuagccgggcauaguggcgggcgccuguagucccagcuacuugggaggcugaggcaggagaauggcgugaacccgggaggcggagcuugcagugagccgagaucgcaccacugcacuccagccugggcgacagagcgagacuccgucucggaaaaaaaaaaaggccggaaagcuaagaagagagacacugacggcaacacugaauuacagcaacacucgcacugcaagcacagaacaccaugggugaagucggacuaguuaaacuucagaaagcccauuucauacagcuggaaaaaaaaaacacagauuaaacacaaaaugaacaaaaccacaaaaauccggucaugcacuuggauaagucuucacggucuuugugcauacccagaaaauugaaguuuucuuuucuuuuuucuuuuucuuuuuuuuuuuugcaucauaacauuugauaaaaaucuguuuguuuguuuguuuuacuaaaauaaaccuguucgggggaacagcuacuagaugaauuuaagguuuuuaugcaccuuauagaacuuauagcaaaaauaguuuuaguugauuucguuauaaauaacguuuucaagaacuugugcaaaauugucaauaauuuccuaaagcacaauugaucagaaaaauccaugauuguucagccuucacacccuucuucauguaagaacaccuuucuguacaucucacaguuacuuauuagguugaaagguauauggagaauggucauuagacgucucgacagccaccugcuguugaccacuugccuccucaacaggagccgcugucgucugcauauguucauacuguggcaaguaggcuccuugcauagcugacguugcaggcauguauguuccggugcugccuagugacagaugacucaucugcugggccagagggcugaucauugaugcgggcuguagugacauggugugcuccauugagggaguuaacacggcaccggggugcuguagaauauaugguugagguugcguccaagaaggacuuugcaccugguaggcagauacaggagauacaauauaggguguaauagaaguuugagugaucauucgguuuguagcaauacuguauggugaaggauaaaauccguuuuguauagcagcuguaguugggucguaaguaagugucauuccaguaagucucaccucuccuucucuaugccauggucuuccauuagggauguauuuguuuggguucugucucuuuuucuguccuccaucagaaaacuuacacaauaaagguucugugggggcagaaacuccugguggugucuuaauaaauuuuccauuaaaaugaccaguaacagcuucacauuuuucuguugauuccguccuagcaaagccaacaccacgacuuguaccacuggcaucacguaguauccuuguagaaauaacuuguccaaaugguuugagcauauuuucuaguucuugcuuauccauggagaguggcaaauuagaaauguagagguugguaggaucuuguuccuguugcuuugccauuugagcuugaaccccacuggccuucagggcagacacagcuuuuugagcugcugcagggcugucaaagucgacaaaaccauaaccuuugcauuuguucguugucuuaugcaaaauugcguuuguggagacuauuuucccauaugguugacagagcuucaccagguccuggucggugguguggggaggcaguccucggauauagagguucguuuugcugagcugaucccauccugaguugcugcugcugcuacuguuguuauuacugcugguggugcugggacugggaggggccauggggugggcugggaccagagacugcugcuugcgauagggcguccggcaguugcugcugcccccgggguugccgcugcugcuggggaagaucaucgcugcgggccgcggcggcgggcgcgggcgcggggcagccugggcgcggggcagccucgccgcgagggggaggacgcaaggagggggccggccgggccccgggccgaggcagcuuugggaacucccucucgccgcgcggcggcggccggcgggggcugcagcuccgcgcugacuuccccuccgcacucgucuaaaagugcggcgcggcgcggggcgagacucgagcagcucgggcagccgccgcucugcgugccauggacgggaguucgcgcgcggagcuggcggcgucgccgacucucccggcggcagcggaggagcagcgccgccgcguccuccgauauuauuaaguuauguuuuuaaauaguaugaaauagcauggaacaauguauauaaagugagauuaaguggaaaagaccaaauuaaaguagcguauaguauauaauuauaacuuuguauaacuacaaauucaugcauuaaaaaaauauuaaaaguaaaauauaccgaaauaucaacaacguuuuguuugguuggagaaccuauagcuuauuuuucaauggcuuauuuuuuuacuucuuuauguucuuuagauuguauuuaaagaaguauguucuagucuagcaauaacauaaaauuuauuagacaaaaauaacuuggcgucagaccuuacugucucaaaccaauuaauuggaaaaaguuccaaaagacagucucaaguuacuaaaugaaauccuuaucaguucaaucauucucuguaauuaauuuuaucaguaaagaagcuugauaaucugucauuuuuaugguuuuaaaauaguuuuuaaaaugaaaguuggaaaaucauuauucagcagccuggugcccaaagugugaauaacaucuuuugucuaaagcaaagugaaaugguucucaugucuucagcagggaggagggaggaugaggaugaggauguggaugugggaagaccaccagaaaucuggguucaggccgggugagguggcucacaccuauaauccuagcacuuugggaggcugagauaggcagaucacuugaggucaggaguuugagaccagccuggccaacaugcugaaaccccaucuccacuaaaaauaccaaaaaaaaaaaaaaaaaaaaaaauuaaccaggcauaguggcuugugcuuguagucccagcuagucuggaggcugaggcaggaaaauugcuugaacccaggagguggagguuguagugagcugaaauugcaucacugcacuacagucugggcgauagaacaagacuccgucuaaaaaaaaaaaaggaaaagaaaaagaaaucugaguucagacccaggucuuuuuucucuuucuguggccagagaguggccaaaaguuuucgcacuugcacauucggagccaaccaagacagucuuaaggugaccucuuguugcugucaaauucuuugacauuacaccugccuauuuuuguacugggcucuguacucacgagucuaggacuguuacaggagaacgugacccuguauucucuuaaauccuggucaagcuuuacccugaucagcuuccaaaucagaaugaggucagauauguuuagggaggcgccuccagccaccugcccacucuggagcagguuuuagucaaaguucugaaaugccuguuuuucugaaacacccucucccuagucuuucaucuguccuuccccuucuuuaccagccacccuagcgaucucguuguugucccugucucucaucacugguuaagaguguggccuuuggggucacauagaucucaguacaaaucccuacuccucuacuuucuggcacugugaucuugggcaagucacuuaauccccugaggcucagucucuuaccucaucuggaacuggggugacagugcuccaccuucucccagcauugugaggaggaagugaggugauagacugaaagcacaacccaggccuggcaaugagcuguaauuauccccccacaaugugagaaaagugcuucauccaaccuguacuugaacccuugcuguauggugggcccagcauguuguggggguccagcuccauuugggugcagcucucauuauucagacuucuuuucuguggagcuaaaauccugugacuugcccauuugccgcuggaauuaucuauauacagcuaaagaaaaaggagauaaaagcucauuucauuucucuuugaaaucaauagucucuuagucuuucaugaguagcugaguaaaaagaugucucaguuaacuauaguaaaucaaaagagcaccaaacagaaaaauaguggggcuagguguuaguucuggcccugcuauuaagcgguuuugcauggaacaagucaugucaacccugugggccucauucaccuccucugcaggauucuauagcagugaugacaagucaguguugucucauguuccaugucugauugauugauaaugauuucccacaugcaggguugaaagagaaucuauggugggugcuuucugaacuaaauuuuugauguuugccaagaauaugggaggauguuuugggaggauaaauguuauggcaacauuuaagccacauauucaccauuccuauacugaguagucuagggcuacccucaguuucaaauccucuuuacauaauugauuauaucaacaaauauuuacuuaguaucuucuauagacucaacauuaugcuuaaguaaacaacaucaggugggcucccugugggugucaaacaaugucguuggagcuguacagcaggaauuuuggagaaaggaggagcacuggaauuuggagcagucaagugaaaaguuuauggaggaagugaaucuuauggcugcagagaggacucagauaaaaauaaagcaggggagaguauuuucaagaugaggggaacagaauggggagaggccaagacagcagaaagcauaguuuguccugacugcauaguaaguacuaauaccuuaaggguagcagauagacugcagucagaugagagagcucaaugagagccagagacuuuucaccuggcaucaacgccugcugaauaacuuguuagcaauccucccagcaagccugaguucagguauuacaguuauuaucuccauuugauagaggagaaagcugaggcuuacagagauuagugacuggccucugucucauggcuguagaagggaaaagggagguugcauuccauguuugugugaguccaaucaucaugcacuuuuuaaggaauuaaaggucugggauuaauggaagcauguuggcgucaucagcagagacagggaaauugggaaggagaggagagcauaauuagugugcagaaacuuggaaaugcugacauuggacuccuggcagaagcaagaggcauugaagaggagaucgggccuggaaagcggugagaguagauagcuuucuaaggaagaagcugucaaagacacagcucagaaacacccacaggagaagcagugcccauguuuccaagguguuuucaacaagucuggggguuuauuuagcuaaaaaaugucuuaguaauuugaacucuucaaagagaauguuauaaaaacaaaaccugcuuccaggugguggaauuugagaaggaaaggacuuaaagaaaagaaucuugaaaaguugcagccuauauucuuggccaaagacccucacauuuuuauuggagaaacgaagauguuuuugacuuacaggaucacuuaaaagcaucugaaggcaguaaacuuccuuguuauuucccuccuagcccuuagugagcuuaauuguuuucacauuuaugaacuauuuuaaauggaaaugcauuuuauccuuagcauuuuccaucccagacauuucauuccugcuaauguuuccaaagcaaagagauaaucuuggugaacauuucuaauguuuccuauaaaaucauguucuuuaaucaguauugccauuugucuccugccaagugaaacagucuuucauacaagggaaauggucuaggaaagaaacaaagaagaagccauuugcuucaaaauggacuuuuuuuuuuuuuuaauggaaauugaucagagauguaaggucagagugagugagugcauggguaauuuccucuccaaaagacuagaaaaacugagugguugggaagagggcauagggggccacagauuggccccucccugccaccaggacacccuugccugaagacccaggcuccuccugccuuuauccccagacgggaagguuggagcccagcucaguguuuaacaggcaugucaaagccuacagggaaugcaaagugucuuucuuuguuugacugauaagauucuuuaaucagucuccucccuuucccucauaacccccucaaaaagccuauuuuuaucuuucagaaaaauuuuagauauauauaauucuuuuuccucagauuuuuccuguuuucccccagugccuccccucuucuaaaauauccaaauaugauuuuuucuaagggaugccaaaacaauuaaauaugacauaaauuaaaauuuccccuauuaauucuauuugccaccacucuaauccccaacauucauuuacuuauauacauagauacauacacauaugcacgguacaugccaguuuuuuucugucucuccauugucuuaaaaugucuggaaaauacguuugcccagaacuuccuggaacuauuugaaacucagccaauuuguuggcauuaacuaacugaaggguccucagauuuccagggacauccuacaacccccuguauuuuuguuccuugaguuggugucuuuggacuucuagagacaugcaaccaagccuuuugggauuuuaagguaagguaauggacauaggauggacaauggccagccuauauccuuuaaagcauacuuugagcccucugugagugucacuccuuacguuuucucauuuaauacugguaagaaccccgugaaguaagcaguaucagaucuuuauaccaacagggaaacaggcuuagggggguugugcuaguuguggguagauuuggaguuucacaauuaaaggaggaacacccauuacugggccuuugcaccgagugccuagacucagaaggcaccaacaagcaaaaacaagcuugaauacugugucucucagaccugccuagguucaguggggaugaaaaagaaagcuccgcagucccacaggggaauaaaggguuucagauuuguagcauuccaggcaggaugcagugcacacuuaaguugggguggggugcacaacuguuuuaguagccugcagguucuaggagaaacugagucuugccucaucugguuaggggaggcagggcaucuggugaggggugucucaguguugcaacagccguaauacagacagcacaugugugcuguugccucaggcugucccagaggggccguuggguccucuuuaucucuggagccaaucuguggcucccugcccccucuuccccagguccuucuguggaguccuggccuuuccugagaguuuccaggcacccaggcgcuggacugcuggacccauauauauacuauauauauacccacauauauauauauauaaaauauaucgguauauauauuauauauauguggguauauauaucucucucucuuuaaaaaccaaucaugcucuuucaugccaaauaugguauuuucacuugaauucaaauccugcauuauaaucuagguggagcaucuugucuuauguuuaagguccaagggauugaacuuaauuaggagauaaacuggugagcaaagaaagcaauucucauuacaaaguagcauuuguuugggggauucagguccccccgaaaauuguccuagagaccccuacuaauagagagauuaaguaacauccuagagucagguuacaaacucaucaucuguguaggauucuccauacuuccucaguguacaaccaaugaucauucuguuaaaggaauuaucuggagaggggauggccucucuguuaagguaaauagccuugugauaaagaguagaacaaaucgauuguagaagcaugaaauugaggauaugaaccauggauaugggucaaagaugucuuuuaucuaucucuuugguggccacaguugcuugcaggcugcccuuuugcaugauauugccaugacuguaguuguguuagguucuuaauuuuguuaguuuauuuucaccccacaggauuaacuuacucagcugaccugcauggaagcugaagacacuuuguguuugaacauucuauuuaagguugaagcaggggaaaagaauuaagguagaaauugaucguugaagggccuuuugcaauuuccgcuuuccuaaaacagaacauccuucuuccucagcuaccgcuaaccuuuauuuagaacagaauaaaucacuggacucaaaauuuauguuauacacuaaagucagcugaaaaacgacuuaucuuuucaccgauugucauuauucaaauuguaaauucaguacccuagaauaauuucacaucuuguugauggccuuucacugacccaaaguccucucuggguuuuaugguguaagcauuguuugugguuacucaacucccuucugcccaacuuucacagaagcugacucaccauuugcugaaagcaucccaccagcuuugcuaugggucaaauaaagaauuagauugaagguuuuguuguuauuacuguugcucuuuucucccuuuuuguacuuaaaagauucaggguuuuuuuguguguguguguguguuucaaaaauucagcuuuugcagucucaugauucuggcauugucaauuauaauucuaugccuuuuuuuagagcugugauagaggaagauguuuagguguuugacauugaauaucugccauucagaacauucccacccucccccugugcugaaaugaaauggggcaugcagaagugacuccaaaguugaagggcagaaggugggguccuggcaaugaagguuggagaaccuuuuuuucccaccucgccuccuggcccaccggcaaacuccugcauucaaaugcccccaggacucugaaacccucagggcaucuccaggagccucagacuugaucugauccauugaagagucaaccuagggaagaagugauuaugaacugacagucucuucuuaucuagagcuggagagaagucggaucugacucuagucuguuccucaucugagguaugucaggauagucaacaguucuccaagugagaaaguaagagugggugaggagugacagaugggggugugugaggcccaggcuggcuuuagcagcugcuggguucuccagggagaagggagaaggcaaggagagaaaugacaacugugcucauugauacgagccuugggaaccaggccucucugaccuuccuuccauaaaugcuaagagcacacagcugauaagaggcccuagagcucagaaggugggcuuuuuggauuuuacaauucccuugccacccuuagcggaaggaggagugaaauaaaguuuaaaaugugucuuuauccuuaaaagaccgcggggucugggcgcaguagcucaugccuguaaucccagcacuucgggaggccgaggcggguggaucaccugaagucagaaguucaagaccagccuggucaacauggugaaacuccaucucuacuaaaaauuagccgaguguaguggcaggcgccuguaaucccagcuacucaggaggcugaggcaggagacucacuugaacccgggaggcagagguugcagugagcugagaucgugccaaugcgcuccagccugggggacaagaaugaaacuuugucucgaaaaaaaaaaaaagaccaccggaagugccuuuguuuuuucuguugucaacucagcccuagacaaagucuggacuagaaucuuuaaggccuuagcuucauacauugaacuguuucccccaaacucucuaaauagaaguaggacucugaguccucugaacaguaagaacacuugcaguucagaccuauggaacuggggccugcccguuaaccuaccuguauagggauagcaaagacuucuggagcuuuuguaagauccaaaauuuguucagaauuaagaacuucuugauaucccguggcuguugcuguagcacuuuuaguaacagcaugucguacuacaaauaugccucuuggcauuuuggaugggaagguguacuauuagaugcuuugguuucaggaaauaaagagcaagcucugaagagcccuaagcaaagcugggaauugcaugccuuucuguuggcugccccaccuccuucucaauauccaucuguucucuuagaauugauuacuaaucuuccuccuagcugccauuuuuugagcauuaccaagugcuggggaggacacuaugcacuucguuuucccccugccagaguucuguucuccucauuucacaugagaggagagagggcacugaggcuuacauggcgaaggaaacuguggguggucauggagccagggaaaggcagagcuccuggcuguaugcagugggaaauggaucucucucuuggcuuauccuuuccgguuccugcuuugacagcccuuugaagguaaaaguaagccaaugccuacccccagccaaaaugucagaugauucuuaagguuuuuaaugugacaacugcuuauauugacuauaagcacuuugccuuugucucugcaaacauuuguauuuuaaauaagacucaaagaccaaaaaacagagaugaaaccaugggauagggcugccaugagggcagggacuaccaaagaguccucaaaucauuccaaguuaguggcucugcgcucauaagcuaagcauuucacagcacagcucuugcacauaacagacacauaaucagcugauuaaaacucaguucauguucuccguaaguguaagaaaagcacaaggaaagcuguuuugguuaacuucaguuucucuuagugagaaagcaucagcuuuauccagcaacuucacauauguaucuuuaaguuugaaaugcccacuguucauaggucagguuuuuauucuagguugcagauaacacuuggauuuguacauuaagaaaaaugaaagaauguucuccaguucauggaaauuuguuuggcuuuauuuugacaguguuucgaauuaaccagauaugaagaaggugaguuuauaguauguuuguuuacacugaagugccuuuaugauauuuugucuuguuugucccugaucacaauuuuagugcaaacauccuuuuggaugaucaguuucaacccaaacuaacugauuuugccauggcacacuuccggucccaccuagaacaucagaguuguaccauaaauaugaccagcagcagcaguaaacaucugugguacaugccagaagaguacaucagacaggggaaacuuuccauuaaaacagaugucuacagcuuuggaauugugaguaccaacugccaguuaacaaaggagaguuuauugccaagaauguucuagauucuaagaauuuuuuaaagaguuuuaacuuuugacucauugauuuccuguuagcucaucuuauauauuaauuuuguguaaucaagcaauuaauaaaauauaaaaucauuaaucagaaugaacuauauucauagucaugguuaauaguugcaacaaauuguguguauauuuuuaagauauauagcugacuuucuauauauuccuuguagguaauaauggaaguucuaacaggauguagaguaguguuagaugauccaaaacauauccagcugguaagaauuguuuucauccuggcaccuaucucuuggucauuuuuugaucaaguucucugugauaaaauugucucccucucuuccaagcgggaucuccuuagagaauugauggagaagagaggccuggauucaugucucucauuucuagauaagaaagugccucccugcccucggaauuucucugccaagcucuucuguuuggcaggccggugugcugcaacgcgggcaaaguuaagaccaucaauggaugaagugaguauauacaugguuuuauucaaaacugagcccacagaaccauggaaaaucuaaacuagauaaauuguguaucuaagugaauuauuuguuaaugagacaaauccagccuccaacagagaauuccaacauaauaguguuuccaggucaaaaagccacaucauuugguacucuguuagaggucauuucuagguggaaccaagacuccacaaaaaauuuaauguaaagacauaaaugagcaguuugcagggaauauuuuauucaaucuuuuuuuuuuuuuuuuuuuuuuuuuggagacagagucucacucugcugcccaggcuggagugcaguggcacggcccacugcaaccuccaccuccccaguucaagugauucuacugccucagccucccaaguagcugggauuauuaggcacgagccaccacgccuggcuaauuuuuguauuuuuaauagaggcgggguuucacauguuggccaggcuggucucgaacuccugaccucaagugauccacccgccuuggccucccaaaguguucagucuucauuaagagaucuggcucauuauaaaugcagcauauauuuuccuuauccauuuuuuuaaauuuauuaaucuauccauagacuuaaucacccauucauuuauuuguuuauuugcacaaauaaacaaauaaugccuacucugugugugccagacuuuguauugggugcugggaauauaucagugaucaagaugcaaugacuacccucaagcucacuguuaagaggagucagaucaguaaacauagaauguugguccagcaagagaaacaugaugauagacagaaggccagguugccguggagcaugaauucagaauacacaccagcccauggaaguuaaggaagcuuuuugauagauaugacgguuuagcuaagaucugaaaaacagguuggauuuaggcagcaguaaggauggaaagacaucccaagcagagagaaugaauaccugcaaaggcuccaaggugauggagcccauggugcuaagaccacagauaauucagcaucauggagggggagcagugagggaaagccuggagugguuaaaauaauagaagcuuccaugacagagggacaugaauuccauucuaggaguuuggauuuuauccugagucuaucauagagccaugcaaggguuuuaaacaaggaguugacauaaucagaauauaaacagcacuggccuucgaggcaggagagcuguauuccaggccugacaccacccgugagaguuguguggagccaagggcucaggaaggagcuaugacauauaucgugcagggacagagaauuggaagcccggagauccggugucaaacagcaggucuguaccuuacugacuaaugauacugcuucccuuuucugagccucaggcuuuaucaucuauaaaaugagaaugauuaauguuguuuguacagguuaaaugagauaauauaugugaaagcacuuuguaaacuguaaagcucucuauauguauuuuuuuaauuacguguguguguguauaugaagguauguuguaugguguauuaauuacaucaaggguucucacaucuagcuguacauccaaaucauccgaagcuucuaacauacagauuccuggaccuucaacaccuuauguuuugaaugacaaucucuauguugggaccaagggauaugcacuuuaaaagagcucccuaaaacuucuggcauuuagucaggggcccuggcucacgacuguaaucccagcacuuugagagucugagguggguggaucagcugaggucaggaguuugaaaccagccuggccaacauggcgaaaccccaucucuacuaaaaauacaaaaauuagcugggcaugguggcacgugccuguaauaccagcuacuugggaggcuaaggcaggaggauugccugaaccugggaggcguagguugcaguuagccgagauuaucccacugcgccacagccugggcaacagagugagacuccaucucaaaaaaaaacaaaacaaacaaacaaacaaaacaagaacaacaacaaaaaacuggcauuuaagaauuacagguugggcccaccauuuccuuauucccuuccaaucuuccacauauuaugguugaaguaaaaaauguagagacuugcccaaguucacaaagcuaguugguggcaaaucugaggcuuaagucaggucucuugguauuuacuuuaguguaguuucuuuuauaccugguuuuaagucacuuaauuuacuccucaaaauaaagggcguuagcuaaucuuuaagaucccuucuaauucaaaauucuauagcugaacuaauuucaugaaaaugaaagaauauucuuuauagguagagugauaaaagguaaaaggaaagauuauucaaacuuaauuuaaugucuguuugcuucuuuguuauuagguuuuaaauacucuugaaaguacucaagccagcuuguauuuugcugaagauccucccacaucacuaaaguccuucagguguccuucuccucuauuccuggagaauguaccaaguauuccaguggaagaugaugaaagccagaauaacaauuuacuaccuucugaugaaggccugaggauagacagaaugacucagaaaacuccuuuugaaugcagccagucugagguuauguuucugagcuuggacaaaaagccagagagcaagagaaaugaggaagcuugcaacaugcccaguucuucuugugaagaaaguugguucccaaaguauauaguuccaucccaggacuuaaggcccuauaagguaaauauagauccuucuucagaagcuccagggcauucuugcaggagcaggccaguggagagcagcuguuccuccaaauuuuccugggaugaauaugaacaguacaaaaaagaauaaauucuaccagaagauaaagaaaaaagcaaguauugcauaggcaccugagcauagguaugaccuugggaagacauuggcuccauaagcaaugccaagagaaugaucaauagugaguuugggugaugcagauaaacaaucuggauaauuccauuucuuuuuucccaaacccucaaacagagugccuuaaaaaauuguuuuaucaggauaauugucucaugaccaaauccacgcucaauuagagccauucaaaauuccuuaagaucauggguucugacuucagccaaacaaaacaaucaaaaccuaccaaaaagggacuggauuguaauguccucuccaucauccucagugugaguccucagagccuccaucugccaagaacauucaguuggauuccaucguuugguuuagcuugcuugcacggguuguaggaaaugucuaauuuguaaauguuaauagauaccuuuggaaagaaucaccuuguuauucugauugaccccucuuguuuuuugguuaaucccugacuagccugcuugucugaaaaugagccagguucacccuuagcuacggcaugcucuggguugaaaggggauuucuucccaagaucuauccuaaacucuuaggacaguuuauccuguauugacuauuauuacagcuuuuuaaaaacagacuuagugaccuauuauaucuuaaggagacuaugugaaauguccaucaaguaauuuuuauuccugagaaaauggcuggucaagggccuaggucagcuuuuuguuuaaucuacaccuuucaacucugggccuucauuccugcuguuucuuggaucucccucuuuugaaauccuaccaaucaucagagcucuacaaaacagccaccuccuggaagcuucccuaaucucuacaaccagaaguacucccuuuaucaguauuuccacagcaauuucuuuguauuucuauuuuauauuuaucacuuucugaauuauaucaaagcugcuugucuuaucucuuuuuuuuuuugagacggagucucgcucugucauccaggcuggagugcaguggcacaaucucggcucaccgcaaggucugccucccggguucacgccauucuccugccucagccucccgaguaaaggugggacuacaggcgcccgccacuacgcccggcuaauuuuuuguauuuuuaguagagacgggguuucaccauguuaggcaggauggucucgaucuccugaccucaugauccgccugccuggccucccaaagugcugggauuacaggcgugagccaccgcgcccagccuucaucucuuuuacuagguuguaaacucccuauauuaguuuucuauuguuuuuguaacacauuaucacaaauuuagugacuuaaaguaacauaaauuaauuauuuugcaguucuggaggucagaauuccuuagcauucuuucuggaggcuguuggggagaacucacugccuugccuuuuccagcuucuagaggccaccugccuucuuuggcucauggccucuuccuccgucuucaaagccagcaacgugacauuucagaucucccucucucugucugucucaccgcaucucuucacuacccucuuccucucauucuggcccuucugcaugucuuuuauaaagaccuuugugauuucacugggcccacucauauaagccaggaaaaucucugugucucagauccuuaauuuaauuacaccugcaaaguccguuuucucguguaaaguaacauauucacagguuucuggaauugggacguggacaucuucgggggaccauuacucugucugucauacucccugaguguguaagggccaucucuucagagccuaaugugucauccuacacagagcagguguuuccuuauaaauuaaguugaauuaaauuaccccuaugaagccacauaaucaauaauucagcuauaauaaacauugccgaauaaauuaacaaagggaggauaaugacuccuuaugaugauggauagaaacacugaagaaaaccauuuucagaggauuuacugaauuuuccucuccaaggagcuuguaauagaaggguaaaccucuaguuucuuguccagcagaggaauaggcucaugucuuuuguuuuauuuuauuuuuuuggugagucaguaugguuggguuaaucauauucacauuagauuccauguugaagaacaacuaaucaaagaagaaaaucaucaggaaucagggugagauuaacagaccaaggucagaaacauggaguuacaauuuuccaaaaaagcacgaagugagauuaaaaccacaguaagucuuagucugacugacaggcuuuauacaggcccucgguaagcaguugggagaacccaugcccaccacugcucuguacgguaucuggcugcucagagcucucugauucacaaaagagaucaucaagaauugacucuguguuaaacuguuuuucacuuagaauauggacccccaccaauacauucaaugaagggucauuaaggaagcucugauuaacaccaggcccaugcaguuacuccgcacauauaaucuguggguauuauguugauuugaacuugcuuagcugacuuaaagcaggguuucucaaacuguaguaugcaucagaaugacuuggaaagcugguuaaaaacgcagauugcuggguccacccagcuucugaugcaauaggucugggguuagaaauuuugcuuucuaaugaguucccaggugaugcugaugccaaugaugugaagcccgcucuucacauccgugaaaaucgcugccuuaaggugcucuuaaauuguuauagauugguagauccuaccuuuccaucacugguauguuuuuugagaaaaggauccuuucuuuucauucuguuauauucauccuauuacauaggauguugguuagcacagagugggagcucuagaaagauuguugaccaaucaucuuauugacuagaccaucuuucuagaguauaacuauuuuggacaccucaaagaugaagucagauaagcuggcagugaccugauuaacguugugguaagcagaugccacuguggcugggaaguaccaaaucuucuguugagugauucagucuuccugacuagauuugccuucuaguggguguauuaauaagcguuaguugauaugaauuaaauguugcaacuuucuauggguaauaagaggauaccuuuauaguuucaugauguggagaccaagauacauaagaaagcaagaaugagucuccggguguucccucugaucagcaaacaugaauucauaauuucauuuacucucauuuuuguaaugcacucugagcaauccuccaggcagauccuauuuacuaagcuucaggcuuuugucccauuuuauaaugcccaaacacauggagaaaacauuuuguuguuuuuaaaaacagguaugggauuucugauauaaucaauuuuauugacuucuugggaguuguaaugaucugugacucacugcauaauauuguaguuuuauaggguggcacaucacccuguguaaaacaacuuuaaugaccugaggacugaugaguacaggaagugagguuuaucaugaguagcauuuauuaagcaucugcuagaaucaaagcacugcauuagcuacuaagguacaaaguaagacacaguuuaauaaggaagacagggcaucuacccaagucaacaguucagugacaucuguuauuugaaccacacaccaaugcaaccgaaguaaaugcugaaagggugagaagaaggaauagauuacuaugcauuuuugagaggaugaagaaggcuucuuggagaagguuucugaaaagagauacggaauuaagagaaauagaaaagagcacugacgaagcacucaggauggcuauucaaggaauuggggauccacagcagcugugcacaaccaucccuaaugccagaaaaaugggguaagggugaagggaacugggucuagagcuuugcauguuuuuuucugguuaacccuuagagucacccugaagguguggaucccaucuuauaauaaggugaggacacugagucaggaaacuaacuugcuaaaaucaaguccucccaguccucccaucagguccuuccagaucuggaggagccaggauuugaacucacauuugucugacuucaaaauccaugcuuuuucuuguguuccaaauugcacaauggagucacugccaguucaagcuccuaugaaaagggauggaugugaaaagucauuuguugauuccacagauuuuuaguagguaccaugucuccugccuuuaucacuauccuacuccucugcuacaacuucucugcuacaggcacccacugcaguuacuugauaugaguuaaaugaauccauccauccaaacuuccauucauugaauaaauacuuagcaauggcuuccuuuguaucaggcacuauucuaggagcuggggcuacagugcagauggaaaccagcaaagcucacugcccucauggagcuuauauguaagugaauaaaucucagggugguucuccugucauagguccuggcuccucugccagcucuuccaaauggguucagagagguuuucuccuuguccuguuguguaacugauaaucccaugguggaccucacuuugcuauucauaugcacuaaguaguuuauggugugcuuuguggcuggcaauugugacagauucuauucuucuauugguaugugguuucuuuggggcauuuguuuggauacugauggcaucuuccgggggucugaggcaccuacacaaaccucaggucacuaucacgugauacuggaguugccuguuaaauuauauuucuucuuccacaaaacugcagguucccugagggaaaggucuauguccugcucauuuuuggaucccuaauggcuggcacaguaccuggugcauaauaugguucaacaaauauuuguaaaaugaaugaaucaaauaguccuucaaagcaucuucagaaucaagauugucaucuagauugcacccgaaguuuaucuuucuaguauucagaauauaaucaaucauugcuuaaauuauuccauuucaucauucuugaauaaaagcuacuaauuuuaaauacuaauaucugagauaucuucgaaaagaagauuagucguuguauguguugcuuauaaauuuucucuaugguggaaaauauucccaaaccaugucuaagcaaugaaaaaccaguguucuggcaggaaauaaacugauguuuguuguguuuuguaucugucuucccguuccaaaucauuuauauauacuugauggucugugggcuugacuugcaaguauuuuccugggagacauuuuuauucaaaagaccuguauugccugccaaaccuucauuuaagagacucauuauggaugucaucugcaucauugcaaacuuuucuggucgucucuauaaauagcaagauaauauuuacagaguuuuacauuggcucuugaauuuuaaaauauucuuauagacaaacauuaauuggaaugggggguaaggagguaggaauggcuuacuugcggaaaugcaggcucauuguugugucuaguaggugcuaggugcauucacacaucucuuaagcuuuaaacaaccuauugagccgguuuccauuuccuugaucuauuagauuuaaaaaaaugaagcauaaaggaguuggcucuugcccuaagucauacuacugauggaaugagaauacaaaccaaaaacacuuuauucaaguccaggaaauaucugccuugaaaaagaauaacuuaaaaauuaaaaguguccucuauuugaacaugaaaacagcuaauaaagauguguuauuuuauuuuauuauuauuaauuuuguccucccauauuggcaaagauaaagcaauugacaaaaauggaauucuuguucaauacuggcaggagugaaaauugguagaaccuuucuagaaggcaauuuggcaacauguaugaaaaccuaaauguugauacaccuuuacccagcaguuuguuuaggaauuuauccuaaugaauaaaaguuguccaagucuucaaacaugagcccaaagguauauuucaugauguuuaugauauuaaaacauuggaaacaacugaaacauccuucaguaaaagauggauuaaauaaauuccaugcaguugucauuuaaaaauauuuagauauauguuuauugcuauggauauauguucccaaaauauuauugaaucaaaaaguagacuacaggauauauguugaauaugagcucauuuauaacauugaauauuuuaagauaauguauguuucauagagagaucuucaccaaauguuaaggauuuuuuuuucugggcugugguauuugggugaucuuuacauucuucagacucauguguguuugaaacuuuuuauaaugaacauauaucauuuuuauuagaaaagaauaaaguuuuugaa

SEQ ID NO: 192193 - RNA, 522 nt, Homo sapiens
cuaccacgccaaacccuuugccacuuucacugcuuuugcuuugcuuuuccccuuucuuuucucucgcuuugccgucagccuuuuucuuugccuuugguucauccauauuggguacuguccaugcuggucuagaagagucuuuuuguuucucuuaguaucagucucccuuuucaugucaucuuuuucaucuuuuaccucacauugcauuuucucuuggcaauguuuggguaccaccacaguugcuaucucuugaacaucuuucauuaaaacaucaccgucuaguuugagaauacuuuuaagccugcuggccuccuuuggggcauucuuuuuucucuuuucagcacgcaucuuucuuuuccacuuacuccguaagcuuuuagccauguuucaccugagaaacgaacacccacaccucagcucuuuuuaaccuaauucuaauuaccuaauaauucuacuuaauaggauuauugaaaggauuaaaccaguuaauaagaaugaugaggcugggcaugguggcucaca

SEQ ID NO: 192194 - RNA, 14843 nt, Homo sapiens
guagguuuguugccucaccagugcgcccgccggaggguguuuaucgcggcuagagagaugucgcugcugcggucgcugcgcguguuucuggucgcgcggaccgggagcuacccggugagaaguccuggugcugguaccgaccugcugucccugcagcucuccugugcgccuguaccuuucccuuccucccaaccucguuugacuccaucucaccuuccccgacagcauugccucugcccaguccagccccggugcaccccccuuugcacacuguccgcucccuaaggucgcuucccugcccguguacccuucacccucuggaguuugcugcuuccugcuccucaucccuuucuuaucucaucuaggcugggucucuucugcgucagucgccccagccaaggcacacauuuuaugcugggccccgucugucugccucggccuccagcaaggagcuccucaugaagcugcggcggaaaacaggcuacuccuuuguaaauugcaagaaagcucuggagacuuguggcggggaccucaaacagguguguguguggaggggugcagggcggaguacuagagcucgaccucagacucuuggggcggucacgcuggggagcauaaaguuagacugcucuucagugaccauaauggcacaguccuaaguggaaaucuggcuuaaaugacaaccuuggccuugacuuugucuuauuugaaagcaguugaguaucccaggauuaacaaaccagacuguuacgguguuucuuguugccuggagcugaaaggguuugugugagcuuuggagucagauuguucaggagucaaauuguggggcccccacacugucugacuuuagacuuuuuuuuuuuuuuucagacggagucuugcucuguggcccaggccggcgugcaauggcacgauguuggcucacugcaaccuccgccucccggguucaagcgauucuccugccucagccuccugaguaguugggauuacaggcgugcgccacgacacccggcuauuuuauuuuuuauuuuuuauuuuuuuuuguauuuuuaguagagaugggguuucgccgugucggccaggcuggucucgaacuccuggccucaggugauccgcccgccucggcuucccagaguggugggauuacaggagugagccaccgcgcccggcugacuuuagacaucuuaaucuuucagaguuguguaguuuuugccuguacggucaugcgucucuuaauaggaagauacauucugagaaauggcgucguuaggagauuuuggcuuaugcacaucauagaguaccuacacaaaccuagaugguauauuguacuacaaccugggcuauauggaauugccagcugcuccuaggcuacaaaccguuacaaaauguuacuggacugaauacuguaggcaguuguaacacagugguaaguauuguguaucuaaacauagaaaaaguacaguaaauaggcauaaaagauaaaaaacgauacaucuccauagggaacuuaucauguauggagcuugcaggacuggaaguugcucugggugagucagugaguggugagugaauaugaaggccugccuuaggacacuauggugcacuauaguagacguuaaagcacaguacacauaagcuacauuacauuuauaagaaauuuuuuucugugauaauaaguuaaccuuaguuuaauguaacauuuuuauuuuauaaacuuuuaacauguuuuaaauuuuuggacucuuuuguaauaacagcauaaaacacauauuguacagcuguaccaaaauauuuuucuuuaugcacuuuuucugugagcuuuuuucuguuuuuaaaauuuuaaacuuuuuuuggcugggcgugguggcucaugccuguaaucucagaacuuugggaggcugaggcaagcggaucaccugagguugcgaguucgagacuagccugacccacacggagaaaccucgucucuacuaaaaaaaaauaaaauuagccuggugugguggcaagggccuguaaucccagcuacucgggaggcugagguaggauaaucucuugaacccaaaaggcggagguuguggugagccgagaucgugccauugcacuccagccugggcaauaagagugaaacucugucucaaaaaaaaaaacaacaacuuuuuuuauugaaauaucuuuuuuuuuuuuuuuuuuuuuuuuuuuugagacagagucuuacucugucccccaggcuggacugcaguggcacaaucuuggcucacugcaagcuccaccucccagguucacaccauucuccugccucagccuccugaguagcugggacuacaggcgcccgccaccacgcccggcuaauuuuuuguauuuuuaguagagacaggguuucaccguguuagccaggauggucucgaucuccugaccuugugauccgcccaccucagccucccaaagugucgggauuacaggcgugagccacagcgccuggccaaaacuuuuuuuaaguuaaaaaauuguuuuguuaaaaacggagacacaaacacauacauuagccuaggccuacacaggaguggcaucaucauuaacacuguguuccacuuucacaucuuguccugcuggaaggucuucaggggcaguaacgggcauggaccugucaucuccuaugauaacaauguuuuuuucuggaauaccucuugaaggaccugccugaagcuguuuuacuguuaaauuuuuuuauuuuuuauuuuuuugagacggagucucacuuugucacccaggcuggagugcaguggcgcgauagaucuugguucacugcaaccuccgccucccggguucaagaaauucagccacccgaguaguuuauaaguuggaguacacucuaaaauaacaauaaagcauauguauuauaguaaauacauaagccaguaacauaguuguucauuauuguuucaaguaucauguacuauauguaauuguaugugcuauacuuuaauaggacuggcagcacagacguuuucuuuacacuagcauugccacaaacauguagguaauauguugcccuacaauguuaggaggacuaccgugucacuagacaauaggaauuuuucagcuccauuauaaucuuagggaccgucaucauauaugcaguccgucauuguccaaaauaucguuauguggugcguaacuguauaaagaaaauacaacugugugccccauaggguuguugugaagauuagauucauccaaggcaccaguuauaauaauaccugguauuuggcauuuagugguagacugccaguaaaugauagauuacuuuaguuucuguuagagaauuuagagaaucaggaaaccugaguauaucuuagaacuacauuuagugcuaaauucugugacuuuguugucugcucuuuuuccucucaauuuacaggcagagaucuggcuccacaaggaggcccagaaggagggcuggagcaaagcugccaagcuccaagggaggaagaccaaagaaggccugauugggcuguugcaggaaggaaacacaacuguauuaguagaggugaguuguuggaaauuccagauaccaagaacagcugucccuuggguguaaagcuuguaguaggcccuaaaggggccuguucuugaagaagagaucuguuuaagaaccauaaagcguaguugaaguuaaacucaugaaacccuggguauuaguuacgaauucguuuaaguauagaaauguacugguguguugaugagaaauggccugacagucuagaauauuacuccugaaugugagucuggcacaggcuuacaccuugucacugauuguuuccuggaacaguuagauuacaaguuaauuauauuaauuguugcugaauagagaguagguauuuuagaggagguuugggggccauaauuggugaagagucagauguggauuaguuuagagugagagauggggauaaacaagauaauagcauaagugguuuggaguugggauggcuggagaaugaggugaugauggugugcagacauagguaaguggugaacuuguggugaguccuucaggacauuauugaaccaucuucugaauauacaggcuauugcuaacucacuggcccaacauaaaucacuucauucuguuccaggcuaggagaggaagcguagcuuuaaaauuuuggagucauuuuuuuuccguugagucuguagcuuguucuaucaguaucuugauuuauucuccagccuuaaggcacuuuuggaaauuaucauuaaacagcuuauacagcuauaucaauuuguucccacagguaaacugugagacagauuuuguuucuagaaauuuaaaauuucaacuguugguccagcaaguagcccuuggaaccaugaugcauugucagacccuaaaggaucaacccucugcauacaguaaaguaaguuugggauuugucuccagugugcugaauuugcuguccucauugggucuuuugcuguuccuauuguagacauucucaugucucauucuguuacuucacaucucugcuuaaaugcuaucucuuugcauagaauuacccuucccccguugcuauauccccgugucaugcugcauuuaaaauuuuuuauuauggugcuuauauauuacauuuuaauuuaucuguguguugucuaucuuccccagcagaauguaagcuuuaugaggcagggaauuugucuuuucacuguuguaucucuggugaaagagaauugggcccacuacuuaguuggagcucaguaaaucuuugucagaugaaugaaugaaugauugaaugcaugcaugccagugaaauggaguuagccagaucaagugaagccauuugaggcuuuguguucagaaauuuggaauggucuuaggaaagaauuucuaaauaaagagauuggagccaggugugguggcucaccccuguaaucccagcacuuugggaggccgaggcaggcagaucaccugaagucgagaguucaagaccagccugaccaacauggagaaacccgucucuacuaaaaauacaaaauuagcugggcgugguggcgcuugccuguaaucccagcuacuugggaaguugaagcaggagaaucgcuugaacccgggagguagaggcugcagugagccguuguacuccccccgggcaauaagagcaaaacuccgucucagaaaaaaaaaaagagagagagauuggaaaagacaugguuuaggaaaauaagcauauucuuauccauagagggaucaaggaaaggaauuaugucauucugccuuugacucagccuuauugccaaggcaaagaugaaccaaccacucacaguaauuuuuuugaguuuauuaccaacuuuuuuuaucuucuuuauccuucucuugagaugucuugguaaauguuaauuauuauuggcauuacauagucauauggaaaacaauguugagauuauuuuuuuuaauuguauugaguagguaagucacuugaacuagaaauuuuagcuuugauuuugccaguaaacaccaguguacccuuuuuuuuuuuauuuuuguuuuuguuuuuugagaugaagucuugcucugucacucaggcuggagugcaguggugcaaucuuggcucacugcaaccuccaccuccuggguucaagcaauucugcaucagacucccgaguagcugggacuacaggcgcccgccaccacacacgccuaguauuuguauuuuuuguaaagacagaguuucaccauguuggccaggcuggucuugaacuccugaccucaagugauucgcccgccuccgccucccaaagugcugggauuacaggcgugagccaccaugccuggccccaguguacucuuuuuccagauuugccauuuauuaacauuuugcuguauuugcuuuaucacuucuuuuuuucuuuaagagacagaucuggcuuucuugcccagccuggagugcaguggcacaaucauuguucacugcugccucaaauuccugggcucaagugaucuucccaccucagacuccugaguagcugggacuacaugugcacaccacuaugcuaggcucauuuuuaaguuuuuuguagagacagucuugccaucuugcccaggcuggucucaaaccucugggcucaagaaauccaccugcuuuggccucccaaaguguugggauuauaggcuugggucacuacagcuggcccuaucacuuuuuauauacauguuaucaucgcccuuuuuuuuuuuuuuuuuugagauggagucucucugucacccaggcuggagugcaauggugccaucucgcucacugcaaccucucccucccaguucaagcgauucuuccaccucagccucccaaguagcugggauuacaggcaccugccaucaugcccggcuaauuuuuuuuguauuuuuguagagacgggaguuucaccauguuggccaggcuggucuugacuccugaccucaggugaucugcccaccugggccucccaaagugcugggauuacaggcgugagccacugcacccggucaucaucacuguuuaaaaaaaaucuuuuuguaaguauguugcagacaucaggauccuuuauuccuucagcauguaucucguaaaaacaaggacauuguuauauaaccacaggacagugaucacauuuaggauuuuuuuuucuuugagacggagugcaguguugugaucucagcucacugcaaccuucaccuccuggguucgagcaauucuuaugcuucagccuccugaguagcuaggauuauaggcaugcauuacuacuuccagcuaauuuuuuuguguuuuuaguagaaaugggguuuugccauguuggucaggcuggucucgcacuccugaccucaggugaucugcccgccuuggccucccagagugcugggauuacaggcgugagccaccgcacccagccaaaauguguuaguuuuaguaguugucauucuacuguuagaaauaaauuucccuucucauuuuuauuuagugauuuauucagcacuaacauugacucguggguucuuauuuuauacaauaaguuauaacucauuauucguuuugaugcucaaauuaucugcggauuugaucaaugcaagcugacuguaauguccuuugauaugcccuuauuauuuucugaguauuuucuuacuuuuuggcuuuuuuguuuauucuuaucuuuuggguuuaugucauacuuuccuuuccccaacuguggaaugggccacuucuucaaggaguccugguccuuuuuaguuggggaaugguuuuuagaaaucaagauuugaauguuaggugugcugauuucuuucuuucuuuuuuuuuuuuuuuuuuuuugagacagaguguugcuguguagcccaggcuggagugcaguggcgcgaucuuggcucgcugcuaccucugccuccugggucccgguucaagcaguucuccugccucagccucccgaguagcugggauuacaggcacgugccaccauacccagcuaauuuuuguauuuucaguagagacaggguuucaccauguugggcaggcuggucuugaacuccugaccucgugauccacccaucuuggccucccaaagugcugggauuacaggcgugaaccacugcgccuggccaggugugcugauuucuacugagaugucauuuguucuucgagcagacagugcagguguaugugcugugugcgugugguucaauccuuccuuuuucauagcaacuucaauauguuuacuguuuuuaguuauguacucauauguacuaaguguuacaauauauauacaaaauuguuucagaauugcuaccccugaccacugcaaauaacaaaacuacuaaggaguucaagauuuauuuguaguucuuuuugucuuuacauugaaguuagguggucaaaugacuccguuuaguuauuuggauuuuuuuuuuccuucugugagcuuauguuacucauuugaaauauaguuuuauauuucuuuguagucaguauuuauuuucaccccaaguauguguugauuuaauuuuauuuuaauuuuauuuuuuaaauguguguuuuuuuuuuuggcugggcacaguggcucaugccuguaauuccagcacuucgggguuuuuuguuuguuuuuuaaaucuuuuuuauauuaauagagaugagguuucaccauauuggccaggcuggucucaaacuccuggcuucaagugaucugccugacuuggccuccucaaagugcuggauuaugggcaugagccacggcacugggccagauuuuuuuuuuuuuuuuuuaagauggaguuucacucucauuagccaggcuggagugcaauggcaugaucucagcucacuacagccaccgccuccuggguucaagugauucuccugccucagccuccugaguagcugagauuauaggugcccgccaccacaccuggcuaauuuuuguauuuuuaguagaaaugggguuucaccauguuggccaggcuggucucgaacuccugaccuuaggugauccacccgccucagccucccaaagugcugagauuacaggcgugggccaccgcgcccggccggccagguucaauuuuauuuuugaauacauaagauacauuaagaaaguccucaaaguuaaaacugucaaaaaaaaaguaugcucagaggagucuuacugcuucucucccuucuaccccguuccuauccaucccuuuauuuagauaaccagugucauuggauugugguuauccuuucaguauuucuuuuugcaaaaauaagcauauuuauacaaauaguucuuuguugcacagauaguaguauaauaugcauauacacuuauaaucugcuuuuuucacuuaauaauauguccuggaaauacuccauagcaauucaugaaggucauccuuuuuauuuuuuccaacuacauaguauucuguuguguggaugugcuauaguuuaaucuccugcuauguuugggcauuuaggcuguuuuuaaaauuuucugauuagaaauaauuguucaaugaauaaucuugugcaguauuauuggaaguauaucaucaaggugaauucauagaaauaggauuucagggucaaaggauaaaugcauauguaguuuuauuagauacuacaacuucacaccauuggauuuguaccauuuugcauucccaucaaaaaugugcaaaucuagcucuaacauuuuaugauuuuaugaaaauauuguucuuggccaggugcaguggcucacgccuguaaaccuagcacuuugggaggcugaagcagguggaucacuugaggucaggaguucaagaccagcguggccaacauggugaaacccugucuccacuaaaaaagauauaaaaauuugccaggcaugguggcgcaugccuguagucccaucuacucgggaggcugaggcaggaggaucgcuugaacccgggagguggagguugcaguaagcugaaaucaugccaccgcacuccagccugggcggcagagcgagacuccaucucaaaaaaaagaaaaaacuguucuuggccaggugcaguggcuuacgccuguaaucccaacacuuugggagacugaagcaggaggaucucuuaagcuaagaguucaagaccagccugagcaacauagggaaaccccaucucuauauuuaaaagaaaaagaaaauaauuguucuugauuucuaggaaauuacauucuaggaaguuaggcuggaggaugagaguggaauguaauuggggguggugcagugauagaauaaaauguuuauaaagauggaacuguuaccaauuuuuaacauucuugccuuuaugaaaauauugucuacacuuaguugucuuaaagaauguuuucuuucuuucuuuuuuuuuuuugagauggagucucaauucuguuuccccggcuggagugcauuggcauaaucugagcucagugcaaccuccgccucccagguuuaagcgauucucacgucucaggcuccccaguagcugggauuacaggcgugugccaccaugcccaacuaauuuuuguauuucguuggagacgggguuucaccauguuugccaggcuggucucaaacuccugaccucaggugauccacccaccuuggcuucccaaaguguugggauuacaggcgugagccaccacgccuggccaauacuuuucuuagagauagacuauuuuugccuauucuuuugauaauuugaauaguacagaaucaguucauguuuguuuucuucgugcacuuaggguuucuugaauuccucugagcuuucuggacuuccagcugggccugacagagaaggcucacucaaggaucaguuggcuuuagcaauuggugaguauuuguaaagguucuggaaacuggaaauuagggacuggaucucuuguuaucuuguuccuccaaaucuaggucaagaaucaugugccuacaagggucagaugauacgaacgugagaagugguguguguguuagauguuagggaacauuaggcaucuuuuuuuuuuccgagacagagucuugcucuguugcccaggcuggagugcaguggcgcaaucucggcucacugcaagcuccgccucccagguuccugccucagccucagccucccgaguagcugggacuacaggcgccugccaucacgccuggcuaauuuuuuguauuuuuaguagagacaggguuucaccguguuagccaggauggucuugaucuccugaccucgugauccgcccgccucggccucccaaagugcugggauuacaggcgugagccaccgcgcccggccacauuaggcaucuuaaagagcucauacgcugcuggaggaagucccauugccaagcuguaaccaauuguuauaucuagggaaacggaguccuggggucaucagaauuucuaaauuccuuaaaagaauuuagauuuguauccaaaaucucacggauuuuggcuguuugcaacuaauuaaaauuauuuucaucacugugccaacaaaacaaagcaugucuuuaggcagagauggccuuuugacuuccagcugaguacuugaguauaugcuguagggaaaauaguacauuaaagauuauuuccucuucuuuauaaaagguggcaggacaauugaggagcauuguuuuuaggaauuugaucuuucuuuucaaaaaaucugguugugaauuuguaaagauacauucuuuuagagccuguuggcuauaggaaccacaucuggaucauuguggugggacuagcaucuugcuuucuuccuaaguauccuugauggagggugggugguagggaaggguuggagcuugcugggaauuuacuaaucugaaguuuccagucaaggcaucaguuccguuuuuaucaggucaucuuguauuaucuaugauguuucaaugagucaugggugagaaaccaggcagacagcuauguaugaggcuuauuaagaaauucuggaagagcuggguguuucagccuugucaguuucugggaauuaacuauuggguauaugcuuugagcuauuuuaaaauuuguuuugguuucuggauucuccuuuuucaugacuuuuagauaugacuauggcuaauccaggcauacuuauacagacccuuuuguuuauucuccuaccccuuuuuaccuuuuggcuuauuuggacuucuguuagaagagaauaacauccugagagaaaggggaaaaauaaguuaaaaucuguuucugguucucauaaauaacucuugacaauguuaucuuuucuguuuuugaugagaggaaauugaaacuauccgaugacauggugcuuugagcuguggacuuuuuccggauagaagggaugaucaggaguugucugugucaguuauggaguauucaggauggugggaaaaagcaccuaauugcuuuggagucagaucugaguuuuaauucuaacucugccuuguguuacuagguggguuaccuaaguucucuaagccuaagcuuauuguaauaguagcuagcauuugagugcuaugugccagauacuauaguuaaugcuuuauuuauuuauuuauuuuugagacggagucuugcucuguugcccaggcuggagugcaguggcacaaucucggcucacugcaagcucugccucccgggcucacgccauucuccugccuuagccuccugaguagcugggacuguaggugcccgccagcacgcccggcuaauuuuuuguauuuuuaguagagacgggguuucaccguguuagccaggaugguaucgaucuccugaccuugugauccgcccaccucggccucccaaagugcugggauuacaggcgugagccaccgcacccagcccuaguuaaugcuccauauauauauauauauguauauauauauauaaauuuuuuuuuuugagauggaguuuugcucuuguugcccaggcuggagugcaauggcaugaucucgcucgcuguaaccucugcugcccagguucaagcaauuccucugccucagccucccgaguagcugggauuacaggcaugugccaccaugccuggcuaauuuuuuguauuuuuaguagagacgggguuucuccauguuggucaggcuggucucaaacucacaaccucaggugaucugccugccucggccuuccaaagugcugggauuacaggcgugagccaccacggcuggcugcuuuuacauauauuauuuauuucuccccaaaacccugaaagguagguggugucaucucuauuuuaaaggugaggaaacaaaggcuugauaaauuuaguaaaugagauuaugucauugagucacuugcccgaggucauauagucaguaaauaggcagaacugagaccugagucacacauacuugugucaccacaaccuauacaaccuauguuuguuguuuuuuuuguuuuuuuuguuuuuggagagagucuuguucccaggauggacugcaaugguacgaucucggcucacugcaaccuccgcuuccuggguucaagugauucuccugccucagccuccugauuaguugggauuacaggugcacaccaccacgcccagcugauuuuuguauuuuuaguagaaacaggguuucauccauguuggccaggcuggucuugaauuccugaccucaggugaucuacccgcuucagccucccaaagugcugggauuacagacgugagccacuacacccggccuguuuuuaaguaccagagugccuggcacauaguuggugcuucauaaagguauucuucacuucccccacucccgcucuccugccccauaccccuuuuccucuuucuacaaaaacugaaaaugguaucucuucaucuuacugcauauccuauguaaaugcaaagggacugucuuccaaacugggccucuucugugcauauuuugguaccaucacagacaucacaauuuguugguguguugguuuuuuguuuuugcuuuaauaggaaaacugggagaaaacaugauucuuaaacgagcugcaugggugaaggugccaucuggguucuacguuggcucuuauguccacggagcaaugcagagucccucacuucacaagcuggugcuggggaaguauggggcccuggucaucugugagacgucugaacagaaaacaaaccuugaagacguuggccgccgccuugggcagcauguggugggcauggccccccucucuguuggcucccuggacgaugagccugggggagaggcagagacuaagaugcugucccagccguauuugcuggaucccuccauuaccuuggggcaguaugugcagccucagggggugucgguaguagacuuugugcgguuugaauguggagaaggugaagaggcagcagaaacugaauagguuccagagacuuuuggcccaggaggaauauuuacuuuuagcucuggacaucauuacaaaaaggaauauuucccaaaccucuucagaccgagaaugcauggguaaaauuauuaaauaguuguauaauaaaaauaauuuuuuccuuguuugcguaauacuggauuuagcuuuucugugccuuucaaaaacaacaggugggccuuauugacgugauagugucguggagaacaggcaucaacaauacugcugcucccuucaacauagauuuauuaugguauuucugaaauuucuaacuuauauguucugucuuacaccuuuuaugacauagaacucuuuuguucuguuuuugcuuugcgacacugugaaccgugcuucugccucggaaccucccuaguuauauuacuugugccacauggauuucuuuaggauuauugauucaaaccuagaguugucuggaaaauguggguucucuucuuugugauugucuguaguaugcuuugaaggugcucugcagugguagacacacugguucuggccucauuuaaugaaauuaauaacacaugccccuauuucucuuuuggaugauguguggguggguggguacugagguuuccuggccagcuguaaggcagauuuugacauucuugugccagaaacagaaauuagaguaguccaguuacccagagagcucacuuaacauugccucuuuacuuccccaguacugaaacauuucuucaaguauaacauaaaauuaccguaacaagcagacccagaauacugaaaauaacuccauuuguucauuauagguaucuuuauuugaaaagugaaaaaugcuuugacacauuacagaucuggguauuuggauuuugccuauggagugcauauaugauuucaaugauuuacaggcuaaauagauuuuagaaauaaucaucuuaaaauugaaaacaaagguagguccugguauaauauuaaacauaaaguuauuaaacauuuuaagcauuguu

SEQ ID NO: 192195 - RNA, 27603 nt, Homo sapiens
cugaccaaucacggacagcgauugauauuucuaaucgucgugauccaccuccccaggaccuuggagccacguuuacaaauaggaauaggguacgugggagggauagaacguacagccaauaaaaucauguggcgccgaugggcguguugaggccgcugccuggcuuagggcggaaacagauucucugcauaagaaggggaacgaaagauggcggcggaaacgcugcuguccaguuuguuaggacugcugcuucugggacuccuguuacccgcaagucugaccggcggugucgggagccugaaccuggaggagcugagugagaugcguuaugggaucgagauccugccguugccugucaugggagggcaggugagaggcguauaaggggcgagggucugggcagaagaggaagcggguaagagauagaggaagaagggcagcuccggagucuggggcuggagccuacggggaaucgggaagaguagguauugcuuuuacggugaccccugggggucgcagacugagaccaauucucugggggccaggaauugggagagguggggcuucccgcugucaaccuucaggucucaguuuaugaucgaaacacccggacuccgcccccguggagaaaugggagcgcccucuccucucacccacuaaauacagcuggagggcuuauggcuuauucugucuucgacugaucucuuccccaggguuugaagagggauuucguuguucucccugaucccagccuuucuuugcuuccuugccccccgacccucccuucuuucccagagccaaucuucggacguggugauugucuccucuaaguacaaacagcgcuaugagugucgccugccagcuggagcuauucacuuccagcgugaaagggaggaggaaacaccugcuuaccaagggccugggaucccugaguuguugagcccaaugagagaugcucccugcuugcugaaggugaaagggacuggguuagauagaaugagggcuuggaaacuagcaguucauccaagaacuggaguccacugaaugaggcaggaucuaggggaccuguagugguuaagaagaccacuggaggaguagacagauuacacggacaggaaagaagcaaagaauccugcaaccacugaugacacuuugcugaacguaggagcagguuaggauagaagaucucagaaaagggcuaaagcaagauugagggucugcgugggguaggaggaguacuuccuuaagccuacuugcuaaagucacccccugcccuaucacucugcuccaguauccuguuuuauuuucaucguagcacuuuucaugaucugaaaucauauuuacugaaucaguuuguuuauuuucggucugauuccccgcauuagaguguaaacuccaugaggucaaagaauuaaucuuguucacaguuguauucccaguggccagaacagugccaggaauguucaagaaguucaauuaauauuuaauuuuggguucuucuauguuucccuaauauaauugcuucagggauaccauaauuucuuaucuuuauggagggcaaauaaggauuuaaaaaaucuuuuaaaagggaggaauggaaagaccacaaguggaaaacagacuuuagagauaucucuccaagucacagaaggaaagcagcccucccuccuuacugaaagucuggagaauugagaguggaagugaagggaagagaauugaguguguaaguagaugagagguuaugugucuuggagccaggagacucugguuccaagaaaagaugucugcacuccaucccccugauuguuuauuuuuuaauugucagacaaaggacugguggacauaugaauucuguuauggacgccacauccagcaauaccacauggaagguaacucacuccuauauuuuccuuaagcccuuagugucauaucauggaaguuccccaguucccuccuccuccuccuccucuuaagaguaacagugcuucacuguggcuucccuugcagauucagagaucaaaggugaaguccucuaucucggcuacuaccaaucagccuucgacugggaugaugaaacagccaagguggcaagagugugggauucaggaagaaaggguucuggccaccggcugagagcccugacaagaaggggagggucaagauuagcugaucuguuucuuggggcuugguggccauuaggacaaaguuuccuggggccugggggcacaggccauucuuuugucucuuuggggacgcagugccauccuuccucuuugcuaucuuucucaugucccccauuccugccucaugucuucuccaggccuccaagcagcaucgucuuaaacgcuaccacagccagaccuauggcaauggguccaagugcgaccuuaaugggaggccccgggaggccgagguucgggugagucuugagagagggaaguugacacucccacagggacaguucagauucuaagggaagaggguugcaucuuauagucggggcgggggcgggggggguccccucccagacccuaaauccaaaguuuaaaacauauuuccagccgggcgcaguggcuuaugccuguaaucccagcacuuugggaggccgaggcgggcagaucaccugaggucaggaguucaagaccagccugaccaauauggugaaaccccaucucuacuaaaaauacaaaaauuagccgggcgugguagcgggugccuauaggcccagcuacucgggaggcugagacaggagaauugcuugaaccugggaggcggacguugcagugagccgaggucgugccacugugcuccaaccugggugacagagugagacucugucucaaaaaagaaaagaaaaaaaaaaacccacauuauuuccaggccgggcacgguggcucacgccuguaaucccagcacuagauaucucucaaaacucuccuaugcuuucuuguggucgguaccuucacucucgccugcaucccugcaaacagcuucuuuacaagugcuucucaucuagugguccuuagcugaguggaggcaggcaaauauagaaugcaaaaaguuccuugggugauucucauguauucacaaauauacacaccuguaaagaauuacaugacaccugccagaguuaucuuuccauaaugcagauuuguaccugcaguugugugcugguaaguguuggacccccagaucucuaugggugugggagggaagcccugaucuguaauguuugccaaugccugugguauaaauacucccaugaugcgcaagucaaaugaugucaacugucuugcaacauucuccaaaacuuaccaguuggcuccaacacaccuguaagucugcaucacuucucuguucaguccugaaaaaccuucaauguuucugccuugcacaaaggcuaagagccaaauguuucagcacagaccagggugguggcaguggaggugaugggaaguaguuggauucuggauauauuuugaagguagagccaaugagauuuguugaugguuuggaugugggauagaaucauggauuacuucaagauuuuuggcuugagcaacuggaaugauggaauuguaauuuacugaagugugaaggaacagguuuaggggaggaaauuagguugguuuuggauauugaagguugaggugccuuuagacauccuaguggugauguccaguugacaguuggcucugugguucuggaauucagggacaaggucugggauagagauauaaguacucauuguauuucugccacacuggccuuuuucuguccuucgaaccagugggucucauuguucccucugccuggugcagucuccugcagaucuuuaaaugauuggccccauccccucauucagguuauauucaagugacaacucccagggaaccuaacauaagcaaacacacacacacacacacacacacacacggaaccuaacauaagcaaacacacacacacacauacacacacacacacacacacacacacacacacacacacacacccuauugcuccuguccugguaagcauccacaguguuuugcauucuucaaagcauguaucauuacuugaaauuauuguauuuguuuaauucugucuucccucacuaagauaagcucugggaaggcagggaugaugucuaucuuguuuucuuauguauccacagcuccuggaacagugcuucacucaaauagguaccuagaaauuauucauugaaugaaugaaaugacugacaagccaguucuaauaucaccuuucuugauuaacccagaaaauuaguuaguuguguuccuucaccacuuaauaauacaagcauccacacacguauauaauccguuauagcacuucauuguauucuaguuauucguuuggguguuuguaucuucaguaggccaagaacugaggucaagacugcauagcuuccucauaucuggugaacauaugcccugugccaagcacuaauagaaacuaggaacaaaaagguggaugagaccuaguccugcucucaggagauauguuaaaugaacagccacaacaagcaggauaaaugccaugagcagugaagugcagcccgcaggggagcacacagucgggacagaguccagggugaaaaggaggccucuugggaaaagugaccuuugaacugacauuggaggaugaggaguuagacuagcagauggagaggaugguggggggaaugagagggcauuccaaauggaaggugcgcuaagugcaaaaggccuggagacaagaggcaauggccuaucccaggaacugacagauacucacagggacugaggggauaaucaugggaagaggaguguaggagaugagucugggugguugguaggggacaggucaugaagggcucuguagcuaugaugaggaauuuagacaauccaagagacaaugguuaggggaggcaaugagguauuugaagcagaaugaugacauauucagguuuggaauugaaggcccacucuagcuggaguauagcaaagauugagagcucacuuaggcagcugugguaauccaggugugaaauaaaaguggccuggggaugaagaaaugugaauauuuagagacagauuuaggggguaaaaucaacagaguaagaaggagucaagaaugauuuccaggcuuuuggcuugugcaguuagauagagggugauucguguuccugagauagguauaaugagaagaggaguagguauggugaaggaaaauggugaguuuggcuuugaauaugauuuuaguggcugcuaggcauucaaguagagauuuccaagggggcuguggaucucugggucuggaguucagcagagagaucugaauugaacccagagguggggaguuguccuuguaucagccauaacugaagccaagguauggaugaaaucccccaaagaaaacaguaucuaaugagaaaagugggauggaacuucaaggaagccaucacuaagagcaugggaagaagaggguuuugccagaagaaagggccagagaggaggcuauggugacauggaaacgaggaaggacacauuugaaggggaaauugguccaugguguuggcugugccugaaccuucaaggaagaggaggauuaaaaacugcuuauaggcaaucauagucauuauuauuuuaauaaaggcaaaacauguacauggaaauaaaaaauucagacaguagagaagagagccagauggaaaguauaaauucucuacuuccaggcaccccugaccaguccuuugguuggacuuaaugauagagaucauuggugaucuuugcuggggcaauuugagcagaguugugaagaugagguguugagaaaaguggugaaaaaguggaacucugcugggcgcgguggcucaugccuauaaucccagcacuuugggaggccaaggcaggcaaaucacuugaggucaggaguucaagaacagccuggccaauauggugaaaccccaugucuacuaaaaauacaaaauuagccgggugugguggugggcgccuguaaucccagcuacucgggaggcugaggcaggagaauugcuugaacccgggaggcggaggucgcagugagcugauaucgcaccauugcacuccagccugggugacagagugagacugucucaaaaaagaaaaaaaagaaaagaaaaaaagaaaaagaaacuggaaaucuuugaagaaguuuggauaugaaagggagauaaaagguaagcauuagugagaggugcugggggguugagagagggggcauucugugguugguguguguuuuaagauggaacagacuagaacauguugaagacuugggugaauguuaguggagaggaggagagggaagucaagguacaguagagagaaugugaaaagaauguggacagggaugggaugcagaacccugggagagcaauuugccucaaaaggaaggucuagggucguaacuggaaugguguauuugcuagugagucuggagguuuugguggcagaaaguugaggccauuccugucugguugcuucuaguuuucaguucuuaugccacuugccuaggugaucagguaaagccccuacuccagggcaggcacugugauguguugcuggccugaugccuccucaauaggaacagcgugcauguuguuuaaagugcagucucuguggggcuagggaacaacugguuagcuauauggaauuaaauaaauuccuauuuauugguguguguuuuaagaugcaacagacuagaacauguugaaggcuguuggguggauguuagcggaaaggaggagagggagaucaagguacaguagaaaaagugagaaaaaaaugcggacagggcugggaugcagaacccugggagagcaauuugccucuaaaggaaggucuaggguaguagaccaacucaauucuuauaaaguaagauucuagagauaucaaagauuuuuuuaaguuauaaaacauacaauuauacaaaaaaaaaugucauagagacccauaaauucacugccaaguuaaacagauguuaauguuuugccugauuuguuucagaucucugguuuaaaaaaaggaauaaaaugcuugugcuaauagcuaaagcccaccuucauauuuagucacucucccucccgccagaaacaaccacaacccucacuauguuuguuuuguauuuuuauuacugauauauauauuacagacaauagauaguguuuuguguuuuaaaauuauacaucaggaguaucaacuuguuuuuuucacugaucaguguguuugccauucaauggcaugacauggaacucugguugagugauuuuuuuuuuuuuuuuuuuuuuuuuuuuuuugagacagagucucgcucugucacccaggcuggaauacaguagugcaaucuaggcucacugcaaccucggccuccuggguucaagcgauucugcugccucagccuccugaguagcugggacuauaggugcccaccaccacgcccaguuaauuuuuauauuuuuaguagggaagggguuucaccauguuggccaggcuggucuugaacuccugaccucaagugauccacccaccuuggccucccaaagugcugggauuacaggugugagccaccgugccuggccugguugagugauuuuaaugucuguauuguguuucauugcuuacuuacccauuccucuguugauaaacaguuggguuucaacucuaaugcccuuauacacagugcugcaauguaggucuuauugugaguguacaagaauuucuccagggaaauaccuagaaaguagaaucacuggguuacaggaguguauguuauuggugaauucaauuuuuuguuuguuuuguuuuguuuuguuuuuugagauagaguuucacucuuguugcccaggcuggagugcaauggcgugaucuuggcucacugcaaccuccgccucccaggaucaagcgauuguccugccucagccuccugaguagcugggacuacaggcgccugccaccaugcccagcuaauuuuuguauuuuuaguggagacgggguuucaccauguuggccaggcuggucuugaacuccuuacauugugauccguccaccuuggccucccaaagugcugggauuacaggugugagccaccaugccuggcccucaauuuuuuuaaugauugaaaaaauauauaaccuaaaaguuaucauucuaacagucuuuaaguguacaauucaguggaaacauucaguguucuaucaccaucacuacuauuuccaaaacuuuuuucaucaucccaaacaaaaauaacuccuauuucucccucucccagacucuguucuacuuucugucuguaugaguuuccuguucuagguacuucacaugagugaaaucauacaagauuuguccuuuugugucuggcuuauuucacuuagcaugguguuuucaagguucauccauguuguagcauauaucagaauuuuauuucuuuuuauggcuuaaucauguuccauugucuguauauacauuuuguuuaccuauuuaucaauggauggacaaauagguuuucaucuuuugguuacugugaauaaugcugcgaugaacauugguguacaaguaucuguuugaguccuguuuucaauucuuuugggucuguaccuaggaguagaaugugccuuaugguaauucuagguuuaguuuuuugaggaacugccaaacuguuuuccauagcaguugcaucauuuuacauuccuaguagcagugcacaggguuccaguuucuccacacuaccuccaucacuuauuuuccuuuguuuucuuuuucuuuuuuuucaguaauagccaucuuaaugggugugaaguaguaucucauagugguuuuugauuugcauuuaccuagugauuaaugauguugaacaucuuuucauaugcuuggugaccauuuguauaucuuuuuuggagaaaugucuauucaaauccucugcccauuuuugaauugaguugguuuuuguuggugaguugugagaguucuuuauguaauaaauucugaauauuaaucccuuaucagaucuaugauuuguaaguauuuucucccauccugugguugccuuuuuacuaucuuuuguuuugcuuuguuuuuuggagacagaguuucacucuuguugcccaggcuggaguguaauggcgcgaucucagcucacugcaaccuccgccucccagguucaagcgauucuccugcaucagcaguguccuuuggugcacaaaagcuuuuaauuuugauuuccaagaguuuuauaguuuuagcucuuaaauuuaggucuuugauucauuugagguuaauuuuuuuuucuuagagaugggggucucguuauguugcccaggcuagccucaaacuccugggcucagguaagcuuccuacuucagcuucugaguaggugggauuauaggggugugccauugugcccagcugcugauuuugaguuaauuuuuguaugugguguaauuuuugcauaugguccaacuucauuguuuugaauauggauauccaguuuuccuggcaucguuuguugaaaagacuguccuuuccccauggaauauucuugguauccuuaccaaaaaucaguugaccauauaugugaggguuuauuucuggccuuucuauacuauuccauugguaaauaugucugucuuuuugccaguaucacacuguuuugauuauaguagcuuuguauuaagauuuaagucaggaaaugugaguccucuaacuuuguucuuuuuuuaauauuguuauggauauuugggaucccuggacauuccaugugaauuuuaagauuuuuuuuuuucuauaaaaaacaccauuggaugccuuucauuucuuuuucauuccuaaucacucuaaaacuuccaguauuauguugaauagaaaugaaaagaauggcuguccuugucuuguuccuaaucuuaagggagaagcuuucaauguuucaccauugaguaugacguuaacuguggguuuuucuuauauggacuuuaucaauaacugaagacauucccuccuauuccuaguugauuguuuuuuuacaugaaaagguuauugaauuuaucaaguccauuuucugcaucaguugagaugaucauuuggguuuuuuccccuucauucuauuaauguauaugacauugauuuaccuauguugaaccauccuugcauucuuggagugaauccaacauaaaucaugauguauaaugcuuuuaauaugcugcugaauuugguuugcuaccauuuaguugaggaauuuugcaucuauauguauaaaagauauuagucgccgggagugguggcucacaccuguaaucccagcacuuugggaggccaaggcagguggaucaucugaggucaggaguucgagaccagccuggccaacauggugaagccucaucucuacugaaaauacaaaaauuagcugggcgugguggcgcacaccuguaaucccagcuacucgggaaaccgagacaggagaaucgcuugaaccugggagacggagguugcagcaaaccaagauugcaccacugcucuccaaccugggugacagagcaagacuccaucuccaaaaaaaaaaagauauuagucuauuguuuucuuguaguauuuuguaguaguauugucuagcuuugauauuaugguaaugccagccucacagaauaaguuaggaaagcauucuuuauaaauuucagauuuaauuauuugucaccuacauucuuucuaucuauacuuugucuucuuguuuuguuuauagugucuuaaaugaauuuuaauuuaaaaaauuuaaauuccaauauagucaaacuuaucagucuuuuucuuuauaccuuauacaucuuaugucuuuuauuuaauccuuuccuauuuacuauucaucuguuuuuuucagguuucuaaaaaaguagaaaagugugaauagaguuucucauacuuuggacuacaauucaguaaaaauuuaucuuaauguauguuauaagguuaggaccuagauacaccuauuuuccacaguugccccagcacuguuuauugaauaguccauacauuccucucugauuuguaaugccuccucaguuauuuaccaaguucucaaauauaugugcauuuucuucuuggcuucucuuuuguuccaauagucuaucuauuccuaugucauuaccacguuguuuuaauuacuauagcuuuuucauaaaucuugguaucugguaggauauacuccccuuuuuucuucaaaacuguuggggcuaucauuggccaaguucuguuaaaacuccuuuuggggauuuuggcuggaauuuaauuuuagacugauuugaagagaauugauacuuuauaauaugaagucuucauacacuaugaacguguuuguuuccauuuacuuguuguccuauauuuuaguaaagcuuuaauuuucucuaaaaguucuucuacaucuuaugugagauuagucuagauaccuuauaguuuuuauuuuugucuuguuuguguaugcauauauuucaaacauacaggaccuuauaguuuuagaugcuauuuuaaguagcaucuuuuacaaauuucauuuucuuuauuauuauuauuuuuugagauggggucuugcucugucaucaaggcuggggugcgaucuuggcucacugcagccucugccucccagguucaagugauucucugccucaaccucccgaguagcugggauuacaggugcguaccaccacgcccagcuaauuauuguaauuuuuuuagagcggggguuuugucauauuggccaggcuagucucaaacuccuggccucaugugauccaccgucggccuacuaaagugcugggauuacaggcaaugagccacugugccuggccaaaaauuccguuuucugauuguugcugguacauggucacauuauugguuuuacauauugaucuuacacucagcaacucuuuuuugaacucuuucauuuuuaguaguucacaaauucuuguggauuuucuguauagauaauuaugucaucugcaagagaaacaguuuugguuucuuccuuucuaaguuguauacauuucauuuuucuuauaccucgagugcaacagaaguggcaaugaugggcauccuugacuuguuucugacuuuaaaggggaugcuccugaaguuucacuguuagcgugauguuuuccugcaggcuuuuugcagauaccuuuuaucagguaugugaaguuccauucuguaccuagacugcuggauauuuucaccauguauagguguggaaguuuaacacaugcuuauucugugucuauugagauagucauaugguuuuuuuaauauuaaaaauguuaauuuauuuucuaguuuuuuuuuauucuuucacuucugggauaauccauggucaugaaguuuuuuuuuuguacauugcuauauucaguauccugauaguauaauuaacuuuuauaacuauuuucguaagugaauuggucuauaauuuucucuucuuguacuuaccuuguuuuuguauaaaguugcauucacuucauaaaauaucuugaggagcuucccucuuuuucugcucuguggagcaguuugcuaagauagagauuauucuucaaagguuagguagggucgggugugguggcucaugccuguaaucccaacacuuugggaggccaaggcaggaagauuucuugagccuaggagcccagccugagcaacauagugagacuccugucucucaaaaaaaaaguuuuaaauuagccugauguggugguguacaccuguagucccaguuacuugggaggcugaagcaggaggauugcuuuaguuggagagguugaggcuguuaggagcuguuaucacgccacuggacuccagccugggugacagagcaugacucucugaaaaaaaaaaaaaaaaaaaaaaaguuuagauaaaauaaauccuccccauccccacaauaugcuacaaaaccgguauauuggggggaucguuguugcuacugauuuaauuuauuuaaagauuauaagacuuuuuugguuugcugcaucaugaagcuuuaauaaaguauaauuucauaggccauuauucauuugucuaaauuuucaaauguauuaguauaaaauuacagauuuuuuuguuuuuuaauaaucucuuuuuguaaauauauccucuuuugcauuccuaauauugacuuugccuuuucucuuuuuucuugaucuauguugccagaggcuugucuaguuuauuaguccaauaaccaccuuuugguuuuguuuauccucucuguuguucauuuaguauuucacuaacauuguauuaguccauucucacauuguuauaaagaaauaccugugacugggcaauuuauaaagaaaagagguuuaauugucucacaguugugcuggccauacaggaagcauagcagccucuacuucugaggaggauuuaggaagcuuccaaucauggugaaaggcaaguggggagccagagucucacaugguggaagcaggagcaaaagagagaggggggacaugccacaaccagaucucuugagaacucacucacugucacgagaaagcaccaaggggauggugcuuuaugcuccacuaugcccagcuaauuuuuuuauuuuuaguagagacgggguuucuucauguuggucaggcuggucucgaacuccugaccucaggugauccaccugccuuggcuuccuaaagugcugggauuacaggcgugagccaccgugucccgccacauguucguuauuuuaucuuuguuauuuccuuccuucuccuuucuuuguguuauucugauuucuuuuuuuucuaacaacuugaauuuuuuuuaacauuaaaaaauucuggccaggcaugguagcucaugcccuauaauccuagcauuuugggaggccaaggugggaggaucacuugaggcuaggaguuugagaccagccuaggcaacacagugagacccugucucuauggaaaaaaaaaaaaaauuagccaggugugguggcacgugccuguggucccagcuacuugggaggcugaguugggaggaucucuucaacccaggaggucaaggcuacagugagcuaugaacacaccacugcacuccagcuuggugacagagcaagacaucaucucaaauuuuuuaaauaaaaaauucuauauuaaauuuucugaauaggcauaaucacauucacauaacucaacuauagaaaugcuuaaaagguauacagagaaaaguauuaacacaucuugucccucauuagccucuuuccauccuuaaagaaagguaaccauuguuaauuucuuuauauacucugagauuuuuuuaaaugcacauauaagcauauaucuuugcacucuuuccaaaucaauauauauauaaaaccuuacuugggccaggugugguggcucaugccuguaauccuagcacuuugggaaguggaggcaggaggaucgcuugaggccaguaguuugagaccagccuagccaacguagugagaucccaucucuacaaaaaaauauuuagccaggugugguagugugugccuguggucccagcugcucaggaggcugauaagggaggaucuuuucagcccaggaggucaagguugcagugagcuauugucauaccauugcacuccagccugagcaaaagagugacacugucucaaaaaaaaaaaaaaagucauccuuauuccugcauauaguuucuguuauucuguuauauaguuguaucauuuuuuaucuaaaugguucccuguugauggacauuuagcuugcuuuaaaucuuuuauuaacacacaagugcugcacugaauaaucuuguacuuacagaggauauguaaauugaguuccuggaaguaaguuuguguaguuuugcuaugugcugcaguaaguuuguguaauuuugcuacgugcugcgaaaucacucugcuuagguaaauuacuuucccuccaacaacguaugggaaugcugauuucccuauagccgugccaaccugguauauuuuuaaacuuuuggauuuuggccaaucaucagguaggcaucagagaaagaaugauuucuuagugugguuuuaauuugcauuucucuuaagaaaaaaaugucuaauuuuccucauuuaaggguuuucucuacucccuucuuuacucuuuucuuucagcuguccaaauucuuugcucguuuuccuaauggcuugcuggucuuuuucuugucaauuuauaagaacucuauauaguagagauauuguccuuuugucugugaugugaguugcaaauauuuuuauaacuucuucagcgaaaugcuuuucaaucugucuucucucuuaauuauacacuuaaagcucuacauuucacucugaguacuauuuugguugcaucccucaaauuuuaguaugugguguuuccauuuucauuaugguuucuacgugcuucugaacuuauuuagaauuaugcuuaauauauuucuaaacaaauguguuuugcuuuguuguuuuuauaugauugcuauugguuucuaauuuuaugccauugugucagugauucuuuuggugauugcugagacuuucuuuuugaugaauuuuuaaaaaauuguauguuugcgcuugaaagcaugucuuuucuccaauuaagcaguucaagaugcucaccguauuguucagauuuucuacaauuuuauguugaguugacuagugaucauuuaaagaacucuguuaauauucccacugugaugguggauuuggcaauuuuguuaauuuuuuauuuauauguuuuaaggcuauguuuaauuuugaaauuaaauaauuuauagguuuucuaauguugcaccaacuuugcauuccugaaaugaaccaaauguggucauauauauuaucccugacgaucccuuuuuuuuuuuguuauuacuuuuuuuuugagacagagucucacuaugucacccaggcuggagugcaguggcaugaucucggcucacugcaaccucugccucccagguucaagagauucucgugcgucagccucccagguagcuggaauuauaggcgugugccaccaugcccagcuaauuuuuguauuucuaguagagaugggguuucgccauguuggccaggcuggucucaaacuccugaccucaagugauccgcucaccuuggccuccugaagugcugggauuacaggcgugagccacccgcaccuggcuguggguagauuuuuaacuacugauucauuuucugaaguaguuuuaggaauauucaaaguuuucuguuucuacuugggacaguuuaaguuuucuuuucaggaguucauuucaucuaacuuuuaagauuuauuggcauaaaguucauuguauucuucuaucuuuuuaaucucuguggcaucuguaauuagguuccucuuuucauuccucauggguuauuuuugcaucacuaauuuguuacuggucagucacaucagagguuagucaguuuuacuaguuuuuucaaagaaacaauuuuuggcucuguugagcuucucuguuguauuuguuuucuauuaauuucuacucuaaucuuuauuuuccuuccuucuacuuuucuggguuuauuuuacuguuuguucaacuucuugaaaugaaugccuagcucauucauuuucagcuuuuccucuuuuauaucucauaaauuugucuccaaccaucuauauaucucugacaaguuuuuaauggcuauuuuaaauuccuuaucuaauuauuaaauagauaauacuuucccaugauacaaaacccagaaaguauuauuuaaaagguauguaaugaaauauuucccaccuggucaugguggcucaugccuguaaucccagcacuuugggaggccgaggcaggcggaccaccugaggucaggaguucaagaccagcuuggcccauauggugaaacccugucucuacuaaaaauacaaaaauuacaggguguggugaggcaugucuguagucccagcuacucaggaggcugaggcaggagaaucgcuugaacccaggaggcagagguugcagugagccgagaucacaccacuaugcuccagccugggugacugagcaagacuccgucucaaaaaaaaaaaaaaaaaaaaaaagagaaaaauauuuccucccauacuugucucucaucugcucauuucccauucucuccccgccaucccugcuccagccccacagguuaacccuggucuuaguuuugcauguauccuuccagccuuuuugugugauuacaaacaauuaugaauggagauucuuauuuccuuuccccuuuauuuauaaacaauauauaguaaauuaaacacacuguucuauaccuugcuuuuauuucccuggacaauaaaccuuagagagaucuuucaauggcaguauaucuuuuuuuuuuuuuuuuuuuuuuuuuugagacggagucuugcucuguuacccaggcuggagugcaguggcgcgaucucugcucacugcaaccuccaccucccggguucaagggauucaccugccucagccucccgaguagcugggacuacaggugugcgccaccacacccagcuaauuuuuguauuguuaguagagauggaguuucaccauguugaccaggauggccuugaucucuugaccucgugaucugcccuccuuggccucccaaagugcugggauuauaggcaugagccaccaugccuggcccuuuuuuguuuuuauagcugcauaaaauuccauuguguguuccaucauuuugucaccauuauucuacugguugaaauaguuccacccccaauucuuuuguugucacaaaugauuauuacauuguacauauaugcauguguaaauauaucuuacauauaauugggcugggcacaguggcuaaugccaauauucccaacacuuugggaggcugaggagagaggaucacuugagcccaggaguuugagaccagccugggcaacagagcaagacccugcaucuauuaaaaaagaagaaaaagaaaguaagcaaaaaaagcauaauugccaggugcaaguuauggauauuuaaagauugucuuuuuuaaacuuuuuauuacagaaacuuaaaaacauauauaaacucccuacaaagguguaucugugguucccugucuuuggacacauaggaugguauuccuguucucuauuucauuuauuuuuguccuagucuguagucuuucccucugcuggcucuugguuuaguguguucuucuuuuucuaguuucuuaagauagaaggguagauuauggagucaagauuuuguuuuuaaaaaauugauguuuauagcuaugaauuucccucuaagcacuacuucagcugcauccuguaaguuuggauauguuaugucuucauuuucguucauuuuugagguauuuuauaguuuucuuuugauuuuuuuccuuuaacucacugguuacuuaaugaguauauuguuuaauuucuacauauuucugaauuuccaaauuuuuuuccucauucauuucuaauuuuauuccauuauggucagagaacacacuuugugugacuuaaauucuuaauucuuugaauauauuuauuaauauaauggcuacuuuuaacucuuugugagauccaacaucugggcccucucacaggugguuucuguugccugcauauuuuccuauauauguuucauacuuuacuguuucugcauguuucauaauuguugaaaaucagacauuuuagauaguauguuguaguaacuccagauagaaauuccugcccuccaccccauggcuuuuguuuguucauuuguucagugacuuggcugcacuacuugcauucagucucccccucacaacaugaagccucuagugucucuucucagagugcacggucuuggcccugcacacagccacacuagaugacagugguuucagcaggcuuuuugacuguuucuuucaugaauuuguuaagccaucugccucugcugguaucacccccagcuguuaggcuccauucauugccaacuaauugcuuuauuguuuuugacauguggggcauaaguuguuccauaguuuaguccaguuaauugugggccccuuugucgggcuaguuuuugagggcaauauauagguuuguucugaguccaggacggcucucaguugcccuuucccugguucucucuguuaaacuagcugucccaagguuuagccuguugcuaucauggagcaaucagccuccuuuuaauugccuccugccaaaaucucuacauuuuugaagugccuauaggcuugaauuuccccauacucuguuucauauuaagucagguccuuuggagaauguuuuggagcccuguauucuuacggacugccucucccccugggcaaaauccccgaggcccugcucuggaguuggggucaggaauaauggcuugcuucacuuggaaggacauuccugcuuuaugagcagggagcuaggcagggaugacaaccucugcucucucgguuugcaucuccuuuugugaaaccuccacucucugagcaagcuuccgugagggcaaucagggccccgauacuuuugucccacugcacuugagguaaagccucugcccuguggguggggcugaguggaggaagggagcccuugaucuuuuucaggaauuuaguugcuguaucuuggagcugguggcccuccugguaaaauaccauauaucauaucucaugacuggauguugagagaauaggaagucccucccccuccaccgccccaccccacuuuuuuuuuuuuuuuuuuuaacuacgcuuaccugcuggaguggagcuuuagucuaacugagcugugggguagggguuuggggcauagauugagggagcaugucaugguucaagugcugcaaauucucacuauucaagauuuaguagcugggcaugguggcucacaccuguaauaccagcacuuugggugggaggauugcuugagcccuggaaagccuggacaacauagcgggacccugucucuacaaaaaaauuuguaaaaauuaguuggauaugguggcacacaccuguaguccuaccuugggagguugaagugggaagauugcuuggaccuaggagguugaggcuucagugagcugugaucaugccacugcacuccagccugggugacacagugagacccugucugaaaaaaaaaaaaagauuuaguagauuuucuugaguaaacauuucuucauuuguuauauguccuuaggaaaauuuccaaagaguuuaaaugcuuuauguuuguuuguuuguuuguauugagacagaguuucacucuuguugcccaggcuggagugcaauggugcgaucucggcucaccgcaaccuuggccucccagguucaagcaauucuccugccucagccucccgaguagcugggauuacaggcaugugccacaaggcuggcuaauuuuguauuuuuaguagagaugggguuucuccauguuggucaggcuugucucgaauuccugaccucaggugauccaccugccucggccucccaaagugcugggauuacaggugugagccaccgcgcccagccaugcuuuguguuuuuaaauuuucaucaguaauggaguuucccuguggagugugcgaaaucccucaugcugccauuucagaaguaggaccgcucccacuuuuuguuuuugagacaaggucuugcuuuccacacggguuggaaugcaguguggcaugaucauagcucacuguaacuuugaacuccugggcuuaagggaucuuccugccucagucucccaaguugcuaagacuacaggugcacaccaccacaccucgcuaauuuuuaaaaauuuuuuguggagaugagucucacuauguugccaaggcuggucuugaauuuuuggcaucaagccauccuccugccuuggccucccaaaguguugggauuacaggugugaaccaccagccucucuuacuuuuaauaguuauuuuagaaauuagaauauugcaugcuuaauuuaucaaaggccaaucaaucucuuuacccucuuucugaaugauauaagaaucuuagaauuguuugaaguuuuuuaccauaugcacauauauaaaaauuacauauuuauauacaaauauauauacacuuuaaaaaaaauacaggccaggccuuguggcucaugccuguaaccccagcacuuugggaggccaagguggguggaucaccugaggucaggaguucaagaccagcugggcuaacauggugaaacccugucucuacaaaaauacaaaaauuagccaggcaugauggcaggugccuguaaucccagcuccucgggaggcugaggccggagaaucgcuugaacccaggaggcggagguugcagugagcugagaucaugccauugcacuccagccuggaugacagagugagacuccaucucaaaaauaauaauaauaauaauaauacauauaugaagcaaauaaaaguauauauauacacacacacaauauuuauacaaaacaagaauaugaaacauaaauugguuaccuacaguuaagcugccugaauucaguuccuguuuuuaccacuuaaaggcuggucaaccugaacaagugccuuaacugcaccacaccuguuucuugaggcacgaaguugagaaaccaauaucgccucacugggucuuugugauaagugagccaauuuauguaaagugccauaugcacaguguaugcacaaugcuugacagauaaucagugcuuaguaaaagacaccugcucuaauaacuaaagcaaauuauuguuggugauuaaguguauucauccuuucuguccuggcaguuccucugugacgagggugcagguaucucuggggacuacaucgaucgcguggacgagcccuuguccugcucuuaugugcugaccauucgcacuccucggcucugcccccacccucuccuccggcccccacccagugcugcaccgcaggccauccucugucacccuucccuacagccugaggaguacauggccuacguucagaggcaagccggugaguaauuagagaaggaggagaagacggggagauacgggggcaggggguggcaaaagaucaaguauugaauagcuggaggaauguguuccuggccugcuugcaugcuguuucucaguagacucaaagcaguauggagauaaaaucauagaggagcugcaagaucuaggcccccaaguguggagugagaccaagucugggguggcaccccaaaagauggcagguaggaccuuguuucaccuguuccgugaaacucacuuccauuucuucccuuccccugaucuuacuguccugacugacuggugggguggggggggguggaaaaguaccaugggcccuccucccuuggugauagaggaggggaagggaccccauccuauuugcucccuucugucucaccccuccugucagaucagucucucccuguucucuguacccuaggugcgagcccgaccaaggaugacaguaaggacucagauuucuggaagaugcuuaaugagccagaggaccaggccccaggaggggaggaggugccggcugaggugagaccagcugccucagaggagcaggauggggauggggagggucacugcagcuggggccauugugaggugaccuacaucuaccuagggaugcaaggauauccccagaaccuuugccuucauaguauggagggcaugaacaggcuuucauacuugacucucuccuuuucuccucgucaggagcaggacccaagcccugaggcagcagauucagcuucuggugcucccaauggugagugaaccuuccaugucuccuuuacugaauauauuuuaggauuggcagggguagggauggaggggagagcuaagccugggagggagguuggguagccaggccggcagaaaauucauuuuuauaggaguuaauacucuuuguagacagcacugcuauuuuagcaagguggcagaacacaguggcuccaccacuuggugacuuuguaauucacuuaaccucaauuuucuuacccauaaaaugaggguaauaaccccuaccuuagaggguugcaugggauuaaaugagaaugcauccauaauucacaguagaaggccuggaacugaauaaacuaaaugguuaauauuuguggaaagaggagaaggguuccagggaagacaagcccuuagccccaggaucuccucuguaguccuaaaagcuagagugacugccagaagggccucagaagugcauggaagaguggggacuuagcagcuuguuagcauccaucucuccuaccagaguguccaccuuaggauggugcucucugcaggcgaauauuugcccuugucucacugucaaacagguaaauccuagaggcagggaccauguccuuccuuggucucucauuaccuguccuuaggaauccagagagaauuuaggagcgcaguagcgcacaccuguaauccuaguuacuuggaaggcugaugcaggaagauugcuugagcccaggaguucaagaucaucuugggcaacauaguaacacaccauguugaaaaagaaaaagagccgggcgugguggcucaugccuguaaucccagcacuuugggaggcugaggcagguggaucaccugaggucaagaguucaagacaaaccuggccaacauggugaaaccccaucucuacuaaaaauacaaaaauuagcugggugugguggcaggcgccuguaaucccagcuacuugggaggcugaggcaggagaaucucuugaacccgggaggcagagguugcagugagcagagauugcaccacugugcuccagcuugggugacagugcaagacucugucucaaaaaaaaaaaaaaaaaaaaaaaaaaagaauuuaaacacaacagaacagguucaugauuauuauucuuucaucucagauuuucagaacaacgugcaggucaaagucauucgaagcccugcggauuugauucgauucauagaggagcugaaagguggaacaaaaaagguauaggccgugcuuagggaauggguagaacccaccucccaacugcgagcauuugaaaaacuacccugaccugggacucaacuccugggucccccaguaccacacaccugcuacuguuugucugcccccgaccaugugucucuguugaaaccccaacugucuuucuccccacucccuacccacccaggggaagccaaauauaggccaagagcagccuguggaugaugcugcagaagucccucagagggaaccagagaaggaaaggggugauccagaacggcagagagagauggaagaagaggaggaugaggaugaggaugaggaugaagaugaggaugaacggcaguuacugggagaauuugagaaggaacuggaagggauccugcuuccgucagaccgagaccggcuccguucggaggugaaggcuggcauggagcgggaacuggaaaacaucauccaggaggcaagcccagcucuuccuccuguugcuuccacagccgccuggucccguggagcaggacaggcugacgggcuaaaagaaacagagggcacagcacagggcaaggacggggcacuuggaagugguagcuguuucccuaauuaaucggggcuguuggggaagggggaccagagagagggacaagacuuaaauaucagacucucuggccaggcgcgguggcucacgccuguaaucccagcacuuugggaggccgaggugagcggaucaccugaggucaggaguucaagaccagccuggccaacauggcgaaacccucucuacuaaaaaugcaaacaaauuggccaggcauggcaguggguaccuguaaucccagcucuuuggaaggcugaggcaagagaaucgcucgaacccgggaggcggagguugcagugagccgagacggcaccacuguacuccagccugggugauaagcaaaacuccauuucaaaauaucagacucuccuacagagcccagcccgcuggcugccuccacaccccagacccuugacucacucucuucucuuggguauuccagacagagaaagagcuggacccagaugggcugaagaaggagucagagcgggaucgggcaaugcuggcucucacauccacucucaacaaacucaucaaaagacuggaggaaaaacagaguccagagcuggugaagaagcacaagaaaaagaggguuguccccaaaaagccucccccaucaccccaaccuacaggugagagcagucagacaagaaagaguagcccagucuguuguuuucaucccucagcugguucuguucccagaggggacccuguuccuucccuucugagggugcucauucucuccccacuuucuggaacacuguccucacuugcgccugcuucccaacaccaucaucccuuugcguguuuaccuccuauucaucccucugggaagcagcuuuuagagcauaucugcugguuuucugguuugcuccuguacacccagugccuagcacucugccuggcacacaauggaugaucaguagcuaguaauugaaugcuugugagucuauaugcugaaaaccacuuuaggacuuugcaccaagagaggccccagcugucagggcaugaauaggagagcccagcugcacaugagccaauagcuuggauagacuuuaaauuauuucuucuucuuguauccccuuguguccauuucauaguguccuauggguguggacaucagauauucuaaauggaauguuccaguuucaaaccuuccauucccacucucucuauaaacauugaaaugucuuuaaagucccaacauauggaggaggagaccacacuuuuccaaccugcuucuucaaacagaacuuuguuggugcagguggccugauuuuggcuuuagaaaacauuuguuuuccuauaggugacgggcagaauuauuggguagggcgggaagauggaaggcugcaauugguggagggagcucuacaggcugaacugggaggggcggggcacacauuuuuuugagcccuggcucauauacauguugagauggaagagcugccaaagccaacugauguuuuagggggagaugacccccacaccccuaacccuggagucacgccucugcuuuguguuucccugugugucucccccucuaagaggaggauccugagcacagaguccggguccgggucaccaagcuccgucucggaggcccuaaucaggaucugacuguccucgagaugaaacgggaaaacccacagcugaaacaaaucgaggggcuggugaaggagcugcuggagagggagggacucacagcugcaggugggcccuggagggcggcuggacccagugcugucggaagggcaagcugccggaaguggaggggcugggaccaguggggcagggggccugcccugaggcucccaaccauccucuccucucacugcauacugcuccuuuccagggaaaauugagaucaaaauuguccgcccaugggcugaagggacugaagagggugcacguuggcugacugaugaggacacgagaaaccucaaggagaucuucuucaauaucuugguaagaggcuucuacccccgaguccuggcccccagcccuccuggaguggaggugcgggcuugccccagccacgccauugcugagcuuccauuuccugaucuguaagacaaggcugggguuccaguggcucagagugcugccaugcaggaagagccccucaggacauggguguccucauucccugccuucccccagcugccuggcccaggacuucccugggcucaacggccaguagcuccagcccaccucuacccucucccaccaggugccgggagcugaagaggcccagaaggaacgccagcggcagaaagagcuggagagcaauuaccgccggguguggggcucuccagguggggagggcacaggggaccuggacgaauuugacuucugagaccaacacuacacuugacccuucacggaauccagacucuuccuggacuggcuugccuccuccccaccuccccacccuggaaccccugagggccaaacagcagaguggagcugagcuguggaccucucgggcaacucugugggugugggggcccugggugaaugcugcugccccugcuggcagccaccuugagaccucaccgggccugugauauuugcucuccugaacucucacucaauccucuuccucuccucuguggcuuuuccuguuauuguccccuaaugauaggauauucccugcugccuaccuggagauucaguaggaucuuuugaguggagguggguagagagagcaaggagggcaggacacuuagcaggcacugagcaagcaggcccccaccugcccuuagugauguuuggagucguuuuacccucuucuauugaauugccuugggauuuccuucucccuuucccugcccacccuguccccuacaauuugugcuucugaguugaggagccuucaccucuguugcugaggaaaugguagaaugcugccuaucaccuccagcacaaucccagugaaaaaggugugaagcacccaccauguucuugaacaaucagguuucuaaauaaacaacuggaccaucaa

SEQ ID NO: 192196 - RNA, 28703 nt, Homo sapiens
aaauagucuacuuuccgguagcggugccagggcaguggccuaauacggaacuccauuucccggcgugccucgcggaggccgcugaacucagaagcgggaggccgguuccgguugcaucagcgagggauucacggcgaaaugagacuguucgugagugauggcgucccggguugcuugccggugcuggccgccgccgggagagcccggggcagagcagaggugcucaucagcacuguaggcccggaagguacucgugcuggugcuggugggcgguggaugggggggcgggaccgaaacacgccagauucucugcagcugucuuugccaaaccccuagcccucgccacacaccccaaucgaccacuucuccuauuauccuugaucacuccacgccuucuucccucccagucacaucuuucacuuccuuuaauuacccucaauauaauacccuucccuuaucucucuccuccccucuuccgucuucccgguccccgccucaccccaguaaacugcucuucccuucccaaccuucuccuacaccuaucaggcaucccccucugcucuuuaguuacuagcaugacagcccccaggcacccuuuuguguucuuaggaaaucccucucuccccuccuaacacacacacacguuccuuucuguuuaccucuucucauucucagccgauuguuugggugacucuuaggagguucucuuguaagucuucucaguucuuuuaauuuuguucucccacugugaccuucagauaauuaugaagauaucccaguuacuuucagucguuaaguucuuggcugcagcacuaucccaauaccaccaccuccucugcaguccccaucuguugcuuccagcuggcaguuucagcugaacaccugcuggccucuccagcccauuccggaccacccccuuucagugguccuauccuggaacuucuggguugagacugcccaucuuucuuuuuuuacucacugaacaaugcaagguuauccuaaguugacaaaguauuucuuuucuuuuccuuuuuuuuuuuuaacccauuuuccauucuugcaucagauuguguggucccguuccugacccggccuaaggucccugucuugcagcuggauagcggcaacuaccucuucuccacuagugcaaucugccggucaguauugguccuugguguagggagguggcugaaucaaaucaggccucacugucauuuguguggcuuuauuugcagccauuguuucccugugugaugagaaaugggcuaaaugggccccucuaaguccaucaucuguugcucucucucugggcagauauuuuuuuuuguuaucuggcugggagcaagaugaccucacuaaccaguggcuggaaugggaagcgacagagcugcagguaggacuaagguaugggggaugucaggcaggcccuuguucugcguggccauccugacucauguccccugcauuuuagccagcuuugucugcugcccuguacuauuuagugguccaaggcaagaagggggaagauguucuugguucagugcggagagcccugacucacauugaccacagcuugagucgucagaacuguccuuuccuggcuggggugaguugggucuugagaugaggacuggggaaggcuuaugguguaaggauuaagagggaagacuguauucagaguguucgaacccaacacugccacuuacuaguaguguaaucuuggcaaaucacuuaaucucucuaauccucaauuuuuuucaguugugaaaugggauaauauuaguaccuaucucagugaguuauugugaggauuaagugagaucauauaaagugcuuaauacagugcuugacauauaaagugcucaguaaauguuagauauuaccauugggaagaaacugagugucucauuuguguacauuuuccuuuucuauccccaacaaaggagacagaaucucuagccgacauuguuuuguggggagcccuauacccauuacugcaagaucccgccuaccucccuggugagaacugugcauaucacuccaacccuaggagcuugguguagggguuacagaaugggcaguagaauacugagaacucccuucaagguacagcuugacugggcaacuauagcagaagaugguugagggaacuggggaaagcaacuggagaaaccucacaaagaaggggaaagaugcccgcuccugccuaccagguccuuauguuugcugauuuucuuuucuuccauacccacagaggagcugagugcccugcacagcugguuccagacacugaguacccaggaaccaugucagcgagcugcagagacuguacugaaacagcaagguguccuggcucuccggccuuaccuccaaaagcagccccagcccagccccgcugagggaagggcugucaccaaugagccugagguuuggaauagggcagagccuuggggccugaggugggagguggcuaggagauggacuuugagcauggccacuaacuuuuucagguaguggcaaggagaaaguuucuuuacccugugggcccuccucaccugguaagggauucucuccacucuuuauaggaggaggagcuggcuacccuaucugaggaggagauugcuauggcuguuacugcuugggagaagggccuagaaaguuugcccccgcugcggccccagcagaauccagugugaguagacauggcacaugugaguggggcuugauuuuguaguggaaauuguugauagagccagaaccugccugcuaggucccguuugcugaucucucuuuaauuuuucauccucuccuuuuaauucuuacaucucuuuuuuuuuuuuuuuuuuuuuuuacauuuucucuuagccuaucauuuuggacacuccaucugucccaucugcacccauguuuuucuugucuauccuuuuuuuuuuuuuuuuuugaggcggaguuucgcucuuguugcccaggcuggagugcauuggcgcgaucucagcuuacugcaaccuccgccucccggguucaagcgagucuccugccuuagccucccaaguagcugggauuauaggugugcaccaccacgccuggcuaauuuuuugaagagacaagguuucaccauguugcccagacaggcuggucucgaacuccugaccucaggugauccaccagccuuggccucccaaagugcugggauuacagacaugagccacugugccggcccugcacccauguuuuucagcuacuuuuuacccaccgauaggagcuaacucuauuuuuccaguccagaucuguauucugaacuccagacacauuugccauacuauccuagacuccuucaccucuacaggcaucucaaauucaacauauccaaaaccaaaccuguuaccuuuccugcuaaaugcccuuuuauuuauucaccugccuuuguugaacagccuccaccuuccaccuaaaaauccaagccagaaaucuugguguuaucuagacuucuucguuucucccuagcuguauuauucauucccuuaccaagucguugacucuaacuguuaaguagucuuugaauccaccccuucuccucucuguugucacugucacuacacagauacuaacagaccuugucaucuguuauccucuuucccugacacucuguacuccacacugccuccagagugacugcuuaaaacugcacagacuauuaucacuccuuuuuagaauucuaucgaugguuccuuuguguaauucacaaggccccugacugcaggcucaguaacauauuuugucacucuccugcuacacuaagauaauauuuauacauacgcaguuuuuuccgucaaaaugaaauuauuuacaguucugaguauguuugccauucaauaaacauuugaguguuuacuccuuuccagucccugcaugcuaggagcuggguauacagaggggaacaagacagacaggaucuccgcugucaugggacuuucugucugguaggauagacagguauuuuaaaaacugucacacaaauguagaauuacacauuuugaaaaguccaggccgggcgcgguggcucaugccuguaauccuagcacuuugggaggcugagguggguggaucauuugagucaggaguucaagaccagccuggccaacauggugaaacccugccucuacuaaaaauacaaaaauuagccgggcauuguggcgggcacuuguagucccagcuacucgggaaggugaggcaggagaaucgcuugaaccugggaggcggagguugcagugcgccaagaucaugccacugcacuccagccugggagacagagcaagacugucucaaaaaaaaaaaaaaaaaguccaaugaaggaaaagaagagguugcuaugcgaggaaauaucagaggugacuaauuuagaggccucucuaaaacauugagugaagacuuaaaacggccaggugcgguggcucaugccuguaauccuagcacuuugggaggccaaggcggcagaucaccugagaucagcaguucgagaccagccuggccaacauagcaaaacccugucucuaucuaaauacacaaaaauuagcugggcacgguggcucgugccuguaaucccugcuacucaggaggcugaggcaggagaaucgcuugaacccgggaggcggaguuugcagugagcggagauugcgccaguguacuccagccugggcaacagagcgcgacuccauuucacacacacacacacacacacacacacacacacacacacacacacagacguaaacaaauuugagacuugcaagauuaaguaggggcuaguuaggcaagaguaagaguggagagaggguguuucagagagaggaaaucuaauaugcaaagaccugagaagcaagagaguuugccucuuaaggaauuccuaaaaggacaguggcagcaggcuggucagucgggggcacaugggucaaaaugaguuuugagaggcagguggggcuggcaucauaccauugucucucaccucugugccuuuaugcauacuguuccuucucccuggaaugccagcaucuuaccugccugaugcacaacucuucuugcagagaggaguucugccuuuuccuucucuauagagugugagacagucuuaagugcuucaauuucugggaggucccauugucauauuauguuguaauugucacauuacauguuuguuucuucacuaauuuguaagcucauugaagguagaggugucucuuuuauggggcucaguugcuagcacagggccaaauguucuguagauauugauaacauuugaaugaauuuaugaaaguccauccuuguuguuuugcuuguuuugaguauauauauauaauauauauuauauaauauauuauauauaauauauguuauauaauauauauuauaugauauguauaauauauauuauauaauauauuauauauaauauauguuauauaauauauuauaugauauguauaauauauuacauaauauauaauauauuauaauauauaauauauaauauauaauauauaauauauuauaauauauaauauauaauauauaauauauuauaauauauaauauauuauaauauauaauauauaauauauuauaauauauaauauauaauauauuauaauauauaauauauaauauauuauaauauauauuauauauaauuaauauauaauauacaauauauauuauauauuauauauauuauauauaauauauauuauauauuauaauauauuauauauuauauauuauauuauauaauauauauuauauacauuauauuauauauauuauauauaauauauauuauauauuauauauuauauuauauaauguauauuauauauauuauauuauauauuauaauauauaauauauauauuuauauuauauaauauauauaauauauaauauauauuuauguuauauaauauauauaauauauauaauauauauuauauauuauauauauauuuuuuaauuuuaauuuuuuuuuuuuagacagaguuucgccuugucauccagucuggagugcaguggcgugaucucagcucacuguaaccuccgccucccagguucaagugauucuccugucucagucucccgaguagcugggauuacaggugcacaccaccaugcccagcuaauuuuuguauuuuugguagagacaagguuucaccauguuggccaggcuggucucaaacuccugaccucaggggauccaccugccucggccucccaaaguguuuggauuacaggcguaagccacuacgcccagccuuguuuugaguauaucuugagcauauauuguggauucaguuuaauacuaagcacuuacuucuucuuuuuuuucuuuuuuuuuuuuuuuuugagauggagucucacacugucguccaggcuggagugcaauggcaugaucuuggcucacugcaaccucugccucccggguucaagugauucuccugucucagccuccugaguagcugggauuacaggugccugccaccacgccuggcuaauuuuuuuuuuuuuuuuuuuuuuuuuaguauuuauugaucauuauuggguguuucucggagagggggauuuggcagggucauaggacaauaguggagggaaggucagcagauaaacaugugaacaagggucucugguuuuccuaggcagaggacccugcagccuuccgcaguguuugugucccuggguacuugagauuagggaguggugaugacucuuaacgagcaugcugccuucaagcaucugcuuaacaaagcacaucuugcaccgcccuuaauccauuuaacccugaguggacacagcacauguuucagagagcgcaggguuggggguaaggucauagaucaacagcaucccaaggcagaagaauuuuucuuaguacagaacaaaauggagucuccuaugucuacuucuuuccacacagacacaguaacaaucugaucucucuuucuuuuccccacauuucccccuuuucuauucuacaaauccaccauugucaucauggcccguucucagugagcugcuggguacaccucccagaugggguggcggccgggcagaggggcuccucacuucccagacagggcggccgggcagaggugcccccccaccucccgggcuggguggcggccaggcggaggcgccccccaccucccggaugggguggcugccgggcgggggcugccccccaccucccggauggggcggcuggccaggcgggcgcugccccccaccuuccucccggacggggcggcuggcggggcgggggcugccccccaccuccuggauggggcggcugccgggcggacacgcuccucaccucccggaugggguggcggucgggcagagacacuccucagaucccagacggggucgcggccgggcagaggcgcuccucacaucucagacggggcggcggggcagaggcgcuccccacaucucagaccaugggcggccaggcagagacgcuucucacuuccuagacagguugacggcggggaagaggcgcuccucacuucccagacugggcggccaggcagaggggcuccucacaucccagacgaugggcagccaggcugagacgcuccucacuucccagacgggguggcggccgggcagaggcugcaaucuuggcacuuugggaggccaaggcaggcagcugggagguggagguuguagcgagccgagaucacgccacugcacuccagccugggcaacauugagcacugagugagcgagacuccgucugcaaucccagcaccucaggaggcccaggcgggcagaucacucgcggucaggagcuggagaccagcccggccaacacggcgaaaccccgucuccaccaaaaaauacaaaaaccagucagguguggcggcgcgcgccugcaaucccaggcacugggcaggcugaggcaggagaaucaggcagggagguugcagugagccgagauggcggcaguacaguccggccucggcucggcaucagagggagaccguggaaagugggagaccguggaaagucggagacagggagagggagcaauuuuuuguauuuuuaguagagacgggguuucacuauguuggcuaggcuggucuugaacugaccucaugauccacuugucucggccucccaaagugcugggauuacaggcaugagccacugcacccggcaauauaagcacuuucuuuuuuuuuuuuuugaaacugagucucacuaggauggagugaguggcgcaaucuaggcucacggcaaccucugccuccuggguucaagugauucuccugucucagccccccgaguagcugggauuacaagcacgcaccaccaggcccggcuaauuuuuguacuuuuuuaguagagacgggguuuuaccauguuggccaggcuggucuugagcuccgaccucgugauccgccugccugagccucccaaagugcugggauuacaggcgugagccacugcauccggccaauacuaagcacuuucaaggcucauauagaauaggaaguacugccguggcucaugccugaaaucccagcacuuugggagguugaggcgggaggaucacuugagcccaggaguucgagaccaguccugucaacauagacugcaucucuacaaaaaaaauuuaaaaauuauccaggcacggugaugccugccugaaguuccagcuaccugggaggcugagauggaaggaucauuuugagcccaggaguucaagauuacagugugcuguguugugccacugcccuccugccuaggugacagagggagacccugucuccaaaaaaaaaaaaaaagggagauaaccuuucucaggcauguauacaggcaaauacauuuaaaugcauaaguggaggaggagacaguuggcauugaagauccuaugggcagacuaagcuguguugggcuagagugcuugccuuccuuugaucuccuuugacacuuugcaccucuucauuacacugaucccagucagcaguuacauaauagaauguaauacccuugggagcagaaccuagggcauauuugccucuauacuugccacagcaguaagcacacucauucugagagauaagugacaggguaacacaaaaggagcacuacucaauaugguacaaagugguuaggggguugggauacaaaaaagacugugugggaagauggccaucagugaaggaagguuuucuuggaggaggugauuucuaagcuggauuucagagaaaguuacgauauucaguuauggagagaaagggugauggaugcacaagaaauuagugagaugcguuuuauggaaauaagcuguaaauguucuaggaaguaguugggccaucuauugggauauauagcagcagcugggaagaaggguugagguuaaugugagggaaucggggaggcagugacuguaggcuaagaaugguuggaaagaugauaggagccuuaguguagugucagugcuaaagaggggauguugauacaggauguguacagcucagaugucaaggaugaugaaacuugaaaaggaauacugcauugagugccuucagacagcagguugaauggcaugaccagcaacgaucuagaaaagugggaaggagagggugacggugaaggcaaaacuggugccugcugguuugaguuaggccaugaggaagugacagacauggguuagagagucgguacaaaaggacuuguuacgggucguaucuaggcuggugagcucuuuggauuucagauaguggcuagagauuauaguaacauagcaccuggaaagaaggggagaagccagcgcugggaaaguguucuugggaguggugagaggguaaugauuggacagagccuagggagaguuugagccugagaaugagguaauagaaaacaagcagucaugacaguaaaagggacagaaauugguguugaacaaggcuccuucauagcaguacaggagacuuccucacuguggcagugcccuguauuugcaucucuggggaucuuagagugccucgggaagcugugguccuguggguuugugugcagaaagacuucaaguguacaugaacacaugacaguagaacaaaucuguguccggguguucugugcacuuuucgucccuguugacccucacauccccccaugcacuguucucuuccucuuuccuuacuagguugccuguggcuggagaaaggaaugugcucaucaccagugcccucccuuacgucaacaaugucccccaccuugggaacaucauugguugugugcucagugccgaugucuuugccagguggagccagcugcucggggagagaccuccuaagggaagggcgggucccaggggaauaggaugcuucaaggguggggcuggggagaucccaaggacaaggaagcgcugaagcggggcccccuagcgaucaccauauucccuugcagguacucucgccuccgccaguggaacacccucuaucugugugggacagaugaguaugguacagcaacagagaccaaggcucuggaggagggacuaaccccccaggagaucugcgacaaguaccacaucauccaugcugacaucuaccgcugguuuaacauuucguuugauauuuuuggucgcaccaccacuccacagcagaccaaguaaguuuccucuaaugaggcagaaauggggcuugaaggcugagacugggaacagugggaguaucuuggagacagaaggaacccggguggcugucugggcacuccuaaacuuaggaucucaauaucacccugggcaguuauccaggcauuuuugagggaagaugguguguguagaagccugaccaggagcugaaggagcagcugagggagggcagagaccagacgcaggcugaugggaaauaucuaucuucccucuagugccucccuuccucucuguguccugaagucuaagacacuucuucccacuccuguaugcauuuauaacacauaaacucauucuuccucugccuaauacucauccuuauaaaaacuuugcauagccgggugcaguggcucauaccuguaaucccagcacuuugggaggccgaggcgggcggcucaccggaggucaggaguucaagaccagccugaccaacauggagaaaccccaucucuacuaaaaauacaaaaauuaguugggcgugguugugggugccuguaaucccagcuacuugggaagcugaggcagaagaaucucuugaacccaggaggcggagguuguggugagccaagaucaugccauuguacuccagccugggcaacaagagcaaaacucugucucaaaaaaaaaaaaaaaaaaaaaaaggcuggggcugggcgcgguggcucacaccuguaaucccagcacuuugggaggccgaggcgggcggaucacgaggucaggagaucgagacuauccuggcuaacccagugaaacccugucucuacuaaaaauacaaaaaaaaaaaaaaauuaaccaggcgugguggugggcgccuguagucccagcuacucuggaggcugaggcaggagaauggcaugaacccgggaggcagagcuuacagugagcugagauagugccacugcacuucagacuuggugacggagugagacugucucaaaaaaaaaaaaaaaagggcugggcgcaguggcucacgccuguaaucucagcacuuugagaggccgagguggguggaucacgaggucaggaguucaagaccagcuuggccaacauggugaaaccccaucucuacuaagaauacaaaaauuagcuggaccugguggugggcaccuauaaucccagcuacuugggaggcugaggcagagaauugcuugaacccgggaggcugaggcaggcagugagcugagaucgcaccacugcacuccagccugggcgacagagcgagacucugucucaaaacaaacaaaaaaacccccaaaacuuuacauaguagacaggccgccaacugauagugcuaugcaguuuaguuuagcacuuggacugacuuaauuuuuaggauauauuaaagaacaggcacaguccuauccuauuggagauuuuuguuaaugaaaaauacaaaacagauaaaucuguguucaacaaaagugaauucuaaaguguugaggggaaagauuaugugggcaguuggggaauaugugugaugggucugagcucauccaguaaaacucucaaaagaugaauagaugcccuuuuccuugaggagccuucugccugauuucuuugucacugaguuugggucccugguuggaguggcaggaggaagggguccaccacgucuucugacugucucuuccugaucccuggcccaccucaccagaaucacccaggacauuuuccagcaguugcugaaacgagguuuugugcugcaagauacuguggagcaacugcgaugugagcacugugcucgcuuccuggcugaccgcuucguggagggcgugugucccuucuguggcuaugaggaggcucggggugaccagugugacaaguguggcaagcucaucaaugcugucgagcuuaagguaagaggagggucuccaugggagcccggaaggagacaguccuuauucuuaagggacgcccuuccugucccauuuaggauuuuuauuuuagcauucuagaccuuuaaccaguggcccuuucugccccaucucagcaacucgucauuuaguucauuugaaaaauacucccugagcacuuacuaugugcugagcacugugcuaagaaacagacaaguugaguuuauauuucccaaccuuuggucuugcaucacaccaccugaucuacauuuguuuagauccuucucucuucuuuaaauaucuucucuucuagccauuuguuaauuuauuucuucauucauuuauucaacauacauuuuuugaauccuuagaauaggccaauuacaauucugcgugcuggggguauggcaaugaauaagacagauuuuauuuaguauggucaggagaccaacacuaacuaaggaaaugauauagaauaaacugccaggaaaaugugacagagagugacuucugggggaagaucuaacuuagguagauagggaaggccuuucagaggcaguaacauuugaacugagaguuuaaccaaagaauuaggagcaagccaggcaauaagagguuaagaauguucuaagcggaaggacuaggaaaugcaaaggccaugaggcagcuaagagcugaaaaggcagaauuggcaaggccaguauagcacuagcacagugagugaggaggaggguagacugagaugaggugagagagauggcaggggccagaucaccagggccugugaagccauugugggaauuuagauuuuauucuggugaaugacaagcugcucuguggaaaauggauggcagggaagcaagaaauaaaguauguugaaggggcugggcauugguggcucauaccuauaaucccagcacuuugggaggccaagcuggguggaucacuugaagccacgaguuugagaccagccuggccuguaacauggcaacccugucucuacugaaaauacagaaauggcuaggugcgguggcucacgccuguaaucccagcacuuugggaggcugaggugggcagaucacuugaggucaggaguuugagaccagccuggccaacauggugaaacccugucucuacuaaaaaaauacaaaaauuagcugggugugguggcggaccccuguaauccccgcuucuugggaggcugaagcuugagaaucacuugaaccugggaggcagagguugcagugagcugagauugcgccacugcauuccagccuggguuacaaaguaagacucugucuaaaaaaaaaaaaaaaccacaaaaauuauccaggccgugguggcgcacaccuguaaucccagcuacuugggaggcugaggcagaagaauuucuugaaccugggaagcggagguugcagugagccaagauugccacugcauuccagccugggugacagagcaagacuguucccccuccaccaaaaaaaaaaguauggagaaggauuuggaggcaacaaggcuacaacccagaaaugggauaaugguggcuugcacuagguuaguagcacuagaaauggaaaagaaaaaauagacuugagguauauuuuuggagguaaacuccacggaguuggauagacuggaauuugggauggucaggaaaaagaugccuuguaaguuuuuggccugaguagaugguaguaccaucugugaacgugagugaggagaacaggcuuucaggugggaugcagccauacuguuuggguuuguuaagcuugagaugccuguuagauagccaggcagagaagucagguagacaguuggauauuaggcauauggaguucaggagagagguccugaggaauuauaauuucucaccuucaaaaacucagaucaaaacucacuuggggccaggugugguggcucacgcuuguaaucccaggacuuugggaagcugaggcggccggaucaccugaggucaggaguucagaccagucugaccaacauggcgaaaccccgccucuacuaaaaauacaaaaauuagcugagugugguggugcgugccuguaaucccagcuaccagggaggcugaggcaggauaaucucuugaaccugggagguggagguuucagugagcugagauuacgcuacugcacuccagccugggcgacagagcgagauuuugucucaaaaaaaaaaaaaaaaagcaacaacaacaaaaaaaaaacaagccaggcacgguggcucacgccuguaguccgcgcacuuugggaggcugaggcgggcagaucacgagaucaggaguuugagaccagccuaaacaacauggugaaacuccaucucuacuaaaaauacaaaaauaagccgggcgcgguggcacgugccuauaaucccagcuacucaggaggccgaggcuggagaaucgcuugaacccgggagguggagguuguagugagccaagacugcaccacugcacuccagucugggcaacagagugagacuucgucucaaaaacaacaacaacaacaacaacaacaaaacucuacuacaaagcccucucugaaagauggaaaaaagagcaacaacaaaaaacucgaaaguuuucauucauuagcuccaccuaacuguucacuccauuagccaucacccuuccauguuuauauagucaguuuaugccacacaaauaaauuuauuuuguaaagaucugcacuuguuucuuuuuuuuuuuuuuuuugagauggaguuuugcucuuguugcccgggcuggagugcaauggcgcgaucucagcucagugcaaucuccaccacccagguucaagugauucuccugccucagccuccugaguaacugggauuacaggcacgcacuaccaaacccggcuaauuuuguauuuuuaguagagacgagguuucaccaugcuggccaggcuggauuugaacuccugaccucagguguuccaccugccucagccucccaaaguguugggauuauaggcgugagccacggugcucagccacauuugugucuuuuuccuuuuuuuuuuuuuugagacagagucugcucugucagcagccuggcgugcgguggcaugaucuuggcucacugcaaccucugccucucagguucaagcaauucugccucagccucccaaguagcugggacuacaggugcacgccaccaugcccagcuaauuuuuguauuuuuaguagauacgggguuucacuauguuggccaggauggucucaaucucuugaccucaugauccgccugccucggccucccaaaaugcuggaauuacaggcgugagccaccgcgcccggcccacacuuguuucuuauauaagccaucucucccugacuuguagcuuccucaaagagaggggcuaugucuucacuucaucacuccuuccuccccucacacagccaaguacagugcagugcucuguaccuagccuauguucagagaauguuuuuuuuacucuggugugaugggacagagaucugaaacucugagaacaaauggaguuauacugagaagauuugagucuccauguuuagaguaggccacauaguagaguuauuggagugugagccugaagcuaaacuagauggcagacugaggagcuaauccuucucugcuccuccccuugccuggaccccuccccuggccugcaggccugaucuguccucuggaauuuuccuucgcagaagccucaguguaaagucugccgaucaugcccuguggugcagucgagccagcaccuguuucuggaccugccuaagguaagugagcuuuucucucaaccuaguuuucaggaggccucuucuguccccucugccuuagccacaaauacugagagcagauuacucuuaaaaguuuuaaauuuccauuaagaauuguacauacuauugucaagagaugaaauagauuaaagggcacaaagugaaagccccaggcccacuugcgagagguauuuacuacuuuuuccuuugugucuauucagaaaugucauaugcauauaaaaguauuuuuaugucucucuuuuuuuuuaagggauagcuucucacucugucaccuaagcuggaaugcaguggcaugaucauagcucacugcagccuugauauccuaggaccaagcaauccucucaccucagccucccaaguaccaugccugacugauuuuuuuuuuuuuuuuuuuuuuuuugagacagaguuucgcucuugucgcccaggcuggugugcaauggcgcacucuuggcucacugcaaccuucgccuccuggguucaagugauucuccugcgucagccuccagaauagcugggauuacaggcgucugccaccaugcccggcuaauuuuuguauuuuuaguagagacaggguuuugccauguugaccaggcuggucucgaacuccugaccucagaugaucugccuggcucagccucccaaagugcugggauuacaggugugagccaccgcacugggccaccugacuaauuuuuaaaaugcuuuuguagagauggguucucacuguguuacccaggcuggugucaaacucuugggcucaagcaguucuccugccucugccugcaaacguguugggauuagaggcaugagcaacuguguccagcauugaccuccugauuuguuuuuuuuuuuuuugagauggagcuucucucuuguugcccacacuggagugcaauggcacggucucggcucacugcaaccucugccucccagguucaagcgauuccucugcaucagccucccaaguagcugggguuacaggugccugccaccaugccuggcuaauuuuuguauuuuuaguagagaugggguuucaccauguuggccaggcuggucucgaacuccugaccucagguaauccauccaccucggccucccagugugcagggauuacaggugugagccaccaucccagccugaccuccuuuuuaaaauacaguguuccuccuucuguacccugggcuuggagaaaaaaaaaaauaggcugggcgcaguggcuuaucaugccuguaauccuagcacuuuaggaggcugaggugggaggaucucuugaugccaggaguuggagaccagccuggaaaacauagugagacacugucuuuacaacauaauugaaaaauuagccggguaugguggugcgauccuguagucucagcuaugcaagaggcugaggugggaggaucauuugagcccaggaguuugagguuacagugagcugugauugugccacuauacuccagccugggcaacagagugagacucuaucucuaaagcauaaaaaaauuaaaggccacaugcagugacucacuccuguaauuccauuacuuugggaggcugaggugggaggauugcuugagccuagggguuugagaccagccugagcaacauggcaagacccugacucuacaaacagugaaacaauuaaccuggccugggugcaguggcucacgcguuaauccuaacauuuugcaagggcuaccuaggugggccgaugacuugagccuaggacuuugagaccagccugggcaacauggugagaccccaucucuacaaaaaauacagaaguuaacugggugaguugugagcagcuguagucccagcuacucaggaggcugaggugggaagaucaccugaaccugggaagguuugaggcugcagugagccaugauugaaccauugcacugcagcuugggugacagacugagacucuguaucaaaaagaaaaaaagaaaaaauuagccaaaugugguggugcacaucucuggccccagcuacuugggaggcuaagguaggaggguugcuuugagcccaggagcuggaagcuauagugagccaugauuguaccacugcauuccagucugggcagcaaagugagacccugucucaaaaauaaauaaauacauaaaauauaauaguccucagguuggguuuguuggguguuuccucaugauuucaggcuaugcauucuugguuggaauacuacauaaaugacauuguguccuuuucagagccacgugauggccauccccuucacugggaaucuuaauuuuguuuggucagguguuauucaauuuguucacugugugauuaauauuuuccccauugcaacuuaugagcagucugggaauacacuuuauuuuuuucuuuucuugagauggagucccgcucuguugcccagacuguagugcaguguugugauuucagcucacugcaaccuccaccucccagguucaagugauucuccugucucagccuucgaguagcugggauuacaggcacauaccaccaugccuggcuaauuuuugucuuuuuuuuuuuuuuuuuuuaauugaccauucuuggguguuucucgcagagggggauuuggcagggucauaggacaauaguggagggaaggucagcagauaaacaagugaacaaaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggguaagguuauagaucaacagcaucccaaggcagaagaauuuuucuuaguacagaacaaaaugaaaagucucccaugucuaccucuuucuacacagacacggcaaccauccgauuucucaaucuuuuccccaccuuuccccccuuucuauuccacaaaaccgccauugucaucauggcccguucucaaugagcuguuggguacaccucccagacggggugguggccaggcagaggggcuccucacuucccaguagggguggccgggcagaggcgccccucaccucccggacggggcggcuggccgggcggggggcugaccccccccccaccucccuccugcauggggcggcuggccgggcagaggggcuccucacuucccaguaggggcggccgggcagaggcgccccucaccucccggacggggcggcuggccgggcgggggucuggccccccaccucccucccggacggggcggcuggccgggcgggggucuggccccccaccucccucccggacgggacggcuggccgggcgggggucuggccccccaccucccucccggacggggcggcuggccgggcgggggcugaccccccaccucccucccggacggggcggcuggccgggcggaggcugacccccaccucccucccggacgggguggcugccgggcggagacgcuccucacuucccagacgggguagcugccgggcggaggggcuccucacuucucagacggggcggcugccgggcggaggggcuccucacuucucagauggggcggcugccgggcggagggucuccucacuucucagacgcggcggccgggcagaggcgcuccuuacaucccagaaagggcggcggggcagaggcgcuccccacaucucagacgaugggcagccgggcagagacacuccucacuuccuagaugggauggcagcugggaagaggcgcuccucacuuccuagaugggauggcggccgggcagagacacuccucacuuuccagacugggcagccaggcagaggggcuccucacaucccagacgauggguggccaggcagagaugcuccucacuucccagacuggguggcggcacggcagaggcugcaaucucggcacuuugggaggccaaggcaggcagcugggagguggagguuguagcgagccgagaucacaccacugcacuccagccugggcaccauugagcacugagugaacgagacuccgucugcaaucccggcaccucgggaggccgaggcuggcggaucacuggcgguuaggagcuggagaccagcccggccaacacagcgaaaccccgucucuaccaaaaaaauacgaaaaccagucaggcguggcggcacgcgcccgcaaucgcaggcacucggcaggcugaggcaggagaaucaggcagggagguugcagugagcagagauggcggcaguacaguccagcuucggcucggcaucagagggagaccguggaaagagagggagagggagaccguggggagagguagagguagagguagagguagaggguagaggguagagggagagcauuuuuguauuucuaauagagaugggguuucacuauguuggccaggcuggucucaaacuucugaccucaaaugauucacccgccuuagccucccaaagugcugggauuacagguguaagccacugcgcccagccuugagggaauacacuuuaaagaccaugcaauacuuugcucuucgugaacaaaauauucccuauaaauguagcauucauugaucauucuuaccugaaucaaucuuuauuauggugauuuuccaacucuaccacuacucucuauauuuauccuucucccuccauuuauuuuuuaauuuaguuaacuauuuauuaucaguauagacucauggauuccuauuuuuuucaauuucuuauaauccuuuccuguccuaaauuuauuuucauguucaaauuguuacuuauuucaucaguaggaacguauucaagguggcuugucugcuuuugagaucucccaucauguuuuaaacacuuccuuaauuuguggcauaaaaaaauacucuagguucaucugguucagccuugaaaucaaccaugucaccaaccuugaguuuaauuuaguagggaacaguauuagauaccaaaaucuaggugguagaugugcucauugcuacugggugucuuugcuacuaggaccuuuuaucaaagagaguugguauuuguuuuuuguuguuuguuuguuuguuuugagacagggucuugcugucaccuaggcuggagugcaguggcacuaucuuggcucacugcaacugccaucuccaggauucaagcgauucuccugccucagccuccugaguagcugggauuacaggcaccugccaccacacccagcuaauuuuuuuuguauuuuuaguagagacaggguuucaccauguuggccaggcuggucuccaacuccugaucucaggugaucugccugccuuggccucccgaagugcugggauuacaggcgugagccaucgugccuggccaguugguauuuauuuuaaguucacacugacaccugcaauuucaguccauccccacagaguucuucgucacuuucucuuauuuauuucaugucucuaucuaccuucuuccacuguagguguccugguucucaauaggcaucagcacauuuacuuauuagcucaauccuacaauauaccuaaaacaauuucagaauugcuuugcugguacgucuacaaaaaaaauaaccuauuaaaaagaguuuaggauuuguuggcaauccugauuccuccccuagacuaaggguauauagccaaguguguucaaacaaaauuuuuuucuagagacagggucucacucugucacccaggcuggagugcaguggcacaaucacagcucaccgcacucucaaacucucgggcucaaguuauccuuuugcuucagccuucugcguaguugggacuacaggcguguacuaucaugccuggcugauuaaaaaaaaauugacuaggcauggugacucacgccuguaaucccagcaguuugggaggccaaggcaggcggaucaugaggucaauagaccgagaccauccuggccaacguggugaaaccccaucucuacuaaaaauacaaaaauuagccaggcgugguggcaccgaccuguagucccagcuacucaggaggcugaggcaggagaaucgcuugaaccuggagguggggagguugcagugagcugagaucgugccacugcacuccagcccgggcagcugagcaagacuccagcucaaaaaaauuuuuuuuugguugggcaugcugguuuacaccuguaaucccaaugcuuugggaggccaaggcuggaggauugcuugagccuuggaguuuaagaccagccugggcaacagagugacacccuaccuuaaaaaaaaaaaagaaaauuuuuuuuuucuuuuuugcacuuccucagcuggccauggugguucaugccuguaauuccagcacuuugggaggcugaggcaggaggaucgcuggaagccaggaguuugagaguagccugggcaacaaagcaagacccugucuguauuuaaaaaaagaaaaaauugguugggcacgguggcuuaugccuguaauuccaacuuccaacacuuugggaggcugaggcgggagaauugcuugaccccaggaguuugagaccagggugggcaacuuggugaaacccaucucuacuaaaaauacaaaaauuaaccaggugugguggcacgugccuguagugccagcuacucaggaggcugagguggaaggaucacuuaagccugggagguugaggcugcagugagccaugaugugccacuguacuccagccugggugacagugagacccugauauggacaagauuagcacauccucugcacaagaaugacaugcaaacuugugaaguguuccauauuuuuaaaaauuaaaaaaaaaaaaauuuuuuuuagggacaggauuuugcuguguugcccaggauggucaugaacuccugcccucaagugauccuccugcgucagccuucggaguagcugggauuacaggcgcaagccacugccccuggcuguguguuaaaaaucuaguuaaggcugggcaggguggcucacaacuguagucucagcgcuuuuggaggcugaggugggcagauugcuugagcucaggaguucaagaccagccugggcaauguggcaaaacccuguuucuacaaaaauuacagucuggcaugguggugugcaccuguggucccagcuacuggggagguugagguaggaggauugcuugagcccaggagguuuaggcugcagugagcugugauuaugauugcaccacugcacucuagucugggcaacagagcaagacucugucuccaaaaaaaaaguuauauauugccaaauugugcuccaaaaagguuauauguguuuauccuuaugcuaaccauauaugagacuuuccuaaaucagcccucuuucuccguuaucucagcuggagaagcgacuggaggagugguuggggaggacauugccuggcagugacuggacacccaaugcccaguuuaucacccguucuuggcuucgggauggccucaagccacgcugcauaacccgagaccucaaauggggaaccccuguacccuuagaagguuuugaagacaagguaaaaacccuuuuuuauucauaucauucagccuuaguguugaaacccugggcuagcagaguagacugcugauuaugucuuguuucaguuugagacuuuggauuggucccuaacauguuuaccuccuucugaccuccagguauucuaugucugguuugaugccacuauuggcuaucuguccaucacagccaacuacacagaccagugggagagaugguggaagaacccagagcaagugagcaguucuugguuaggcugugcauggggaggguaggcgguaggguguggguguuaggguugggugucuggucuuccuugggccuuugaaggaggucucaggaaaucucuccuaaccacauuccccuagguggaccuguaucaguucauggccaaagacaauguuccuuuccauagcuuagucuuuccuugcucagcccuaggagcugaggauaacuauaccuuggucagccaccucauugcuacagguaaguacccuggaagacuacugaugggguguucauaggaaaugaggggugaggcaguacuuggaaaaagaucuuggagagcugcuaucuugaguuaggaguugagcugaaauaggaaauaauuaaaaugagaacucaaccuagagaaacgaacaagaaccugaagaaagcaaaagucuaaagcuaaaacucuuuaguagauauaagcaaagagaaaaaagggccagaauggauaggaagggacucccaaaaucugagcauaccagccccuuaaggagaaauguugcuagacacccauaguugagguuagaaagaggaaagaaggaagaguuagugggcuagagaggggaaggaugugaugugagcagaugguucucacucauucuccucuguccagaguaccugaacuaugaggaugggaaauucucuaagagccgcggugugggaguguuuggggacauggcccaggacacggggaucccugcugacaucuggcgcuucuaucugcuguacauucggccugagggccaggacagugcuuucuccuggacggaccugcugcugaagaauaauucugagcugcuuaacaaccugggcaacuucaucaacagguaggacuugguaaggggucagaguuagcagugagcugggguggggcucauuuucccucaggagaugggaauguggagagaacuagaaaaugggcaggaggcugugaggacacuguggaaaguugauuucuauuaauugggaucuguuccuagcacauacuaggcuaugugugcuugauggaacaguuagcuguagagaugugauuuagcaaaguugguuauaaaguggguuuuuguaaauuguuuccuuauuacuguucuuuguagaauugaagauguauucucucccagcaaaauaguucaccugcagaucauugaaaaguuuggcugaagaaagggguuauuuugguguggggguaggaggcuucugugggcugggcaugguggcuuacauuuguaaucccagcacuuugggaggcugaggcaggaggaucacuugaggccgggaguucaagacuugccugaccaacauaaugaaucucccaucucuacaaaaagaaucagccaggcgugguggcgcacaccuguagucccagccacucaggaugcugaggcgggauggucucuugaacuugggagauugaggcugcaguggagcaguacucguaccccuacacuccagccuuggcaaaagagggagauccugucucaaaaaaaaaaaaaaaaaaaggcuucugcuauacucuucagaguucagaguuuuuguuaccuuaggcucacauucuaucauuggugccuaucucagcucuucugcaaucuaaagcaguauucuccagaauuuaggauucuuuagucacacucucugagcccuggacccuuauaggucaguccugcuacucacuuucagcuuugguaauuaaccacauuuaauaaauaguccuuaccuacaggaguucgagaccagccuggccaaccuggugaaaccccgucuccacuaaaaauacaaaaaguagccgggcgugguggcgcacaucuguaaucccagcuacucaagagguugaggcaggagaaucacuugaacccgggaggcaaagguugcagugagccaagaucaugccacugugcuccagccugggcaacagagugagaauccucaaaaaaaaaaaaaauuaaaaaaaaaaaaaaguacuugccuagaguguuuguuugauagcaguuaacacauacucagcuuggucauuuugaguaaugacuuuuuuuuuuuuuuuuugagauggaguuucucucuuguugcccaggcuggagugcaguggcgcgaucuuggcucacugcaaccuccgccucccggguucaagcaauucuccugccucagccuccagaguagcugggauuacaggugcacaccaccacgcccggcuaauuuuuugcauuuuuaguagagacgagguuucaccauggccaggccaggcuggucuugaacuucugaccucaggugaucugcccaccucggccucccagagugcugggauuuuaggcgugagccacugcgcccggccgaguaaugacuucuuaaaaauaagagguacaguuguuuaacuuaaucagguuucuuaugugcagagucagauucuuaggggagagaaagaguaaauaauuaggccuugucuacuagcuugagggagccaggaguuaccuguuccaggcaggaauccugagagaauguacagcuguggaaauugggugaaauucuaacaaggagacgggauaauaacuuccccucuuuuuuccacuucugcuuuccuacucccaaccaagagcugggauguuugugucuaaguucuuugggggcuaugugccugagauggugcucaccccugaugaucagcgccugcuggcccaugucacccuggagcuccagcacuaucaccagcuacuugagaagguucgguaaguaacugacaccucugucuuuucugcuggcauguugagagccuccuuguauuggucucuguaggacauuacaccuuggccugcuuccucccuucccaggauccgggaugccuugcgcaguauccucaccauaucucgacauggcaaccaauauauucaggugaaugagcccuggaagcggauuaaaggcagugaggcugacagguagguaagcggggaggguuggcuaaaggcauaaaguggcuuguaagcuguauccuccuggaggucuugacuaaugucuccucuuccucaggcaacgggcaggaacagugacuggcuuggcagugaauauagcugccuugcucucugucaugcuucagccuuacaugcccacgguuagugccacaauccaggcccagcugcagcucccaccuccagccugcaguauccugcugacaaacuuccuguguaccuuaccagcaggacaccagauuggcacaguagguggaagagccagccucucuuaaaauugauacucuugccaugcagcuuuuggagugggugagagaagaccuaacaucucuccaguguuacuuuggucaugggacuccuaaguuucugauauaaaguccuugguagucguucacaaguccggaauuaucuguacaucuucauuguucuucaugccagaaaccagaaccuggcacacaaaacuaacugguaaacagauauuugaagaaacacugugaucaccuagucuccauaaugcuagcagauagugggcagggaaaauacaggaaagccauuuccucuuugacacaaaaugaaaaaguaaguacauugcuaaacuucuggaucagccuagcauccuuagagagcuuaaagaaucuuugacccuacaaauuauuugggguuucacagggaaagcuacagcuaauuuccuaaaaucagcagauauuagcucaguguuaagcucguucuuucuaaaacacaucagagauugggguuggagaggucaucuguauagucuaugguagagucuguauccaaucaguagaugauucuggaacucuuuuuuuacaggucagucccuuguuccaaaaauuggaaaaugaccagauugaaaguuuaaggcagcgcuuuggagggggccaggugagaaagcuaaaggcugugcccucgcuccacaacagccacagcaucacuucccuaauuucccuaaguaguccucacccaucacucuuuccaucuuuuggcccugccgcuuccucacuuacaguuuuucuuuccugucuuaacuagaagagaccuucgacuuaaagguaaccacuuucccucugagaugcuguauaaaacuggagguuaggggauauuuaugguugcuggugauaacuuuguuguucuccaggcaaaaacguccccgaagccagcaguuguagagacuguuacaacagccaagccacagcagauacaagcgcugauggaugaagugacaaaacaaguaugaagcuuaagcccugugggagacuggacaagcugaauccuaaauagaucuuuuucuugccucacuguuaccuccccaccccccuuuaucuuagggaaacauuguccgagaacugaaagcacaaaaggcagacaagaacgagguugcugcggagguggcgaaacucuuggaucuaaagaaacaguuggcuguagcugaggggaaacccccugaagccccuaaaggcaagaagaaaaaguaaaagaccuuggcucauagaaagucacuuuaauagauagggacaguaauaaauaaauguacaaucucuauauacaa

SEQ ID NO: 192197 - RNA, 24954 nt, Homo sapiens
uucaaagauuuaggaggacaacacauuuaguuuuauuucaaucaaaucacacaacacuuucuuuuccaacugcugcaaagugcaucuacaauaugcuauuacagauccacuuuuaaaagguuuccugugacauuacagcaagccucuuuuuucaaacagaggaauaaucccaaauucuuccucaaauaaacuccauuccaguaaaugguaaauacauaaaaauuacaguaagccagacacuuaaaaggacagccaagaagucuuccaacaguuuauuagaaagaauguagacauuuaaaaaaauccccacugucaugaacauaaauugagguuuucagcccggguauaagcugaaucaaaaaaaggaaauaaaaaauccaauaguguauuaaacauuuuucacucauuugccauacugacagugcaaauacaaaucuggacuaaauguacagacucucaagcaacaauguacagcuuucuucguccuccaugcuaagagauguaaaagcuuaagggucaaacaauaccaauuguauaggcuucaaaaaccaucuaaguuagggcauucucuaguuuuagcuaagauacaccuggaacacugacaagucaucacuuacauagaauaaugugaaguaaauuuuuugaaaaauaaauuuuaguggaacaauccugaaggauaacaccagaagaauagcagguuaccaguaaggugucagccaauuuguuccagucacuuuugaauccauguucuauaaucuaaaauuuauucucuuucccuaagcugagagcuuccuaucaugucaguaucuauguuaugaagaaaaggagacuuaggugagauguuuuuauuuaucgcaacugcugcauuaauugccuaggaccucaacagcuucaugaaagucugggaaauguucaugcauaagguuauugccuuagcugacuuaaaauugccccauacaaugguacauaucaacccuuagugaagccuuuuaaaaaacaaacagguugaaaaauggguuaaaguaggcaaauacagcauaucugccuuuagagcuaucaacucaggaauucucucaauuaugaaaucuugcagagaaguuauuuuucuuucucaaaauccaggugaugacaauauuccuuacuccagaucuggcauuucugaaagaauuuuuaaaaauauuaguauauaguacaagugaauaaucuaccaauuuuacugucuuaaaggaaaagcaaccaaaaaucgaaauacauaguugcccaaugaauuaauagguugucuugcuaucaaguuauucacauuucugcuuugguuauuuauucaaggucauaaagaaaaaauuacuuuacuuccaaagaaguuaacaucucuauuuugaguuuguuuuuugaugcaaaguaucacuguauaaacauacuuuuuauauacacuuacuuucaucaucacugucuugugaauccugaaagagggaaaauaaaguuaccgagcugaucaaauauucguuugcuaacugaacaguuuaccuaaaaaaguucaagugcuauauuuuugacuaaaguagcacagguagguagucauaucaagccuagaaauuuagucauuggacuugacuagguuuaccuaaggugaauggauguacagcagaggauuuaucuaccuauaaaaaaugaugugugccuuuuggugacaauuuagcccacccguugaauccauuccuaaauuaaccuaucucggcauucaaagagaaaacauggaucaauaugaagaaaaauggacugauagaagacagugaacucuaauccuagcuguugagugaauauuaaguguuuuucuaaauagcauuaaauaacuuucugggagauguuaacaggaugcugggguuggaaagauguugagaaaaguaguuuaguguaucuuccucuuacagauuuccaauguccaucuuuuuuuuuuuuuuuuuuuuggguggggggagauggagucuugcucugucacccaggcuacagugcaguggcgagauccggcucacugcaaccucugccucccggguucaagcgauucuccugccucagccucccaaguagcugggauuacaggcacccgccaccaugcccggcuaauuuuuguauuuuuaguagagaugggguuucgccaucuuggccaggcuggccugaaacucuugaccgcaugauccacccaucuccgccucccaauguccaucuguuuuaucggucucugaccaauccugacauaaaaccuauuuaacuuacuuucuuagucaaaaucauaccuauaaacugacucucuucuuucuuuuugagauggagccucgcucugcugcccacacuggagugcaauggugugaucuuggcucacugcaaccuccgccucccagguucaagcgauucucccaccucagcucaccaguagcugggauuacaggcaccugccaucaugucuggcuaaguuuuuaagacaggguuucaccauguuggccaggcuggucucgaacuccugaccucacguacucugcccaccuggccugcugggauaacagacaugagccaccucgcccggccuaaacugacuguuauaauugaguacgguauuaauauauaaugucucuauacaaugauucuuuggaaaucuaauccauuuaggaauggucuacgguacaaccaguucccuaauagauacccccauucgucaaaaaugggcacauuuuaaaaauugcuuuucccuuuucuuuuuuuuuagaaaauaagaaguaauugugaaucuauauaaaaccauuuguaaauauguuguuucuuacuauuuaauaguaugaaaguaaacagaaaaaagaauuuuuagacuuacaucaucugcuccaucuacuucugguaaaucuacauccucaucaccacccauguuguucaucaucuauuugaaguguaaaaauuaguuuuaaaaaugauguuaaguuaggcccuaauuauuaaugcuguaugcuucagaauaaaccuuaagucugccacagauaucaaaaaaugcaaaaugcaaauauaagcaucuuucccuucuggaaaaggaagauuauagguaauuauacaaaauccuaaaaacccauauggaaauuaaaacuaaauuuucccuaaagaaaagcaaagcuauucaugcaacagguuugacaaacauuaaaaauucuacuugaguagugguuaccucuggugguuaaggaaaagaaugggauucauuuguaguugcacagcuaucuaucuuaaguuagguggaacauguauuaagguauucuuuuuuuuuugagacagagucuagcuuugucguccaagcuggaguaugguggcgugaucucagcucacugcaaccuccgccucuggguucacgcaauucucaugccucggccuccaggguagcugggauuacaggcgcguaccaccacacccaacuaauuuuuuguauuuugguacacacgggguuucaccauguugcccaggcuggucucgaauuccugggcuguagugauccacccaccuuggccucccaaagugcugggauuacaggcgugaaccaccaugccaagccuuuuuuauuuugagauggagucuugcucuguugcccagguuggagugcagcagcacaaucucggcucacugcaacuuccgcuucccggguucaagggagucuccugccucagcuuccugaguagcugggauuacaggcagaugccaccacgcccaguuaguuuuuguaucuuugguagagacaggguuuuaccauauuggccaggcuggucuugaacuccuggccucaagugauccccuugccucggccucccaaagugcugggauuacaggagcaagccacugugccaggccugguauucucaucaugguuuuagauauugugaagaaccaagaaaugauuuaaacuuaaacuauuaucagaugaugagaaacuuauuuucucaaguuuaaaccauuuuuguaauguuuaaauuuuagaaaaauaaaaucacauaugcauggaaaaaaaaucaaacuucaaaaauacaugauuacccagauuuuagaaugggaaaggaccuuaaaaagauagucaaacauacaauggaauguguucagccuaaaaguaucauucagccuuaaagaaaaaaaucugccuuaugugacaaaacacaaugaagaaucugaagcacgucaugcuaugugaaauaagccagucacaggacaaauacugcaugauuccacuuauaugagauaccuaagauuauguaagauaccuaagauagucagacacacaaaaauagagaguagaaugguagaugccaggagcuggggggaaggaaaaugcagaguugcuacuguuaaauagguaucaaauuccaauuacacaaaaugcauaguuccagagaccuacuacuguacagcauuaugccuauaguuaacaauacuguaucaugcacuuaaaagauagcugggcguggccaggucuggugacucaugccuguaaucccagaacuuugggaggccaaggcggguggaucaccugaggucaggaguucgaggcuagccugcccaacauggugaaacccugucuccacuaaaaauacaaaaauuagccgggcaugguggugggcacccguaaucccagcuacuugggaggcugaggcaggagaauugcuugaacccaggagguggaggcuggagugagccaagaucgugccauugcacuacauccugggcaacaagagcaaaacucugccucaaaaaaauaaauaaauagucuguuaaaagaguagauuucaugugaagugcucuuaccucaauuaauuaaacacacacaaaaaaggauucaguauaaaaauuuugggcaaucuaucuugaaugaaaugaguaacugggaguuucccuaccuccaaaagcacuacucaauacuuuaaguuucuuugggcaggaaaaaugcuaaauguaccaagcauaacgcuacgugcuuaagauaaacagcaagagaaaacuguacauauucaagagauauguaagagauaacaacaaaaacuggacaacaaagauagcaaaauaaaacaaaaaacaaaaaacaaaaacaguguuauaaggcugggggugguggcucaggccuguagucccagcacuuugggaagcugaggcaggaggaucacuugagcucaggaguucaagaccugccuaagcaacacaauggcuugcacagcuagguaaaugguggcaccgauuucuacagguaaggaaaguacaauuaaaaaauaauaugaauagaacauccucccuuccuguugaaaucaccaugccagagucacguguggagaacuguuaaauaagcaguugcauaaagcuggaaacuuagcuccuuuuauuuaacucuuaaggucucaaaauacaaaaucuaguuaaugaaaaauuucaaauagcaacaagaaauggauuucaucaguaugcauucgacuuauacacuaauguucuuucuguacuuaguuuuauucuacuacauuugauaaagucuauucugccuauauagagaugaaucauuuauucuugggccauggcaacguuauuugggugacaucuuagaaaacagacuuucuuaaacuuuuuuccuuguauaucucaugguaaacauuucaccaugaauuuuuuuuuuuuuuuuuuuggagacagagucuugcucugucgcccaggcuggagugcaguggugugaucucggcucacugcaaccucuaccuccuggguucaagcaauucuccugccuuagccuccggaguagcugggauuacaggcgugcacuaccacgccuagcuauuuuuuuguaguuuuauuuaauuauuuauuaauuuagagacggcguuuugcucuuguugcccagacuggagugcaauagcgaucucggcucaccgcaaccuccaccucccggguucaagugauuuuccugccucggccucccgaguagcuggaaucacaggcaugcaccacuacgcccagcuaauuuuguucacgccuucuggguucacgcgauucuccugccucagccuucugaguagcugagauuacaggcgcccgccacugcacccggcuaauuuuuguauuuuaguagagacgggguuucaccauguuggucaggcuggucuugaacuccugaccucaggugauccgcccaucucagccucccaaagugcugggauuacaggcgugagccaccgcgcccagccuaugauucuuguguuuaacaguuuaucguucugcauuuauuuauuuauuugaccgagucccgcucuuucgccaggcuggaguccaguggcacgaucucggcucacugcauccucugccuccagcguucaagcaauucccguuucagccucaggaguaggugggaccacaggugcgcgccaccaugcccagcuaauuuuuuuuguauuuuaguagagaugagguuucaccaaguuggcccguaugaucuagaucuccugaccucgugaucugccagccuuggccucccaaagugcugggauuacaggugugagcaccgugcccggccaaaaguuuauagucuuauuuuaugacuucaaaauccaagucaacuacugcaaucaugcuuuaaaaaaaaaaaaaaaaaaagucccaaugaugaaauuagcaaacuagcuguguuaguuugucuuaaugcauuaacuuuuguaacuuuuguagcuaacacuaauuccuuuuaaaaucauuaaaaugguucaacuucaggauuaaaauugccauuguuaacaucuauuuacuaugacugcaaaauggucuuaaaaauaaaauaacaugcaucaugaauaccauuaggugcccaaaaccauauuaaauugacuacauagacagguaccgugugcuucgaauggggagagguccauuuaaaggaacuuaccucagagaaacgaucaaaauuagacaugucuucaucugaaucaucuucccagucuuuccaauuauugaagucgacacuaagccaauuaagcuauaaaucaauacaaauaucacccuaagauuaggcuaauuugcauuuggcaugaaccuuaagacuacguuuucuuuucuucuaaagagaccaggucuugcuauguugcccaggcuggagugcagcaagcauucacaggugcaaucccacuauugaucaauaugugaguuuugaccagcuccguuucugaccaagggucuuguuuacccucuucaggcaaccuggugguccccgcuuccugggacaacaccguacugauguuaacuuagcgugguuaccugacauauggcaaugcaacccagacuugggcgcaaguauuucucccacuucacccuccagaguagcuuuuaacuacaacaggcacaugcuacuggugccuggcaaaacaauauuuuuugaacugugacuuuguauuuuuaggagggcauguaauuagcacacaaagaauagacuaagcuaaaugagguggcucacaccuguaaccccaacacuuuggguggccaagguggaaagacuaguuguguaauccuucaggaguucgagacagccugagcaauaguggauccuguaucuggggaaaaaacaaaaaaacaaauuuccugggcgugguggcacauuccuacaauccuagcuauuuggagaggugaggugggugggaggaucgcuuaagcccagguggaggcuacagugagccauguucacaccagugcacucuggcaugaguggcaugagacuaccuaaaaaaaaagacuaggcuggugucguggcucaugccuguagucccagcacuuugggaggcugagguggggagacugcuugagcccagaaguucaagaccaagcugggcaacacugugauaccccuuucuacaaaaaauacaaaaauuagccagguguuguggcaugccccuacagucccagcuacuugggggacugaggagggaggaucacuuggagccugggaaacugaggcugcagugagccaagaucgugccacugcacuccagccugggugacaaagagagacccuguuuugggggaaaaaaaacacugaaaauuguuaaacauaccuuuugaaaacaaauuuacuaguaagaacuauuuucaguugauuauuuuuucaccaagcuuuguccccucccaugugauagcugaguaauuuaugcaaagucugucucuuaaguacaaaagauucuacaccaguuaauaacugauauucugaucacacuucguauuaaaacugaguagacaaaaaacaugaacaugaggcuuuauacuuagcugugaaacaaaaacacagccauauuccuuacaucaaauaaguacaucuuuuauuaccuaaaauaaaaauaucaaacuuuucaaaaaaggaaaaugaaaccuaccuuugcccuuucuuuuguuaaccuuggccaugacuggccagauucuccuuuucguaaacaacauaaaauugaucuguccguucuuuuaugcuuggaauccuaaaaacaaaaggaccaucauaccauuuaucuuuccagcaucacuacaugauagaaaauagcuugucauuucucaccuuucucauuucuuuaccuaaauuuucucuggacucugaaacaugcccuugacuacuaaaaacuucaaacuauccaacugccccaacccccuuuaaguuucauuuaaaaaaaaauuuuuuuuucccuucuauuuccuacugaaauaaucugcacaacaauaaaguuuaaaguuuaaccugguaccauuuuuuucuuuccugcacacgauaaacagaauaaaaccuuaaaaacuuuaacuaaaaaugauauaaccacagaaugguuuaaagauucuauucuuagauaagggaagccuuggccgggcgcaguggcucaugccuguaaucccagcacuuugggaggccgaggcagguggaacaccugaggucaggaguuugagaccagccugaccaacauggucuuuacuaaaaacacaaaaauuagccaggcaugguggcaugugccuguaaucccagcugcuccagaggcugaggcaggagaaucccuggaaccuacgaggcagagguugcagugagccgggaucgcuccauuguacugcagcagucucaaagaacaaaaccaaacaaacaaaaaaacaaaacaaauaaaaaagaugagacgagccucaaggauacuacucuaagcccaaacagugauagcaaaaacaaaaaguaugcagaaaccaauuuuggaggaaauauucuacaaaauguaaauauacauaguuugccucacuguuaagaaaaacagaacuaaugcucauugcuaaaaagaauacuugguaugucuguuuccucacaacuaaaauuuggauuaaagcauaaagacuacuuacauuuggaucaauacagugaaaaagaucaauuucauuuaaaugcuuaaaauuaucacuuccuccgagacaacuguauaaaauaauaaagaaagaauuaagccucuucaaagagacaaagauuaauaauaacuucaaugaaaagacaagccagucaaaguuauucaguugugugaaugacuauuuuacaucauuggauaaaaagcuuaacuuaccugaauguaaguuuggauuuuucaaaauuuacauuaacauccuuacugucuucaacacaaaauucaaugaagacauagucccuucgaucguaccacuuugcagaagcaggcugccuacaaaaggauaaaguagggaaagucaagcuggaauucauuaacuaaacauucacauacuaaccuucgacaccauuauagcauuauuucagggcaguuuguuacaauuuuaaacaaaaacuacauuuuuacccuaacagcuacauuccaaguuaaaaccuaugggucuaacaagauuuaguuucagaaugauuccaauuucauaauaggaaagauuuaaaaaccaaacaaugcuuaguagaguuagccguuuaucuaguccuaucaaaaauuauguuacuuggcugggugcaguggcucacaccuguaaucccagcacuuugggaggccaaggcaggugggucacuugaggccaggagagcuagagaccagccuggccagcacagcgaaaccccgacucuacuacaaauacaaauacggaaaaaaaaaaaaaaaaaaaaaaaaaaagcaggguacgguggcucacgccuguaaucccagcacuuugggaggcugagguggguggaucaccuaagcucaggaguucgagaccagccugaccaacauggugaaaccccaucucuacuaaaauacaaaaauuagccaggcacaguggcaggcgccuguaaucucagcuacuugggaggcugaggcaggagcaucgcuugaaccugggaggcggagguugcaaugagccgagauugcgccauugcacuccagccuggcaacagagcgagacugucucaaaaaaaaaaaaaaaaaaaaaaaauuagcugggcauggugaugcaggccuguagucccagauacuugagggaugggacugaggcacaagaaucacuugaacccgggagguggaggcugcggugagcugagaucaugccacugcaauccagccugggcaacagagacucugucucaaaacaaacaacaacaacaaaaaacacugguacaucagagcuucacuuuuuacauuaaguucacugaaaccaggagaaucaaucuccuuuccucaaauucagcaaucuagaauuuuaucaguuuccucaaaauuaauacauugaaguccuaacccccaguacaucuuaagaaugggauuguauuuggagaaagugucuuuaaaugacaaguaaauaugaggucuuaggauagacccuaauccaaugacuguuguccuccuauauaaagagauuagcacagagggaagaaagaagauagcuaucugcaaaccaaggaaaggccucagaagaaacuaauccugcugacaccuucgccuuggauuuucagccucguggaaaugugaagaaauaaauuucugcuguuuaagccacccagugugugauacuuucuuaugaaagccuuagcaggccaggcgcgguggcucacgccuguaaucccagcacuuugggaggcgaggcagguggaucaccugaggucgagaauucgagaccagccugaccaacacggagaaacucgucucugcuaaaauuacaaaaaauucaggcgggcacaguggcucacgcccauaaucccagcacuuugggaggccgaggcaggaggaucacaaugucaggagauugagaccauccuggcuaacacgaugaaacccugucucuacuaaaaauacaaaaaauuagccaggcauggugguaggcgccuguagucccagcuacucgggaggcugagacaggagaauggcaugaacccaggaggcggagcuugcagugagcugagaucaggccaccgcaccccagccugggcaacagagcaagacuccaucucaaaaaaaaaaaaaaaaaaaaaaaaaaaaauucgccaggcgugguggugcaugccuguaaucucagcuacucaggaggcugagucaggagaaucgcuugaaccugggaaguggagguuacggugagccgagaucaggccauugcacuccagccugggcaacaagagugaaacucggucucaaaaaaaaaaaaaaaaaaaaaaagugcugguucacaccuguaaucccagcacuuugggaggcagaggcaggcggaucacgaggucaggaguucgagaccagccuggccaauauaguaaaaccccgucucuacuaaaauugcaaaaauuagcugggcgugguggcacguaccuguagucccagcuauuugggagacugagccaggccaaucaguugaacccaggagguagagguugcagcgagccaagaucacgccacugcacucuagucugggugacagagcaagacucugucucaaaaaagaaaaagaaaaagaaaaagaaaaaaagccuuagcaagcuauaugaucaugucccagauaaaacaaauuuaaauuaucaaaaccugugguuaggccaugaaccaaaaaugauuccuacauuuuuuaaauguauauuuuuaaaaaaacacaggaggcggaaguugcagugagccaagaucacacuacugcacucuagccuaggcaacagaaugagaccaaaaaaaaaaaaaaaaaaaaugugaaugagauaagagauauuuguggccugcaaagcugaauauuuacuggcugacccuuuauacaaguuggcuaacacauuaaaacuacaaacagggccgagugcgguggcucacgccuguaaucuccagcacuuugggaggcugagaugggugcaucaccuaaggucaggaguucagagaccagccuggcaaacauuaugaaaccccaucucuacuaaaaauacaaaaaauuagcuggguguggugaugggcaccuguaaucccagcuacucaggaugcugcagcaggagaaucgcuugaaauaaggagguggagguugcagugagcccagaccacgccauugcacuccagccuggacaacagcgugaaacuccgucucaaaacacaacacaaaaacugcagaccaggcgcagugacucaagcccaugaucccagcacuuugugaggccaaggcugauggaucaccuggggcugggaguuugagaccagucugaccaacguggagaaaccccgucucuacuaaaaauacaaaauuagccaggcgagguggcguaugccuguaauaccagcuauuugggaggcugggagggggagggggagggggagguggagguggagguugcgguaagccgagaucacgccacugcacuacagccugggcaacagagagaggcugugucuccccccccaaaaaaaaaaaaaaagccaaaauaggauuggaacccagcauuucugacagaaggcuuauuuuuuuucacuucacaaaaagggacaauaauuucuccagcgguccuuuuauugcaaaguaacuaaccaugucucuguacuuccaguuuguuuuauuauauaaucuaaacuagcuucugcauacuugacaacaugauaauggaguccugagagucuaaaauuuguuauggaggcagugagagagugauauuugaccuugagucuuucuugaacaaagaaaaauucuuuuaucuccuggggauguuaaaagaagaaugcuucagggucuaaaaccaaagcaagaaaguaauuuuuuuaaaaaaagagugcucaaaagacggaauguggaaagccacaagaguugcuugauagaaaagugcuaaguggguaugcguggugguucaugccuauaaucccagcacuuugggaggccaaggcagguaaaucacuugaagucagccuggacaacauggugaaaccccaucgcuacuaaaaauacaaaaauuagacaggcaugguggcgcgcuccuauagucccagcuacuugggaggcugaagcacaagaauccuugaacccggugguggagguugcagugagcugagaucgugccacugcacugcagccugggugagagagugagauuccgacucaaaaaaaaaaaaaaaaaaaaaaaaaauagugcuggcuaagugcgguggcuuauggcaguaaucucagcacuuugggaggcugaggugagcaggucaccugaugucaggaguucaagaccagccuggccaaccaccguggugaaaucccgucucuacuaaaaauguaaaaauuagcugggcaugguggugcacaccugugaucccagcuacuaggauggcugaggcgggagaauugcuugaacaugaaaggcagagguugcaguaagccagauagcgccacugcacucuagccugggcgacagagugagacuccuucuccgcaccacccaaaaaaaaaaaaaaaagugcuacauuuuccauaaaacauuaccuugaacagcuuucaccuuuguaucuuagaguggaaacuaccacauaaaauaacucgcuaggacagagguucacaagccuuccugguauauagugcccuuggugucugaggaguuuuguugugcucuuaagccaaaaggaguaacuagcaguugcuuugaugacauagcuguauccaagcaacauaacuauauugucuuagcagccuaguagcuauuggaaaaacgaauuuacauuauuggaaagaaaaauauauauaguuucuuauauaaccauaccuaucaauggaauguguauggcuuuuggauacuauauaacuucucaaacuuugaaaugacuucuaucaucucacuccuuguuccccauuauuauuauuauuuuuuuuuggugggguggguaccuguguuuuuuugaguuauagcaaccaccagaaauucaguuuuuagaagaugaaacuuaauggagggguuugcaguacaaucucauauugaaacugaacaaccugaaacuaauaguuugcuuagugucuuggcuuauguugaguaucacugaauuacucugaaauuuaaaauaucccaagguaguugugaguuccuccauggggcccugauacaucuuggcacaugauuugguagccacaggccacaggacuagcagguuuauucagaaaguuuuauaguacuacagcugauuacagaagaucucaaauaucuuacgguuucccugagcaaugaguaugugggagacagcuuggugucagacauuuauaggcaagguguuugauaccuaagaaggaaaaaccauuuaugaacuccaggaacuacuuuuuuccuuuccauagcagaacuuugaugucucauuccucacauauuacaaauagguauuuuuaauuuauuuauuauuuuugagauggagucuggcucugucgcccagguuggagugcaguggcgugaucucggcucacagcagcuucugccuccuggguucaagcaguucuccuuccucagucccuugaguagcugggauuacaggcgcccgccaccaagccuggcuaauuuuuguuuuuuaguagaggcagguuuucaccauguuggccaggcuggucucgaacuccugaccucaggugagccacccgccucagccucccaaagugcuggaauuacaggagugagccaccauacccagccuguuuugucuuuuauaauaaaaugugcauugcacauaguaaaacuaucaaauggauuaaaauaacugggacacuuuuccuagcaaacuguuuccaucuagcuucuuuggugcaucaauuuuuuauagugaagggugcuugcaguguuuuauaaauuagaguuauaacucaccagauacuaacauauuaaaauuaugguauuuaggaacaaauacggucucuguccuuucaaggcuaacaaagagaccuuuuagauaggacuauagaggauuuuagguuaugcaaaauguaauugcuuggauugguauauauagcccuucuauugagcuuagaaaugcuugucacaucagcauggaauaggcugggcacugugccucaugccuggaauccuagcacuuuaggaggccaaggugagaguaucauuuugggccaggaguucaagaccagccugggcaacacugcgagaccacaucucugccaaaaagaaaaaaaucgcuggccauggugacacaugcuuguaguccuagcuaacuggggggcacugaggugggagaauugcuugagacaaggaguuugagguuauagugagcaugguuguaccacugcacuccagccugggccacauagcaagacccugacuuagagaagcauggagaccaggagugauggcucacaucuaauaucagcacuuugggagcccaaggcuggcagauuacuggaggccaggaguucaaaccaaccaugccaacauggcaaaacccugucucuacugaagauacaaaaauuaguugggcaugguagcauaccuguaaucccagcuacuugggaggcugagacaugagaaucgguugaacccaggaggcggaggcuacagugagcugagaugugccccugcugcaccccagccugggcaacagagugagacucugccucaaaaaaaaaaaaaaaaaaaaaaagcauggaauguccgccugugggguuuauuguuguuuugcuuuaaguagauuauuuacauaauguaugcagagguggaaaguuuugaaucuauagggauauuacuauuaaaaugaauuaacagucuuacacaaugguuaugaguuuagccaguguuagcagaaaggcuagagauaaauccaguauaauuaguuuagaagcuaaaguuaaagcuaaacucagcccccucuccauauguuuuggguuuguuuuuuuagacggagucucacucugucaccccggagugacaggcuggagaacgguggcaugaucuuggcucaccgcaaccuccaccucccagguugaagcaauucuucugccuuagccucccgaguagcugggauuacaggugccugccaccaugcccggcuaauuuuuguauuuuuaguagagacgaggugucaucauguuggcaaggcugaucuuuaacuccugaccucaagugauccaccugccuuggcuucccaaagugcuaggauuacaggcaugagccaccgcacccagcccucuccauauguuaauaggagaaaaagagaugguguaauccucauggaaggcaaaaggagauuucauaaacgcugguuuuccauuuuuguuuuauugguuuugguuuuuuuuuuuuuuugagaaagucuugcugucgcccaggcuggagugcaauggcgcgaucacagcucacugcaaucuucacuuccgggguucaggugauccuccugccucagccucacaaugaguagauggaacuacaggcaugcgucaccacaccuagcuaauguuuucacauuuuuaguagagaugagguuuugcaauauuggccaggcuggucucgaacucggccucaagugaucugcccaccucagucccccaaaguggugggauuauaggugugagucacugcacccaacccaauuuucuuucuuuuuuuuuuuuuggggggacagaguuucacucuugcugcccugauuggacugcaacggcgucaucuugccucucugcaaccccugcuucccagguucaagcgacuauccugccucagccucccaaguagcugggguuacaggcaugugccgucaggccuagcaauuuuuuuuaaguagagaugggguuucaccacgcuggucaggcuggucuccaacuccugaccucaggugauccuccagcuucagccucccaaagugcugggauuaacaggcgugagccaccacaccuggcccaguucuccuuucaaaugagggaauacauauguguuuauuccugauucaggauaaguguagggcacccuccacccacuuguaguuuuuguuuuuuaaaaguuuuuuuuuuuuuuugagaccaguucuugcuuugucauucaggcuggagugcuguggcgugaucucagcucacacagccuugacuucgcaggcucaggugauccucccaccucagucuccaugguggauggaaccacagauacaugcuaccacacacccagguuauuuuuuguagagauggggucuuaccuuguugcccaggcuggucucaaacuucugaacucaggugaugcauccaccccggccucccaaagugcugggauuacaggugugagucaccauaccugguccccccauuuguaguuguguuuuguuuuuuuguuuggacagaguuuuugcucuuguuguccagacuggaaugcaauggcuugaucucgugaaccccaauccuauuucagacagccccaauccuauuucggacagccccuuuaugauucucaaauuagugcuguguaaauggguauuuuaagaaucaggccgggcgcgguggcucaugccuguaaucccaacacuuugggaggccgaggagggcggaucacgaggucaggagauccagaccuuccuggcuaacagagugaaaccccgucucuacuaaaaauacaaaaaauuagccggaugagguggcgggagccuguagucccagcuacucgggaggcugaggcaggagaauggcgugaacccgggaggcggagccugcagugagcaaagaucacgccacugcacuccagccugggcaacagagugagacuccaucucaaaaaaaaaaaaaaaaaaaaaaaagaaucagccgggugcaguggcucaugccuguaaucccagcacuuugggaggccaaggcggcagaucuccugaggucaggaauuugagaccagccugaccaacauggcgaaaccccaucucuacuuaaaaaaaaaaauacaaaaauuagccagguacgguggcaugcgccuguaaucccagguacucagggggcugaggcaggagaaucgcuugaacacccaggaggcagagcuugcagugagccgaaaucacaccauugcacuccagccugggcgacagagcaagacuccaucucaaaaaaaaagagucucacucuguaacccaggcuggagugcagcaguggcgcauucucggcucacugcaaccuccucgccuccuggguucaaaccauucuccugccucagccucccaaguagcugggauuacaggcacccgccacggugcccagcuaauuuuuguauuuuuaguagagacaggguuucaccauguuggccaggcuagucuggaacuccugaccacaagugaccugcccgccuuggccuccaaaagugcugggauuacaugugugagccaccgugcccagcugacauuggcacuaucaaaugaaguguggcuucaugugaaugagcaccugaggcacagaaaagccccaacagcacauuuuauucagcuucagaauacaaaaugggaaaagagcauaugcugaaggugaaguuaaaauaucaaugagcaaguggcuccaauuccagcacucugggaggcugaggagggaagacugcuugagcccaagaguuugagacaagauaagccuuagcaacauugugagacccccgucucuaaaaaaaauuaaguuagcugggugugguggugcacaccuguagucccaacuacugggggaccaaggcaggaggauggcuugaucccaaguuugaggcugcagacagugaugacaccacugcacuccagccugggcaaaguagugagacagugucucagaaaagaagaaauauucccggaaaaccgcaaguucaaagguauaccaaggaucgggugcagcagcucacaccuguaaacccaggacuuugggaggaagaucacuugagcccaggaguucaagaccaaccuggacaacacgguaagaucccgucuccauuuaaaagaaaaaaaaaaaaaaaggccgggcgugguggcucacaccuguaauccuagcacuuuggaaggccaaggugggaugauugccugagcaaaacggcgaaaccccauuucuacuaaaauacaaaaaauuagcugggcauagcggcacaugccuguagucccagcuacuugggagucugagagaggagaaucgcuugaaccuaggaggcagagguugcagugagccaagaucgcgccacugcacugcagucugggcaacagaaugagacuccgccucaagaaaaaaaaaaaaauuuacaaagguauaccgaggaagcagggaagcagccucauucuagaaucuaucauugccggcugcggcaguagcucacgccuguaaucccagcacucuaggagucugaggcgcguggaucaugaggucaggaguucaagaccagccuggccaagauggugaaaccccaucgcuacuaaaaauauauaaaauuaggccagaugcaguggcucacaccuguaaucccagcacuuucugaggccgaggcgggugaucaccugaagucgggaguuugagaccagccugaccaacauggagaaaccccaucucuacuaauuagccgggcaugguggcgcaugccugugaucgcagcuacccgggaggcugaggcaggagaauugcuugaacacaggaggcggagguugcggugagccgagaccgugacauugcacuucagccugggcaacaagagagaaacucugucucaaaaaaaaaaaaaaaaaaaaaaaaaaaauuagccaggcauggcggcaggcaccuggaaucccagcuacucaggaagcugaggcagagaacuacuucaacccagaaggcggagguugcagugagccgagaucgcaccaguucacuccagccugggcgacagagccagacuccaucucaaaaaaacaaacaaaaaccaaaacuaugggccgggcgcgguggcucacgccuguaaucccagcacuuugggaggccgaggcaggcggaucacgagaucaggagaucgagaccauucuggcuaacacggugaaaccccgucucuacuaaaaauacaaaaaauuagccgggcgagguggcgggugccuguagucccagcuacucgggaggcugaggcaagagaauggcgugaaccccagggggcggagccugcagugagccgagaucgcgccacugcacuccagccugggcgacagcgaaacuccgucucaaaaaaaaaaaaaacaaaaaaaacaaacaaaaaaaaccccaaaacuguaauugccgauccacacaguaaauaguaaaaaguucaauacacuauuuccauagcaaaauaugcucacuagaguauuuuuugagcucacguaaauaugaucuuagguguuuaacagcgagauugguucugaacaguugauauuuacaaagguuuuuuuuccccugaaaagagacaaucgcuaaccacaagacccaaaaaugauagcuuguagauuuuuaaaccgagaaaauccaauuagucaggagaaucuuaauuuagcaauaaaacacuggcuugcacucaagaaauuuuucacuuccaguuucuacugccuucuaguuaaagucuaacugaacacaggaagaaaaauuaaaaauccaguugccagguuacagugcacaggaaaucaauacugaacaaaggccacccaccaucagauacucaaguuauagcaauuaacaauauagcauauguucacuacgacaauuuguuuugcaggcuaaagauggacaauuuuauuuuggagauucguuccuacacagcugaaugacaggaagauuuuuaccaaaaucagagacgcaaguuucuggacaacuuccuaauuauauacaagacauuagacaggaaaaacaacaacuuccaacaucucuaaaauaaauaaaacauuuuacuuuuucucuauuuuuaaucggucgaacgacaaugauucaaaaagaaaaugcgaaguagcacccucuggcaagguuaguuaagcggaaaaucuuaagugggggaagguccuaaaaaucccagccuucuccaagauagguccgaaauuaagagcuuuuauguaaauuaugagacaaacuuuuauaacuuaggauuuaaagaaauguaacuacgaaaucgcugaagagcaaaugaguaaaucaaaugagaaaacacacucccaagccuuuaagacacccagcauaaaucucucucuccccagagcuuaaaaaaaauuuauuagccaggcaugguggugcuugccugcagucccagcuacucgggagacugaggcaaggaggaucgcuugagcccgggagguagagguugcagcugcacuccagccugggugacagaggaagacccugucuccaaaaaaaacacuuuuaaaacaaguuaucaacaaaauaaacccuuaucagccagauucuuaagacuggaugacgacccauuaaaggcuucuuccacuucaaauaacugacuuacaacuuucauuuuaaaauuuaagucuuuagcuuguuaagagucccugaagaauuuacuaaacggcauauauuauuuuuaaaagaauauuuuagcuggucucuucaaaacacuuguuucccccagcccaacacucuucaaguggcauugaaucacucguuuugaagguagcauuuuuucuuuucuuuuuuuuuuuuuuuuuuuuuaagacagucucgcugugucgcccaggcuggaguacaguggcgcaaucgccgcucacugcaagcuccgccuuccggguucaagccauucucuugccuuagccucccaaguagcugggaccacaggcgcccgccaccacacccggcuaauuuuuuguauuuuuaguagagacgggguuucaccguguuagccaggauggucucgaucuccugaccucgugauccacccgccucggccucccaaagugcugggauuacaggagugagccaccccgcccggcaugaaaguagcauuuuuauuuuuuaacuagagaggcuacuuuuuggaauagucucucuacugcuacacuuacuuuuuuuuuuuuuuuuuuuuuuuugagacggagucucccucuauugcccaggcuggaguacaacggcgcaaucucugcucacugaaaccuucaccuccuggguucaagcgauucuccugccucagccuccggaguagcugggacuacaggcaugcaccaccacacccagcuaguuuuuguauuuuuaguagaaacgggguuucaccauauuggccaggcuggucucuaacuccugaccucguguuccgccugccucggccucccaaguauagggauuacaggcgugagccaccgcgccuggccuuacacuuacuuuucacccaaguuuuuaaaucuacuuuccuaguaauagccguuccuuaccuauuuaaauaucucauguggccuccaucaaaugcuucuacuucaagccaauuuuaaacauacuuuucgcgaaaagauauguuguuuggcucuauuauuaaaagcugcuuaaugccucaucugacaaaaaauuuccccuuacagauuuucagaguaugaaagguuaagacugaugucccuucuacauuacuuaggagagcuuucaaauagaaaagcaaaaacuauuuuauauacauucaaauuuauuuauuuauuuugagacggguuuucacucuuguugcccaggcuggagugcaauggcaugaucucggcucaccgcaaccuccaccucccagauucaagcgauucuccuaaccucagccucccgaguagcugggauuacaggcaugugccaccacgcccggcuaauuuuuuuuguauuuuugcagcgacgcgguuucuccauguuggucagucuggucucgaacucccgaccucaggugauccgcccgccucggccucucagagugcugggaucacaguugugagccaccgcgcccagccuaauucaaauuuuuuaaaaccccgauuacguaucacuuucggggagggggcuccuucaaaaauucuaacaugcugugcucuagaagcuuguucccagugauaaacucgcuucagccucacgcaucccuuuagauuucuagccaauauacucagccucaguaucaugacuugaaucaagcaaauccuuauuacuuuuccaaagacauaaagucacuccccucuucucucuucugaauggagucuaaaacaaaagaaaaaaaagguuccaccuuaauuguucuccauaccuuuuaggacguaguuaguaccuugaaaaauaaccucccgucaaaaaaaaaaaaaaaaaaaaaaaaacccuguaaaaccggcaguucccacuguacgcggcagugccaagaauucuuaccgguuaaaaucgccaaggcuuuccuuuaucaucguaaaaugaagacugccauagaaucuguauucaccuccacacaaauuuaagaucuuugggacgacuguagguuaauuaaaugccuacuacauaccuauuucauccuacacuguaacaagauagugaaaccucaccucaaguagaacaugaaacacagaaaauguccguaucuuuccaaagucgacacgugcggaacuaccugcucaaugguaacuccuccucgcugccagggaagcggcugaguuuuggcaaccucccguguuuucaagagacuggaguuaggaggcggacuggaaguacccacacucaagaaacccagacacuggagagggaaguauguugcggcgugggcauggcuuccuucuaguugccuagcaguaccugcagcucacggcgagguccgcguggggcucucccaggagcuccgccaggcaccuggcggcacccaccacaggugcacucgacucagggccuggccccgggaccacaaagcaacagaaccggagcgcccaagcagccgagaggcgacccacgaagguucacgcuucagggcgccgcauggcgagcagcuaccgggagcuuaaggccuagggugaaguuaccgaaagaggcgaguaacccagacagccaaagggguaaaaguaggauuuccggcauggggaagccaaggaacgguucaggggugggggaagcagacaucuggaggaaaaauguccuccacccgccaacgguaaccggaacaaggauccuggaccucccgcccccaggcaggaacgacugccaccaccgaugcgagaaaggcuagggggccgcuuccagggagcccccaacgcggccucggccucacucggcgaccuucccucggcggggugucgcacucacauugugaacggggcagggggacgggcgaacuggugggcgggccucucuggcggcggcugcugcuagggagucgacuucucuccgguggcgacuccgcuuuuucucuccggucgcggccucuucucgcuucccucaggcgacggcggcagcggcgggcucgaccucgggccccagaaugcaccgcgcggaaagagcggcuccuccggucggggagaagaggaaaguguaggaaaaggggcgcgaggacggagaaugaacgugcgugcgugcaaacgagggguggugaggccgggcggc

SEQ ID NO: 192198 - RNA, 74372 nt, Homo sapiens
aaguuucuguguuccuuuuacagcaaaagggacuuuuuauauaaccaaaugugguguuuuagugacuuuuugauaauguacaguuuuuugugaauuuaaauuuauuucuuucuauauuuuuaggaccaaucucauuuuuaauaagguuaaaaagaaaaaaaaagucuagcgaaaaaacuccuguuuuugccaugugauguuccacaagugcagcuguagaaaagugcuugucaguuguugaauaaaaaaaaccacauuugauagagauucaaaagacucuguguauucaucuucccuucuacacaccugagggggagacggcguugggauagguaugacuggcuuaagagaccacaggcaagggaacaacaggggcuccuguuccauacccucuguguggauggaaagggucauuagugcuccugccuaaaugucuggcugaguugcuggagcaaagggggauucagugcauccagguccugccuugugagauguggccccagcuuccuaagcugccaccucuguguuccugucauagcaaauaugggaccaucaccagcuuaccacuucccacucacggauaagacaccaagacguagacuuuuguguuuuauuuaaaaaaaaaaaagugugaaguaagacaaaauggaccucuaccaaguuguagggaaggacaaggaaaagaccagggguagaaaaggaguguaaguuuuagaaugguggcauuggcauagaugugggaagaguauaaaacuagaagaagucuccagauaaaaauaugcaaaauaugucuguuuaaguauaaacauuuucuguccacaugcaaagagguguuuacccacccaaaaaggguauauguuggaguggggacuucacucgcgcuggauauguauuacccuccagccuggaaacuuugucuuggugcaacccccuaaacuguauguuaagguagaaaaggaacauucgcuuccagccuuauaaaaaugacagacucccucuuugguguuugguuaccuucacagcuauacgccagccacugagcagcuuucuuguccucuuaaguucuaaacucugcuccuaugcugguguccuccaaccauuacuuauuacccuaagccgucacugcacagccuacuccccuggccuaucacagcaggaccuaucuggagaguucacacuauucuagggcgaucagugagcuaaaaaucccagagaaaacacuguaggaauagaaauucccaaguuuaauucccaagaguuuaaaaauuaugagccuuuucuagcccccaccuucccaacccucagagaaggacaguaaagaaaucagugaauccagguauuuaccuguuguugaauugugagguugugagguagacguguaacaaggacaaggaaguuuggggaucugcuuggagaaugaagguuuauucaaaacaaguggacaggucagggguaacgggugaugagggcaccuggcuuuuguaaucauguggggacuguccccugggaggugcagcaaaaaucagaacggagacagaagcucacagucugguuuuagcugccaacuccuauggaaguccauagcugacuccuauggaaggccuaccaaaugaggaaauuucaggaauuugcuaaugcgugggaggauugaaaauguaggcagcacagaaauagaguaguugguuuaaacgggaaucaggaaggauugguauaacaaggcacaagauuuggaauuuacccuuuacagacuggcuuuuauaacacccacccucgucucugaagccugcugauucagggcuagcagagccuaggggcaaguuugggccagaucacccacccaguuuauugcccuuggcuaagaaugcaaagccccucaugagcgcaaugcugccacuugcccagaagguggggcaugugcacaaggcagcagcaauaguucuuuucuagaagacuaauagccacugcuacuagggauuccuaggacauuccagcaaggccucucacagcaucauaugacgcaaaguaacagcccacggguugacauuggagugacaggccucaacucccaauggguugacauuggagugacaggaguaggcacuggaggcacuaagggagggugagugagcugauugucaaguuaggaaaggaaaacgaauggaguggagcugaaguggcccaacccagcgcauggccugugaagcagcaaagucuggucuucaucuucaauaugaguaauguccucuuaccacuccuuaucuguuacugacaaggucuauuacccuuuagagccaccaggcuuccuggccugggcaacucuacaaauucuuuaguuaaaaacacuacaaagggccgggugcaguggcucacgccuguaaucccagcacuuugggaggccaaggcagguggaucauuugagcccaggaguucaacaccagccugggcaauguggcaaaacccugucucuacuaaaaauacaaaaauuagccaggcaugguggcaggcaccuguaaucccagcuacucaggaggcugaggcaggagaacugcuugaacccaggagauggagguuucagugagccaagaucacgccacugcacuccagccugggcgacagagcgagacuccgucucaaagaaaaaauaaaaauaaaaaaacugaaaaggccaggugugguggcucaugccuauaaucccagcacuuugggaggccgagguggguggaucauuugagcccaggaguucgagacgaggcugggcaacauggcgaaaaccugucucuauuaaaaauacaaaaauuagcuguuuggaggucaggaguuggacacuagccuggccaacgugguaaaaccccaucucuacuaaaaauaaaaaaauuagccaggcaugguggcacaagcccauagucccagcuacuugguggccggggaagggguggcugaggcaagaggaucaccugagccuugggaggucgaggcugcagugagccauuauggugccacugcacuccagccugggccacagagugagacccugucucaaaaaaacaaaacaacaaaaccaaaaaaccaaaaacauuaaaaacaacaucucauccaagcauggaggcucacaccuguaaucauagcacuuugggaggcugaggugggaggcucacuugacaggaguucaagaccagucugggcaacauaguaagaccccugucucuacaaaaacuuaaaauaacgaacugggcuugguaguaugugccuguacuuccagcuacuugggaggcuuaggugggaagaacccuugggcccaggaauucaagacuguaguagacuacgacugcaucacugcacuccagccugggugacacagcaagaccaucucuaaaaaauaaaauaaaggccgggcgcgguggcucacgccuguaaucccagcacuuugggaggcuaaggcgggcagaucaccugaggucaggaguucgagaccagccuggccaacauggugaaaccccaucucuacuaaaaauaaaaaaauuagccgggcaugguggugggugccuguaaucccagcuacaugggaggcugaggcaggagaauugcuugaaccugggaggcggagguugcagugagccgagaucgugccauugcacuccagccugggcgacagagcaagacucugucugaaaaaauaaaauaaaauaaaaacaucucucuccaucaucaucuccacaucuuccugaccucucuacuggcacccuccuccaaaaaguccaaucaguuuagggucugaguaucaucucagagccugagaugaggaguaauaacaccgauaggagauggcuaggcaggcucagagccuauaaaggauuaugccaucugaggaaaggacucuaguguguucuagcugacugaaaacagaaaaaugccaaguacuaaaauauuuuaagaauguuaugagcaucuguaaugagugggggugagauguaaaguacaaagagaguaagagcugggcuccaugaagacagcauucagaaaacacuaggcauaguguuuaagagcccaacccuuggcugugagcuggaaggcuccccuauguuuccuucugccaucaacccaaccaauuagacuauuucaugggagaaacaguaucccuccuuucuucucccuccuuuccuccaaacacucacccacuguuacaaaugaacuaacaauuaggagaggaaaugaguguaaaccaaaugcaccaaaaaagaaauuccucagugccauuagccacugcaaaauaacuucaggcccccaucacuucccaugcccaaaccagaaacacucauuaauacaaucuaacaaguagauucacaugagaagaacuccaaaagguaaauucaaaauucaaaacaaaaaauuagagccauuuaaacauuuuaaaauauauauauagagagagaaagaagacagaaucaggaguucugugaggcagaggagaggggaguggcaauaucaacaaugguuucuaugcgugaaaggcccuuccuaaaccuccuaccauagcaaagcucccccggucuaucagaugaacagaauucuagauuuguuuucucuuucucucaaaggccacugacaagaaagcagcuaugguauauuuuccuugacugagggcuggagacucaaaaacaaaagcuaucugcccagccagagcccucuagaagguugcugggcuuggggcuauuuuacacuggauaagcccuuccugaguuuggaagcaucaauuagaagacugcggcaauuuguccuuuacgcuuuauauccuacccauugccccgcacucccucaccccuaggauguacauagaaagucgacacuaggggcacugggacucucaauucuaggguggcugggaagggagggaaagcugggccgagcucuacuugugacaacugauacuacaguuucuuuuccccugcugucacccccuuccucucccuauggccagccuaaugaacaccugucucucuauccuccauuauuugccuuugucugacugucuaguggagaggcaccuggccuugaagugcaagggagucaaauucuccuuucagugcauaagggagugacugggagaagacaagagcaggauuuuauuuccuagaagaugggugaagucuuucuucaaucugucuccauguguauagagucacaucuugcagaaggggacaguuaaagaccaagacauaggcuuuuuuaaaggacuccugaccucauaaagaguuggaauuuauugcucuuugcuacccuagcuccccguuguccuuccacagaaggaacauuauuucugauguccugguucccugggcaaaggguccaagcacaccggggcagggcagguugcucuggacaguuuagagagcuuuguccuuucccaccauugcacagcacacaccagaacaaugcccaccugaaucccucugaguacaugugugcauucagcauggagccacagcucuuucaagaaucacucuugcuauaugcagaguuaucaaaagucaaagucuggggagaauucaaggaucccaguccaguccuuccccaacaguugcaugagugucaaaaggcacuguuuguccaggguuggggugaaaauuuacccuaacccaggaggcagggacaacacugucuauaucaguguuucccagucuuggcaauauugaccccuggagucagauaauucuuggcuggggguaguggggacuauccuaugcaguguaggauguuuagcagccacuagaugccaguagcacacacaucccaccuccaggcguggcaaucaaaacugucucuagauguugccaaaggccugagggacaaaaccaccucugauugagaacuccuggucugugagugaagcagcagaucuuccaccguguggaaggagccuauguggauucaacuaggucgcagcugcaaaggcucugagcacagcaauguguaacagggaagagaggggccaugaagcccaggacagaaaauauccuccaggaggcaagaaagcagguacucccaaaaagcuauaccucagaugcuguuggccuuggcagugagaagaguugauaaaagucaguaaguccauucuuccggaacuugccagggaagaccuagucuucaaccaaguuuggcucaaggguguguucccagggcuguggaguugucucuuuaguaagccugggucacaucugugcuuucugaagccaaagucuaguuuuuucucccaggguguggcagggugggggaaagaacagccacuuccauggccuacuuaguguucugccuuguuccuugcccagccugccccccaaccccaaauuccacaugaaauuucauuuuuaaaaauccauaaaauuaaaagcuguaaaagggcaaaguaggcaggcucagcuguuuagaaaagagaaaaagaagaaucuggacaagagaaagaaggcauaauaugggugaagaggagauggggugcaugagcugagagcuuuacaaaauaacauuuuuagagccugcauacuuuuuaaaacacauacacacaugcaucaaaaaaguccauaacuaagcucaguaaguagggcuccuucaucgauguuccagcaccacaccuuucuguucuguuuugguuuguaaagaaauaauuacaaauuguuuuaaaagcauucccaaauaauuccaauacaucgaaaacuuuuucauauagaugagaagcugcgaccaccaugucucuucaagguaggggaaaaguacguugcaguuaaaaacaaaaagcuuucuuugcaaaagaagaaaaguuuuuuugaucuccuugaauguagcacacaaaaaaagugaugguucccccaggcuccaucagcaauaguaaagggcaggaacguagagauuucuuuuuccaggcccaggccugugaaaaacgauggcuaaguguuaguccuuagcagggccgacggauggucuccauuccugguuaacccucuggaaucugggagcaugaguaucuccaagaauucauuucuauucaguaaagauggggaggggaauccuaaagaaggcacaagccagagaggagacaagacaaacaugagaaccugucugacuucaggccgggcugagcugcugucugccagugcagcccucccugccccccagcaugugguucuuacccacuguuacuuguugaacuggaaagaauagaccccaugcucugagggugcguccacugccacuugguucuguuggccgcugcucuccugugccauagccaaggaggggggucaucuugcgcauuccuuuccucaccuccacuacagcagccugaccaaagcccacccuacaucgagugcccucccaaaccuacccacucuccacacucaugugugaguguuuccacccacaccaccacuuccccaaccuuccuacagccuguccucuucccaagacgcauuagucaauacaagccagcauccuggugucaacuacuggcuggccaaauguaaggaagggccucauucaugaacucagaccaaguccuucuuuccuacaucugcuguuguuuuuuuuuuaaauauggaacgcuucacaaauuugcaugucauccuugcacaggggccauaaucuucucuguauuguuccaauuuuaguaugcaugcugccgaagcgagcacauccuuccuacguucuucguauaccuaccagcuauuugugaacacagaaucagcaucauugugagagaaagaucuugaucagggggaaaccugccuccguucauuuuccuaaucucaauccaaagaaaugauaacacccuuaccucgacugaaacacuggaagaaggcacagggguguacugggagauguaagcuccuugcauagcugcagccgucggcauauacuagaaagagaaacaucaacaggcuuacagcagugauuuuuggcuacauuugaagcagcugaggggcuuuaaaaaaaauacugacaccuguauucuaccccagagauucuauuuuaauuggucugagcauuugcaucuuaaaagcacuucaggugguucuaaaguacacuguuagggagacgucucccuauaugacuuauuuuccuccucuuuccugacuuucuucugcuuuuccucaacacacucccuucucuacccuugagcccuuucuaugcaaaaaggaaugcaguaggccuaaaagaaaccuaaugagcuuccuccauccuuccagguacuauuuugaugaggauuccuaggacguguguguaucuuaaacuaauaugcagacagaagcacuauucacaaggugcaugaguaggaaucaguuaaaaggggugggcuggggagcagaauggcuguauuccuggcucauggagcacuaccauuguaguuuauguccuguucugagugugccccggaugacacugaaguaauuccaucauuauucauaaguuacuuacgcugaagaguauuacacagguaugccuugcucaguaggagaguuuacaaucagaaauauccugcuuuaccgugccugugcugcugagggagagauggcccaguugcuggguaaggggucccaucauggaggcaggcuggagagaaaugggaugguccaucccuggugucagaacugaacccuagaggcagcaacaaaggacaggguuagcugcagcauccugugaggcugccuaaagcagugaucgguggcugucaggaccacuggagacagacauuuaagaauccugggaaaugguaagugagcagcaacccaacuaugcaacaagaauaggaacucugccugucaguguggaaggacccucgucuaagaauaacaagcuuaggucuuacugcuggguugcacaagggucugagccagaacucacacccacaucuccuggcaucaaaggccuuuuuuuuuuuuuugagacggaguuucacucuuauugcccagacuggagugcaauggcacgaucucagcucacugcaaccucugccucccgaauuuaagcaauucuccuguaucagccuccugaguagcugggauuacaggcacccgccacuacaccuggcuaauuuuuggcauuuuuaguagagacaggguuuugucauguuggccaggcuggucucgaacuccugaccucaggugauuugccugccuuggccucccaaagugcugggauuacaggcgugagccacagugcccagccaguuuuuucuuuacaucaaauugccucuuuggcuucugcccacuucugaauacucacugaaggcugcaugagguaugaaugguggugcauccaggauggguuagguacuuguagaggagaugucugagucacucucuaaaacaagcaaaaacaaaaauguuaauugccuggaaacuauuauucagcccacagaucuaauaauguucaacaaagcucagaaaaguuugaaugccccacucaaaauagaaacauuaagaaaaacuguuuuuaaaauauuagcaauucuuaaaacucaauaaauaauccaguuuaaaaaagggcaaaaaggaguucaaaauuauagugagcuaugauucugacacugcacuccagccugggcgacagagugagacccugucacuaaaaaaauuaguaaaaaaaaaaaaggguuuggaaagauaucucucuaagaagauauacaaauagccaaugaguacaugaaagagguucaaaugcaaaucaaaaccacaaugggauaccacuucauaccuauuaggauggcuacaauuauuauuucuauuuuuugagacagagucuugcucuguugcccaggcuggagugcaguagcgggacuacaggugugcaccaccacaccuggcuacuuuuuuuuuuugagacaggaucuugcucugucacccaagcuggagugcaguggcaggaucucagcucacugcaagcuccgccucccggguucacaccauucucccaccucagccuccugaguagcugggacuacaggugcccgccaccaugcccggcuaauuuugcuuuuguauuuucaguagagacaggguuucaccguguuagccaggauggucucaaucuccugaccucgugauaugcccgccucagccucccaaagugcugggauuacaggcgugagccaccgugcccggcccacaccuggcuacuuuuuguauuuuuuguagagacgggguuucgccauguugcccaggcuagucuugaacuccucagcucaagugauccgcccaccucagccucccacagugcugggauuacagguaugagccacagugcaaggccagcaugacuacaauuaaaaggauagaauaacaaguguuuuacacugccacuggugggaauguaaaauggugcagcuacucuggaaaaugcuuuggcaguuccucaaaaaguuaaauauagaguuacuauguagcccagcaauuccacuccuagguauauauccaagugaaaugaaaacauauguccacacaaaaacuuguauaucaauguuuauagcaguauuauucauaaugaucaaaaggaaacaacuuaaaugaugaccaauugauaacuggauaaacaaaaugugguauagccauauaauggaauauuauucagcuauaaaaagaaugaaguacugauaaaugcuacaacauggauacaucuugaaaacauacuaagugaaagaagccagacgcaaaaaaaucauauuguaugauuuuacuuuuguguaaucacacaaucauacaauuuucugagcuuugccuauuauauccagaauaggcaaauccauagacacagaaguauauaauggguugcaaggacauuucaauuaaaauuggauuugaaauaauccaauauuggauuaaauaauccaaaaagugagauuauuuaauaauuuggcgcuaggccaacugguuaacacucugaaagaaaacagacuccuaucuuaugccauacacaaagauaaauuccugaugauuacacauuuaaauguaaauguaaaacauaaaaucuuagagaccagauacacaguauagagacagagaauacuuuuuuaaauuaagacaagaaauuuagccgggcgcaguggcucacgccuguaaucccaacacuuugggaggccgagguggguggaucaccugagguugggaguuugagaccagccugaccaacacagagaaaccccaucucuacuaaacauacaaaauuacccaggcaugguggcauaugccuguaaucccagcuacuugggaggcugaggcaggagaaucacuugaacccaggaggcagagguugcagugagcugagauugguccauuguacuccagccugggcaacaagagcgaaacucggucacaaaaaaaaaaaaaaaaaagacaagaaguucaaaaguuauuuauuuauuuauuuuuugagacagagucucacucugucgccgaggcuggagugcaguggcgcgaucucggcuuacugcaagcuucaccucucagguucacgccauucuccugccucagccuccccagcagcugggacuacaggugcccaccaccaugcccggcuaauuuuuuguauuuuuaguagagacggcguuucacuguguuagucuggauggucucgaucuccugaccuugugauccgcccuccucggccucccaaagugcugggauuauaggcgugagccaccgugccuggccucaaaaguuauuuauaaaagaaaaagacaaauuuaacuauauagaaauuuuaaacuuuuuuuuuuuuuuuuugagacauggucuugcucuguugcacaggaugaaguacaguggcgcgaucacagcucacugaaaccucaaucuccgggcucaagcaauucucccaccucagccuccugaguuacugggauuacaggcacgcaccaccucaccuggcuaauuuuuguauuuuuuguagggacagggguuuugccauguugcccaggcuggucucgaacuccugagcucaagugaucugccugccucugccucccaaacugcugggauuucaggcaugagccaucacaccuggccaaauuuuaaacuuuuauauggcaaaaacuagugauucccacacuauggucccuggaccagcagcaguggcagcagcaucaccugggaacuuguuggacaugcaaauucuugccuuccacccaucuuacugaaccaggaacuggguguggugcccagcaauccaguuuucaauaagcuuuccacaugauucugauacaucgcuaaaguuugaggaccacaaauucaacagccaaaaaauaaaauuggaaaaaaauuuguaacaaagauaacauuuagaagauuaauacuuacauggaguuuuuauaaguugaugggaaaagaacaaauaaccaaauagaaacauggacaaagcauaugaauagcaaucagagagaagccaaucaaacuaugacaaaugaaaugguuaaauucaccuauaguaagggacaugcaaauuaaaauaacgauguacuuuacauucaucaagacaggaacaauuuuuuuguuuuuuuuuuugagacagaguuucacucuugucgcccaggcuggaguguaguggcgcgaucucggcucaccacaaccucugccugcuggguucaagcaauucucuggccucagccucccaaguagcugggauuacaggcgcccgccaccaugcccagcuaauuucuguguuuuuaguaaagacuagguuucaccauguuggccaggcuggucucgaacuccugaccucaggugauccaccugccucggccucccaaagugcugggauuacagguaugagccaccgugcccagcaagacaggaacaauuuuaaaagagcaguagcaccuaugccuggaaggaaauggguacuuucauacauggcugguagaaaugugaggugacacagccuuuguggaaagcaaucuggcaacaucuauaaaacugaaaauccauauagcauucaaccuagcaauccaccuccugggacucuagcccccagaaauagaagcauucauauauaaaaauauagcacaaggguguuuaguggagcauuauugauagcagcaaaaaaacgaaucuaagugaaugcccccauuggguauagcuaaagaauucuggcauaucugcagcaugaaauauaaugcaaccauuaaaaaagauaaaauuagagcagaggaucucaacauuagcugcaacagaaucaccuggagggcuuguuaaaacccagaucacggcugggcguggcgcagcacuuugggaggccgaggcgggcggaucaccugaggucaggaguuugagaccagucuggccaacauggugaaaccccgucucuacuaaaaaaaacaaaaauuagcugggcgugguggcgcaugccuguaaucccagguacuccagaggcuaaaacaggagaaucgccugaaccuaggaggcggagauugcagugagccgagauugcaccacugcauuccagccugggcaacagagggagacgcccucuuaaaacaaacaaacaaacaaacaaaagcccagaucacugggccccauccucagaguuuguaauucaguagauuuggaggguaguccaaaauuucuguuucuaaaaauucucagaugaugcugaugcugcuuguucagggaccacacuuugagaaucacugguguaggauacuguuaagugagaugagugaauguaaaaauauauuuaaucugguccaauuuuuguaaaauaaacaacuccccaaaugcuauacauauguguauucauaugaaaaaauaugacaaaugcuacacaguaggacauuaacaugaguuuacuuguggaggugguggagggggaguaagaggacaccauuaaaacuguauaccauauauaugaccacaugcacagaucaucuuuuacgcuguuauguaaaauuguguguaauaugauuaaaaggaaaaacaaaaaacaaguaguuccuagccuuauauuacuucacuuaaagcacaguaguagggaaaaccaccacaccauuuuucaggcaugaacauaccugauacgaagacacaggagaggaaagguauggggagagugcagacugagcaagcauccuguugggggugauguuauagggggcuggguaaaaccugugggaaggaaccucaaucaguacugagucacaggaaaccacaagggaagggucccaacugauaggcacagccaacguucccuugacuuucaaauagagagaaucaagaugaaucauuugagugucuggacacaggccauuaucauuuucagguggcuugauuauauaaaaccuuacccauucugaagagcugugguggggucauaggucaaggccaugacgcccuauaaagaaagaacacaguguucacauugugagcccuugagugagaauaggagcuggcccagaauguccaaggcugggaauguuuugguuuaacaaauuaaagccuagacaagucccacuacagcuguuucagaguuuuucuaauugugcaggccgcaaagccacacucgagaacaaacuggcaguauguucacagccagcauuucucaauuacguacuguagcucucaagcuuuccaccuaagcucacagaaaucaugccaugaucauuuccguuccacuuuaaugucguuaguacuccugucuccucagagguccucuuaccaugucugcauuccuuggccaagcccguccauuuugcacaaauuuuccuugguucugucguuucuuuggcccgccaucagcaaauuugcaaagcaagggaucggauggggcugccgagagagaaggcagaugggcagcugagucccaccucauguggcccaggcacagucaugcaaagcugcuccagaaucuucacuggaaguaacaaccuguggcccucucagccugagccccagaugccucaccugguacuccagggggugucuuaauauauuuuccauuaaagugggugaugauggcuucacacuucucuguggacuccauccuaaggagcauaagagggguuaggcucuagcuucuccaggaucugugcucuccacacauugaaagagaaagcaaagcucuaaguucccagccccacaacugcuccaaauguuaugacuacagaaacacagagugucugccacacaaauucaagguucuugaagagguaaccccagcuuguaaugaagguucuuucaacuggucccuguaugggauccucauaggaauaauggcagucuucagacuauuaacaugggcccucucuuguaucugccauauaaauaagaauacaagaaauagagguuguuaccauuauuuuuuauuagaaaauucugaaugaaaauuguuccuuuaauuugauaaaauuguacaagcuaagaauuugccaauauuuauuuuuugcuccuuguuguaauuaaggucaaggucuaauuagcuauugauaauaucauuaauauuucaugaaucuguggaaggaaaaagcaauaagaaagaguucauggcccauagugauagaaaaaggaauguuggagucuacugaguuaguuucuuguuggagaaagagaaauaaggaaucagaagacugagauuccagcaccacuucgccacccagagcucugugaguuaggacacucacaaaaacccucugauccgccgggugcgguggcucacgccuguaaucccagcacuuugggaggcugaggcaggcagaucacuugaggucaggaguuugaggccagccuggacaacauggagaaaccccaucucuacuaaaaauacaaaaauuagccgggagugguggcacuugccuguagucccagcuacucaggaggcagaggugagagaaucgcuugaaccugggaggcagagguuguagugagucgagaucacgccauugcacuccagccugggcaacagggcgagaaucuguguuaaaaaaaaaaaaaaaaaaaaggccaggcucagugguucacgccuguaaucccagcacuuugggaggcugaggcgggcggaucacaaggucaggagaucaagaccauccuggccaacauggugaaaccccgucucuacuaaaaauacaaaaaaaauuagcugagugugguggugcgugccaguagucccagcuacucgggaggcugagggagaagaauugcuugaaccugggaagcagaggcugcagugagcugagaucaugccacugcacuccagccuaggugacagagcaagacuccgucucaaaaacaacaacaaaaaacaaagcaaaacaaaaaaaccccucugaucuacuccuuauuugugcuuuagagauaacauccaucuacccuaccacaugguguuguguagaucaaaggagauaauguauauaaauguguucuacaaauuauaagggacuauauagaacaaggaacaguauuuucaccuauuuccauauuuaaauuaacucaguauauuuaaucuauuuccccauauuuaaaguaagacucacauuuucugugccaaugaccaccagaaauaugaaccauuccuauaaaagauuuuuuuuuuuuuuuugagacugagucuugcucugucgcccaggcuggagugcaguggcgcgaucucggcucacuacaagcucugccuccuggguucacaccauucuccugccucagccucccaaguaagcugggacuacaggugcccgccaccacacccggcuaauuuuuuuugguauuuuuaguagagacgggguuucacccuguuagccagaauggucuccaucuccugaccucgugauccgcccgccucauccucccaaagugcugggauuacaggcaugagucaccgcaaccagccaaaagaagauauuguuaaaaguccuuaaauugagccuuuuagagaaaaccacacauuagguaucguagagcuguggucuucuguuggguacuucuaccccuuacagucuuuccaaaggguaagcaggccguggagcauuucagaaucucaaguuucucaaaaacuguuaaaucugaucuuccugagggagagcuccugacggcuaaugaucaaggcugaaguccccucuuacaauagcuccucucaaaugguuuccaauucuuuagaaacaacaaaguugggggacuuuagcaaguugucaauucacacauaaaaaaucaauuuugaugacagaacaccuugguucuuggcauauaauucagaaggauuuuuuuguuuguuuuuuuagauggagucucgcucuguugcccaggcuggaguacaguggugcaaucucggcucacugcaaccuccuccucccagguucaaacgauucuccuaccucagcucccaaguagcugggauuacaggcaugagccaccacgccuggcuaauugcuguauuuucaguagagaugggguuucaccauguuguccaggcuggucucaaacuucuggccucaagugaucugccugcuucggccucccaaagugcugggauuacaggcacaagccaccacaccuggccagaagaaauuuuuaaaauuccuguuuuaacaaaauccuuuccacucccaucuacuuauuuaugagaacaagguuucucagcaugaaaacaaaaagcagaaacagaacuggcauuaaacucucccuuguuacaguaauaaacaauauuaauuuaugcuuaccuguccuaauuagaaaaaucuaaacaaaacaaaaccuauccaugucauagaugcuucuguauaugcaauaaaauuuacuucuauaaaauaauuuggccaggugugguggcucaccucuguaaucccagcacuuugggaaaccgaguuggguggaucacuugaggccaggaguucgagaccagccuggccaacugggugaaacccugucucuacuaaaaauacaaaaauuagcugggcaugguggcaugcaccuguaaucccagcuacuugggaggcugaggcacaagaaucgccugaacccgggaggcggaguuuacagugagcugagaucacaccacuguaauccagccugggcaacagagcgagacgccaucucaaaaaaauaaaaaaaaaaauuugggccaggaacaguagcucaugccucaaucccagcacuuugaaaggcugaggcaggaggacugcuugagcccagguguucaagaccagcuugggcaaaacagugagacuccaacucuacaaaaaaauuaaaaaauuaggccggguccaguggcucacgccuguaauccuagcacucugggaggccgaggcagguggauugccugagcucagcucaggaguucgagaccagccugggcaacaugguaaaacccagucucuacuaaaauacaaaaaauuagccgggcguggcggcaugugccaguggucccggcuacuugggagguugaggcaggagaauugcuugaaccugggaggcagagguugccaugagccaagauugcagcacugcacuccagccugggcgacagagugaaacuccaucuccaaaaaaaaaauuaaaaaauuaaaaaauuugcugcccccaccauccccccaccaaaaaauuagcugggcaugguggugggggccuguaguuccagauacucaggaagcggagguguaaggaucacuugagcccagaaggucaaggcuguagugagccaggaucguaccaaugcacucuagccugcacaaccgagugagacccugucucaauaauaauaauaauaauaauaauaauaauaauaauuuuguaugaacauuuuauuuuauuuuauuuauuauuauuauuuuugagauggaguuucgcucuuguuguccaggcuggagugcaguggugugaucucggcucacugcaacuucugccuccuggguucaaaugauucuccugccucagacuccugaguagcugggauuacaguagcugggauuacaggcgcucgcccagcuaauuuuuguacuuuuaguagagacaggguuucaccgaguugaccaggcuggucucgaacuccugaccucaggugauccacccaccuuggccucccaaagugcugggcuuacgggcgugagccacugccccuggccuuguaugaacauuuuaauauauuuauguugucugggcaauugugagcucaucauuguaaagauaacuuuuuuuuuuuuuuuuuuuuggaaucucacucugucauccaggcuggagugcaguggugugaucucagcucacugcaaccuccaucucccagguucaagugauucucucaccucagccuccuaaguagcuggaauuacaggugcccaccaacacaccuagcuaauuuuuauauuuuuaguagagacgggguuucaccauuuuggccaggcuggucucaaauuccugaccucaagugauccgcccaccucagccucccaaagugcugguauuauacaggcaugagccaccaugccuggccaaaauuuuuaauuuauauacauauuuuuguugcagagaaguaugacaagaugauccauaaagacuuuauaaaaauauuuuacacuagaauacaauucuauagagaaauggaauagaaacaaaauucuauagagaaauggaauagaaacacaaguucaagaagaaaaaaggaauauaagaaugauaugagauuuaugacucuaguaguccccccuuauccucaggagauacauuccaaguccccuaguggaugccugaaaccauggauaguaccaaacccuagauauacuacgcuuuuucaucugauggccacaauggcuacuaagugacuaauggguggguagcauuugcaguguggauacuuuggacaaagggugggauggagcggacaacaugaaauuuuuuauuuauuuauguuuuugagacagaaucucacugugucacucauguuagagugcaguggugugaucuuggcucacugcaaccucugccucucagguucaagcaauucuacugccucagccucccgaguaccugggacuacaggugcacacuaccacuccuggcuagcuuuguauuuuuaauggagaugggguuuuaccauguugaccaggcuggucuugaccuccugaucucaagugaucugcucgccucggccucccaaaguguugggauuacagacaugagccaccgagcccagccugaaauuuaaucaugcuacucagaauggcauacaauuuaaaaacuuuguaacuauuucuggacuuuuccauuuaauauuuucaguugacuguggguaacugaaaccauagaaaguaaaaccauaaauaaggggggaccacucuauuuuuuuuuuuuucuuugagauggaguuuugcucuugucgcccaggcuggagugcaauggcgugaucucagcucaccguaaccuccgccucccagguucaaaugauucuccugccucagccuccugaguagcugggauuacaggcaugcgccaccaugcccagcuaauuuugcauuuuuaguagagacgggguuuuuccacguuggucaggcuggucucgaacucccgaccucaggugaucugccugccuuggcuucccaaaguguugggauuacaggcgugagccaccaugccuggccgagacuacuguauuuaauuuaaaaaaaaauagcccuuuuuuuuugaggggggguguagggguaagggggacuaggaaguggcuggggguccuaugggcccauagcuccauccccagggcaagacccaccccaucugccuccagcccuacccauauuccuguauugauuuauuuauugagacagggucucacucuguagcccaggccagagugcaguggugugaucaugguugacugcaguuuugaccuccugggcucaggugauccucccaccuuagccucccagguagcuggaacuauaggcacgugccaccaugcucagcuaauuuuuuuuguuuguuuuguuuuuguagagaugggguuucacauguugcccaggcuggucuugaacuccugagcucaagugaucugcccgccucagccucccaaagucggguuuuuuuuugagacgagucucacucuguugcccaggcugaagugcaugucgcccaggcugaagcgccuuggugcaaucugggcucacugcaagcuccgccucccggguucacaccauucuccagcaucagccuuccgaguaagcugggacuacaggcgcccgccaccacgcccggcuaauuuuuuguauuuuuaguagagaugggguuucaccauguuagccaggaugaucucgaucuccugaccucaugauccgcccgccucggccucccaaagugcuaggauuauaggcgugagucacggaguccggccaaagucagguauuuuuuaaaugaaugauuuguguaucagauugcuaugauauuuagaucucauuugaauacauuuuuaaacgaaguaacaguuuuauuuuaaaugccaauauuuauaauuugcuggaaaucauacuuugcaugaaucugaauauaugaagaaaacuuguagacauuaacauagaaacauauaagagauuucauaguuuuucaaaagucucuaaagccacaguuccuaaacugugcucucaggcacuguggguggcuguggugaacucagagggucacaacgaggguuauuuuaacucuuugaagaaaaacagcaauaucuguuggagaaugugugcacuacuaacucaaaauuguacacugcuucaacauuaguucccccuacaauccuuuugauagauaacaucauauuuucacaaagcuggguuuaaauaguugcuaugacaaaagcaaauaccauaagaaaaccaauacguaacaggaaaugaguguguagguguccauucugauaccaaauuuugagaaguugugcaauuccaacaggcacauauuccauuaguaaguauaguuagaaugaaauaaagacaugcucucuuucaauguuuguguauuauuuuuucaaacagcuacaaaguuguuaaagcauaaacacuucuuaagcuguauggaccaugaaguuacugcugucaggaaauuuuuuuaaaaaguuguguggacuggcugggcgcaguggcucaugccuguaauccuagcacuuugggaggcugaggcggcuggauaaccugaggucaggaguucgagaacagccuggacaaccuggugaaaccacaucuuuacuaaaaauacaaaaauuagcugggcaugguggcgggcgccuguaaucccaguuacucaggaggcugaggcaggagaaucacuugaacccgggaggcagagguugcagugagccaagauugugccauugcacuccagccugggcaacagagugagacuucgucucaacaacaacaacaacaacaacaaaaauacaaaaauuagccaggcguggugguacgcaccugugguacgcgacagagcgagacuccgucucaaaaaaaaaaaaaaaaaguguggaccauucaguuacuuaauaaauugaacuguuagguauuucuuuuggucuagggugaaaaacuauuagauaacuaaggguggcacaaacugagaaagguuaagaaccucugcucaaccugcaaaauaaguucgauggucccaagccuaggaacucuccuuuagauauacacgggauugccagcagguggugcuacuaagcuugagucagcuggggaagaggaacuauuucuuuucuucuucuucuuuuuuuuuuuuuuuuuuuuuuuuuugagauggcgucucgcuuugcugcccaggcuggaaugcaauggcgcgaucucggcuuacugcaaccuccgccucccggguucaagugauucuccugccucagccucccgaguagcugggacuacaggagcccgccaccauacccagcuaauuuuuguauuuuuaguagagacgggguuucaccagguuggccaggcuggucucaaacuccugaccucaggugauccacccgccucagccucccaaagugcugggauuacaggcgugagccaccacgcccagccaagagaaacuauuucuuguucccaaggucugaaacacucagaguaaggggguguucacggaccagacaagauauaaagcaaaaaggggugcuuggcucacuuaguccagucauuuugaaacuaaaaaaaaaaaaaaaagucaaaagaaucuccuuucaaauaaaaucuuaaaauaaauaaaagcagagccauuucuuaagugggcuaagggaggcugauacccuacgacagugagggcagauaccaaagcccaaagaagggcaccugggaaaacugcagguauagggaauacugugggaaaauuacucaucugaaucaaucuccacuucagagagugaaccaaggcucacaagcucugauaucacaggugcagaauuguucuggaauacaggucucccaacagaucugaaaaggaagaucaaaacuucuaccucauccuacugcucucaaagccagaaggaucagggcucugcucuaacacccacuccuguaagacccugggcaaaucauuucuacugaagaguucacuuuccucaucuguaagauagagaauauuuaucucacagggauguuguaaagauuaaaugagacaagaugagaaauacucaguaaacuauaagaauauacagaauuuuuuacucugguugggucuggauuaaaggaacaaagccuagaguacuucccuaggaaguaguagggagcuuagccgagugugguggcucaugccuguaaucccaacugcuuagguggcugaggcaggaggaucacuugagcccagauguucaagagcagccugggcaacacagcaagaccccaucuuuauaaaaaaaauauuuagguggggcuaauggguuuuugaguauuguaaccuauaauaaaaugaaccuuuuuuuuuuuuuuuuuuuugagacagagucucacucuguuccccaggcugcagugcaguggugcgaucucagcucacugcaaccucugccucccagguucaagcaauucuccugccucagccuccugaguagcugggauuacaggcaugcgccaccacgucuggcuaauuuuuguauuuuuaguagagacgggguuucaccauguuugccaggcuggucucaaacuccugaccucaggugauaugccugccuuggccuccuaaagugcugggauuacagguguaagccaccgcaccuggccuaaaaugaacuuuugacuuaccaucaaguauuuuugaauaauaguaaaguauuuugaccuugugugggaaaggcauagauuuuguuuucuggugacccccaagugacauuuguuauuaaccucaucauuuccccacuccugccauccucaccuugcaaagccaacaccucugcuggucccacugguaucucgaaggauacggguggagauaaccuggccaaagggcuucagcauccccuccaguuccugcucauccauugacagugggagguuugagauguauaaauuugugggguccuguuccuguugcuguggaaauaacagugagaaaaugaggcucacaucucuuaucccucucccacccucagcccuccccacaaaugacauuucagaaaagagacuauaggaagggucccacauaaacaaagauuauucuauuuguuaacacccagucccacuaccacggguuguauauugaguuccaggagggagaagugcagauuuaauauuucuaguacuauacaagcccaucauacaagucauaaaugguguuuggcugucucuuuuagaaacaggcagagcagcauucccgcucucccccagcagccggucccagaggcuggauucccucagacugccuugcuccuuggcuggcuuguuuugagcagccccuccccacuucucuuccagccacgcagaauccucuaaguaggaaugccuguucacucccugauggaggaagagcaggaggaggggagaagggaacagggagagagccagaugcagaguucacugugucaccacggagcccugaaagcuacagucuccuaggacccugaaggcuccuaaaccuuugagcuuuugucagaggguuuuacuccuggaagaagagguaggagagcccuuccaggggacagaaugugcaaaauggcaauaucauccaauaguuguauuuuuaagaauuuaagcagucacucugcccuaaacaguggucaccagcaaccuuaauccucuucugccuuuuccuuuuguuuuccuuuucuuuaaccauuacagaaaaggugucuagcaggccugccucacaagcucuauguauaauacucauaacagcuucagaaaggcaaagggacagccaggcgugguggcucaugccuguaaucccagcacuuuggaaggcugaggugggcggaucacaacgucaggagaucgagaccauccuggcuaacacggugaaacccugucucuacuaaaaauacaaaaaauuagcuggaggugauggcgggugccuguagucccagcuacuugggaggcugaggcaggagaauggcgugaagccgggaggugcagcuugcagugagccgagauugcgccacugcacuccagccggggcgacagagcgagacgcugucucaaaauaaauaaauaaauaaaauaaaauagaaaggcaaggagacaaucccaccuaacagaagaagugagagaaaagcuucuagauuucuaguagucuaggugaagacaacaguuucagacagaucugagaagagacaguuuccucccuugauguggcuucccuccugccuccccagcccacuacccagcccguauggggaacaacauuaggagguggagagcauuguucugaaauucugaguugcacaauugacuuguucagagaauguugcaaaaccaccacaagcugucugguagggaaguggggccagggugaauaauauagggaacacggggaagcagcaggaguaccggaagaggccaccuuaccuuucuugcugccaauaacuuggugaaaggaagagagcugauagagcuaccugccauagacuuugaauacaucuuccuccagcagccaggggugcucauggacugucuagaaagcaccacggauagcccuugcccacucaauuucaugguucuuaagcccucuggaaaccuuagaacuggaacuuuggugcuaaccacaaaccccuuggaggaacagacaugggguaguacccuuaccuuugccaucugugccuguacaccgcuggccuucagugcuguuacagcuuucugugcugcugaagggcugucaaaaucuacaaagccauagccuggaacagaggaaacagcaucacuaggaagugggagguguaaggaacagagagguccaggcuuuucaggagacagaggaagaguuaugauccauguaacagaaaugggagggagaaagagcuauugagagguuucagguaguuauccacaugcuccucaaacccugagaugugaucuacuuuguggcuaagaaugccaaggcaaugagcuacucuggugucccugcccuucucccucccccuuaagaaauuugagguuucaggaacuaggcucugcuaauaacccaaagccccccuacaccucuaaaagaauucacuccccucuuuucuugauauaccccagaaaugcuaggcauguagggaaugcagccucuccagagcagaccaccagccaccugcuggaagaagacccucaccaccccagcuuauagcccuuucucuuccuuccacucuuccagcucuaucuagaacugcucaaaaccccaauaaaacuacucacccucagaaaauaacacccaccaaaacacuccccaaaaaaggcauuuacaugacuuugcuaagcagaagaaaaucucacuuacccacuucuaccaccucauccagggaaauacaaaguccaaaauaagcucaguagacucaaagguguuuuguacagucuucuggccuuggggccccuaaacagcauuuucagcucuagcuaucuggucaccaaagaaucuaaauaucuccuaaucuuuuaagccuaaaaacuucagggacuucucgcugacacuguagacucaggacucucagcaguaaagggcagugucaagggauggccucacuuacuggugcucuccaacaccaaggacaguuguucucucaccuuuacauuuguuuguggucuuguccaguauggccuuaguggaaacaaucuugccauaucuaagggagaggaaaaugcaaaguaauaaucuggggggcagagacuaagaauaggacagagauucagacaucucaacaaauccaugcccuuuccaugaucuaacuuuuccuacucaaaccuucauaaaaauaaaaaagaaacgggggccgggugcaguagcucacaccuguaaucccagaauuuugggaggccgaggcuggaggaucacuugaggucaggaguuugaggccagccuggccaacaugaugaagccucaucucuacuaaaaauacaaaaauuagcugggcgucacgccaguagucccagcuacuugggaggcugagguaggagaauugcuugaaccugugagguggagguugcagugagccaagauggcaccacugcauuccagauuggaugacagagcgacacuacaucucaaaaaaaaaaaaaaagaaaaaaaagaaauggguuaaaaaugccacacuuaauauaaacccauccuccccaaagguaccuaaaagaaauaagguaacuguagucccuauaauaccaacacauuucucucuucuuucccagcuaagacucacacacuaguuggaaagagaugacugucuuuuggggaaagaagcuuggcaauguccacacgaaagaguguguagaggcagagcucuggcuggaauucccugaggacuaaaaagaauccuugccauuacuuauuuucuuuuggaaaacaccacugauccuaugaaaaaacuauagacauuuuucuucucugauauccuauuuccaucaccccuccacugaccccuuuaauugaaggucaaccugagccaaauugcuuugguucaaauccugguucugccacuuuuuagcuaugcgugaucuugaacaagucauugaaccuuuuggugucucagccucaucaucuguaaaauggagauaggauuguuaggacugugaauuaauaaacagaaaucauuaauguguaccacaugguaagcacuuaaaauuuuuaauugcuauuauuauauucaaggaaccucaacuuuaauaucucuuugccuuacucuaagacuucuauuucucauugucaagauuugagaguguuagggaggggagugggaacuguaguauuaaaaaaaaaauugugugugugugugugcaucagggucuggcucuguugcccaggcuggagugcaguggugugaacauggcucacugcagccucgaacuccugggcucaagcaauucuccugccucagccuccugaggaccaaagguguguaccacaauguccggcuaauuuuaaaaauuauuuguagagacaggaucuuacuaugcuacccaggcuggucuuuaacuccuggccucaagcaguccugcugccuuggccuccaaaagugcuaggauuacagcugagagccaccaugcccagcucuaagaaaaucaucuuauaaacaaaaaaccaucuaaauuuuggugauaaggccaaagggcugcauauccuuucuucuucuucuucuuccuucuucuucuuucuucuucuucuuccucuccuuccucuuccucuucuccuccuucuccuuccucuucuuuuuuuuuuuuugagauggaguuuugcuguuguugcccaggcuggagugcaauggugugaucucagcucacugcacccuccgccucccagguucaagcgauucuccugccucagccucccgaguagcugggauuacaggcgccugccaccacacccagcuaaguuuuacauuuuuacuagagacgagguuucaccauguuggccaggcuggucucaaacuccugaccucaggugauccacccgccucagccucccaaagugcugggauuacaggcaugagccaccacacuuggccaaguuauagauuuuuguccaguaaaaaugcaaauuauuucugugcaguagauaaaauaauugcaaagguuaguggcuuuacuauccuauaggacauaaaccaguuuuuaucuaauguagcaaucuuauuccaacauucuuucuucauuuccuauaaauaguuccucaaaugcucuuugaacucauuuugccauccugcugguucccucauuaaugaguuauaaaaaucuuugacacauauucauuuuauauuugcaugacaguuguguuuucuuuuuguuuucugaaacagaguuucacucuuguugcccaggcuggagugcaguggcgugaucucggcucgcugcaaccuccgccucccggguucaagcgauucuccugccucagccucuggaguagcugggauuacaggcaugcgccaccacacccagcuaauuugguauuuuuuaguagagaugguguuucaccauguuggucaggcuggucucgaacuccugacuucaagugauccaccugccucagccucccaaagugcugugauuacaggugugaggcacugugcccagccuaacaguuguguuuuucaacuuuuugaaaauuauacuuugguagcagagucauguggaacuucuaaaacuugaguaguaguguaucacagaucagggauuauauuagaagcguuccacuagaaaaaagccucuacauuccacuccaggagggugaaaauauuaaagagacagaacagaaaucacuaacaaagucagaaguacaagagcuaacugaaaauaguugucagggaaugaauuugagaauaauaccccaaacaagcaauuuucccaucucuccuuccaucccuaaagaacauaugaugauugauuuguuuucacuccuuggcggcaucucacugacuuuuuuaguagaacuucugugauccaaaggauuagacagaauaagccaagcaaugcccugaaagcugggaacagaacacauuaaaaggagggugaggauggauguggcuauccuagcccuuccaggcuacacacuuggauucauucccaaauugaggcaggggagggacucaugagaagucugacuguggggcagaggacacaagugcugcuauccuuaugaaggccccaggguggagcuugcuguggucuagcagcugagacuuugagcucagaauuuccacugcagcuggcaacagcugggucacugcugcugcuuccuugaaggagccccuccgagaaacaggaguuccaguccuagacuccacgccucuccuucccacaugccagacuuuaggauccagcaauauuuacuuccucuacaacccagggagagacaacugggacaaaggcaggaaguccgucuacgcaugagaaacauccuuccuagaaaggcuuaacucccugcucacagcggacagagggcuccacccaccugcucugcucagccuccuagucaggacuccucuggcaccucuuucauuccugccucacuccugccucuccacaguccccuuuugggcuccuuacuucgauccuacaugcugcccuugacuauacuuaugcuucagacacagcaaaagauaaggcaauuguucagaaaggcaaaauaaaaaucccucuguaucuguggguuucccacuuguggauugaaccagccauggauugaaaauauauaggaaaaaaaaaaaagucuuucuucuaagagagguucagggaaaaaaaacuaaaaaaauaacuguuggguacuaugcuuaguacccaggugacaaaauaaucuauacaccaaauacccaagucccgaguuuaccuauguaacaaaccugcacauguaccccuuaaccuaaaauaaaaguuaaaauguuuuuuaaaagaaaggaugguugcaucuguacugaacauauacagacuuuuuucuugucauuauucccuaaacaauacaguauaacauuuauuuacauggcauuuguauuguauugagguaucauaaguaaucuggagauaauuuuaaaguauauaggagcaugugcauagguuauaugcaaauacuacaccauuuuauuuuauuuuauuuuuauuauuuugagacgaagucuugcucugucacccaggcuguggugcaguggcgugaucucggcucacuacaaccucugcuuucugguggcgugaucucggcucacugcaacgucugcuuucuggguucaagagauucuucugccucagccuccugaguagcugggacuacaggugcccaccaccacacccagcuaauuuuuguaguuuuaguacagacgggguuuaaccauguuggccaggcuggucuccaacuccugaccucaggugauccacccaucuuggccucccaaagugcuggaauuacaggcaugagccaucaugccuggccacuauaccauuuuaucuaagggacuugaagccaggcucaguagcucaugccuguaaucccagcuuuuggggaggccgaggcaggaggaaugauugagcgcauaaguuugagaccagccugggcaacaugaugaaaucucaucucuacaaaauuuacaaaaaauuagccaagcauggugguguguaccuguaguccuagcuacucaggaggcugaggugggaggauugcuugagcccuggaggcuacaguuaguugugauuacaccacugcacuccagccuuggugacagaacaagauccugucuuaaaaagaaaaaaaagcguagggacaugagcucagugaauuuugguauccaugcagggggacagaggagguccuggaacaaaucccccccagauacugaggaacgaauauaugguagucuaaucaagauucuucucugagcgaggcacgguggcucacaccuguaaucccagcacuuugggcggccgaagugggcagaucaccuggucaggaguucgagaccagccuggacaacacaguaaaaccccaucucuagcaaaaaaaaaaacaaaaauuagcccgaugugguggcgugcgccuauaaucucagcuacuugggaggcugagacucagucuuaaaaaaaaaagauucuucucugucuugugaugugagagaauuuuuguagcacauuauauuuaguacaagaaacaaaauuuagaaaucaaggaccuauauuaguaugauacucuuucgcucccucaaaaaccaacauuucugcuaauucccaccucucaaaaauuacuaguccaagacaguccccuuaauuccacuuacauaccuuucuagcaagguaagcugagauaacggaccaguuuuaaaauuuuuuuuaauauauauuuuuacuauauuuuuuauagagacaaggucucacuauguugcccagccugguuuugaacuccugagcucaagcaauccuucugccuuggucucccaaggugcuaggauuacaggugugagccaccacgcccggcccaaggaccaguuuuuuauauacaccagacuuuauuuuuuauugcuuauuauuuuuugagcuggacaucugugcacucuugccauuuuuccaacauuccuaauugggcaauuccaugaaucaaaucuacuaaaaagaacuccgaagggucuucaugggguagauacagaauaauuguuccuaucuccaccuucuuuaucugcuaauuugaggucuccauucccaaggaauaucuccagcagcagaaagucuccaaagugcaugauuugauuggcgagucccacuuucuuccauccccacugccagcucucucaugccuucuaauuaacaucuauagagauauuaaacuucucuauucaagguguaaggacagcagucuuuccacuaagaccaucagguugggggaggugcuggaaauaaaguuggauauuaggcuuuaaaggccagucccacacuggcuuuccuuagagaaacacauaaaggcuuuauaauauauaucaguagcagguagauuuuuauuuauuuuuauuuuuuugagauggaaucucacucuauugcccaggcuggagugcaguggcaugaucucggcucacugcaagcucagccuccaggguucacaccauucuccugccucagccuucuaaguagcugggacuacaggcacccgccaccaugcccggcuaauucuuuuguauuuuuaguagagacgggguuucaccauguuagccaggauggucucgaucuccugaccucgugauccgcccgccuaggccucccaaagugcugggauuauaggcaugagccaccgcacccggccaguagcagguagaauuuuuuaagaggcugcugagaaaguuugugucuauggaguagaaacaaaaugccauugccuuuuaggauaagugagcuggcaaggccaggagugguggcaugcaucuguaaucccagcuacugagacaggaggaucacuugagcccaggaguucaagacuagccuggacaacauaacgagacccugucucaaaaccaaaucuauacugucccuggaagccuacgcacauguacuccaacuuacggcugacacagcuugacaagaucuuggucaguagugccugguugcaauccucggauguauagguugguuuugcucagcuggucauuuccauugcuuccacuacugcuguuagguguacuguugcuugggcuagguggugccaucugcugagccaaugacacauauggcugcagggagacaugaggaagagguagaaggauuauccauuuacauguuggagagugaggaagauccuggaccucuugaaaaaaugauuccaaacuauauauaaucacaaaugugcacucacuuggacacacauaguuuguuccuuagcucuauauuuuagcagagaagaagaaauuaauaccacauugugagauagcccaaagacuuaaaauccuguuguagcuuuuaauacauccuuuauauuuccuauuccuuuuucccucuuuuugccagcacuuacauuaggauuucccagauaacagucuguaggcugggcgugguggcucacaccuguaaucccagcacuuugggaggccgaggcaggcggaucaugaggucaggagaucgagaccauuguggcuaacauggugaaacccugucucuauuaaaaauacaaaaaaauuaguugggcaugguggugggcgccuguagucccagcuacucaggaggcugagccaggagaauggcgugaacccgggaggcagagcuugcagugagcugagaucgcgccacugcacuccagccugggcgacagcacguuuggaaaagaaaugcaggacgggcgcgguggcucacccuuguaaccccagcacuuugggaggccaaggaggggggggguggaucacgaggucaggaguucaagaccagcugaccaacguggugaacccccguuuauacuaaaaaugcaaaaaaaaaaaaaaaauuagccaggugcaguggcacucgccuauaaucccagcuacucaggagguugaggcagaagaauggcgugaaucugggagguggagcuugcagugagccgagaucacgccacugcauuccagccugggugauagggcgagacuccaucucaaaaaaaagaaagaaaugcaacucaaaaccacagugggauaccaucucccaaaagucagaauggcuaguauuaaaaaguaaaaaaauaacagaugcuagugagguuaugagguuauggaaaaaagggaacacuuauacacuguuggugggaguguaaauuauuucaaccauuguggaagacaauguagugauuccucaaagaccuaaaaacagaaauaucauuuagcccagcaaucccauugcuguguauauacccaaaggaauagaaaucauucuaucauaaagacacaagcauguguauguucgcugcagcacuauucacaauagcaaagauaugaaaucaaccuaaaugcccaucaaugguagacugaauaaagaaaagauuguacauauacacauggaauacuacggagccauaaagaagaaugagauccuguccuuugcaggaacaugguuggagcuggaggccauuauccuuagcaaacuaaugcaggaacagaaaaccaaauaccacauguucucacuuauaaagugggaacuaaaugaugagaacacauauuuacauuaaggggaacaauacacacuggggucugucugaggguggagggugagaggagggagaggaacaggaaaaauaacuaauaggucaugaggcuuaauaacugggugacaacauaauuuguaaaacaaacccccaugacacaagauuaccuguauaacaaaccugcacauauacccaugaacuuaaaauaaaaguuaaauaaauuuuaaaaagaaucacuuugaaauuuccauuuaauuacuaguucugcaauaauaauaauacacugguccaggcacaguggcucacaccuguaaucccagcgcuuugggaggcugaggugagagaauugcuugaacccaugaguuugagaccagccugggcaauauaacaagaccccaucucuacaaaaaauacaaaaauuaguugaggcagggugcaguggcucacgcccguaaucccagcacuuugggaggucgagguggguggauugccugagcucaggaguucaagaucagccugggcaacaggugaaacccugucuauuaaaauacaaaaaauuagccaggugugguggcaugcaccuguagucccagcuacucaggaggcugaggcagaagaauggugugaacccgggaggcagagguugcagugagccgagacugcaccacugcacuccagccugggcaacagaaagagacuccgucucaaaaaaaaaaaaaauuaugaagguugugauaaauauauauuucauaaagauaaaacgcagucaagaagacuaugaccuauggccggguacgguggcucacaccuguaaucccagcacuuugggaggccgaggcggguggaucauuugaggucaggaguucaagaccagucuggccaacaugaugaaaccccgucucuacuaaaaauacaaacauuagucaggcgugguggcacaugccuguaaucccagcuacuugggaggcugacacaggagaaaugcuugaaccugggaggcggagguugcaguaagcugaaaucgugccacugcauuccagccugggugacagagggcgacuccgucucaaaaaaaaaaaaaaaaagaagauugugaccuaaauccuuuuuuuuuuuuuuuuuuuuuuuuugaggcagagucuugcucuguugcccaggcuggagugcaguggcccgaucuuggcugacugcaacgucugccucccagguucacaccauucuccugccucaggcuccugaguagcugggacuacaggcgcccgccaccacgccuggcuaauuuuuuguauuuuuaguagagacggaguuucaccguguuagccagaauggucucgaucuccugaccucgugauccgcccgucuuggccucccaaagugcuaggauuacaggcaugagccaccgcgcccggccgugaccuaaauucuuaaucacaguuccugaguuuagaauaaggaguucacugcuggagaucauuaaauaagauauguccuucuuggccgggcacgguggcucacgucuguaaucccagcacuuugggaggccgagguggggagaucacgaggucaggagauggagaccauccuggcuaacacggugaaaccccguuucuaccaaaaauacaaaaaaaucagccaggcuuaguggcgggcgccuguagucccagcuacucagggaggcuaaggcaggagaauggcgugaacccaggaggcagagcagagcuugcagugagccgagauugugccacugcacuccagccugggcaacagagcgagacucugucuccaaaaaaaaaauguccuucuuuaucucuaaggaguugcuauuauugauccuuagcugagaaaacaaagcugcuucucugaauaugagacuguaggucugucagcgaugagggugaugaugaugauagccacgaugucaacaguaacaaugauaauaaaagcaacugucagcuggcgcgguagcucaagccuguaaucccaccugcucaggggguugaggugggagguuggcuugaggccaggaguuagagacuagccugagcaacauagugagacccuaacucuuaaaaaaacaaagaggccaagcacaguggcuuaagccuguaaucccagcaaauugggaggcugaagcaggcggaucccucaagcccaggaguucaaaaccaaucugggcaaccuggugaaaccccacaucuauaaaaaaaaaaugcaaaaauuaggugugcaugguggcacacaccuguagucccagauacucacagggcugaggugggaggaucacuugagccuggaaggcagagguguaaauguugcaguaagcaagaucgugccacugcacuccagccugggugacaaaguaagauucugucucaaaaaaaaaaaaaaaaggaaaaagaaaaaggaaggaaagaaggaaggaagggagggagggagggagggaaaaaaagaaagcaacuuuaguagcaccauacuaugugccaagcacaagcagaugaagagaccaccugccucaguuggcguucaucuauccccauucucaaugugagauaauguuucugaaagaaaguaucagugaugccaggacuguccaaacaagaauacaaggguuacuggggaaauaaauaaauugaagagaggcagcugguggcucacgccuguaaucccagcacuuugggaggccgaggcuggcggaucaugaggucaagagaccgagaccauccuggccaacauggcaaaaccccgucucuacuaaaaauacagaaauuagcugggcgugguggugcgugcuuguagucccagcuucucgggaggcuggggcaggagaauggugugaacccaggaggaggcagagcuugcagugagaugaguucucgccauugcacuccagccugggcgacagagcaagacuccgucucaaaaaaaaaaaaaaaaaaaaaaaagcccgggcgagguggcucaugccuguaaucccaguacuuugggaggcugaggcggguggauccacuugagaucgggaguuggagaccagccugaccaacauggagaaaccccgucucugcuaaaaauacgaaauuagccgggcgugguggugcaugccuguaaucccaguuacucaggaggcugaggcaggagaaucgcuugaaccugggaggcagagguugcggugagcugacaucgcgccauugcacuccagccugggcaacaagagcgaaacuccgucucaaaaaaaaaaaaaagaaaagaaaagaaaaaagaggcuauugguuugcugccaugcuuaccaucuugguuuuaauacuaaggucuuagcuauaguuuaaaaauaugacuuagucaauaauaaacuuacuacaaggccugaaaaaauucuuagaaaagaagauacggcucagaagaaaacaacuuuucugccuuuauugagcuuacagucagcaaaaauacugugggacuggucccucucaucaggagguaaauucuuuaggcuuuuugcucuauaguaagccauugcuuacuauaaaacaacuuuuaucucuugcuauucucacguaccuucugaaauugcugcauagguuugacaccaaagaaaaaugguggaaaaauauucacuuuuaaggguaagagaauacaaggggggagaaaugguuaagaaagccccuaaguaaagcuuaucuggcuuccuaaaacacuuuggagacaaagacccuguaaacuaauaauauguuuaccuauaauauguaagagagaaaaggguaauacguaugagcacccagggaacugacauauucuuaccggagaagggaagaauaaaaagaagcuaugguuucuccagaacccuaccauggauucccuucuuauguuucucagcugaggaaguucuaauucuucaacaagagagcaucauaaaugcguuuauuuccaaauugauagagagaugaaggcuaggguaggcaauggcuuacuauagagcaaaaagccuaaagaauuuaccuccugauuagagggaccagucccacaguguuuuugcugacuguaagcuccauaaaggcagaaaauugucugaguugccuaucuuugaauccauagugacuuuauugaugaauaaauaauaucaucaguuaauauuaucaguuaauaucaucaucaugaaugagcugccuucucagcuccauucaaucacugauaaagugaacuaccaagggagcaguuuuaccucuauacuucuuucauguuauuuuggccuuaaauauaguucagaaugugguuaguauuaguucucagcagcugcuuaaaagcuaaaagacaggccaggcaagguggcucacacccauaaucccagcacuuugggaggcugaggcggguggaucaccugaggucaagaauucaagaccagucuggccaacguugugaaacccugucucuacuaaaaauacaaaaauuagcugggugugguggugcgugcuuauaaucccagcuacuccagaggcugaggcaggagaaucgcuugaacucgggaggcagagguugcagugagcccagaucgcgccacugcacuccagccugggugacagagugagacucugucaucaaaaaaaaaaaaaaaagcuaaaagacaaagucauguuuaguauaagaggagauuacagugacauacuuuuacauuaaauacuuuagaucauaugauccccagagauuuuuauaggguaucuuacagcauaauucucuauccuuuauuuauuauuuuucaggucucgcuauguugcccaggcuggucuugaacuucugggcuuaagcaauccuccagccuuggccucccaaaaugcugggauuacaggccugagugagccacuguguaguauuauuuaaauacuacaccaccaauuuauagggaauugagguuauuucucacucccucucuccuuuuuuuuuuuuuuaagacacagagucuagcucugucuuccaggcuggagugcuguggcaugauuaugcucacuguaaucucaaacuccugggcucaagugaucuuccugccucagccucccaaguagcuaggacuaaaggcacacaccaccacacauggcuaauuuuaaaaaacauuugugguggcuuaugccuguaaucccagcauuuugggaggcugagugaggggacuguuugaggccaggaguuugagaccagccugggcaacauggugagacccccaucucuacugaaaauacaaaaauuagcugggcauggugguaggcaccuguaaucccaccuacucaggagacugaggugggaggaucacuggagcccaggagguggaggcugcaugagcugagaucgugucacugcauuccagccugggugacagagugagaccuggucucaaaauaaaauaaaaugcauagaggcggagucuugcuauguugcccaggcugaucuugaacuccuagccucaaacaauccucccacuucagccucccaaagggcuuggauuacagguaugagccaccauaccuggccaaggucuucuucuuccuuuuuuuuuuuuuuuugagaccaaguuuugcucuuguugcccaggcuggaguacaauggcgcgaucuuguaucaccgcaaccuccgccuccuggguucaagugauucuccugccucagccucccgaguagaugggauuacaggcaugugccaccaugccuggcuaauuuuguaccaaggucuucuuaauauuaugucugaaagaucucagucucaguccuagacaauuaaaaaaaaacaaaacagaaggaauugcuauauaauuuaaacaaaaguaacuuucugagucagagagagguaguccucaagauguugagggccagcucacuaaguagguauccagguacuuggcugccugccucaaagcccuaaaucuuuuuuuuuuaaaguguauauauccuuuuauucagaaauuccacuuguagggaugcuuauauaugugcacaaauauauauguacaaggauauucauugcaucauucguuauaauaguaaaauacugaaaaagcauauacucaucaaugagaaaacugguuacauaaauuauagugcauacauaaaaggaguaccauguaagccauuaaaaauaauauggcacauccauguaucuuuuccuggaaggauacuaaaaauauacuacuacaugaaaaaacuaagcuguuuaguaccgccacuaccacuguuaauauuacuauuuuauuuuauuuauuuauuuaaaacauuuuauuuuaaguuucaggauacaugugcgaguuugcuauauagggaaacaggugccauggugguuugcugcaccuaucaacccaucaccuagguacuaagccucacaugcauuagcuauuuaucuugaugcucuuacccugccuguccauacaacaggccccaguguguguuguuccccucucuaugucuauguguucucauuguucagcucccauuuauaagcaagaacaugcaguguuugguuuucuguuucuguauuaguuagcuggggauaauggcuuccagcuccauccauguccaugcaaaggacauaaucuuguuccuuuuuauggccacauaguauuccaugguauauauuuaccagauuuucuuuauccagccuaucauugaugggcauuuggguugauuccaugucuuuucuauugugaagagaaagcucuaaaucuuuaaauaugcuuuccacaaaggcaucucaaguucuccuggauccuugacagcugauaggggaaacaucaagccucugcagacagaugacagcucaauaugggugaauuaucuauaucugcaaaggaaggagaauuuuguccuucguucuaauuuuagaagaauucggccgggugugguggcucacgccuauaaucccagcauuuugggaggucaaggugggugaaucacuugaggacaggaguucaagaccagccuggccaacaugcugaaacccugucucuacuaaaaauacaaaaauuagucgagcauaguggcaugcgccuauagucccagcuacucgggaggcuggggcaggagaaucgcuugaagccaggaggcggaggcugcagugagccgagaucgugucacugcacuccagccugggugauagaguuagauuccaucucaaaaaaaaaaaaaaaacaaagaaauuaaauuacaagaauucuuuuuuuaaaaaagacucaauuuuuacagacucuucgucagaugcaguggcucaaacuuguaaucucagcacuuugggagaccaaggcggguggaucacuugagcccaggaguuugagaccagccugggcaacaugguaaaaccucgccucuacuaaaagaaauacaaaaauuaggcugggugcaguggcucaugcuuguaauccuagcacuuuaggaggccaucgugggcagaucaccugaggucaagaguuugagaccagccuagcuaacauggugaaaccccaucucuacuaaaaguacaaaaauuagccggacuugguggugugcgccuauaaucuuaguacuggggaggcuaaggcaggagaauugcuuaaaccugggaggcggagguuguagugaguagagaucacaccacugcccuccagccugggcgacagaauaaucuuuaucacauacacacacaaaaaaagaaauacaaaaauuagccaggcaugauggugcauggcugcagucccagcuacucaagagacugaggugggaggauggcuuaauagagugauacucugucucaaaaaagacuccuggcagggugcaguggcucacgccuguaaucccagcacuuugggaggccgaggcaggcagaucacauaaggucaggaguuggaaacuagcuuggccaacauagugaaaccccgucucugcuaaaaauacaaaaauuagcugggcgccuguaaucccagcuacucaggaggcugacacaggagaacugcuugaaccugggaggaugagguugcagugagccgagagugcaccacugcacuccagccugggggauaaagcgagacucugucucaaaaaaaaaaaaaaaaaaaaaaaaggacucuuaauuuuaaaagaauaacuauuacugauauuuggcacuuguuguauauggugcuaaguauuuuauuuauuuuuugagacagggucuugcacugucacccaggcuggagugcaguggcaugaucaugacucacugcagccuugaccucccaggcucaagcaagccucccaccucagccucccgaguagcugggacuacaggcacuugccacuacauuuuuuaauuuuguagagacacgcuauguugcccaggcugguuucguacuccugggcuugagggauccuccugacuucgccucccaaaguguugggauuacaagugucagccacugcaccuggccugugcuaaggauuuuauaucuaccaucucaguuauccuaccucucuugcuuuccuucugcuuuuacguguggcugcucacucugagaagggagugaugcuucugggaauagaaauguccuuuccacacgggugucuucacacaucuuuauaugcuaaauuccagucauccaacuaaccuuaaaucugcuguucccuagcauccugcuuugaauuugaauaaucaaucaaaguuuccuuuucugucuugguaaccaaguggguacugucuagguuucacuggcagauccaaagucaaaaaagccccagccuugagacuacuucccaccuccagggaauaaaacugaaauuccugcauuucacacaaaaaaaucagugaaauacuagaacuuuuuaaaaacauuacuuccuuuacaugccuacguuucuaaggcaauacauuagcuuuuaguuaauaaaucauacuucaagacucgucaucacacuaccaggcuuuucaugccuuccucugucacccaggcugagugcaguggcacgaucucggcucacugcaaccucuaccuccuggguucaagcgguucuccugccucagccucccacguaccugggacuacaggcgcaugccaccaugcccggcuaaguuuuguauuuuuaguagagacuggguuuugccauguuggccaggcuggucuugaacucccgaccucaggugaucugcccaccucggcuucccaaaaugcugggauuacagguguaagccaccaugccuggccucaaguacucaaauguuuacuaagugaaugaauuaacccauguuuauucugaaagcauucaacauauauacaucaagcagguaaucucaaauucugcaagucuaaaauuaauuucuguaccuuuuccugaacucccuuauuucuaauaucucuuaacuugucugacugccucuguucuccuacaccuccaaaccacccucaauaaugcagcuagcauuagccuucucaaguauaugugaucaugucauuucucucuauauaaacccauuaauguugcucauucacuuccagucuacuucauaagaagacucauaccuagaauacucuuuuauuggauuucuuuacauauuucuuugcuacaugaugauaugcuaccaucccuuacuucuaaaagcaaaucuaauaucaucccagacaucuaagauuuuaggccacaugugauggcucugcuuaaaucuugaaaucaugaggggcacaguacaauuaugaguccucuucuaaauaccacuaauucaaaugacuuccgccauuccaccucaugagcauaaaccaagguuaugaguaaaaaccugcaagguuucguuuucuaggagccaaauaaaaccgcaugccauucaaaggagugaagcaaauugauggauguuagagcagagaucuaucccuuuuuuuuuucuuuuuuuuuuuuugaaacagggucuugcucugucacccaggcuggagugcaguggugcgcgaucauagcucacugcagccucaaacuccugggcucaagugauccuccugcuucagucccccaaguagcuaggaauacagaugcaugccaccauaccuggcugauuucuaaauuuuuugcuauguuguuuaggcuggucuugaacuccuggccucaagcaauccuccugccucagccuaucccuucccuuccucccuuccuuuuauuauuuauuuauuuauuuauuuuuuugauacagagucuugcucugucacccaggcuagggugcgauggcgcaaucucggcucacugcaaauucugccuccuggguucaagcgauucuccuaccucagccuccuaaguagcugggauuacagaugugugccaccacacccagcuaauuuuuguauuuuuaguagagacgggguuucaucauguuggccaggcugcugucaaacucccaaucucaugugauccacccaccucggccucucaaagugcuggaauuacaggcguaaagccaccaugccuggccuuuuuuuguuuuguuuuguuuuuuugagaaagggucucacucugucacccaggcaggguggaauguaaugacaugaucacaguucacuguagccucaaccuuccaggcucaagugauccucccaccucagccuccugaguaacugagacuacaggcacaugcaaccacaccuggcuaauuuuuguauuuuuguagagacaggguuucaccaugucgcucaggcuggucucaaaacuccugagcucaagcaaucugcccaccucagccucccaaagggcuggcauuacagguaugagccacugcaccuggucuagucuaucccuuucuuaagagaaaccuggagaacugacaauucagccaauucaugucuucuaauaacccugacauugauucucacaugaaaaugacauuuaggacauaucaauaaauagcaaaugagauuuaagauuuagaaucugcugcaguuuaugaaauccaccauaguauaggaggauuaaggaaaacaucuggcucuucauuuucuuuuuuuugcgagacggaguuucgcucuuguugcccaggcuggagugcaauggcaugaucucagcucacuguaaccuccgccuccuggguucaagcgauucuccugccucagccuucugaguaacugggauuacagugcccaccaccacgcccgguuaauuuuguauuuuuaguagagacgggguuucuccauguuggucaggauggucucgaacuccugaccucagguggaucugcccgccucagccucccaaagugcugggauuauaggcaugagcccccgcaccuugccuggcucuucauuuucuagcauagggccugacauaagacugauggcccuugagaaccauuucaaacuaguaugagugauaauacaguccuauccuucccuuccccagaacauucauuaaucugagggaaaggcugguggggacguggacauaaaaauauauaacuccuucaucuuucacccagaaaaagaaaaaucgaauuccccuguaccuguagcagaaacuucauguuuccugucuuacugagucgcaugaaacuaggagaaaagagaguguccuuccauuugcucucuuucaagagauuauaaugauagaaggaggguggcacaaugccuacuucccaaucacuagguuuucaucagaucuuuuaagagaaugauccaaucagacgagcuacuuguaauuauaaucuaguauaaguaaaacauugucuuuaaagaagcuguauuucuggcccggcccaguggcucaagccuguaaucugagcgcuuugggaggcagaggcagguggaucgcuugaggucaggaguacaagaccagccuggucaacauggugaaaccccgucucuacuaaaaauaaaaaaauuagacgugguggugcacaucugugaucccagcuacucgggaggcugaggcacaagaaucacuugaaccugggcgucggagguugcaaugagccgagaucauuccagccugggugacagagugagacuuugacucaagaaaacaaaucaaaacaaauaaagaaguugcauuucugaaaauuaagcucuccgaucaagugcucauuuaguuuagguucauaaaauuuaugaauccuguauccauucauuugccaucaaagucauccucacccugggcccuuaacuaugaacugccagagcaguagaaaacucaaucccacaucugauaccuagcuaaguuccuggcacauaauaggcauggauauuuguuaaaaugagugaaauaaacacaugguuugcuaauuguguaucauguuaauaaaucccuaaaaagucucacagauacacaauccagcagccuaacaucaaaauuccuaaugcaacgggaauguggaugauccacaauacauauuccuggagccaguggucuccaggacauauaacauaacugaacguuugccuaaaauacauuauuuccuggguuccaagucauuguaucaccuaauaagagaaaguccacuuucucugagaaguaacagaccccauaauaauuacccaugagauccuuugcacuauuucagucauucagcaaauauuuguuuguuuguuuguucuuugagacagaguuuuacucuguugcccaggcuggagugcaguggcacaaucucagcucacugcaaccucugccucccagguucaagcaauucuccugccucagccucccaaguagcugggauuacacgcaugcgccaccaugcccggcuaauuuuuguauuuuuaguagagaugggguuucaccauguuggccaggcuggucucgaacuccugaccucaugugaucugcccaccuuggcagccucccaaaguucugggauuacaggugugagccaccacauccagccaagcaaauauuugaauaccaacuauguacaaacacugcuugaugcucuggggacucauagaugaaugguguaugagugacguauuucauaauauauuuauuuauuaacaugcuccacagggagguacauaauaaauuuaaaugcacauccacaaggagucacuaacaaguucacaaacuagagcuuacaaucuagaaaaguagcagaaugggcugggcacgguggcucacaccuguaaucccagcacuuugggaggccaagguggguggaucaccugaggucaggaguucaagaccagccuggccaacauggugaaaccccgucuuuacuaaaaauacaaaaaaaauuagccaggcgugguagugggcaccuguaaucccagcuacuugggaggcugaggcaggagaaucgcuugaaccugggaggcagagguugcagugagcugaggucaugccauugcacuccagccugggcaacaagagcgaaacugucucaaaaaaaaaaaaaaagaaaagaaaaguagcagaacaaaauauuugugcuaaugguauaagaauaugaaagaagacacaauuaauuccugagggugaagucucucaaaaaagacacuugggccuugaaaggauaagcagagcaauaauuaauuauuuuuuuaaauagagacagagacucauuaugugcccagucuugucucaaacuccuggacucaagcaauccuccuacuuuggccucccaaagugcugggauuacaggcaugagccaccauacccagccagaacaauaaacuuuuuucauuuuuguuuuuucagauggaguuucgcucucauugcccaggcuggagugcaguggugcgaucucagcucacugcaaccucugccucccagguucaagcgauucuacugccucagcuuccugaguaggugggauuacaggcacccgccaccaugccuggcuaauuuuaaaaauauuuuuuagcagagaugggguuucaccauguuggccaggcugguuuugaacuccugaccucaaaugaugccacccgccuuggccucccaaagugcuaggauuacaggugugagccaccgcacccggcccagaauaauaaacuuuuaauggaaagccaucaaggaaaugcaaaucaaaaucacaacaagcuaucacuuuauaccuacuagaauggcuauaauaaaaaagacagauaaguucugguaaggguguaaagaaauuggaaacuggaaaccucguauaccauuuauggcauugcaaaacgaugcagcugcuuuggaggauaguugggcaguuccucaaauguuuaaagcauaaaguuaccaugugaccuagcaacuccacugcuagguauacaccuaagagaauugaaaacaugcccacacagggccaggugugguggcucaagccuguaaucccagcacuuugggaggcugaggcagucggaucauuugaggccaggaguuuaagaccagccuggccaacauggugaaguucugucucuacuaaaaauacaaaaacuaggcugggcacgguggcucaugccuguaaucccaguacuuugggaggcugaggcagggggaucacaaggucaggagaucuagacuauccugguuaacacagugaaacccugucucuacuaaaaauacaaaaaaauuauauuuuuuguauauaaaauauaauauacauuuauuuuauauuauuuuauuauacauauuauauuauacauuauauuuuacauuauaauguacaauauauuauacauuauauuuuacauuauaauguacaauauauuguacauuauauuuauaauguauuauaauguauuauuauuuuuuauaauguauuauuuuauaaugcauuauacauuuauaauaacccaugguggcgggugccuguagucccagcuacucaggaggcugaggcaggagaauggcgugaacccgggagguggagcuuacagugagcugagaucgcaccacugcacuccagccugggcgacagagcaagacucugucucaaaaaaaaauaaaaauaaauaaaaguacaaaaauuagccaggugugguggugcaugccuguaaucccaacuacucggaaggugggguauaagaaucacuugaacccgggaggcagagauugcagugagccaagauugugccacugcacuccagccugggcaacagagugagacccugucucaaaaaaaaaaaaaaaaagaaaagaaagggaagaaaacauaugcuuacacaaaaccuguacacaaauuucacagaagcacuauucauaauagcccaaaguggaaagaagacaaauguuuaucaacugauaacuggauaaauaaaauaugauauauucauaugaugaaauauuuauucagccauaaaagggaagaaaguacugauacaugguacaaugugaaguaagcccaauaacauuaugcaaagagacagaagccaaucacaaaggaccacauguugcaugauuccaucuauauaaaauguccagaauagggcaaucuauagauauagaaaguaaauuagugacuacuuagggcaaugggagaggagcaaugggaggauuaaguggugauagguaaguggguaggauuuccuuuuggggauaauaaaauguucuaaaauugauuaugguaguggaugcaaaacugcauauacuaagagccacugaauuguauacuuuaaauguaugaugugugaacuuuaaacuguaugaugugugaauuauaucucaauagagcuguuauaaaaaugugaugagguacauguuuauagcagcacaauuugcaaaugcaaagauacggaaccaaccuaagugcucaucgaccaacaaguggauaaagcaaaugugguguauauacaccauggaauacuacucagccauaaaaaggaacaaaauaauguauuuugcagcaacuuggauggagcuguaggccauuauucuaaaugaaguaacucaggaauggaaaaccgcauguuauauguucucacuuauaaaugagagcuaagcuaugaggaugcaaaggcacaagaguaauauaauggaauuuggggacugggaggggaaggcuggaaggagugugaaggauaaaagacuacauauuggguacaguguaaacugcucaggugacaggugcacuaaaaucucagaaaucacugcuaaagaacuuauccauguaaccaaaaaccaccuguaccccaaaaacuauugaaauuuaaauacauaguuuaaaaaaaugugaugagggccagguguggugccucaugccuagaaucuuaacacuuugguagugugaggcagguggauugcuugagcccaggaguucaagaccagcuugggcaacacggcaaagucccagcucuacaaaaaagaaaaaaaaaaaaauuaaaaauuagcugggcaugguggcaugugccuguagucccagcuacucaggaggugggaagaucacuaaacuugagaggcugagaaugcauugagccauuauugcacuacugcacuacagcauggcaacagagcaagacugucucaacaacaacaaaaugugaugaggauggguagacagaagaagacauuccaaccacuaaaacuaucuugagacguuagguuaccagacguuaccaugaacuggcauagaauucagccuagguggcaucacucuacuucauuuccagguagaaaagucagucacaggauaaauauauuuuacugaagcucaaaucauguaagagaaagaaacaaauauuuccugcaacuccucuuccuaaaaacaacaauguaaaacaagaaagacaucucuaaaacagagccugaggcagagaauacacgccacauaacugcccagcauagauggguuuuuuuuugagacaaagucccgcucuguugcccaggcuggagugcagugguaugaucucggcucauugcaagcuccaccuccuggguucaaacgagucuccugccucagccuccugaguagcugggauuacaggcaugcgacaccacgccuggcuaauuuuuguauuuuuaguagagaugggguuucaccauguuggucaggcuggucucgaacucuugaccuugugaucccccugccuuggccucccaaacugccgggauuagaggcgugagccaccaccccuggccuauagcugguuuuaaaaggugacucuauggccgggcaugguggcucacaccuauaaucccagcacuuugggaggcugaggugggcggaucacuuaaggucaggaauucgagaccagucuagccaacauagugaaaccccaucuccacuaaaaauacaaaaauuagccaggcgugguggcgcacgccuguaaucccagcuauuugagagucugaggcaggagaaucacuugaaccugggagguggagguugcagugagcugagaucaagauugcaccaccgcacuccagccugggggacagggcaagacuccacccccgccuccaaaaaaaagaggugacucuaggccaggugugguggcucaugucuguaaucccagcacuuugggaggccgaggcggguggauccuugaggucaggaguuccagaccagccuguacucuacccugggccacagagcaagacuaucucaaaaaaaaaaaaaaaaggugacucucaguacuuuuuuuuuuuugagacagagucuugcucuguugcccaggcugaagaguaauggcaugaucccagcucacagcaaucucugccuccuggauucaagugauucuccuuccucagccucccagguagcugggauuacaggcgccugccaccacgcccagcuaauuuuuucguauuuuuaguagcgaugagguuucaccauguuggccaggcuggucucgaacuccugacgucaggugauccacccgccucggccucccaaaguguugggauuacaggcgugagccacugcgcccggccuucauggacaguuugaaaugaaguauggggcugggugugguggcucaugccuguaaucccaacacuuagagaaaccaaggcaggagaaucauugaggccaggaguuugagaccagccugggaaacacagugagauacugucucuauauaaaauuuuucaaaaaagaaauuuggaggcugagacaggagaauugcuugaacccaggaggcggagguugcagugagcuaagauuguaucauugcaccccagccugggugacagagugagacuucaucucaauaaauaaauaaauaaauaaauaaaaauaauaaaaagaaaugaaauaugggaugguuaaaaaauaaauaaagaggccagguaugguggcucacggcuauaaucccaacacuucgggagacagagaugggaggacugcuugagcccaggaguuugagaccauccugggcaacacagggagacccugccucuacaaaaaaauuuuaaaauuagccuaacauaguggugugcaccuauaguccuagcuacucaggaggcugaccugugaggaucacuugagccgaggagguugaggcugcagugagccaagaucgggccacugcacuccagccuaggcaacacagugaaacccugaauaaaaaaaaaaaaaaagaaaaacaagaaaaaaaaaaaaggaaacacagggacagucaaugguuuucguuaacuauaagccccauuuuuaaaaaaaaaaaacccauacuuuaaauaugcucaaaucaguagucuaaaaugacaccaaaaaacagguaaagggauuuaguuuaccauuuuaccugaaucaucaaaaagucuacuagagccaggugcgguggcucaugccuguaaucacagaauuuugggaggccaaggugggaagaucccuugagcccaggaguuugacaucagccugggcaacauggcgaaacucugucucuacaaaaaaaaagaaagaaaaaugcaaaaauuagcugggcaugguggcaugugcccguaaguagucccagcuacucuggaugcugaggugggaggaucaccugaguccacagagguugaggcuguagugaguggugaucaugcuacugcacuccaccaggaugacagugagacccugucucaaaaaaaauaaaucuacuagauuuaagcauugaucuaauaagugaaaauggaacccaaucaagagaaucuuguaucaucuuuuaaaauuuuuuauguuuauuuuauuuuuugacucuugcuucucucuggauuguuaucaucuuagggaaaaacacuuauucccuacuccagauguuucuuucaauguagacagccaagcguuuagcauaucaccccucccuucuuagugacuagaagaaaaacacagcuccuucuuuccuauuuugagauccagcuagcugcagagaguauacacucagcuuugcuacucugaacuggucaaauuuuacauggguaagugcccacacgaagaagugcauagguuuuuguuugguuuuuaaguacugcuuguauuuagguggauaaaucugucuaauucuggauucaguauuagaacaucuacuagcccacaaauauaagcuaucuucuugaauauuaguuuuauuaguaguaaguguuacuuuauuucugucaaacuuuuucguauuucucaacuggauugaaguaagaggagugcuuccaauugaaacccucaaaccccaacaaucuuuaagagcuaugcaaauauuauuuuugguaauugaaauagugggguaaagguuagaguacagcccuaccaguuugcaaauccuauuauuuguaaaauaauaauuuaauaguaauucaauuugaguuaaaguaaaucaauuucauuccuaauuaaugucuucauuuuacaaaugagggaaaaucagauucacuuuuuauauaacuaacuuaauuuuucacuguucauucagcaacugaauaggcaaggaaucaauguuuacucaauuuuuuaaaaaguauuuuucuugacuauaaaucccauuaaccaacagaaaaugguuaaaacacuggcucaaaagucgcagagacuuagcgguuuugggguuuuuuuuuuuuuuugagucaaggucucacucugcugcccaggcuggaguguaguggcacaaucaugguucgcuguagccccaaauuccugggcucaaguaaucuucccaccucagccucccgaguagcugcgacuacaggugcaugcuaccacaccuggcuaauauuugaguuuuuuguagagacuuagucuugccauguuaccuagucuggucuugaacucuuggguucaagugauccuccugccuugaccucccaaagugcugggauuacaggcaugagccaccaagcccagccaauauuuagguuuaauucuaccauugucuuguauuagcugugugacuuuggauaaguugcuugaccucaccuauaaaauggggacaguuaacaacaccuaugaaauaggacuguuguggggauuaaaauaaaugcagguagccaggugugguuauucuugccuauaaucccagcuacucugaagacugaggugggaggaucacuugaagccaggaguucgagaucagucugggcaacauagugagaccuugucucuauaaaaaacaguuuuuuaaaaaucagcuggguguguuaguguacaccuguagucccggcuacauggaaggcuaaggcaggaggaucaccugagcucagguguuugaggcugcagugagcuaugaucacaccacuccacuccagccugggacagaaagugagauccccuuuugcaauaaauaaauaaauauauacauauauguaaauacaaauaaauacauaaauacauacauacauacauguaaaacucuuaucaugcugccugaaacauaaaaggagcugacaucuauucauucaauaaauauucaaugcccacuuuagaguacuagguacuacguuagguaccaaggacaaaaugcuuagcuaaaccagacauggcucuggcccuaauaaaauuuucaggaguauuuaguggggagagagacauuaaucaaauaaucauaaaauaauuuaauaauuacccacugugauaaaugggcuaccaaaaaaaagacaaaaagaaggcuguggccuauuuucauuagacuagucagaaagaugacauuuaaguaugaaagacuucaaggaugagaagaaacuagccauucggagaaugaaagagaucauuccagaaagagggagcacacgguuaaaagcuauaaggugggacuuuggaaggaauagaaggccagugaagcuggaauguaaugaagcauccggccucucaguuuuuagaagguuuaugugaguuaaauuuuauaaagggcuuagaacaguaacugguaugcucaggaggcugagggaggagaaucacuugaaccugggaggcagagguugcagugagccgagaucacgccauugcacuccagucugggcaacaagagcgaacgaaacuccaucucaaaaaaaauaaaagaacaguaacugguauguaaaaauacugucuauuauauaaaauaaaacuaagaaaacaagguaauuauuaacuccagggaaaacaaaaauugaacaaaggaacuauuaucauagcauauuauauagcuuagcuagaaauaauacuuauaaaaucauaauaauauaaauacugaauacugguuuaacuaaaaaucaugacacaacuuauacacagaaggugggaagaaaggggaagcuggaacauaagggcacgggguuuaagagaaauaaaucuuuacccucuauaacagaaaggcaauaucugauuugcugaaucaauacacaaacauagacuuauagaauugcugaauucuggcugggcgcaguggcucacgccuguaauccuaguacuuugggaggcugaggugggugaaucacuugaguucaggaguuccagaccagccuggccaacauggugaaaccucaucucuacuaaaaauacaaaaaguuagcugggcgugguggugugcacguguaaucccagcuacuugcguggcugaggcaggagaauuguuugaaccugggaggcggagguugcaguaagccgagauugcgccaccgcacuccagccugggcaccagagcaagacucugucucaaaaaaaaaaaaaaaaaagaauuucugaauuuuauauaacuaacaacgaaugauuugaaaaggaaauuaaaacuguuccauuucuaauagcaccaaaaauaauaauaugcuuaagaauaagguuaaccaaggaggcaaaagacuuguacagugaaagccaaaaacauuacuaaaagaaauugcagaagacacaaauauauggaaagacacuccaugcucauggauuggaagcauuaacauuguuaagauaucagggccaggugcgguggcucacgccuguaaucccagcacuuugggaggccaaggcggguggaucacgaggucaggaguucaagaccagccuggccaagauggugaaaccguaucucuacuaaaaauacaaaaauuagccgggcuugguggcaggcgccuguaaucccagcuacucaggaggcugaagcagagaauugcuuguacccgggaggcggagguugcaguaagcugagaucacugcacuccagccugggugacagagugagacagccugagacuccgucucagaaaaaaaaaaaaaaaaaaaaaaaaaaagauaucaguacuacucaaagcaaucugcagauucaguguaauccauaucaaaaucccaaaaaugggcuagguguaguggcucaugccuguaaucugcagauucaauguaaucccuaucaaaaucccaaagaugggccgggugugguggcucaugccuguaauuccaggcacuuugggagacugagguggguggaucacaugaggccaggaguucgacaccagccuggccaacauggcaaaaccccaucucuacuaaaaauacaaaaauuagcugggcaugguggugcacgucuguaaucccagcuacccgggaggcugaggcaggagagucacuugaacccaagagguggagguugcaaugagccgagaucaugccauugcacuccagccugggcaaaaagagcaaaacucugucucaaauaaauaaauaaauaaauaaauaaaauaaaauaagcaaaggacuugaauagacuuaucuccaaagaagauuuacaaaugacauuucacaaaugugaaaagacguucaacaucacuaaucauuagagaaacagaaaucaaaaccaugggauaccaccucacacccaucaggauggcuacuuauaaaaaaaaaaaaaaaaaggcagaaaacaacaaguguugguaaggaugcagagaaauuggaacccuugugcaguguugaaaacaggacagugguuccugaaaaaguuaaaaauagacuugccauaugauguagcaauuccacuucuggguauauacccaaaagaauugaaagcagugucucaaagggacacuugaauguauuuguacacucaaguucauagcaacauuauucacaacagccaaaaggcagaagcaacccaaguauccaucaaugggaaaaugaauaaacaaauaugugcuauauguuguacauacaaugaaacauuauucagggugaaaggcaaggaaacacugacacaagcuacaacauaggugaaccacgaggacauuacaccaagugaaauaagacagucacaaaaauauuguaugauuccacuuacauaagguacauaggauagucaaauucaucgagacagaaaguagaacagugguugccagaggcuggagggagaggagaauguggaguuguuuaauggguauagaguuucaguuuuguaagaugaaaagaauucuggagauggguugcacaacaauguaaaugcacuuaaugcuacuaaacuguauacuaaaauguucaagaugagccaggcaaggugggcgccucacgccuguaaucccagcacuuugggaggcugaggugaguggacugcuugaggucaggaguucaaggccagccugaccaaccuggugaaaacucgucucuacuaaaaauacaaaaauuagccaggugugauggcaggugcccguaaucccagcuacuugggaggcuguggcaggagaaucacuugaaccugggaggcggagguugcagugagccaagaucaugccacugcacuccagccugcacaacagagcaagacuccgucucaaaaaaaaaaaaaaaaguucaagaugguaaauuuuauguuauguauauuugucacaauuaaaaauaaaaauaggccaggugcaguggcucaugccuguaaacucagcacuuugggaggccaaggggggcagaucaugaggucaggaguucaagaccagccuggccagcauggugaaaccccgucuccacugaaaauacaaaaaauuagccaggcaugguggcaaacgccuguagucccagcuacuaggaaggcugaggcaggauaauugcuugaacccaccagguggagguugcagugagccaagaucacgccacugcacuccagccugggagacagagugagacuccaucucaaacaaacaaacaaaaaaaaaaaagaaagaaggagagaaggagagaaagagagaaaagaaagaaggaaggaaggaaggaaggaaggaaaagaucuuacuaagaaaaagaguaggagguaaggaaacagagacucuauauggacuacucuuucaagaagcucaggccaggcaugguggcucaugcuugugaucccagcacuuugggaggcugaggugggaggauuacuugaguccaggaguucaagaacagccuggguaacauggugaaacccuaucacuacaaaaauacaaaaauuagccgggcagaacuccugaccucagguacucugccugccucgcccuuccagagugcugggauuuuuuuuuuuuuuuuuuuuuuuuuuuugagacagaguuucacucuugucacccaggcuggagugcaauggcgugaucucagcucacugcaaaauccaccucccagguucaagugauucuccuguuucagccucccgaguagcugggauuacggugugcgccaccacgcccagcuaauuuuuguauuuuuaauagagacaggguuucgccauguuggcuaggcuagccucaaacuucugaccucaggugauccacccaccugccuuggccucccaaagugcuaggauuacagguguuagccaccacaccaggacaaucguuaaccuuaaugaucauuuacuaugugccaggcauucauuacuaacagcucaauaaaguagauacuaguaguaugccauuagauauggaguuauggggggaaaagaaggucaaggauaauauuaagguuuuuggucugagcauauggaagaaugaaguugccauuuacugagacagagaacaguuuuggcagggcagggaggagaagagcaggcaggagcucuguuuaaauauguuaaguuugaaaugucuaauaaaugucuaaauggaggugucagguguaauguuaaauauauaaaucuaaaauacaggagggcaguccaaguugagaguuccaguccaaguugagaguuccgucauacgggugcuauucaaagcuaugagacuggauauaaauuuuuuuuuuuuuuuuuuuugagauggagucucccucugucacccaggcuggagugcaguggcacaaucucagcucacugcaaccucugccuccuggguucaagugauccuuccaccucagccucccgaguagcugggaccacaggcaugcaccaccacgccuggcuaauuuuugcauuuuugguagagacaggguuucaccauguugccccagcuggucucaaacuccugagcucaagcaaucugcucaccucagccucccaaagugcugagguuacaggcaugagcuacugcacccguccaagaccuggauaaaacuaugaagagagaaguauagacagaaaagaggcucaaggacugaguccugggguacuccaagguuuagaggucaggaaaaugaggagaaaccaggaaaggaaccagaaaaagagaggccauagaaauaagaagaaaaccaggagaguguggcauuccauaagucaaaugaagaaaguuucucaaggaauagagugaucaauuguaucaaguguugucgauagguuaagaugaaaguuaagaaauaaacauuuacuggggcugggcgccgugucucacgccuguaaucccagcacuuuaggaggcugaggcgggcggaucacgaggucaggagaucgagaccauccuggcuaacacagugaaaaucugugucuacuaaaaauacaaaaaauuagccgggcaugguggcgggcgccuguagucccugcuauucgggaggcugaggcaggagaaugacgugaagcugggaggcggagguugcagugagccgagaacgugccacugcacuccagccugggcgacagagcgagccuccaucauaaaaaauaaauaaauaaauaaacauuuacuuaauaacaugagucacugcagacuuucaaaaaagcaguuuugguggagugguaggaauaaaagccuaauuaguuugcuuuaagagggaaugagagaagucugacauuaucaaaaaauggaaaggauguaaaucuaugacaaauuuuauacauuguugauggaaacagauuugguacaauacuuuggaaauaaauuuagcauuaucucccaaaguggaauauucgcauaccugauggcucagcaaucccacucuuagguagaaacccaagagaaacucuagcacaaggauacuauauacagaagaauguucagaacagcaauuucaaaaacagcaaaaaugaacaaacacaaucuagaaacaauccaaaaaucccuugguaggagaauggauaaauuacaguauauucacaaaugaaauauuguaaagcaugaaaaaauggauaaaccacaucuauaugcaacaugaaugaaucgugaaaacacaaaacugaagguaaaaaaacaaaaacaaaaacagaagacuaugugcugcaauaagacacuacagcagugguugcaagcacagauuuggaacuagauuacccggguucaaaucccaguugggccauucacuagcaguaugauuuucaaacucucuguaacucacuuuuccucaucuauaagaugggaauaauaauaaugaaguuguaaggauuaaauaagauaaaauauaguuauauaacuauauauuauauagauauaauuauauacaguuauacaaaguacuuagaacagugcaaacaaguuaauuaaacaugauuuuaaaacuauguuuuuugggaaagacuuucaguccaaaauggcaguauagaaguaaacuggcuucacuuucuuccacagaaaacuaaaacuauguuuuuaaaaaguaacagggcugcugggcgcaguggcucaugcuuguaaucccagcacuuugggaggccaaggugggcgaaucacuugaagucaggaguucgagaccaaccuggucaacauggugaaacccugucucuacuaaaaacacaaaaauaagccagguguaguggcaugcgccuauagucccaccuacucagaaggcugagacaugagaauugccugaacccgggagguggaagaugcagugaguugagaucacgccacuacacuccagccugggugacagaggaagaucccgucucaaaaaaaaaaaaaaaaaaaaaaaaaguaauagggcugggugccgcggcucacaccuauaaucccagcacuuugggaggccaaggcaggaggaucgcuugaggucaggaguucgagaccaucuugggcaacauagcgagucccugugucuacaaaaaaauuuuaaaauuagccaggugugguggugagugccuauaguccuaccuacuugggaagcugaggcaggaggaucacaggagcccaggaguuccaggcugcacugagcuacgaucaugccacugcacuccacucuggaugacagagugagacccugucuccacaaaaaauuuaaaaauuagcugggcauggugacgcacaucuguaauccuagcuacucaggaggcugaggugggaggauugcuugagccagggaggucgaggcugcagugagccacgaucgagccacugcacuccagcccgagugacaaagugagacccagucucaaaaaauaaaauaaaauaaaauaaaauaaaaagcaagagaguaauaaauacagaauuuaggacagugguuagcucuagaagaggugcagaggaugagauggagaaauucauguguacguaauuuacaggcaaugaaucuagucuaguacuugagaguaccucuuacagguguuccucuauuauuacacuuuauaacuacauguaaacuuuuguauuaucugacaauauauucaagauaauaaaagaaaaaagaauggaaggaaauaaauuggagacagcaaguauauaugauucuugaauagauagcucuuucaagauguuuuacuguaaagggaagaagagaaaugaaacaauggcuagaagaagaagaaaaaguuuuuuuuuaauuuaauuauuuuucuuuuuuuuuugagacagaguuucgcucuuguugcccaggcuggagugcaauggcacaaucuuugcucacugcaaccuccaucucccagguucaagcaauucuccugccucagccucucuaguaucugggauuacaggcaugcgccaccaugccuggcuaauuuuguauuuuuaguagagacggaguuucaccauguuggucaggcugguuucaaacuccugaccuccggugaucugccugccucggccucccaaagugcugggauuacaggugugagccaccgcaccuggccaauuuuuuuuucuuuuuuauacuccauagguucacaauuuuuagacagaauuucauucuuguagcccaggcuggaguacaacggcacgaucuuggcucacugcaaccucuaccuccuggguucaagcgauucuccuggcucagccucccaauuagcugggauuacaagcaugcaucaccaugcccagcuaauuuuauauuuuuuaauagagacaggguuaccacguuggccagacuggucucgaacuccugaccucaggugaucugcccaccucggccucccaaagugcuggaauuacaagcguugagccacagugcccggcccacaauguuuuuuuuaaauaagagaaaaacagccaauauacaggcugauaugugauuauaaacauuaccaauccucaaaauaauucgacaaaauauaucaguacuuuuuuuuuuuuuuuuugaaauggaaucucgcacugucgccugggcuggaguccaguggcagaucucggcucacugcagccucugucucccagguuccucgccucagccuuccaaguagcugggauuacaggugcccaccaccacgcccagcuaauuuuuuuguauuuuuaguagggacuggguuucacuauguuggccaggcuggucucgaacuccugaccucugauccgcccgccucagccucccaaagugcugggauuacaggcaugagccaccgcgcugggccaauauaucaguacuuuaagaugaaaaauucaaggucagaaagccuaagacaccuggcgcuggucacacagcuaauaugugacaaagccacauuuaaauucagaucaaucaauaaauaauuacuuaaaaauaaauucagaucuaucuaacuccguauuucaggguuuguauagaacauaaugcuuccuuccuuugcuuaaccuugauuuagugccuaccauaggcacuaaaugugauagcuuaaucacauuuauuaggauauauauuuuuugaguaucuacuagauaggccuaagaugcuauauuagguauuuggggagauaauaaacugaauaacacugucucuaccuuaaagagcuuacacucuagcaaugaagauaagacaauuaccuaaaugauuccaauacaaugcaaaauuauauaaacaccauauaagaagcauaaaacauuauggggguucagaaaaaaguccccuuuggaaaaaacaguccccucuggggcugggaaauggagggauuagcagaagcuuuauauaagagguaauuuucaacugaacuuaaagggauggguaggauuuuuaaagacaguuuugacugugaguucuuaaagggccacagucaugccuuaaccccagggccuagcaugcugcagcugcucaauaaaccuaaguaauaugagugaaguaaacaaaugaaacgaaaggccauuccggaauuaagcaacaacaacaaaaaggaucagaggcugaaugcauaaggcacaagaacgacaaaaagaucagaguuggagggacgugaauaugcauauuuugagaauaaguaccaaguaacuggucaugauucucuuuacauuugucuccuacaucucccaucuuuaagaaaauuaucucagccaggugcaguaucucaugccugaaaucccagcacuuuaggaggcugaggugggagaaucacuugagcccaggaguuugagaccagccagggcaauauagugggaccccaucuguacaaaaauuuaaaaauuagccaagugugauggcgugagccaguagucccagcuacucgggaggccaagguaggagaaucgcuugagcccaggagguugaggcuacagugaaccaugauugcaccacuguguuccagccugggcaacagagcaaaacccugccucaaaaaaaaaaaaaaaaaaaaaaaaaaaaggaaaaagaaaauucucucuugacagcaccgcuauccucuucuagcuuuuaucucauuucucuggucccuuuuuuuaaaauaacaacucuacugagacauaauucacauaccauacacgucacccauuuaaguauaaauucaggacuaggcacaguggcucacgccuguaaucccagcacucugggaggccaaggcaggaggaucgcuugagcccagggguuugagacaagccugagcaacauagcaaaagccugucucuauaaaaaaaauuuuuuuuaauuagcugggcauguggcgcuguaaucccagcuacuugggaggcuguggcaggaggaucccuugagcucaggaguuugaggcuuuaguaagcuaugauugugccaaugcacuccagccugggcaacagagugagacccugucucuaaauaaagaaagcauaaauucaaugguacuuagaucacagaguugugcaaccauaaccacaauuuuagaacauuucauuaucccaaaaagaaacacaauacccauuaccagucacucccuauuucuccacuaagcccuaggcaaccacuaaucgacuuucugucucuauagauuuccguauucugggcauuucccauaaauggaaucauacaacauguagucucuuaugacuggcuucuuucaugagcgucauguuuuuaagguucauccacauuuagcauguaucaguauuccauccuuuuuucuuuuuuuuuuccccuagagauuuguuuuguuguuguuguuguuauuguuguuguuguuguuguugggacagagucuugcucuguugcacaagcuggaguacaguggugugauccacugcagucuccaccucccagccucaagcaauccuaccaccucagccuuccgaguagcuggggcuacagguguguugcacaccagcacgccuggcuaauuuuuguacuuuuuguagagaugggguuuugcuuuugccauguugcccaggcuggucuagagcuccugggcuccagcaauccaccugccucgggcucccaaagugcugggauuacaggcaugagaaaccacacucagccuaguaccccauuccuuauuauuguugaauaauauuucauuguaugggcauaccauguauuuuauuuauccauucaucaguugauggacauuuggguuguuuccacucuggacuauuaugaauaaugcuccuaugaacauuuauguacaggucuuuguguaacauauguuuccauuucucuugggcauauaucuaggaguggaauuccugggucuuuccuuaaccuuuugagaaccugccaagauguuuuccaaagcagcuguaccauuuuacauucccaccagaaguguauaaagguuccaguuacuccacauauauuaugucucucuuucuuucuuucuuuuuugauacagagucuugcucugucacccagaaugaagacaguggggcaaucaaccgcagccuugaccuccugggcucaagcaauccucccaccucagccuuccaaguaugaauagcuaggacuacagguguaugccaccacacccagcuaauuuuuguauuuuuguagagaugggguuucaccauguugccccgggcuggucucuaacuccugggcaacacggugccgaggagauauuuguccuuucgauuaucuuuuugauuauugacugucuuuuuuauuaucugucuuuuucauuauaaacagccuacugggugugaagugguaucucauuguggcuuuauuuuauauuuccuugauggcuaaugauguuaagcaucuugccauagagccuguggauaaacaucgauucagauguuuugccuacuuucuauuuggguucugcucuacaucuuaaucaauguucuuaagagauuaguguauauauaccaucuauacuuccuuacuuguuuucacucaucaaccuauuccaaccuugauuuugcuccccauaccucugaaauugcuugucaaagucaucaaccaccuuuacacuaacaaauucaaagacuauucuucaauccucaucuuccagcauuauaauuuuaugauuugcacacuugacuuuuuuuuuuuuuuugauacauggucucgcucaguugcccaggcugcaaugcaguggcaugaucauggcucacuguagccucgaccucuaccagcucaggugauccucccaccucaggcuccugagcagcuggaacgacaggcacacaccaccauauguggcuaauuuuuguaucuuuuguagagacaggguuuugccauguuguccgggcuggucuggaacuccuaggucaagugauccucccacuuuggccucccaaagugcuggaauuacaggcaugagccacugugccuggccauacuugccuuuuaauuccaacugacuucuuaguccaguugauauuuuccuuuguccuguuucuguucuguauuuuuuguuauauugcauauugcauauucuccuauggaauaagaaauguaaaccagcaaccaaagggcauauccagaaaacugcauuaacguaacuggccaguagagcaaauguaacaguaucaagggggcaugguggggggguggcgggggauggggaagauaaggaaaggccagacagauaguagguguugggcuagagauuugcacuuuguucagcagguaauauauagccauuaaaguuuuuuuuuuguuuuuguuuuuguuuguuuuuguuuuuuugagauggagucucgcuguugucggccccgggcugaagugcaauggcgcgaucucggcucacugcaaccucugccucccagguuccagcaauucuccugccucagccucccaaguaacugagauuacuggugccugccaccaugccuggcuaauuuuuguauauuuaguagagacaggguuucauccuguuggccagucuggucucaaacuccugaccucaggugauccacucaccuuggccucccaaagugcugggauuacaggcgugagccacugcgcccggccuaccacuaaacuuuaaccauuugaguuaacuuauuacugauaacagaacagcugccccagucaagagauguuagaccgacaaguucuuaauucucaguccuauuacauuugauuugauggaaacuagaaggaaaaguaguaaacauacacagagaaaauucucuauccuguuagaaguacuaagugaauccagcacuguuugucacuucucucuccugaguaaacacucaugacaaucucagguaacaagcuucucaaagaaugaggaucuggcaguacccaccagucagccuuacuuucaucaccuccuacuccccaucagucuucaauauauuaacauugagaagaaauagaaauguaugaaaaguacguuggagaaggcaaauuauccuaaguuaaacacagucccuuuucuuuuuuuccaaaggaaaugguuguugauccuaugaggaguuaaauuauaauaacacaugccagagagaugaugucaagaaaggcgugguuaggcccuuuacaaguuugaaauuccuuuagucccaaacauuuccucuuucgaucucaccuauacucaaaucucucuacuuuggcaacuucuucaaacauugaagaaacaguguugagacccugucucuuuuuacuucagccuuuuuuuuuuuuuuuuaaugaaccaaguuacugaagggcauuaaaacugauguuuaaaaaaaaaaaaacacaaaauuaucuugcagaaucccucuuugaaauccacauuuuuccccuucaguaacuauuuuaauuccaaagaaaggaaaaaaaaauuuaacacuacuuccugagaaaaaaguccgccuuuauuaggcauuauacauuuguugacggcauucccauauuuaccaccagccaauaaagaguaagaaaacuaugacugucaugggcuccucaggaaacaucuuuccugauaagugaaguauguauuucaaaauaaaauaauccuaccuuuuauguuuuauuuuauuuuauuuuauuuauuuauuuauuuuugagauggagucucacucuguugcccaggcugcagugcaguggcacaaucucggcucacugcaacauccaccuccuggguucaagugauucuccugccucagccuucugaguagcugggacuacaggcgugcaccaccauacccggcuaauuuuuguauuuucaguauugacgggguuucaccauguuggccaggcuggucucaaacuccugaccuugagccaucugcccacuuccaccucccaaagagcugggauuacaggcgugagcaccaaaguuaaauuuuuacaauaacuuucauuaguuucaguaagaaacaguaacuuuuauauaaaaguuauauauagguagggcgugguggcucacgccuguaauccuagcacuuugggaggccgaggugggcaggucacuugaggucaggaguucgagaacagccuggccgacauggugaaacgccaucucuaccaaaaauauaaaaaauuagccaggcgugguggugggccucuguaaucccagcuacucaggaggcugaggcagaagaaucacuugaacccaggagucggagguugcagugagcugagaucgccccacugcacuccagccugggugacagagcgagacucugucucgaaaacaaacaacaaaaaaguuauauauaaaaguuggcugaggugggaggcucgcuuaagcccagggguuggagauuguagugagccgagaucauggcacuguccuccagcccagacugcagagugauacccugucucaaaauaaauaaauaaauaaaugggccagacaguggcucacgccuguaaucccagcacguugggaacccgaggcaggcagauugcuugaggccaggaguucaagaccagccugggcaacauggcaaaaccucgucucuacuaaaauuagaaaauuuagcugggccugguggcgcacaccuguagucccagcuacccaggagguugaggcgggagaaucgcuugaacccaggagacugagguugcagggagccaggaucgcgccacuggacuccagccugggugacaggguaagacucugucucaaaauaaauaaauaaacaaauaaauaaaauuuaacugaguauggaaaauacacaaauuacauaagcaaaugcaucuacaacccuuuccaaaacagaaacacaguaagcccuacuugacaagacaaagagcaacguaauaaugcuauaguuuaaaaacacccucccuggucaucuaguguugaggaaaaaaauuaaguaaaauaaaaauaaaaauauggggccaggcgcaguggcucaugccuguaaucccagcacuuugggaggccgaggcaggcagauuaccugaggucaggaguucaagaccagccugaccaacaugaugaaaccccgucucuacuaaaaauacaaaaaaauuagcugggcgugguggcgggcaccuguaaucccaacuagucagaaagcugaggcaggagaaucacuugaacccaggaggcggagguugcagugagccgaaaucacgccacugcauuccagccugggcgcgacagagcaagacuccaucucaaauaaauaaauaaaaauaugggccaggcuuggugacucaaaguauaaucucagcacuuugggaguccaaggcagggcagaucacuugaggucaggaguuugagaccagccuggccaacauggugaaaccccgucucuacuaagaacacaaaaaaauuguccgggugugguggcacuccuguaguuccagcuacuugugaggcugaggcagaauugcuugaaccugggaggcggaggcugcagugagcugagaucacaccacugcacuccagccugggugacagagcgagacuccaucucaaaaaaaaaaaaaguaaaaauaaaaauaugaaaacccuccacguucacaaacuuauauaggcacaaaaggagucauaugcauggccacagagugaugcacagauacagcauccuuacaucugaucauaacauugacuuauaagaacccaaagaauugacaaauacauuaguaauuaguaauuauguaucuaccuauccuccccaaccaauuccaacaauuccugaauugucaaaccuuacuaagagauuucaacccaaacccacaaccauaccucuuguccccuauacuauccuagauuuagaagcuaauuaacuuuuuccuauacuccaaggugggagagggagcagagagcaaaaagagauuuuuagauagcuucaaauacgugaaaccucuaauagggaagcaauucauuuugggaauucauuuuauuuuaaugaguucuggguaaccugagagaacuaggagggaaaaaaaucaggaaagaaauuuucacaugguacucuacaagguuugaaaagaauaaagacaugugaaauauuucccuuucaaauauauacguauaauauauaauguauuaucuauacauauauuugauaaagggaugucaguauauguacauauaaacauauauugauaaccaacaaauguguauaaacucauauuucauuucuuuuugagauggagucuugcucugucacccaggcuggagugcaguggcacaauccuggcucauugcaaccucugucccccagguucaagugauucuccugcuucagccuccugaguagcugggauuacaggcgcgugccaccaagcccagcuaauuugggguuucaccauguugaccaggcuggucucgaacuccugaccucaagugauccacccaccuuggccucccaagugcugggauuacaggcauaagccaccaugcccagccucauuucuuuuuuaaaguaaauuuuauuguguauauuuaagguauacaacauguuacgggauacauauagauaguagaaagguuacuauagugaaguaaauuaaucaucccacauaauugucccuuuuguuucuuuuuguggcaagaggagcuaaagucugcucauuuagcaugaaucccauauacaguacaacuuuaucaucuauaguccucauguuguacauuggaucucaggauuuguucauccuacauaucuacuacuuuguauccucugaccuauagcuccccauuuccucuccccucuacccauauuucuucaggauauaaacaaaaugaguaccacacagacuaagcccauaaaucaacauuaaguguuuugggucuaaacauuuacccacugcauugaucagacacuuguguuuaaauccaccucuaauggucucauuagguacaugagaaagcagcaggaaucguuccucacccuccaacauuccauuagaugagcaaaagauucccuaaaugucuaugucacauuuuuucuucaaagaacagcuacaacacaaagagaggguaaagagucuucuuccugcuacagcaugaaauuccuccuaaucaguaugcugugcgcccugaaaugccagaaacugccaaauauauuccuugucaaauauggacaagauuguccaucucuccccaugugcccaaggacagcacaauucucuggcagccauggguuaaucauaaagacuccuaggaucacugcaaagucuggcuaucugcagagguccaaguaucaguucaaauacaagauccaaaguaucacagcgcucugugccuuaaucccaaggugcgaugucucucaagacuccuucucuauaggcugggugggguaggaucuguagucuagaagaguauacccagcucuugauaaacuguugugguuucucugacuaucuaugauuucagcuaucuaauacuacuggugguauggguaggagggaagguuggggagagaauggaaacaguuaaucaaaaaauaaaauaaucuuguggggugggguggacugggggacagggucugaaaugacauauuauccuuguggagauugauacaucagcaggaagucaaacuaacuucauuucauaaggauacaaacuugcaagcuugauuuguuuuuaauuccccugucuuuucaggccucgcagagacugaaaguucccugaacuccagaaccaguugaggaaagaugcagaaagcaguaguggaaaagggagaagcgcggugaggaauuaggaaucuugagagaggaagccccuuccccucuuuaaaaagaauguaaaaaccaagggcauugcaagauccccagaaaaagaaguagcuagauaccaaaaaagcgcuuuucccuaccuucuuguuguuucuauuguagccaaaagucgaaaucccgggccuggaagucacggauagcagcauuuucucuuuaauguuagggaacgagcgagagagagagagagagagaaagggaggggguaagaaagacggggagggagggaggaggggagcgagggaaagggggagagggagggaggaaaaaagggagggggaggagaaaggaggagaaaaggagcaggaggagagagaugaaggggggcugcgggcagagaaugagcuc

SEQ ID NO: 192199 - RNA, 33044 nt, Homo sapiens
ucgcgcaggcggggaccgguccagcugagccugguggcggaaaggcugcggccccgcgccagagggccgguggcuccuccgggcuucugaggacccgcagggagcgggugagugaguguguggcgagagggcgcuaagcggacacggggauccuuucgaagcuaugggggcauucucgggaaacgcugagucccuuuucccgccacccgguuuagagccagggggcggggcucgugcugcaggcgcgcacgcgcaauucuguacucugcuccuuagucucccgcgccgcguucccgggucucaccggacgcgggcuuagcccuacgcugcuccgcacagcuugggucucccgcgggaugggguugugauggaaaggggcuuggaauuccugaauuagaacagaaagugccugagggaguuccacuucggagcuuagcaucuaguugagaccuccugaaaaaaaccgguguguggccuggcggucagcaguggucggaauucacaggccgcuuuacuuauaucguggguuuuauggaacggauuucucacucccucccuucguugccuuguucggguuugucaccuggaccucagccgcuaaugaagcuuuuuuccuugagccucucaauucuuugccauucgugcuucgacuaguacuuucaauuuuuuauuuauuuuauuuuauuuugagacggagucucguucugucgcccaggauggagugcaguggcgccaucucggcucacugcaaccuccgccucccggguucaagcgauucucuugccucagcuuccugaguagcugggauuacaggcgcgcgccaccaugcccggcuaauuuuuguauuuuuuuuaguagagauggggguuucaccuuauuggucaggaugaucucaaacuccugacuucgugauccgcccgccucggccucccaaagugcugggauuauaggcgugagccaccgcgccuggccuguuuguuuuuuuugguuguuuuguuuuguuuuguuuuugagauggagucuggcucugucgcccaggcuggagugcagugguccgaucucggcucacugcaaccuccgccuccccaguucaagcgauucuccugccucagccuccccaggagcugggauuacagcugcccgccaccacgcccggcuaauuuuuguauuuuuaguagagaugggguuucaccauguuggccaggccggucucgaacuccugaccucaaaugauccgcccgcgucggccucccacagugcugggauuacgggugugagccaccacacccggcccuacuaguacuuuguacaaaguaaagguagaucaucugauguuaaauuuaaaacuccucuuugaccacccacaguuagccuuaaauccguaggugggugucuguggccucucagucuggcccugacccucucaaucucauuuuguaaaucucuuacgcaccugacuccuggccacguggaaagauuguggcugcccucuuucauaucucaguacuuaguuccugcuguuccuucugcuuggaagaucuugacacugcucugccaagcgaacuucucuuugaagacugagcuuaauugucccucugaaaaucaauguauccagcuuccuaugccaaguuagucacuucuuccugugugucccugaaguuuuuuaccccccucuauuaccaggggcacugauacagcucaauaaaagaucaauaaaagguuacugagcuccuaacauguaccaugcacugugcuuagcgccaggcuuacagagaugaguaggauggagaguucccgacccuuaaggaacucaaguccuaaggaaaacacauguaauugagucuucugugguuacagugaaagggucaucaagaaguccuuccuggcuuccuuccuccucucacugcacucacaccaucuuacauccugaugccuccaaaucuuuagcuccaaacucuucucccucaucuuccagacuucucuguuucaguucaauuuaguaaagcauuuauugagcacuuacauugugcugcguaaugaugauuccugaugugaaagaguuuacguuuucgugcaguuaacauaggauaguuagaaucaccugaggaacauugucaaaacacuugccuaagccccaucgcuggaaauucugauccuguagcaaggcucugaaaguucaagggugaauaagaauuccuaucucuacuaaaaaaaaaaaaaaaaaaaaaaaaaaacaaaaauuagcuggguaugguggcauuuuccuguaaucccagcuacuugggaggcugaggcaggagaaucacuugaacccgggaggcggagguugcagugagccgagauugcaccauugcauuccagccugagugacagagugagacucgucuccaaaaaaaaaaaaaauaaaaagaauuccuguccucagggaaucuaaggcuaauggagggagauagacuuugauuuuaacuauuauauacaacaugaauuguaaguaccauguuggaagucugaauaugguacacaguagacauuaaggaaaaggaggucacuucuguauggagaagucaggaggaagucccuuuugggcagucuuuuuuuuuuuuuuugagauggaguuuugcucuuauuguccaggcuggagugcaguggcguggucucccagguucaagcgauucuccuggcucagccucccaaguagcuggaauuacaggcacccaccaccacaccuggcuaauuuuuuuuauuuuuaguagagacaggguuucaccauguuggccaggcuggucuugaaguccugaccucaggcgauccauccgccucagccacccaaagugcugggauuacaggcaugagccacugcgccuggccugcacagagucuucagagcuaagcugauauuuggaugggaggccauucuagauagaguaguggcuugagagagaagcgugagagguaaacaggagagagauucaugaaagacuuuguauuguaggcacuggaggucacugaaacuuuaguuuuguauaguaaugcaugcuaauaguaaagaauucaaauaguaccaaagggaaagacaaauauuucuccuauccuagauccccuaguucucagagacgaucacuaugaaguuucuuauguauccauugaaguguucuaagcaggauuguuauaugccuaaaucagguaaccauauugaggcuagauugaacaagacuggaggcagcugcauucaugccuguaaucccagcacuuugggagcccaggugggugggucgcuugagcccaggaguuaaagaccagcccgggcaacaugacaaaaccuugucucuagaaaaaauacaaaaauuagcaggguguggugauguacccuauagucccagcuauuugggaggcugaggugggaaagucacuugagccugggagguugaggcugccgggagcugugauugcaccacugcacuccagucugggugacaaagugagacccucuuucaaaaaagaaaaaaagucuggaggcagagaaagaggauaggaagagguugaguaaccuaagcaagagcuacucaggaacugaacuaaggcaguagcaauugggauagaaggauagacagcaacugauagaagaacuuaaggaaguuaagugagauggagcuaaggugacuccuagguuucuuuuuuuuuuuuuugagacagaguuucgcucuuguugcccaggcuggagugcaguggugcgaucucagcucacugcaaccuccgccucaagcgauucuccugccucagccuccugaguagcugggauuacaggcaugcaccacuacacccagcuaauuuuguauuuuuaguagagacaggguuucuccauguuggucaggcuagucuugaacucccgaccucaggugauccacccgccucggccucccaaagugcugggauuacaggcaugagccaccacauccagccucuuuuuuuuuuuuuuuuuuuuuuuuuuuuuuuugacguggaguuucgcucuuguuucccaggcuggagugcaauggugcgaucucggcucaccgcaaccuccaccuccuggguucaaacaauucugccucagccucccaaguagcugggauuacaggcaugcaccaccacacccagcuaauuuuguauuuuuaguagagaugggguuucuccauguuggucaggcuggucucaaacucccaaccucaggugauccacccaccucagccucccaaagugcugggauuacaggcaugagccacugcgccuggcccuagguuucuuuuaauaaggugaaacucuuagccuucuucacugaggagauagugucaguccuugagagagccaaaguggagacagacuugggaagaugaguucagcuuuagaccuauugaguguaagguaucuuugagacauaaagguagagaaugcuauucaguuagucaguuuaacauacgagauugucaacucaauagcucagaggggccagaaauacagauuugcuggcuucuggcuugggugguaguugaagugcaugggagagggugaguuugcccaaucaggccgcguacagugagaagggaagaaggcuaaagaugcaggccuaaggaaaaucagcacuuaaguaggaggaggaacagccaauaagagaucaaaggggaaaguuuuauuuuauguuggauuuuuccccccuuaagaugagcuaggacaggugugggggcacaugccuguaaucccagcacuuugggaggcugcggucggaggauagcuugagccugggggcuugaggcugcagugagccgagaucgcaccacugcacaucacuacacuuuugagauacugccucaaaagaaaaaaacagauggaauagccuugagcaacucauaauauauggggauggggcuaguauaaagggaagguuggaaauaaggaauaaccaacuaagggacaggaagugauuaaugaggaucacagaguacuuagauuagaagcaaagaacuaaggguggguguuugaaauauguauguuuuuaggcuuggguggagagaguugagagaguucaugucugauaaccucaauuguuccuaacaggaaggaagcagauaaaccaggugggaggcaaggaagcaguagagugaaggggcuugaggauaaugaugaaaguuaggaauagugguucuuugggaagagacaaugaaggggaccaagaauacagaaaugaggcugggcacgguggcucaugccuguaaucccagcauuuugggaggccgaggcagguggaucacgaggucagguguuccagaccagccuggccaacauggugaaaccaugucucuacuaaaaauacaaaaauuagccaagcgugguggcgggcaccuguaaucccagcuacuugggaagcugaggcaagauaaucgcuugaacccaggaggcggagaugcagugagccgaaaucacgccacugcacuccagccuguaugacagagcaagacucugucucaaaaaaaaaaaaaaaaaagaauaccgaaaugauuugcuggaccaggcugaaggcccugcucagguugcaggcuauacauguuaucgggggaaccagcccccaauauuucaauguagguucuuuucuauuuucccuaagugucagcuggucucauaaauaaagagaaagacuacaaagagaagaauuuuacagcugggccucugugggugccaucacguauugguaggaccaugauggcgacuugagccgcaaaaccagcaaguuuuuauuagggauuuuagaaggggagggggguacgaauagggaguggaucacagagaucacaugcuucaaagggcaauaaaagaucacaaggcaaaagggcagagcaggaucacaaggcaagggcaaaauuagaauuacugaugaggguccaugucccacugggcacacauugucuugauaaacaucuuaacaggaaacaggguuugagagcagaaaaccagucugacuagaauucaccaggcuggaauuucccaauccuaguaagccugagggcacugcaggagaccagggcauauuucaucccuuaucucaaccgcauaagacagauaaucccagagcagucgucuauaggccuaccccugggaaugcauuccuuccccaggguuaucaauuauuaauauuccuugcugggaaaagaauucagugauauuucuccuacucacaugucguuuauaggcucccugcaagaagaaaacuauggcucuauucugccugaccccccaggcagucagaccuuaugguaucuuuccuuguucccugaaaaucgcuguuguucuguucuuucucagggugcccugauuucauauuguucaaacacacguuuuacaaacaauuuguacaguuaaugcagugaucacaggguccugagaugacauacauugucaguuuaugaagaugacgggauuaagagauuaaagacaggcauaggaaauuauaagaguauugauuggggaagugauaaauguccaugaaaucuucauaauuuauguucacagauugcaguaaagacaggcguaauaaauuaugaaaguauuaauuuggggaacuaauaaauguccaugaaaucuucacaauuuauguucuucugcuguggcuucagccggucucuccauucggggucccugacuucccgcaacaucaucuaucuuauaucacuauagagggucguuugguuuucuccagcacaucugggccuagauuugaauugaagucuaggaagcagaugguugcauugaucugagguuauguauggucuuuugcagggugagugcacugaaaggaaaagagauagaggccacacgggaaaauggccaaacugauguauauagugauacaguaguaggauaugugugacccugguuugaucauuuuguuuucuagcucagaaaucuucaguggcucccuggcuuagguucuaaaucuuugaacugauggacaaagaugagguuuuucccauaaagcugguuccagcugcuuuuccauugcuuuccuguuggacucaucuauucauaauggcucccucuuugguuuugcacuggcaguucucugcuuaaaugcccauccuauucccagcugccuuaauccuaugcagcuuucaaaggcccaguucuaaucaugcuuccucagacaaaaccuccuugaccacuuuaaccugaaaagaguacuaguuuuuuaguuuuuuucaguaucacguauuuagagcuuguacugccuuaucuuuuacauuguuuguucuauauuuguggauuuuauuucugcaacuacauuucuuuuuuuuuuuuuuuuuuugagacggagucucacucugucgcccaggcuggagugcaguggcacgaucucaacucacuguaaccuccaccucccugguucaagugauucuccugccucagccucccgaggagcugggauuacaggcacccgccaccacaccugacuaauuuuuuguuaguuuuaguagagacgggguuucaucauguuggccagacuagucaugaacuccugacuuugugauccacccgccuuggcuucccaaagugcugggauuacaggcgugagccaccgcgccuggccucugcaucuacauuucuuaaauuucuuuagcgcuaccauugcaccugcacgcuaucuuuugccaggaagguucucccuaagcauuuaguaacugacuauagagucugacagauggagaggaaauuaauauuuggggcgggggagggguucuguuuguuuuguuuauuugucuuuugagacagggucucacucuguuacccaggcuggagugcaguggcacaauuucagcucguugcaacuucaaccuccugggcucaagugauccuccugccuuagccuccuggguagcugggacuaaagguguacaucagcaugcccggcugauuuuuguguuuuauuuuuuguggagacugggcuucgcuauguugcccaggcuggucucaaacuccuggacucaagugauccucccaccucaaccucccaaaguauuaguauuacaggcgugagccaccauguccagccagggauucuuacuuugugcucagcacuggguagagugcuuaauaucacugcuucucaaacugucuugguaaaggaccagguagauuuuucccucaagcuguugcagaucaguaguguucuaaaagcacuucuguaaaauaaaauuacuagaaaaauaacauuuaaaaagacauagagaauacaggcuuuuuauuauuaucaucauuagauucaacaaacauuggcugggugcaguggcucaugcccguaaucccagcacuuugggaggccgagguggguggaucacuugaggccaggaguucagcagccuaggcaacauggcgaaaccccaucucaacuacaaaacacaaaaaaauuagccuggcaugguggcacaggccuguaaucccagcuacuugggaggcugaggcacgauaauaguuugaacccgggaggcagagguuacagugagccaagaucacgccacugcauuccagccugggugacagagggagacccugucucaaaacaaaacuguaaacugccugucaaauugcccuaagauguucuaagugcuaaugcuuucuuucuguacuuaccuugaugcagacugcuaauaguuuguggauuggcaguggucugaagaccaagguuugaguagcauugcuuuacaugaucucauuuacacuucccuaauaucuugugaggguggguauuauuauuauuuccucaguauacugauaaggaaagagauuuaguuaagccaccugcucaaguucaccaguuuaguaccagacagaauuggaauucaagugcuagaugccauuuuguucauacuacugggucucaaagaggauccuuggagcagaguugguuuggggcagguagaguguuuuguuucgucuucaaaaaguaaguuuauuuggucgggcgcaguggcucaugccugguaucccagcacuuugggaggcccaggugggcagaucaugaggucaggaguuugagaccagccuggccaauauggugaaaccccaucucuacuaaaaauacaaaaauuagcugggcaugguggcgcgugccuguagucccagcuacuugggaagcugaggcagaagaguugcuugaauccaggagguggcgguugcagugagcugagaucgugccacugcacuccagccugggcgacagagcaagacucugucucaaaaaaaaaaaaaaaaaaaaaaagguuaauuugaauugcaaauacauuuaauauuuuaucuguuguuuucuuuugguucuugcauuuuaaugccuccaaguauugauuucagaugcauauugcuucaucugaacugcuugauacuuaguugaguaggaaaaguaacuaacaucccuuuuaaauguccaguuccauuggcucugugguguuugacaaaguucucaccuggucuaugaugaaaugugaaaauaaagucaauguaaugaauuuuuucaugaagucauauuuauuaaauuugaaggacaguauuuuauccugagauuuuugucuguaguuuuuuugguguuaaaaugguagaaacagaaugcguauaguaauuguguggaguguuguuuauaacggcuguuugagauauaauucauauacuguaaaauucacccuuuuaaaguguacaauucaggcuagguguggugguucacaccuguaaucucagcacuuugggaggccaaggcaggaggauugcuugaggccagucaggaguuugagaccagugugggcaacauagggagguaccagcucuacacaaauuuaaaaauuagccagaugugguauugaaugccuguggucccagcugcuugggaggcugaggugggaggauugcuugggccaaggaguugaggcuauagcgagucaugauugaucuguacuccaaccugggcuggucaacagagugagacccugucucaaaagaaaaaaaaaaaaaaagaaaaccccuguacaauucugugauuuuuaguauauucagagaguuguacaaccauuucugcccaccucagccuccuaaagugcugggauuacaggcgugagccacugugcccauaucagccuauugcauuugccuauucuggacauuucauauaaauuccaucauacaauauaugaccuuuuguguuuggcuucuuuuuuuuuuuuuuuuuuuuuuuuuuuuugagaaggaguuuucacucuuggugcccaagcuggagugcaguggcacgauuugggcucacugcuaccuccaccuccagggcucaagcgauucuccugccucagccucccgaguagcugggauuacaggcgcccgccaccaugcccagcuaauuuuuuuguauuuuuaguagagacaggguuucaccauguuggccaggcuggucucaacuccugaccucagggugaucugcccaccuuggccuccaaaagugcugggauuacaggugugagccacugcacccggcuguguuuggcuucuuucacugaacauguuuucaaguuucaucuacuucauggcauguaucagucaguauuccauuccuuuuuuuuuuuuuuuuuuuuuuuuuuuugagacagagcuuugcucugucaucuaggcuggagugcgguggcgcaauaucagcccauugcagccuccaccucccaggcucaaguaauucucccaccucagcuucucuaguagcuaggaccacaagcacacaccaccacacucggauaauuucauuuuuuaaauuuuuuguagagacgaggucucacuauauugcccaaacuggucuuaaacuccugggcucaagugauccucccgccuuggccucccaaaguacugggauuucaggcgugagccacugaaccuggcugugcccuuuuuaaauauagacuuucaaauuugaguuagcauaauuaggaggcaggaggaucacuugaagucaggaguuccagagcagccugggcaacauggugaaacccugucucuaccagaaauaccaaaaaauuagcugggcaagccaggcacgguggcucacgccuguaaucccugcacuuugugaggccaagacgggcagaucaccagaggucgggaguuugugaccagccugaccaacauggagaaaccucguuucuacuaaaaauacaaaauuagcuggguguuguggugcaugccuguaaucccagcuacuugggacgcugaggcaggagaaucgcuugaacccgggagggaggcagagguugcagugagccaagaucgugccacugcaccccaggcugggugacagagcgaaacuccaucucagaaaaaaaaaaaaauguuuaucaagcccaguauuaacacucucggagcgagagagcagacugaccucugcaaaaugagaucagcauuaguuugguguaguuugggucuuuuuauguguuuuuuuggcugccuaaucucuagucagugucugccuuuuugauugauggguguguugcuuagugcuugccugcugccuccaucccauaauuuuaaguacaugcaugauaugcaguccaugugcaugagcguugaugaguugauuaucauacggggucaucauaaggacacuuuuucucuuugaugcauaugacuugcccugaagagcugccccuugcugguuuggucuugauccugcgggccaugggguccuugcuugcuucucuuagcuuacuuuuuguuuuggccugcuuaacuucugccuuuuaucuugcuucuugcucaccuaccccuucaccuugcuucugcucucauguucuuacucauucugcccuuuauccaacuuuaaauucccuuuacuauuauccugccucauuuucuguauucugcuuccucaguuacagugagccgugauuguaccacugcacuccugggugccagccugggugccugagugagacccugucucaaaaaaaaaaaagcuauaaaaucauuuugcaaacuugaguguacuaggaaaagguauuacuauuuuugguuuuguacaaaugauuuccuuucuuuuaugaauuauuuucuucaguuauauuuucugaaaucaguuuacuguuucaaaggguaugacccaggauaaucuguugauucaaaauucggcaaauauuuauugcaugcuuggcugggcgcaguggcucaagcauguaaucccagcacuuugggaggccgagguguguggaucaccugaggucaggaguucaagacacaucuggccaauaugguaaaaccccgucucuacuaaaaauacaaaguuagccugguaugguggcgugcgccuguaauucaagcuacuugggaggcugaggcaaagaaucacuuaaaccugggaggcacagguugcagugagccgagaucacgccacuacacuccagccugggcaacagagcgugagacucugucucaaaaaaaaaaaaaaaauugcaugcucgcuauaugccaagcucuauucuaggcacuggagaaugcagcaaugagcaaaacaaaaugaagcccuacagcauggagcuuuccuuuuguuggacugguuuaugauuuuuacuauauaaaucaaugauuucuaaaugcuagaagaacacuaauauaugaugacauuuccauccgucugaagugaaaugagaaaaauaaggauaauguauucuuacugaauucugaccacuguucgguguucuaaauuccuuucugaggagccuggagagagccaugucugcagcccauccaucuugcuaaacaggucacuuggacccaguauguuauggcuugcucucauaacuugacucuggcauagcaucaaucacacgaugguuagcagacuuccuuaacuaacuuacgcuaauauuaaacauuccuuucuacugacuccaacuuuuuauuuuuauuuauuucuauuuauuuuuugagauggagucuugcucuguggcccaggcuggagugugguggcgugaucucggccuacugcaaccucugccucccggguuaaagcgauucuccugccucagccucccaaguagcugggacuacagguacacaccaccacacccagcuaauuuuuguauuuuuaguagagacaguguuucaccauguuggucaggcuggucuugaacuccugaccuaaggugauccacacaccucggccucccaaagugcugagauaacaggcaugaguuacuacgcccagccaagacuucuuaaauuaguguuuucuuggacugcaguuacucauuggcuaagaauaagucucuuuaaauauuugucagaguuugguuuuuccauagacaguauggaguuuuucauagugauuauggauuuuaaaggacauagcugagauuauaucauauacuguauacuuuuucggaguguuaaacaagcuguuucuuuuuuuuuuuuuuuuuuaagacggagucucgcucugucgcccaggcuggagugcagugguacaaucucugcucacugcaagcuccaccucucggguucacuccauucuccugccucagccuccugaguagcugggauuacaggcgcccgccaucgcgccuggcuaauuuuuuguauuuuugguagagaggggguuucaccguguuagccaggauggugucaaucuccugaccucaugauccgcccgccucagccucccaaagugcugggauuacaggcaugagccaccgugcccggccaacgcccagcuaauguuuguauuuuuaguagaagaugggguuucaccauguuggcaaaguuggucucgaacuccugaccuuaggugaucugccugccuuggccuuccaaagugcugggaugccaccgcaccuggccuacaaaaauuuuuuaaaaggccaggcaugauggcacaugcccagagucauagcuacucaggaggcugaggcaggaggacugcuugagcccaggaauuugagguuacaaugagcugugaucaugccacuguacuccagccugggcaacagagugaaacccuguuucucuuuuuuuuuuuuuuuuaaaagaagaugauucuuugggagauagugauagggaauguaccaguuucuauucacuccauuuccucaccuguucuguuagaugcugauuucuacugaaauuaccaagguuuaagaguaacuuuggagaggagagugaaggaccuuucucuacacauucgcagugucucagaagccucagggcuccugagauguauuagauccuugguggaaucacuguauggccagagcucgguuuuuuuaauuccugugguacaucagagcugugucugccuggaagagccacagaaaguggagggugacaggguugagcaauuuauuuuuuccagagacucuguagaccaggcuggaguguaguggugcaaucacagcucacugcaaccucaaacaccuaggcgcaaguaguccucucaucucagccggccucccgaguagguaggagugcaggugugugccacaacgguuggcuuuuuguacagauggggucucacaauguugcccaggcuaaucuugaacacuggggcaaaugaucaucaugucuuggccuccuaaaaugcugagauuauaggcaugagccacugugcccagccagggucuaacaauuuuauuuauuuauuuauuuugagacagagucucgcucuguugcccaggccagaguguggcggcaugaucuuggcucaccacaaccucugccuccuggguucaagccacucuccugccucagccuuccgaguagcugggauuauaggcaugcgccaccacgcccggcuaauuuuguauuuuuaguagggacaggguuucuccauguuggucaggcuggucucgaacucccaaccucaggugaucugccugccuuggccucccaaagugcugggauuacagacgugagccaccgcgccuggccaggguaggugcuuaauucauaggcuggagccucuuugguuuugaucagguagaagccauuauuuaaaacuuucucuggggcugagagcagaacuuuugguugugacaaaagucaaacauuugaggaucuuguucagaauauucugagcauuagggccucguccuguuccuaucuucuuuucauggagaggaacuuacauuuuuuaucuuucucuauuucuccaggccucaucauuucugucuccuguuucuccacuuccuucucuguugguugguccacugauguauggacuugcacaugaugaacugugaacuucuagccacauguagugcccuuggguacuuggagggagacacuuaccauaaggaaccagauugcuuaggugaguaccuuuuugaugaaacaggaaaaaaauuggcuugaauuaaggaggucuguugaauuccucaaaccaugggugugaaaagaugugggucuggauggagcuucuuccaagguuccacaugcauguuuuguucugucucugaagagagcgugaaggaucugauccgcuauuugaggcaugaggaugagacacgagaugugcggcagcagcugggggcagcccagauccuacagagcgaccuucugcccauccucacccagcaccaccaggacaagccucucuuugaugcuguuaucagguugccucccuagcuuuuaaacuuuugccaccugccaggcuuugguguuugagcugauagguuuggcguuugagcugguaaagaaacuuaacaacuucucccuccuucauugucucccagacugauggugaacuugacacaaccagccuugcucuguuuuggcaaucugccuaaggagcccagcuuucggcaccauuuuuugcaggugcuaacuuauuugcaggccuacaaagaggugaggauuuccuuuggagucccugggguggaauauggggcaguggugaagaaguggaugacugcuacuuaagaucagguucccuauuucacaggccuuugccagugagaaggcuuuuggaguccucagugaaaccuuguaugagcugcugcagcuggugagugagucuucaccuuacaggauaccaugggacagcauuuugcaccuucuccgggcagaggaggagaugcugagauauggucccaguccuuggggaugugguaguccgauccauagucucuggcugccucaguacuguuugaacucuuucuuuuuaauccugcuucucuucuaugccugggucuuccagccagaguacauacugccugccuuccacagggagucucuuccucuuacucucuucugguuagggcugggaggaacggcaggaggaagacaacuugcugauugaacggauccuacugcuggucagaaauauucuccaugucccagcugaccuugaucaggagaaggugagggucuuggguguucuguguucuugugcaugguuagguugagcugccuuuuuuuuuuuuuuuuuuuuugagacggagucucucucugucgccaggcuggagugcaguggugcgaucucagcucacugcaagcucugucuccuggguucacgccauucuccugccucagccucugccuccugaguagcugggacuacaggugcccgccaccaugccuggcuaauuuuuuuuuuuguauuuuuaguagagacaggguuucaccauguuagcuaagauggccucgaucuccugaccuugugauccacccacuuuggccucccaaagugcugggauuacaggcgugagccaccgcgcccggccaagcugcccuuuuugggcuauucuguccucugacaagucugggagaggaggcuuggucaaagaaugaguuggagagcuucaaggcagggcagugggauugaaugagcuuccuuucuacccucaccacucacugcucagaagauugaugaugacgccagugcccaugaccagcuccucugggcgauucaccucagcggccuggaugaccugcuccucuuucuggccagcucgucugcugaggagcaauggagccuacaugugcuagagauugucucccuuauguuucgugaccaggugagacccuggccuauugcccgaguccccuccgcccauguacuuuucugcuguacagccagaauugcucuugugauaauggcugcauuaucuggggaaggcaggcgacagcaggaguagccaugucuugaguucaguaguacccccuuauucaugguuuucuuuccuugauuucaguuacucacagucaaccauggucugaaaauauuaaguggaaaauuucagaaauaaacauuuuagaaguuuuaaacuuguacauuguucugaguagugugaugaaaucuuuugucccuguuuguccuaaacaagaugugaaucaucccucugcccagcauauccacaguguauacccgccuguuagucauguacuagccaucuuaguuaucaaauugaaaaaacauaauagaauauguguaugugcguauauauauauguauacauguucuguuuucugauaacuauauauauagcacauauauacauucuauaaaacauagaacguacauguucuauguauauguguauacacauacaaauauauauauguauauaugaauauauacauauauauauuucaguacugucugcaguuucaggcauccagugggugucuuagaacauuucccccucagauaagggagaacgacagcacaaugccccauuaaugggguucuauuuuguucacucuuugcauccccaguaggcgugaacucaggauaaggaaugacuguccuccugauucuucccucuuuguuccaaucuagaaccccgagcagcuggcgggaguagggcagggacgcuuagcucaggagcggagugcagauuuugcagaacuggagguguugcgccagcgagagauggcagaaaagaagacucgagcccuccagcgaggcaacaggugagugacagagaggcagguucuuuuuccuacaucauggaaugcugagggcauagaaggcaaauucuaagguggggugauugaacaacauuuuaguguuuuuuuuuuuuuuuuuugagacagaauuuugcucuugucgcccaggcuggagugcacuggcacgaucucugcucacugcaaccucugucuccuggguucaagcgauucuccugccucagccuccccaguagcugggacuacaggcgcaugccaccaugccaggcuaauuuuuguauuuuuaguagagacaggguuucaccauguuggccaggcuggucucaaacucccgaccucaggugauccgccugccucagccucccaaagugcugggauuauaggcgugagccaccgugcccgaccaacauuuuguaguuuuaacuugcuccaaugugccgaugauagagaauggagauaaaguuuccagagaacugaaaaaucaccuuggaccuuuuuguuucugcaggcauucucgauuugggggcuccuauauuguccagggguugaaauccauuggggagagggaccucaucuuucacaaaggccuucacaacgugaguauucuuacaucuggagugggaacauaguggaguugcauagcuuaagcaggguaaucaucuuaagaguucuuggcugugccugguggcucacacuuguggucccagcacuuugggaggcugaggcaggaggauugcuugagcccagaaguucaagaucagacugggcaacauggcaagacccugucucuaaaaaaaaaauuaaauuaaagguuggguacaauggcucaugccuguaaucuuaacacuuugagaagcuaaggaaggagaauugcuugagcccaggaguucgagaccagccugggcaacauggcaaaacccugucccuacaacaagugaaaaauacuaacugagcaugguggcacccgccugugguccugacuacucgggaggcugaggugggaggauuccuugagcccaggaguucaaggcuccagugugcuaugauugcaucauuacacuccagccugggugacagagcaaguucuugucucaaaagaaaaacaaaaauuaguuucuucugagaaaauugacgagagcugcaaggggaaagugguauuuaggaguaauucuaaucccccaaccgacacacccagcuacgaaacuacaguucagauuugggaaagcagccgaaaaaggugccuaaacgucgccaggccgcccgagagcuguccauucagcgccguucugcccucaaugugaggcucuuccucagagacuucugcucugaguuccuggagaacuguuacaaccggcucaugggaucaguaaaggugagaaccugugaaggauauggagauaaucaggaauggaauagacaggugaugaugcagcuguugguggguaagaaguggggaggagcucggggaggcugccccuggaauguggacucguaggugggaaggauauacaguuaggaugucccugagagauagugaaaaugccaggaacgagugggcuccuggcaugacaaaagaggcucuggaaaaauugccucagagggagaggaaagggagaacaggagagaguuggaaauuguggauccuagaguauuauagcggugucccggcgugguggcucacaccuguaaucccagcgcuuugagaggcugaggcaguggaucacuugaggucaggaguucaagaccaaccuggccaauauggugaaaccguaucucuacuaaaaaaaaaaauacaaaaaaaaaaaaaaauuagccggcaugguggugugcauuuguagucccaguuacucaggagccugaggcaggauaaucacuugaaccugggaggcagagguugcagugagccgagaucagaccagugcacuccagccucaucaugacagugcaagacugucaaaaaaaaaaaaaaaaaaaaaaaagaccaggcgcaguggcucacgccuguaauaccagcacuuugggaguccaaggcagguggaucaccugaggucaggaguuugagaccagccugcaacauggugaaaccccaucucuacugaaaauacaaaaaauuaacugggcgugguggcgggcaccuauaaucccagcuacccaggaggcugaggcaggagaaucgcuugaacccaggagguggaaguugcggugagccgagaucaugccauugcacuccagccugggcaauagagugagacuccgccucaaaaaaaaaaaaauuaugacgguguccagcauccauuccaucaucauaggacaggaaggaagaaguuggaagcccuggagucauggugaucuuuuuuuuucuuuuuuaaaugucaggaucaccugcuucgggagaaagcucagcagcaugaugagaccuauuauaugugggccuuggcuuucuucauggccuucaaccgagcugccuccuuccggccaggccugguuucugagacccucaguguccguaccuuccacuucauugagcagaaccucaccaacuacuaugagaugaugcugacugaccgcaaggaagcugccuccugggcacgccggugagugggaugguuacuggagauacagugagcuagggaucugaaugcuugaauucuggcuggugcuuuuuuccugauucaggguucaggugaucagucuggggagcaaggacuggcugggaaauuuaguuuggguggcacauuuuuuuuuuucgcugugggaaguugcuguuuccaugggccauugcccuaagcuguccuccauuucaccguuucccgucaacucucaggaugcacuuggcucugaaggccuaucaggagcugcuggcaacagugaaugagauggacauaucuccagaugaggcugugagggagagcagccgcaucaucaagagugaggcccuggccugguccccgaucccagccugucccaucucgugaugagaaucucauucuucccagucccagcuucauccaucucuccuuuucaagcuuuccagaauagcccuuccaucccuuucucuuccccauuccuagacaauauuuucuaugugauggaguaccgagaacuauuccuggcacuuuuucgaaaguuugaugagagaugccagccccgcucuuuccuucgugaccugguggagaccacccaccucuuccucaaaauguuggagcgauucugucggagccgugggaaccugguggugcagguacugggcagccccacaauguagaaagagcuguaagggagagucaaggaaggggggcucuuucuucucacaguuuguacagcuuaaguucaucuguuaaacgugcucugaacuacgacagcaagagguuuguggguguuggccagugugagucuacuacaguuuccuucucccauuagaauaaucucugaucugccauaaauauuuuaguucagucaggaaacauuuauugaacaccuaccacaugccaaguacaaaaacccuggggauucauaauuuuagagucuaauaauuaugcuauagcauuuucugguuauaccuugaaagcauuguggugagguggaaagagccuuaaauugcggccaggcaugguggcgcacaccuguaauccccgcgcuugaggaggccaaggugggcagauuacuugaggucagggguucaagaccagccuggccaacauggugaaaccccgucucuacuaaaaauacaaaaauuagccaggcguguugaugcacaccuguaaucccagcuacucagaaggcugagacagaaucgcuugaauccaggagguggagauugcagugagccaagaucaugucacugcacuccagacugggugacacagugagacucugucucaacagcaacacaaagagagccuuaaauugaacuuuagaaagucuggaaucuaguccuguauugguuauuauuggaauaagcucaagcuggucgugucggucuccagauccauaaaguugggauugugacaguuguccaugaacccaaaguggaaucagugaaaagccuaggacaggcugggcacaguggcucaugccuguaaucccagcacuuugggaggccacaguggguggaucauuugaggccaggaguuugagaccagccugggcaacaugacaaaacuccuucucuacuaaaaauacaaaaauuagcugggugugauggcacgcaccuguagucccagcuauuugggaagcugaggcacgagaauugcuugaacccaugaggcagagguugcaguaggccaagaucaugccacugcacuccagucugggccacagagcaagacucugucucaacaaaaaacaaaaacaauucaccagcaugguggcacauaccuguagucccagcugcucaggaggcugaagcacgaggaucacuggaacuuaggaguuugaggaugcagugagcugugauugagacauugcacuccagucugggugagaccaagacccuaucucugaaaaauaaaauuauugguucacauuaaaauaaaaaaaacccugggacaaaaugcaaacuccaaggaauuuguauccuggaaacacagagacuuugcuuuguauaaacagauuuugggccaggcgcgguggcucaugccuguaaucccagcacuuugggaggcugaggcgggcagaucacuugaggucaggaguucacgaccagccuggccaacauggugaaacccugucucuacuaaaaauacaaaaauuagccaggcauggucaugcgcaccuguaaucccagcuucuugggaggcugaagugggagaaucacuugaacccgggaggcggagguugcagugagccaagaucaugccauugcacuccagccugggcaacagagcaagacuccgucucaaaaaacaaacaaacaaacaaaaauuagccuggcgugguggcacacaccuguaaucccagguacuugggaggcugaggcaggagaaucgcuugaacccagguggcagagguugcagugagccgagaucacgccauugcacuccagccugggcaacaagagugaaauucugucuuaaaaaaaaaaaaaaaaaagauuuuguaccagaaccuuccuauaacucuaguugcuacagcuuaaaauucugucauaacuggacuugaaagaugcaguaguaccaacgagacuuugcuaaaggguauuuuugcacucagagcucugugguauuaucuguaauacuagguacuaucauuuauugagcauuuacugugugucagacacugugcugacguuuucauguaauccucacaguagcgcaugugcccaaagugguuaagcaacuuguccaaagucuuguuaguaauacuaauucaauacucaaauccagaucugcuggacuccaugcuccuaaguuuugguguguuugauuguaaguucuuuaauggagcaugaccuucaggggccucucaguucauccuguuugacuuuucaguacccacaccaaagacugguucacagcccugacuugggagaagcaggauuuggguauugacucacucuccugcuuuucuuuuuuuuaauuauuuauuuauuuauuuauuuuuuuaagcagggucucgcucuguuaccuaagcuggagugcaguggcugaaucucagcucacugcaaccucuccuucccgugcccaagcgauucuucugccucggccucccaaguagcugggacuacagguacacaccaccaugccuggcuaauuuuuguauuuuuuguagacacagggucucgcuguguugcccaggcuggucuugaacuccugaccucaagcgauccaccugccuaggcuucccaaaguguugggacuacaggugugagccacugcgccuggcuguccuacuuuucaggagaaaaaauuagaggcuuuauuuacauagugcuuugcauuuuaugaagcuuuuccaugugucuuauuugauccucauagcaucugcuuauucuguagaccucuugagauagcacugcuuuuggcaaaccucugaacucaggaaaugggucaggaguuuugccaugacaucuuaugcucacucacauuauagcuuuuauccacacucuaguguaauuaccuuucuacuuccugucuccaccacuagaguaaaagcuccucaaagggaaggaaauaugcuguucacuauugcuuucuauuaccgauggauagcagauaaugggcacucugugaauguccaguuaauuaguuuuguaauagaaaagacacugauggggaaagcccucuuuagcucucuugacauccuaauacaauucuuuccccacagaacaaacaaaagaagagaaggaagaagaagaagaagguccuagaccaggccauuguuucugguaaugucccaucuagcccagaagaaguggaggcuguguggccagcccuggcugagcagcuacagugcugugcccagguaggugguuacagaaacccugucuuuuuugagaauagugcucaggguauacaaucuggguuuuccacucccuccgcucccauagcuuuauccaucucuagaauucugagcucagcauggacuccgugguucccuuugaugcggccucagaggugccaguggaggagcagcgggcagaagcuaugguacggauccaagacugucuccuggcuggccaggccccacaggcccugacucuccugaggucugcucgguaagaacccugccugcucauccucuugggcuuugggggaaggaggaggccaucacugcgguacaguguucucagucuucaaaagagaguugucucaucaaggcucugggacuguauaccaacugacuccuggggcguuuugauugguuuguuggguuuuuuuguuucugaaaaacauuaaaaaagcauaguuaauugagaaaaaaauaaagaaagcaaauccucacuugacaucaucaauaaguccuugguaauugcagcuuugaguaaaaugaccuacggcauguuucuuauaacguuaagagaaaaaaaacugguuuuguuauacauuguuucacuuaaaguggcaguauccaagaaccuauugaagacauuaagggcggacuuaacuuuaauucuaguagccaaagauaugcaucauuaacauuuugaugaguaaccauccagagguuuuuuugcuccguuacauguaaaaauaucguauauaccuuguuuuacaaaaaugaaauacuguacaugcugauuuauaguaauuuuucacuucucaguauauuaugagcaugauuucucaucagauauauuucuguaauuguuaauggcuuuaaaacaccauugugugaauauguacauuuguucaaccaggugucaaacauuuagauuguuugcauuuuguucuuagcugguuuuuauugaauuguggcuuaugaggaaaauuuucccuggagucuuuguuucauuugagguaacaguuugcauucuguuucuggccaacaaaagaaauaagucuaaauuccuucuucuacuucgaauuauaaauuuaaagccagauuuccccuggguaaagccuuuuuucuaucugugcuccagggagguguggccugaaggagauguguuuggcucucaagacauuucuccagaggaagagauccaguugcugaaacaaauccucucugcuccacuuccccgugagucuccacccuucacaucugucuccuuccagcucuuuucuagcaccaacauaacagagacucaguaauccucccucugucuauagggcagcagggcccagaggaacguggggcagaggaagaagaagaggaggaggaggaggaagaggaggaguugcaagugguccaggugucggagaaagaauuuaauuuucuggacuaccugaaacggugcgggcugagaggccugaguugguccuagaguggcgauugugcggcugugaggaugagcuaugucuuccuuaugcugacauccucucccuccuuguuuuggugcagcuuugcauguucaacugucguucgagccuaugugcugcuacuaaggagcuaccagcagaauagugcccacacuaaccauugcauugugaagaugcugcaccggcuggcccaugaccucaaaauggaagcccuacuuuuucagcugucagucuucugccucuucaaucgucugcuuagugacccugcugcuggagccuacaaagugaggggauaacaaggaaugggguucuggaaggguaugggaacccucagguaaauaaauaaucuucaggagauagaaggugcugagaggugucaagggcugggagaugggaaaacaaugagaaaguagacaggcagguugagggagcugcauggagaaggacagaagagagugagugaggagggggcagcugggaacagcuauagagaaaauaccuagagggccagguucgggucugcauuggaccagagaggccucauaguaaccuccuucuccuacaggagcuagugacuuuugccaaauacauccugggcaaauuuuuugcacuggcugcagucaaccaaaaagccuuuguggagcuguuguucuggaagaacacagcugugguucgagagaugacugagggcuauggcucccuggaugacaggugagcuugaaguuggcaaaggguggguggggguaggggaaguuugaugcagagucacagaaugucaaagcuguuaagagcuugcaugucauuuagcccacuguuucuuucccuauuaugggugagagaacaggcucaggaggugaaaugcuuuaccuaaaguuauccaagagaggagcagggacuggagccuaagucuaguguguaucuaguuuccuucuccaucaccagccuccauagagguagucacuguugggagcugggugguugcccagagggagucugugugcgaccucucccaaaaugugcugggaaaccaugaggauuuguagaaauguuuguccucuuucccuuaguaucucagccccucuccuuucacacuuagucucuuuuucccauaauauucucagucccuagagucagaauggucaggguuccauuggcccaaccuggaaaaucucuuaguuugacuuuuagguucuuacguggaaggaaagugaggggaaggaggcacacuguaggccucugcuggcuggccucuuucaguuaccugccuuguccuuccuguucuuuucagaacugaucagagaaggccuuuggucuccucuuuuugggccaagaaccuauaugcucccuuucuccuuucaccauucaggucuuccagucgcagagcaccuacauggagccccgaagaagaggcucaucuucgggagcuguaccucgccaauaaggacguggaaggugagaggccuugggaucuggagaguuuaugaggagggcagcuugagcugugggaccuucuuuacugccuuaguccuuccccacgccagggcaggaugugguggaagccaucuuggcccaccugaauacuguuccucgaacacgcaagcagaucauccaccaucugguacagaugggacuggcugacagugucaaggacuuccaaagguagagaggcacaugcucuggaggcuauugggauggggacucgugaucacuuccugggcuuccucuuccacugacaccuuccuaaucaggaaaggaacccauauuguacuguggacgggggaucaggaguuggagcugcagcggcuuuuugaggaauuccgggacucagauggugaguaagcuggaaacucaggggaccuuugagaugaaagccaagcuauccauuuauuuuggggcugccuuuuauucccaaggaaagauucucccaucccuucuguucacuuacuauauuuguaagugucauuuuuggaugaauugagguacccucuuuccagagaccucugauuuauuuuacucaucucuuucccuguuacccuuggguauucacaugcuugcuuuuuauagauguccugggucauaucaugaagaauaucacagccaaacgcucacgggcccgaauaguggauaaacucuuggcucuggggcugguggcugagcggcgggagcuguacaagaaacggcagaaaaaguuggcauccuccaucuugguaacaaucugacccuagcucugcuggcaugggcucacuucccuugaagugguccuuaggagcaguccaccuggauucuuccugccugaggcuguucugaccagguccuuccgagagagcaggcgcgggggggugcgguggucaggaacgaggagacuccacuaaguuccuuguguugccuucauuuucauucccccaacccccaaugaauuuuagccaaauggagcggagucccugaaagauuuuugccaggaagaucuggaagaagaggaaaaccugccugaggaagacagcgaagaggaagaagaagggggcucagaagcagaacaaguccaggguagcuuaguccuuucaaaugaaaaccuuggucaaagccugcaucaggaaggugaggacuuuggcugggagagaugucucagguggagggcuugggaguagggucaaauguaaguuucccucauuuccuuaggcuuuucuaucccgcuccuauggcuccagaacugccugauccgagcagcugaugaucgggaagaggauggugaguggacaggugacacuuuuaggagaagagcccuggaggcuauuggagaccuaccuggucaugggauggagaaccaguucuucccuuauaucuucaccauaugacuauugacccugucuuaggcugcucccaggccguuccauuggugccacucacagaggaaaaugaggaagccauggaaaacgaacaguuucagcagcuguugcgcaagcuagggguucggcccccugccucugggcagguaaauaugucaguuacagugucaaccaaggcguguuaguccuauuuccaaauacaucuccuccuccuccucacugucauggugguccuccuuauccuuaucgucaucuugguccuucucauugucuugucaucucugaccaagauuccugcagcagccauucugcuagucuucuuuuccucucucuaaucuccccuuccccuagauccaucuuccagacugccuccagauuuaucuuuuuaaaauauagucuugauuacaguugucccuuagugucugagaggggauugguuccaggaccccccugcccacagauaccaaaaucuauagaugcugaagucccuuuuuguaguauuuguaaauaaccuagguacaaccuguauacuucgucauuucuagauuacauauaauaccuauacaauguaaauguuagguaaauaauuguuauacuguauuguaaauauauauauauacauuuuauuuauauauauauauauacacacacacacacacacacacauauauauauauauauauauuuuuuuuuuuuuuuuuuuuuuuugagacagagucucacuccaucacccaggcuggagugcaguggcucagucucagcucacugucgccucaaccucccagacucaggugauccucccaccucagccuccugaguagcugggacuacaggccuauauuaccacucccagcuaauuuuuuguauuuuuuguagagaugggguuaugccauguugcccaggcuguguauuauuguuuaauguuguauuguuauuuuuuuuuaauauugucgaucuacagugguuugaauccacagacucagaacuuguggauauggagggucaaguccucuguccagagccauugaugguuccuuacugcuugcaggacagaauccacaaacuccaaauggcauccccauccuuggccaaccuuugcagccucacagccacaccacucacacaccgacuuuacaucauagucacccugguaggcuuuuucaugccuccaaaugguuaaucaugccagucccucuauuggaaggcugcaaccgugcacacagggugacacacacacacacacacacacacacacuccaucugucuuacugauggaccucuacccagucuucaagagucugcucaauugucaccuugucagagaagcaguccuugucauucuuucaaccccugaaguaaaaauaaucacuuuugcagcugugauuuguucaugccccugaugcagccuuaauccuguggaaucugcuggguaugguggcucacgccuguaaccccagcacuuugggaggcugaggcaggcggaucaccugaggucaggaguucaagaccagccuggccaacauggcaaaacccugucucuacuaaaaauacaaaaauuagcccgguguggugguaggcaccuguagucccaccuacuugggaggcugaggcaggagaauugcuugaacccaggagggugagccuuuauugcuuugccacggcacucuagccugggcaacagagugagacucugccucaaaaagaaaaaaaaaaaaauccugugauacuacaguacauuuguucuuuuucccauuggauugugaguuauuugauagcaaggaucauaccugauucaccuuuacauccccaggauuuauuuauuuauuuauuuauucaauugacaacuauagccagguguaguggcucaugccuguaaucccagcacuuugggaggcugaggugggaggaucguuugagacuggccugggcaacacagcaagacccugucucuacaaaaaauuuuaaguaguugggcaucaugguggcaugcaccccugugguccuggcuacuugagaggcugaggcaggaggauagcuugaucccaagagaucgagacuacaguggaccaugauugugccacugcacuucagccugagugacagaggcagaccccuucucauuuaaaaaaaaaaaaaaaaaaagaacaaccaaaaaaaccuauaacugggaaccuccuaauguagcaggcacugugcuaggcacuggguauauauuagauaguaaguauuauaauaaauagaguucacaacccuuguggaucuucaccaauauugggucauauauauucaaugaauaucauacucugggaaacaaaaagcugguccuuucccuuuucaacuuuuuggccccuguaggaaaccuucuggcgaauuccagccaagcugaguccuacccagcuccggagggcagcagcuucuuugagucaaccagaggaggaacagaagcugcagccagagcugcagccuaaagucccuggagagcaaggcucugaugaggagcacuguaaagagcaccgagcacaagcccugagggcccucuugcuagcccacaagaagaaagcgggccuggcauccccagaggguaauagugcgacagccaucuucugaguauuaacgugucagccauguuggucuagagggcaggaaagguguucugagaauaugaggaccgaguuccuaauuuugugucauuuauggucauugcagaggaagacgcuguugguaaagagccgcugaaggcagcacccaagaaacgacaauugcuggacagcgacgaggaacaggaagaagaugagggcaggaacagagguagggaauuugaugggaccuucuuuuucuucucuaauccugaagacaaacucuaccacguccuuaccccuuaacauauuuagauauucucucucucucucacccccaucguucccacagcaccagaguugggagcuccaggaauccaaaagaagaaacgauaccagauugaggaugaugaggaugacugaagagcuaagaagccuagggguagagauagacacguuuuuagauggugcauucaagucagaguuggaagggucauacaggacccagaagcuccucuuacuggacagagcaguagaaucccaggcucuuucacggauuuaggcugagaaacuucagcagcaguauuggacuucucugcugucagucuuuguuucucccaguuuuuaucgguaugccccagcagcucucuggagauuuaguucucuucuucuaggaaccauuucuuuugguuauuggagcuccuuagcaaauaagaggagugagugaaauagagaaagcaccccggaccccuuuuauuggucuguuccuuuggcuuucucuuggaggugggucgcagcaccagauggggagcuuuaugacaugacaggcgggaguuuuguaccacuuuuagaagauaccagaugccucuguccucauuuuguuuccuaugaucauccucuagauaccagauagaggcccauuccugcauuugagauaggguuggaauauaguacucuagaugaugaauguguuugcuuuguguuugguauuaaacauguaagauuagaaguucucaucucagucugacuuggcgauaugucuaaguuccccagcccuuccccugcugugcucuugaaagaagaacuuaacaauuuuaggguaaaaagagaccaacagaccggcacaguggcucaaaccuguuguccuagcacuuugggaggcugaggcgggcggaucaccugaggucaggaguuugagaccggccuggacaauauggcgaaaucccaucuccacuaaaaauacaaaaauuagccggccaugguggcaugcgccuguaaucccagccacucggguggcugaggcaggagaauugccugaacccaggaggcagagguugcagugagcuaaggucacgccagugcauaugccugggcgacagagcaagacucugucucaaaaaaaaagaaaaaaaaaaaagaccaacaaccuucccuuuucuuccgcuuucccuacagaagacacagaaaagcauuuuugccucuagauccuuuugucuaggguaaauucuuagggugacaagaguaugcggcaggaagaaggaggagccauaaaggaagagaagccagcuuguuggcauggggcauagaaaaggacaaaaucuaggcaugaaaaggauggauaaauacugcaaauauuauguucuuacccauucuuggaaacgucagcuuucuugcuuccugugcuuccagccgagguagggcaaaggugagauugagaaaauagccauucagcucaggaaggcuucuaaguaaaggauggauuugga

SEQ ID NO: 192200 - RNA, 3684 nt, Homo sapiens
gggggucgcugcgaaccccgggguuccgcgguggaggggugcuauacugggaugcaggcgcggcggggacuggcagcaaucaugcccugggagcuaacguagagcuuuggauaaugcuuuugcaaguuguacgagaagggaaguucucggggugaguguccaaccucuucuuggcccucgcgggcgcccugggguccccggggacagugaugcuuccuuaaagucuuagcuuucagcaguaguguaggcccagucaaaggcaacuggcgcuucccacacaccccuuuuucucaucccccucaccccgcccccagcccuguccuuagcugcccucgaccuuuugcacucgugacucccuggccagagagagccuagcgggcugcagcaggugcuggggggaaagcuuguuuggacgaccuucgucugggaugcacucuucuucuccuucaccuacaaaugauagaggauuacgaagaacuauacgguuggcuccucuuuccuuuggccuuagguuucugaccuccugcagccuccucuugccucgggcugcccagaucuuggcggcugaggcuggcuuaccuucgagccguuccuucaugggauuugcugcucccuucaccaacaagcgaaaggcuuacucggagcguagaaucaugggguaagcauucucugccuugcauccuugcaccucccuuuucccuccaaauaacccuguccaggcaagaaugucaggguaucaucggugggcaagauucaucccuagccaucccccuccccagcuacaauacugauccucaguccuccccugccacucuuccgaccuuaauuucucccuucuugguugcugugcaugugcuuaagugaaaugagacuaggguuggacuauacuuuaagacaacagggcguagcugggugcgguggcucacgccuguaaucccaggacuuugggaggcugaggcgggccgaucguuuuaggucaggaguucgagaccagccuggccaacauggugaaacccugucuccacuaaaaaaaaacacacacacaagaaucagccuggcacgguggcgggcgccuuuaaucccagcuauuugggaggcugaggcaggauaaucgcuggaaccugggaggcagagguugcagugagcugagauugccccacugcacuccagccugggcgacagagcaagacugucucaaaaaacaaaacaaaaaacaggguguauuuuucuggugaccauuuaaaaauaauuuuuauggguaccuaguauguguaaauuagcagcguaaccuuuuuaguauauuuugagcauaauagcuaaauuaucgagcacuugcuacaugcuagcagcuugacuuagauguuuuacauagauauuucucauuuaauucucacaacaaaccuauaaaucaggugagaaaauggagacacagguaauuuaccuaaggccacauuguuaaaaaauuguuaagagcugggaucugauccuugugugaucaccaguaaaacugacagccucuguucucccuagauggucccucuuaaaaucaaaauaaacaaugaaugcaaaagcauucuguaaacugcaaaauauaagguaacaguaucauaaggauuuacacguuugcuuuugggaaguuauucauccaggcuuauuugggaucuguaguuccugaaggugcgugguuagugggcaaagguaugaauuaggggccuauagcaaggaggaaccugacccagcuggcagcuccuuggccugugauucuucuucuccuagguacucaaugcaggagauguaugaggugguguccaacguccaggaguaucgugaguuugugcccugguguaagaagucucuggugguauccagccguaagggucauuugaaagcccagcuggagguuggcuuuccaccugucauggaacguuacaccucugcaguuuccauggucaaaccucacauggucaaggugaggccuguaugggagggauugacaagauuuuuuguuuuuagcaguuucauaugaaagugcuauuuuggccuuccuuguaaguacuuuauguccaugugucaaguauuucccucauaucagaaaagaaggaaaauggcuuucaauuccuuuauauuguauccuauacuuaguaauguuauuuaacuaccugauuacccuauucuaggcuguuuguacugauggcaagcucuucaaccacuuagagacuauuuggcgauucagcccugguauuccugccuauccucgaaccugcacuguggacuuuucggugagucaggagguuguguagcagaggacgaggacuggguaugaggaagggcugggguacugugacaggguuauuaauuuauuugagauggagucuugcuccgucacccaggcuggagugcaauggcacgaucuuggcucacugcaaccuccaccuucuggguucaagcgauuuuccugccucagccucccaaguagcugggauuacaggagccugcuaccaagcccgacugauuuuuuauuuuuaguagagacgggguuucaccauuuuggcuaggcugcucucaaacuccuggccucaggugauccguccgccuuggccucccaaagugcugggauuacaggcgugagccaccgcaccgaccugacaggguuauucuuuaaguauagcuagcauuucccaagucaguuagucugagcuugugucagacucguacuccgugcucagucccaaguuagggcucuuacggggauccacgaacuggauggggagggggagaaaaggcacugaggaacaguuuccuugcauuuggccagggacuauccaacauggucuggaaguuucugacugucucuuacccauucccagauuuccuuugaauuucguucucugcugcacucccagcuggccaccauguuuuuugaugagguugucaaacagaauguugcugccuuugagcgucgggcagccaccaaguuugguccagaaacagccaucccccgugaacugauguuccaugaggugcaccagacuugaggcaagggauugcucccugaccucccuucuaccccacuucccuacacaauucucuuauuuauuugguuuggcuccuguuccaauuugaaaggagucuguguucauaauacuguuucuccucucaauuucccagaaauuggguucuaugcuggcuggaaauguugggggaaagagaaggcaaaggauguggaaaugagaugugcuuaggaaagggucaggcccaucguaggagcaccauaugccugcagccuuuucacuacgaauuagaauaaggacuaugugguugucucuggaccuuaucaagacaccuuagugucugaccaggggacgauaguaacuuuucuaaggauugaauaaauugagcuuuucuucuggcacagagguacugagugguaaguaacuuuuacccugccugagauuccucaggagaaaaggcaaccugccuccagccugaaauacauaaagccucauuuuaagacuguaaguccaugcugccuggcuacuagagagcaaggggcuuucuuaccaccagugcugaggagaaaaguacugaacggaaacggaguugucuuuguacucuugaguuguaccuuauucuuccacuuggccugaguuuuuauaaaauuucaauaaauugugacagugugaa

SEQ ID NO: 192201 - RNA, 20627 nt, Homo sapiens
gagcugcagcuguuugucuguucgacacaggcuuggggccgacgggggagacggagccccagguaccgagcugauggagcccaaagggcaggggcggaagcgcccgggagaugagagcagccuggccugagagcggaggcgggucugguccuaagcgagggguuagaguggcccaccggagaggggagaagggggccgggccccggcaggccuaaugggggucgcugaggaggggacugggcggccugggaccccgaaguuggugagucgggaaggcggcugggcuguggcggcggccaggccgagggccgggggcuggaggccuggagcuugagugagggcaggggcaggccucauuaagcagcgcugaagagggaggagcuggggaaaggaacagggcagcgggugagguaagcccauuugccgggaggugaggagggucagaccugucgcccgagccccgggggugacuggggcugggucccugcagagagguucauuggaagggccugagaaggguucuuaguuggguaagaagcguucuuuucagggaaagugccuauuguaaaaagaacugagggugcuaugguguugagcugagagagauuuggguucagugagggagaacuggggaaaaugaagaaggcuguauuaaucuagaagacuaagguaguugaaguaauggaagcagggccugguaucaguuaugggaacuucugggaaugcugaagggugggcugggggcucugggucuugggaguacacacucuuuuguucccuuuaguguuuagaugugguaauuugaagcuuuuuaaaacucccaggguagggaugaagaucaaaguaauuuuuuuuuuuccaugacuguuggcugcuccaaacucagccccuacacuuucuguuggccucauagcuggucuauacugcagucuguuucuuaacuuacuguuucauguccuaugaaagagcuaagaaguuggauugggggcauguuuuguccacuucuuucccacuuaauaauguggucuauagcaaauaccaugucuccuagaacugagaaucuauuucauaucuauuucauuaucuacaugggaaaggggcuuagagauccucagccaucaggagaucuucugaucauaguuggugaaacuuuugugggacuuagacuugacuuggguauuucccaggcagguaauggaguuaacagguccgaaacuaugcggugauaucacugaggaagagauuuggggaagagugagaaauuccauuucaaaagcuuggcaucaccccuuguucuuugucuacuucaaaagcccagauuucugugcuguuagaaaguugggucaaacuaugaaguaucuggggaagauggugaguagagaaaaagauacagaggugcaguagcccacgccuguaaucccagcacuuugggaggcugagacaggaggaucacuugagcccgggaguucgagggugcagugagccaugaucuucccacugcacuccagccugggcaacagaaugagacccugucuccaaaaaaaaaaaagacaaagauugccaaagcagaggaguggaguacccuccuccccacauauuuuuaauggucugcuagccuucuuagucccucauagauuggagccuauuggauuuucccuuacuguacuuccuccuuuucugcgucucuaccaauauauuuuaucacuacauuucuuuuuuuuuuuuuuuuuuuuuugagacggagucucacugcaaccuccaccucccagguucaagagauucuccugccucagccucccaaguagcugggacuacaggcgugcgccaccacgcccagcuaauuuuuguauuuuuaguagagacaggguuuuaccauguuggccaggauggucucaaucucuugaccucaugauccgcccaccucggccucccaaagugcugggauuacaggcgugagccaccacacccggccaucacuacauuucuuaauuacaaaaguuaauauguacauauuuuaaaauauggaagguguacagcaguuuaagaaguauaaauccucccacacauaccuuauucauauuucauuuaggaaggucaaggaucagagacagcaaaucagacuaaucuugcuuugcuuugggggaugugucacaaaaggcaauuguguuuucauguucucaucaaacucuagucuuauucuuucuacaguuuucccuucugggaugauacucuguuauuuauuguguuccuuucacaguucauuuugucuucuaccaaguccgacaagcagagggcuguacuguguguuauucaccuugaguacacacaaacacacacaccccaaguugugugcuggguguccuaggaagugcccaaagagauggaacaaaacuuuauggggagaaaggaucauuuugguugggauaauuguuggcaucucugcuaaagaaaggaauuucagacccuuaucucaaauucauggucucuggauguucauggucucugcauguucacauuacuugacuaucccuuucuuauccaugaugaugaugguucuccuaagaggccccuguauuugucuuucuuuucuuuucuucuauuuuuagagacagggucuugcuuugucacuuaggcuggaguacagugugugucuuucuguagggaucugagaagcuccaagcuuaucuggauuugaaaucgguuuuccucuaaaucucagagucagaguacagcuggggcauuucauacuaccaccuuauuaauugaauuuguccuuacuagcuuuaaaagcccucuguuguacccagccuuuguacagcgcccauuggaaaccucgguuuuuucccccaaggaacuuuucucaccugcaagccaguccuagagacaguuguguaggaguauguguguguguuuuuagacggaguuucacuuuugucacccaggcuggagugcaguggcaugaucucggcucacugcaacgucugccuccuagguucacgcgauucuccugccucagccuccagaguagcugggauuacaggcgugcaccaccacgaccagcuaauuuuuguauuauuaguagagacgggauuugaccauguuggccaggcuggacucuaacuccugaccucaggugauccacgugccucagccucccaaagcacugggauuacaggagugagccaccgcgccuggccgugugugcguguguguguguguguuuuaauccuaucuaauuuuuccaacaguuuuuugcauccuaagagaguuuaggaguagaauuaucaauaaggaauuucauacauagaccuggaguugcaaaaauauauuuggagaagagagcuuucccauugcccuucaagucauaccucauaucuuuuaaaauuuuuuuccuggacaaucccuacugcauaacauaccucauaucuucuaacucuuacuuuaccugggagcaaauauugcuuauugguaugaauuuuacuucugagaaggaggcauaggguagaagaagcaagcguauaguuugcucccuaauccuaaagcauuucagauuggaagguaaccaaagugugagacaaugaacuuauaauaaggaaaugcagcagcccucuuggaggaaggauaccauaaaacccuacaugguauacucccacuuccguuuugggaaagauuuagccauugacucaacaguaacugaacugaauaaggagcuacccaggugaacaaaguauguguacauuucugggcaagguuguagcuucuguucagggacaguggguaccuuuucagagugucuccugguucugugguguuauggcuccuuuuuuuaaacuuguguuucucaagucaggaauuaauagauaguggcccaaagcuuuugaccguucaacaucaacugaaaauucagcgaacuuuguuuuuagcuauaguugccucaguguuugggugggagggccacauauugggugugauuaggccaucugaggcauaguaacgggugacaggaaaagcaguuagcccaugcgaguugcaauaguaccuugugggcaagaucccaagggggcccuccauccaagggagaucacagaggagccagggagagaauugauucugaggccuauuaaaaauauucccaaauggggccgugugcgguggcaugcgccuguaaucccagcacuuugggaggcugaggcggguggaucacgaggucaggagauugagaccauccuggcuaacacggugaaaccccgucucuacuaaacaaaauacaaaaaauuagcugggcgugguggugggcgccuguagucccccagcuucucgggaggcugaagcaggagaauggcgugaaccugggaggcagagcuugcagugagccgagaucgcgucacugcacuccagccugggcgacugagcaagacuccgucucaggaaaaaaaaaaaagaacccaaauggaauugaguaagaucuguccagaugguacagaaagggaggaguugauugggggagagaaguagaauuacuuagccuuaauuuagggagcauuuaaugagcaccuacuagggaucaggcagcaugcugugcucugaagauuuuaagauaaacucccacuuuuaaagaaguucauaguuuagcagagcagacagacacaauuuauauacugugauaaugugauacauacuauuauagaaauacagucuuuuuuuuuuuuuuuugagacggauucuugcuuugcuguccaggcuggaguacaguggugcaaucugugcucacugcaaccuccgccucccgggcucaagcaauucucaugucucagccuccuggguaacugggauuacaagccugugccaacaugcccagcuaauuuuuguauuuuuaguagagacgggguuucaccauauuggccaggcuggucucgaacuccuaaccuccagugauccaucugccuuggccucucaaagugcugggauuacaggugugcgccaccacaccuggccagaaauacagucuuaauacugugggacccuacgggccucuagagaaugauuaauucugugggggagagggugauuauguaauuucacugaaguaacauuugagcuuggucuuaugagauauauagaauuuugcuaggcagacaaguagggacgggcauuccaaucuuaccuaggucaauaauagggaguuuguacuaccauacugauaagagguaaguaugcuuuuugccucuuggagaaauauaagggaaagggugcgagauguggaaggaaucucauuuaauccaaugacucauuagguaacacuggaucaacaaaaugaagagcugagccaagugguagaacucucauuucaagauuuuggugacuuggguuuaaacagaguuggagagggagaugaagguauuuacugguuucugcucuaucuucccuacuuaguaaaacucucacauuaaucgcagggcccaccaaauucugcaaaaguuaccgcuuguuuuccuauugccucucauugaauugcuucuauuucaacuguccuggcaggguuuggucauagaccuucuagaaaagaguagugaugaauuaauucuucugucagaaagauaugggacugcaucccaguugccaaggaaggccugggucuucuuaauuuguuuuuagucccaaagcaaguacuuaccuaaacugaauagaggcaggaacucuauccagucuaagcucucgauccuguccugguguucucuuuagaguucagcauuuccugcuuccuuaagaaguauagugguauaagaggcaggaguaccugacuaggaguccuacauuuacugcuuagcaguuggcuguaugguaacacuugacaaguugacuaauuuuauuuuauuuuuuauuuauuuauuuauuuuuugugcaaaugguggccuuuaauaccaagaaagaccaugacaagugacagaacaggagcaaauucccuaguguagugccgagcuagcccuuugcaggacccuaaaaccugaucuaguaacagaauaaaucaguguauuuacauuuauguuugcccugaaaacccagguaaggucugaagccugaggcaucucuccuuccuuuccuccucccucucuuccuaccuccuugccuucguucacuuccucaauucauuccucucccuucucccuuccucucuuuuccuucuuuuccuuucugcuuuucccuuuucuccuuuuucuccucauucucuuuaccaucuaccuaugugucccuccaagccccucugcuauuucuccccugcucacucccucugcuguugucucccucagguucagcuuccgggguggggaggcaagaaaggguccucagcucagggagcacuuguugguguucuuuaugucacaaguuuucaggucaguacugggaggcuuguugccguuuccugaucuccggccuccugacuugagcaagaugucccgggccagggaacuaaaagccucauccacauucauacuggauuuagcacuaguuucgaaaaaucggauuccaugcucucgagccaacuuaucggccugcuccuucugcaccuuccucuuggccuccaugucacauuuguucccuagcaagaggugcuccaccccagcugaggcauucuccaugaugcuuuucauccaguucugaauauucucgaaagauuucucauccgugaugucguaugcuaggauaaugcccauggcuccacgguaguaggcaguaguuauugucuugaaccgcucuuggccagcugugucccagacuuguaguuugaucuucuuccccucuauauccacagugcggaucuugaaaucaauuccgaugguggagauguaaguguuguugaaguuguccucugcaaagcgaaugaucagacaagucuugcccacccccgaguccccgaucagcagcaacuugaagagguggucguaggcuuuggccauggcggacaccgggggagccggggaagggauggggcuauuuauuuauuuuugagacggaaucgcucuguuguccaggcuggagugcagucgugugaucucggcucacugcuaccucugccucccagguucaagcaauucucgugccucagccuccugaguagcugggauuacaggcacgcaccaccacacccagcuaauuuuuguauuuuuaguagagacagguuuucaccacguuggccaggcuggucucaaacuccugaccucaggugaucugcccaucucgcccucccaaagugcuaggauuacagguguaagccaccacgccuagcccaaauugacuaauuguaugugucucgguuuccucaccuauaaaauauagagacuggacuaaaugaccucuagacuggcucugaucugccugacugaccuuaaggcugacaacugguacuggguuggacuccaguggcuauauauaccgagaacucugucucuguugauaggugauagacuucuggagacuucauauguauuugguuuagggacucaaagcuaacaaguggaagggggcuugaggaauggagucuuacucuagcugggacugcuaagacacuuuuacuguuaugccuacuuugcugcacugcuugggagaguugcccacauuaaagaacauccuccaugggucuccugcaucuagugggcuaacccauggucaggccucaauccucccuaguuaaugggucauuuuauaagucauucuuguagagccguacuucuuuuuuuuuuuuuuugauggagucuugcucugucacccaggcuggagugcaguggcaaagucucgacccacugcagccucugccucccagguucaagcaauucuccugcuucagccucccaaguagcugagauuacaggugucagccaccacaccuggcuaauuuuuguguuuuuaauagagacgggguuucaccauguucgccagacugguguugaauuccugaccuuaggugauccgcccaccucagccucccaaagugcugggauuucaggcaugagucacugcacccggcagagcugcacuucuaagggaaguuaaaucugauuucuucucuucugagcuaaaaagguugaaaggaagagaaaccugccccaucucccuuuuuuuugucucggguuugaagguaauaaucaucauaccacuugacugguuuaccaaaaaaaaaaaaaaaaauuaguauuuuugugggaaaaaaugagaauagaaaauaaauaauugaaucuuauauguauuauuucauuucuguaccacagaauuuuugagagucuagcuauuauauuuuuuaaaugauacccuuauaaacaugauaagauuaaagaucaaagcuuagagguggcucaacaauugcugugaacagggaggaaggcaggacauauucuuucuuuuucagaggugggaucucacuauguugcccaggcuggucucaaacuccugggcucaagugauccuccugccuuggccucccaaaaugcugguauuacaggcgugaaccaugaugugcagccagaacauacucuuaaggcuacauauuaggguacgagguagucuuuucuaagucaguaguuacugaucucugagaauccaagguugcuuaguagcaagaaagcuugcugaccacaucugggcucuggcuugacuucccaucucugagaguuagugacagagacuuugcaacucaagcgugucugcaauuguuuccugucuuuacacucccccagagcucaagugauauguuuagccaugagaauucaguccauucuaacucccacauuuuccuuuauuguagaguaguaacauugaggcuuaauauucuaccccuuggaucacaugcuuugaaauacauaaaaauguaagggaguaaguugaaaaaaccaguaacuuuuucuauuguuucuugagaguauagcauauauaugucaccugaaggaaacuugaucagcuuaucaucuguccuuuuuuuuuuauuauggugucaccugucuucucuuuuauuuauuuuuuauuuugagagacggagucuugcucuguugcccaggcuggaguacaguggcauaaucucagcucacugcaaccuccgcccucuggguucaagcgauucuccugccucagcuucccaaguagcugggacuacaggcauguggcgcuacacccagcuaauuuuuguauuuuuuaguagagacgggguuucacuauauguuggccaggcuggucucaaacuccugaccucucaaacaccagagugagacucucucuaaaaauggaaaauaaauuuuaaaauguuauaauuaaagauacucauuuaaauugaauaaauuuagcuuuaugaaaaauuugcuguaucaucuuuauuuugauccuuucgucauaggccauugaaaacuuaaucauaaaaugguacauguauaucugaauuuuuaagacugacugaccaaggggacuacagaauacccaguagaaucaaaguaauugucauguuccucuguauuaaucuagucuacuuugggaccuugaguucucaccucucauucuuuugcuaacuuccucuuuacccuuuaguuaugucuccuuuuuuuuuuuuuuuuuuuuccagagauagcgucuuguucugucgcccaggcuggagugcagugguguaaucagcucacuacaaccuucaacuccugggcuccagugauucucccaccacagccucuggaguagcugggauuacaggcacauaccaccaugcccagcuaauuuuuuuaaauguuuucuagagacucagucucgcuauguugccuaggcuggucucaaacuccucaccucaagcaaggcuuccccuuuuaucucccaaaccccugggauuacaggcaugggccgcucugccaggccuguuuuuucucuuuuucuuucucuguaccacuuucauauuguggcuucuucccugcccccgaucuccccccuacccaccccagguggagucuugcucuguuacccaggcuggagugugguggcacgaucucggcucacugcaaccuccgccucccggguuuaagcaguucugccucagccucccgaguaggauuacaaaugccggccaccaaccacacccggcuaauuuuuuuuuuuuuuuuuuagacugagucucgcuguugcucugucgccaggcuggaguacaguggugcaaucucagcucacugcaaccuccaccucacaaguucaagcaguucaccugccucaaccucccaaguagcugggacuacaggcacgcgccaccacgcccagcuaauuuuuguauuuuuaguagagacgggguuucaccauguuugccaggcuugucucaaacuccugaccuccugaucugccugccuuugccucccaaagugcugggauuacaggcgugagccacugugcccgccuuuuauuuuuugagacggagucucgcucugucacccaggcuggagcacaguggcgcaucagcucagugcacccucuaccuucuggguuuaagcgauucuccugccucagccucuggaguagcugggauuacagguaugcaccaccacacccagcuaauuuuuuuuguauuuuuaguggagacgggguuucaccauguuggccaggcagggcucgaacuucugaccucaggugauccaccucagccucccaaagugcugggauuauagguaugagcuacugcacccaggcuguggcugcuuuuuaggaauauauugauaacaacuaauauugagauauauuuuaauagcuauuagcacuaugcuaaacacaucuuucacuuauuauuuguagcuaugaggaugguauuuuuuccauuuuacaaagguagaagguaaggcuuagagagguagagaaauucucuuuauaucauauuaguaaugauuaguagcuuaauauuuauuuagcacuuaguaucuaucaaauacuuaaaauacuuuaguuauuuauaugcauuaucucauuuaauccuuacaacacccuuaugaaguaggugcuuauaaggcuauuaucucauuuuacagaugaggaaaugaaugcacacauauauuuagugacuugcucaagguucauagcuaguaaguagagcugaaaaacaaacguggagaauuggacuccagagccuuuauuccucugaauugccuccuguaugauuuucugucuuuacgaucuaguaagugggguuacugaaaauuuuuaaccccaguuuaacuccagucccacuaauuguggugacaaaauaaugauguuuccccacauaugccauagaguaugaugucugugaagucacuaggaucugcuuuggaaaagcgaaagaguaauuugaacaagcaaaguacaacucucaagcaaugcuuagguuugggagagagguuuuugcaugcucugccuaugcuaacuucccuuugaauuucauaguuccuuuccgcucagagucaggaugaugaaauguauucagauuuagacgauuagaaucucaaagucccaacucuucucucuguucccugccccaccagcagcuuucuuagcccucuuagaagauagaggagcugauucaguguauucuuucaucaaauacugauugcuugcagacuuaacgcccuauaccauccucuggagacuucugcaugucuuuagaagguauaccuuucucugccucuaauuuggagggcuacagcuguuaggccccuuugguguggaggguaaucuaaucccuaggcaccagcaagacagcugcaaguugagaguaggucaagcuuacugauucuugauagacuuucagauuuggaaagauggcagaaacaaagugaaaaaagaguuguuaaugaaacaaagaguugauaaugaaugugaucuguugguuguauuucucucuuuaccuucaaccaaaaaugagaaaggauagauuuuguggcaaugggacccugguuagaucuuuagaaaugucuuaucagggagaccggucauauauaaaggauacagcagcaacuacccuucugcccuuaggaguggugacucuuaucccacaccccuagagugaaucucucauuuugacaaagagcuaaggaaaaaugaaaagaaggccaggcacgguggcucaugccuguaauaucagcacuuuggaaggccaaggcgggcagaucaccugaggucaggacuucuuagacuagucugaccaacauggagaaacuccgucucuacuaaaaauacaaaauuagccaggcgugguggugcaugccuguaaucccagcuacucgggagacugaggugggagaauugcuugaacccgggaggcagagguuguggugagccaagauugugccauugcacuccagccugggcaacaagagugacgucucaaaaaaaaagaagaaaaggaaaagaagagcacagcaccaggaugccaaggagauacuggggaucuaggguaccgguggguggaucuggauauucuucaggccagcuaaagguugaucacuuugugugacucaaacaaaaaacuuugaagaccugguggggaauuacuggggaauuaaaaacucucaguuuucagucucucuauuucggcucccuuggcaguuagagauuaugugguagggcagacuccagaagcaguucuuauuuugcucuucccaacucuuaccacugaggaucagcugccugggaccuucucagagcuaaguccucauagaagcaaggagaugaagagguucuauccuucucugaaaagcgauugcagcuucaauggacguauguuuaauuuuauucacuuuuuuuucuugcaggaguguugaagccuggaaauccccuccccuucccccuccccccuuuacaguaucccccucccuccacccuuucccauucugauaaucuggccaugacuagcagaagcacagcuaggcccaaugggcaaccccaggccagcaaaauuugccaguucaaauugguccugcugggagaaucugcagugggaaagucaagccugguauuacguuuugucaaagggcaguuccaugaguaccaggagagcaccauuggaggugagugccuugggguaauaggagauugaauguuugguaaggguuuuuuuuuuuuuagauggagucuugcucuguuacccaggcuggagugcaguggcgcaaucuuggcuuacugcaaccucugucucccagguucgagcgauucucaugccucagccucccgaguaacugggauuacaggugcacaccguggcaccugucuaauuuuuguauuuuuaguggagaggggguuucaccaucauguuggccagguuggucucaaacuccugaccucaggugaucugccugccucggccucccaaagugcugggauuacaggcgugagucaccacgccgggccgguaaggcuuuugaaaagagauauaagaccugauuauggagcuggcccucuuagucccauucuuuuccccagaaauggaaacccuuuauaaaaacagaggccggucccaguggcccaccacuuugggaggccaagaugggcggaucaccugaggucaggaguucgagaccagccugcccaacauggcgaaauccugucucuacuaaaaauacaaaaaauuagccaggcgugguggcaggcgccuguaaucccagcuacucgggaggcuaaggcaggagaaucacuugaacccagggggcagagguuguagugagccgagauugcgccacugcacuccacccugggcgacaagagcaaaacuccaucuccaaaaaaaaaaaaaaaucaaaaucugguaaaauaggcugggcauggugggucacaccuguaaucccagcauuugggaggccaaggcaggcggaucacuugaggccaggaguucaagaccagccuggccaacaaggugaaauccccgucucuacuaaaaauacaaaaaauuagcugggcgugguggcacaugccuauaauuccagcuacucaggaggcugagguaggagaacuacuugaacccaggagauggagguugcagugagccaagauugcgccauugcacuccagccugggugacuagagugaaaauccgucucaaaaaaacaaaacaacaacaacaacaacaaagauuagccgggcaugguggcacaugccuguaaucccagcuacuugggaagcugaggcaggagacucgcuugaacucaugaggcggagguugcagugagccaaaaucacgccagugcauuuuauccuaggcgaaggagcgagacuguuucaaaaacaaaaaaaaaucugguaaaauagaggcuggaacuaaugcaaaauacaaagggugucugucuuucucaucuuugcuaccuuuuccccacuacuaccccaaaauagggugcuaauucaauaaaggaucuuuuaugagaacuuccaaauuauuccuuccccuuguuauuuuuauuuauuuauuuauuuauuuuugagacggagucucugucgcccagacuggagugcaguggugcaaucuuggcucauugcaacuucugccucccagguucaagugauucucgugccucagccuccugagcagcggagauuacaggcacauaccaccaugcccggcuaauuuuuguauuuguauagagacaggguuucaccguguuggccaggcuggucucaaacuccugacuucaagugauccacccgccucggccucccaaagugcugggauuacaagcaugagccaccgugccuggccucuuuccccuuuuuauuagucaucuuggaaauguauuccuggaccugcagcagauuauaugaaaaaguaacagccaaauaauauugauaaugaugggacuugccaucaagcuuuaaaaucuucuaauuaauucuuuuuuuuuuuuuuuuuuuuuuuggauacugagucucacccuguugcccaggcuggagugcaguggugcagugguugcccauugcaacuuccgcuuccccaguucaagcacuucugcugccucagccucccaaguagcuggaauuacaggcguccaucaccaugccugguuaacuuuuguguuuuuaguagaggcgggguuucacuauguuggccaggcuggucucgaacuccugaccucaagccauccaccugccuuggccucccaaagugcugggauuacaggcaugagccacugcgcccagccaauccucuaauuaauucuuuuguuuguuugcguuuguuuguuuguuuuuugagacggaguuccgcucuuguugcccaggcugaagugcaguggcgccaucuuggcucacugcaaccuccaccucccaaguucaagggauucuccagccucagccucccgaguagcugugauuacagguguccaccaccacgccuggcuaauuuuuguauuuuuaguagagacggguuuugccguguuggccagacuggucucgaacuccugaccucaggugauccaccugccucagcccccaccucccaaagugcugggauuacaggcgugagcuaccgugcccagcccaaucuucuaauuaauucuugaugugacuuuuaucugaagcuauuuucucugucauuuguuauucuccuauuuugguuagaagaaggaugacucguauaagugccaguucuucugucccucuuaguuuaugauguacccccauuccuuagcuagugacauuucuggcaggaaggacuuagccaagggcagucuuaauccugguuucaagacuuacauguaaggagaacucaaaaccuuuuccuguagcugacuauccuggguggugacuggucuuaguguagggcaguuacauuuugaagggggggagggauguucccauucauccucccacuuacagcaucuuccccuccauucucucauccauagcggccuuccucacccaguccguuugucuagaugacacaacagugaaguuugagaucugggacacagcugggcaggagcgauaucacagcuuagcccccauguacuacaggggugcccaagcugcaaucgugguuuacgacauuacuaaucagguaagugagcuaagaagacuguccuuguuggcuggacaugguggcuuacgccuauaaucccaacacuuuaggaugccaaggcgggaggaucaugaggucaagagauugagaccauccuggccaacauggugaaaccccgucucuacuaaaauuacaaaaauuaguugggcgugguggugcgcgccuguagucccagcuacucgggaggcugaggcaggagaaucgcuugaacccaggaggcggagguugcagugagccgagaucgagccacugcacucuagccucggcgacagagcaaaacuccgccucaaaaaaaaaagaaaaaagacuguccuugcuuauauuuagaggaguuaguuuggggcaggggguaagggggcagaaaacggguucuugaaauagcaaauaagaguacaaauuaugcuuccaagugcuaagaagacagauaaugaauuaucagagaccugugguuucacugagggaagaccaccuagaagaggugaauuuugagacucauuuuaaaaggugauggauauggauuggcagucauuccagccuacucauucucuucauguuuuccuaggaaaccuuugcccgagcaaagacaugggugaaggaacuacagcgacaggccaguccuagcaucguuauugcccuggcagggaacaaagcugaccuggccaacaaacguaugguggaguaugaaguaagguggcccguggaguuccucucuaacacuuccucuguuccugggaccucuuuuuuuccaaaccagcccucucugaaaacgucaacagaggacauucauugucucauuccccaguucuacaccaaguuaaauacagcaacacugugacccuaaugacagccaggagauuuucaaaggagucaggagaaaacuccagagcagaggguuagggagguaccagcuguggggguaccagugugaaaacaggaaggagggagcaauuaaauuugugguaagggacuauucaagugucacaacccaaaagcccccaacuaacuuacccucuccccuauaauuaagcuuucugacauuuguguguuggacugaguggacauggggucaucuugagggaguugucauuaaauuaugcaucuaggcuagcuggcucaaagggguauuaauuaaggggagggaaccuaggauuuugccuagcuguugugcugcaugggaguggaaaggcaauacucguucccacccuacauucugagcacuaauacaucccacuccuugcaggaggcccaggcauaugcagaugacaacagcuuauuguucauggagacuucagccaagacagcuaugaacgugaaugaucucuuccuggcaauagguaaggucagaacauccugagguccuccuuuuucccucguuuauaggcaaaauuauagcuaacccaaaucaaggauaggugcgaguaucuccuuuugcaaaaacuuuagguauggaaauaccuuaacuuucuguuaugaccuccauccuuggcugcagcuuuagcucccuugucuucaauguguaaguuugccggccaggugugguggcuaacaccuguaaucccagcauuuugggaggccgaggcgggcggaucacgaggucaagagaucaagaccauccuggccaauguggugaaaccccgucucuacuaaaaauacaaaaauuagcugggcgugguggcgcacaccuguagucccagcuacuugggaggcugagccaggauaaucacuugaacccgggagguggagguugcagugagccgagauugugccacugcacuccauccuggcaacagagcgagacuccaucucaaaaaaaaaaaaaaaguuugcaaauagugaacccucccaucuucagaacauucuuuuaaucucucaaauucucccuuuuccccaauucaguagccguuuuuggcggguggaggcagagggguagggaaguaaagucuaccauacuuuguucucuucucuuuuuaucucuagcuaagaaguugccaaagagugaaccccagaaucugggaggugcagcaggccgaagccgggguguggaucuccaugaacagucccagcagaacaagagccaguguuguagcaacugaggggguggcuagcagcaaacaaguauggagcuagcacaagagcuaagaaauaaccuccaucccuaccccucagcacacaaccccuacgguaacagcacacugagcccuggcucccaagggcugccuccugacagcuccgucauggcacuuuuuaacgcuucagcaacaaacaccaggcagcuguugccacuggccuccuacccccuacucuggggcuugggggucaacuccccccaggacuuaccuuccaaaacaaacuuucuucacuuuguauuauagguacaagacagcgacuuacguaucuuuucuccuccucccuaguguuccuccccauuuuuucagaaaacacuucugacuccugucccuuccccuucugcuuuuggucagucccuguucuugagccucuuuucuccucuccccaggaugcagaaaguggugaacccaggaacugaggaaggagguuuccaguucauuuacauuaagggcccugggggagaauaaagcucagagcaggagggaguaaggaaacauuuccuuuuuguuuuuauuugguuggaguuucucauauuugaaaacauugcgguauccaugauuuggccuuguggaggguguuccuagguagaggugagaauggggaggcaagaucucaggcaccaggcaggaggugccuuguaagcuaacugggcggagguggaggugcagugucaacuguggcucuguaacucuucaaaggcccaguuuccccucacgcagccucuuagguagcguuuccccuaaucguggggguuggaccccagagucuuccaaagaauuuucacugguugccugcaucuuuggcucugcugugaucugauuggaggagggacaguuucugguacccauccucugauuuauacauaugcauuuuuuccccucuggccuuuagauggccucagccccagccaccauauaccccugcaguuugcacuuuaauugaugguaguucaguugggguacuuguuuuauggaaguuuugauugauuuacuugcccucccaccuucuuuuuaauucaaugaaaucugagguuaaugcgagguucgaggagagguuauagauaaaacuaccaguggcagcuacucaaguccuaucuccacuguuagcuuccuccaacucuaauuauuaaccuauauucuugccaagcuaacuauugacuauagguuugccuuuccuggagaauuaauugagcaauugaggagugucucaggauagcacaggccaagguaggggaguaaaaaggaggucaggcaaaagggaggaguuuucuguccuuucccagguuucacacucaauuugauauccauuaccaugucuuuucuacuuccuuguaaauagguaugaucuuuauucccacuguacagucuguucuauccucugccucccaucaggcccuguuucuuuguuccuuuguuaauaucuugaauuuagucccuccauccuuaauccccccaucccuccccaucaugcaaccagugguuuaauccauguaccaauaggggcuaguaccacagaggccuccuguggugcccucguaucauaccaccuguuccuguggagagggaaugaccggcacugaagguaccuuacaacuggcucauauuaucagaggaccuugguccuuucuaaaucucuagucucucuucauauccuucaucagguguuuuaagaugucucugagaagccaucaaggcaaaagagaacuuuaaguuccuuguuccagcccggaguuuugggaaagaaagaaaggaaaggucacagugaccuaggauuggaaccuuccugcccuuuuggcuugcagacugccuucuaucccagaacagcugagaaaucuaugaagcugagauucugaaggacccagcuuagguucuuccacuuaggccucaauucccuuccuuuuccaggggcagccuuaguucccauggcccugaaacacacacauuucccccuuccuuucccagaagccacuggccccccauagcacccagugcauccuuuuuacaaguggaagaacuaggauggcuuuccaaagucuucuagaaaugaaguucuuucucugugcagcuuucccccuuggagcaggagugaagauguuucauuaucuugggccugggaaaccacuuccccaggcuucucccuccccccacccccauaggaacaggauuuggccuuagcuucugggccuaucggcugccuucccucuacuuccuaccaccucuucugccuuccuuugagcucuguugggcuuggggaucuuaguuuucuuuuguuuauuucccagcucauuuuuuucuucuggucaguuuuuuuaaggggggguguugugguuuuuuguuuuuguuuugcuucugagaaagcauuugccuuucuuccucucccaacauaacaaucgugguaacagaaugcgacugcugauuuaccgauguauuuaauguaaguaaaaaaaggaaaaaaagaa

SEQ ID NO: 192202 - RNA, 3681 nt, Homo sapiens
cagcuguuaccgcgucacaugagggaggccggcggccacucggcgggggaggggaccguggcuggagcccggggcggggccgcgcggcaggcggggcgggagccggggggcgcagcuagagagccccggagccgcggcgggagaggaacgcgcagccagccuugggaagcccaggugaggccgcggggacccggcggacuucggcgcgggcugggagagaccacccgcagucccuuccuccagggcucgccccaggcccgcggagacucguccggcgcucuccagccgcccuggagcaacuuugcuucgaaguucccugggcccgggcaggguguggcgggggugcuggcugcacuuuuuuuuuuuuuggugggcggggaggucagagcccaggggaaaggggcuggggcgggggucgggguugggcugaagaccguuucuccaggcuggguguuggguggggaaaggguguuugacgcccggagacuggcgggccgagggucggcgucaggcucaagccccugccggcgcccuuggaucuguccugggccccagaggcggcggggcgggguccgggcuucgcggccgucgcccccaccccucuccugcggguaaagagggggcugggagacguggauccgaccgcggguuuccgggugggaggggccgggaaucggggccgugaagggaagcccucgagggccggccgggagcccggaaaccgaggucccccuucggccaguuuuaauccccccgcccuccccucugccccaggcccggcagccauggcgguggaaggaggaaugaaaugugugaaguucuugcucuacguccuccugcuggccuuuugcgugaguggcgagggguccuggggggcgcgccggcagggugcggggagaccuggcuccacaguggugagggcugagggaaugagaauuaaggcagcuggagaccagauguggaaagaaagccagggaaagacagcgcagccacucccuccuccaguuuuccuggacaccugaggcuuguuuccaccgagaauggccauccugggugugcagcaaccccuacccccaucccuccuggcccuuccugucuggugacccaaccacuugugauauggggcaguggggcaaccagccaaccgccugaugcuaucgccauggggcuucccuucgcucucccuucuccccucucucccuccccaacccucucaucccuguccagccccucucccccuuucccuccucccagcgcuugggggugaggaagggcucugcccacuucaauuugcuccugcccugggcuccuggcuugagaggcuacuguuugucuagggagggacacaucacucuugcucccuuuuccucuucccuucuccuggccuaacuggccagaggaaccuuagucacagcugaugcgcgcgugggaugugcacuggaggauagugagggggcaguucugggagagaauugagcugggagcccuggaggccuguagaaagcauuauucuaggucagaaauacgugucuugaggucaaggcuuucugggagguuuuugaauuuggucaugucccugauuaaagagccgggaggggaucaggggagguaggggcaggcaaggaugggucaucccccuaccccacagccaaagaaauucccuagaggugugagaaucucucuuccggauggggucaagucuguguccuagguguacccccugcccuccaccauggagggccacuguguuguggauauggccuaauccucaccugauuuucucuuaggccugugcagugggacugauugccgugggugucggggcacagcuuguccugagucagaccauaauccagggggcuaccccuggcucucuguugccaguggucaucaucgcagugggugucuuccucuuccugguggcuuuugugggcugcugcggggccugcaaggagaacuauugucuuaugaucacggugaguugggggcgggaccaacaugggcggucugggacugccagagcagcuugguucgggcucaggaaggugggugaggugggugggugaggaagaccuuugugaguguccagggaccggcugugccaaaacgggccccuguaaugcauagacuccaaacuugacuucuguccuuugcuccugcaguuugccaucuuucugucucuuaucauguugguggagguggccgcagccauugcuggcuauguguuuagagauaagguaagcagggaauaaugggaagggccugccucagccgggucugggacccuggugcuugaauucugacugcaacagugcuccuccguacucucaggugaugucagaguuuaauaacaacuuccggcagcagauggagaauuacccgaaaaacaaccacacugcuucgauccuggacaggaugcaggcagaugugagugggguugcugggagcagggguggugggaauagagaauucucaucuccaaggcuggguguggugacucacgccuguaaucucagcacuuuugaaggccgaggugggcagaucaccugaggucagaaguucaagacuagccuggccaacguggugaaacccugucucuacuaaaaauacaaaaauuagccaggugugguggugagugccuguaaucccaccuacucaggagggugaggcaggagaaucgcuugaacccgggaggcggagguugcagugagccgagauugagccaccgcugggcacuugucugggcaacagagcaagucucugucucaaaaaaaaaaaaaaaaaaaaaaaaagaauucucaucuccauauugaaggugaagguucacuuaacaaccuucuucuccauauuucuucccucccccaguuuaagugcuguggggcugcuaacuacacagauugggagaaaaucccuuccaugucgaagaaccgaguccccgacuccugcugcauuaauguuacugugggcugugggauuaauuucaacgagaaggcgauccauaaggagguagggaggagacuguguaugggacuugggaaaccugggaaauguuuuagaaugcaagagacccaggauggagguggacagggucagggauggggaggggaucuggaaaugcuaaggguggggugaaagguacaggggcagggaagagacugauggaccaagggaggggguuggggugggaaguuucugauggugcuuuuguccuuugugccugccaccuucagggcuguguggagaagauugggggcuggcugaggaaaaaugugcuggugguagcugcagcagcccuuggaauugcuuuugucgagguaagagauaacccugagcaggggcugggacucuguccagggugccuggagggaaggggcugaggggaggagggugcugaacaggagguacuggccugggaguguguguuuggagucucuugcaugggucugagguagcuagcccuucugacuccucuccaccccuguccccaucuuuccuucuagguuuugggaauugucuuugccugcugccucgugaagaguaucagaaguggcuacgaggugauguaggggucuggucuccucagccuccucaucugggggaguggaauaguauccuccagguuuuucaauuaaacggauuauuuuuucagaccgaaaagagauggucugaguuugucuuaga

SEQ ID NO: 192203 - RNA, 122274 nt, Homo sapiens
ugaacaguaauucauuuaauugcaaagcauuuugaaauaaaaaaaaucaaacuuaaaacuguguucuguuccuggagguggccugaggccuccccgacagcccagcaccugcguuccuggugcgaacacgcuagcacagggccugccgcagggccuggaugcgggcaacgcaggcgccaaugggcuggcgcugagccuggagcuccucugccagcagcuggaucugcauuuccaccuggggccauggagggacaggcagggcugagagggagcacagcccggggcguccccagggacaccuggggauggccuggggccucaccuguuccagcucuuucugcaccugcugcucuacuuccugguccucaggccccggcuccucucuguucagcuccagccaccugcgcaggcugcucgcuugccgccgacaggaccugagggguggagauacccacugccugccaggcuggguccuuggcagagccccauccggcucagggagaggcaccucagcuaauucugaugcggguaucggguggagagagguggucugguagggccccugaccugaacugcaggccccugcuugggagccaaacacuuguucuuuuuccucucccagucuccuccgcccuccccagcagacagcaacucaggugggccugggcaagaacacacuccuugucucucucccccugugcagagccaaggaugaggcgccagucuguugcccuggaagcucugagguugcugcauguugaaugguccccagaccacugagugcagcugagucacgggccugucuccucugcauuuuuuuuuuuuuuugagauggaguguugcuguguugcccaggcuggagugcaauggcgugaucucagcucacugcaaccuccgccucccagguugaagcgauucuucugccucagccuuccaaguaguugggacuacaugcgugcaccaccaugcccggcuaauuuuuguauuuuuaguagagaugggguuucaccauauuggccaggcuggucuugaacuccuaaccccgugaucugccuggaucacagccucucaaagugcugggaugacaggugugagucacugcgccuggcccuucucugcaccuuuaauaucaguguuauaauuagucacuggggacagcauggccucaucggguuuuuagaguuuugcucaacuuuaucgucccccccauaggaagcagagccucugugcacaggugagucugacgacuugggccuuccuaagcagcacugagccggguagagagccaugguggagauggggucuuucuggacagcacacacugagggcuccccacaccccuccauggcuagaccgagaccaccuacaggacccuggcagcuggcucgggggaaauggaacugccugcccaccucuccaggcaacaccugcuccuguagccagggcugcagggcguuucgcagggcucaccagagguucugcuugguggucugguagugcaguaguugcugcuggaucuccucaaguucagccucaagguccaggcugccuauggcgacagaaguaagcuuguuucagacuauuuuccccucggggaccaggguaaauagcaagucccagguccgggaguggccugagugcuuucugcccugacaggccccagguacacaccugcaguugaaaguccaggcccagcccugguggcugagaaguccccaggaaggaguagaugggggucagggacacuggccagggaugaggggaccgggggcuuaucccuaggaguagcccgcugugcugacaccugcaaaggaaagaaggguagaugcugagcaaggaagcuaggaggaagccagggagggggacaccaaguccuugucacugccugcccugcaggggugggggaagaccaggcucccagcugcaggagcugggcuucccaggcacuggccgugccagcucagugucuagccugccccugcacacagggccugguacuguaggggaaagucccgcaagcaaccagggagcaccccgugucaccacaguccgccucacgccuccacugccugagcagcuguuccuagccuugccuuacccaacccuccacccccaccugcucuaagcucaugaccuugcugagcuuugacaucagugagaaguggucagugagaggccacugcucuacagccuuuuccaugcccuccucuccuggugagaguggacuugccccuuccaucaccggacaggggucaaaacccuuucaaacccacauucaaaccauuccagccaggguaaguggccccacauggccuaacucaccacaggaacugguuccuuccuguccccucauccccuuucaggaaccagcugcuuugguggccuuagagcagcugucacuuccauuacugagcucucacacccccuggccauccccacccaggcucccugcuuggagccuccuccccucucuccuuccccuguacucuccuccuagaggccgcaguggcucugggguuaccuucggccugugcugaagauucuucucaaucucuggcccugaccucuuccuugaaggucagacucaacguuugcuuucucucaaauuugacaucaagagccugguucaaaacacucuugacacuucaccccaaaccaguccccacccccaguuccuucuuccagucaaagaacucuguuucccaaguuauucaagccagcagcccacaucagccuggauuccuucuuuccccucauucagcaacucccucagagcagcauauccugccucaucugccuccaagagaguaccuguccccucuguggcaaccgcugagcccaggccaccaguacuacuugccuggaccacguggucauggugaccacagccugcacagaaaccugacauggugcucccugccaaaacccuuccccgacuuccuacucuucucaaaucccaggcuacuucucacuguggccugcaggacccuacgugaucugcagccacuuuacuggccugcaggcagggguuuuucuuugcuugucucugacuagaauauaagcuucaggauggcagggcccuuggcuggcuguucacugcuguggcccuuggaccuggugugcaguggcuaccuaugcuugucaaauggaugaguggccucccugugccaagguuuuccagaaacuaguacagcuguggcaugagaaagcaccagaagucagaccagagugagagccccagugcccaggccuggugguggaggacguacccuggcuggugcagccgccccgcagggcaugaaggaggaaagaggcagcagcagcagcuccgggccugugcuugccgucgggggcugcuucgggccaggggcgcuugacagggccccaggcagggggcugugugggaccagugcugucggggccucugccaggaagggccgcgucagggagggggcugcuggcugagccaugccuaggccauguuccuguggcuucugaggccugagcacagggaaggcaagagccuggucaggccacaggacccuccucugggaccaaagaacaagaaggaaagggggccacccaccccagggcugccaaaacacaggccccacauggaggugcccgcugccuuuggggaccccugaccaucucccccugccugcccacggugcugcaccccagggaccucuggcucugcgcaggcuccaacaggaagugugggcgucgcggcugcuuccucgcugagugggcaguguugcuggaaagaaacauggggucuguuccccugggcugaccaggggcugcaggggggucugagaucucugugggaucuccaauuuuauagggagacugaaagucaggaaaggcgaggccaaggucagcaaguaagcuggggugggccugggccauagagcucccagcaguuccgacaaaagguaccugacgccaggggacugcuucacccacauugucucuuuugaccugcagaacaacccuggugacgcugguguacaggucgccaggguccaugucacaggggagcagccucugagacguucaggaucccaucaaggucagucaaacagugaggagcacagcagggaccgggacccaggccccaugcacccaccugacaucucccccgaggcccaaggcucucggguagugcugguugcugugggagccaccagcuucaucagcauggggcagggcagguuaggguuugaggagaccauaguaggggugggcagagggacaggugccagcucacacaagaaagaggggcuucugacaaaaagccagugucuuggcugugauggagcagaagagaggccggcaggcacggguaggagcugagcuuguucccuuugucaacuacguguaugacuccggaaaagaucgugucagcaggacgggagagaggguaggaagguguugcagaggaggggacaccuauuuccugagcuuuggcaggcaaaggagagaggguuuggaaaucccacuccauucucucccucuugccgugggagggaugggaucuggcuggagaagaggggguucccagcagcucagcugugacaaggccgugaccagcccgucccaucccgucagggcuguuuuccucccugcuaugccauccaaccuuuugcccaggguggaagcgaggacaaggugagcacaggcuacucacagcuccagggcguggggcuccucagcagccaggcggcccagagcucccagaggccgagaagccuguggccucuuggucucaagggugccauccccagccccagcagcaaugcgguugagaaggggacccucaaacgucacuuuccugcugggugcgauggcugccaggggcugaggcuucccgccccggcccagcacuuucuguuuccagagcguggcacagcggcggacggcacgauggagacugugagccgccuacaacacagccucuggucagcucaugccacacccugccugcuccccacaggaaggggcccugggccuaccuggaccugcugcugggccugcagcugcugccgggaggccuucaugcuggcugcaaagcgcaggagccgcguggcacccuccuggaggagcugccccugguaggccuggagcgcccacugcagccgcgccuucuuucuccuccuuuccaguacaaaggccagccacguggcccacaccuccagggagggcaggaggugaggcccaggucucccugcuuagagcucccccacagaccaggugcccucccuccacccaaggcagggcuaaggccugagggagaggcagggaugguaggaugcagagccccaauuaccuuugccugcagcgagaaggcccagaaccacagggcccgcacugucgcccgcugcuccugccuccuggcugccagcuagggccagaaagaccagaucauuucccuauagccccuucaaggaggccguggugaucacggggcccugcccagcucgucccucuuggcucccucucuagucgaggcucccacuuccuccacuaggaagggccagccuugugccuggcggugagaugcucaacacacgcuccaucuguggccugaggaaugaccuucaugaaagaagguggcaaagggcuccugcagggggaugcguggaggcagcggccugagguccggggaauggugaaaacaggacaacagaacgggaagagggagcuggggacguguggaugcugcucugugugaucccucuuggcuuuuuaaaaagcaagaucccagcaaagccuuaaaacacauuucauguuaauuuuuaagauauuaugcugauuuuucuuuuugagauggaaucucacucucauccaggcugaagugcaguggcaugaucacagcucacugcaaccuugaccucccgggcucaagcaauccucccgccucagccucccgaguaguugggaccacaggugugcacugccuacacccagcuaauuuuucuguuuuguuuuuguagagauggggucucacuauguugcccaggcuggucuugaacuucugggcucaagugauccuccugccucggccucccaaaauccugggauuauaggcgugagccaucaugcccggcccacugauuauauauauauauauauauauauauauauuuuuuuuuuuuuuuuuuuuuagacagagucucgcucuguugcccgggcuggagugcaguggugcuaucucagcucacugcaagcucugccucccagguucacgccauucuccugccucagccucccgaguagcugggacuacaggcgcccaccaccacgccuggcugauuuuuuuuguauuuuuaguagagacgggguuucaccguguuagccaggauggucucgaucuccugaccucaugauccgccugccucggccucccaaagugcugggauuacaggcgugagccacugcgcccggccuccacugauguauuuuuuaauacaacacuguagagagagaaacuggccuugaaguaacuguucuuaugcagacugcagacggaaggaagcugaugugccuggaaaugacaggaaggugguagaggagguggcccuggggagggugauaguaaaaauacugaacuagagguguaggcugaaggucauucacugcccaggccucacaggccagaggauggagaaggaagugcagaggggacaucuccuggguucccaccuguugucuccacuggcggaagcagguccggcugagucucugugccagcaguugggugcucugccugugcaggagcugggggagagcaagugcacagagaguggcguccugacccagccuagacagccugggguggguccugaucuaacccagccucugcccagcugaauguccucccauugcuaggaguccuggauggugccaggggucuccugcauaggcagggagugccgccuagaggacucacucuguaggucccccagcacugauaagccacgggucagcaugaaccggguuuuuccgcugagccgucuucccugggagacacuggauucuggggcuggcuacucgcuaggcuccaccaaacgcccagaaaggcuccugcagcuuugucuuacaggaccccaaaccacccaccacucauaccggcugcauggagugcugucaggaaagaccccuuccugagaaauggucuccuggccuggacaccccuugccaggcaggcagaacuuggagaguugccaccgucagccucacccucuuccugacacacugcagauggugcgucuuccaccgggccagccccuccagcagcagcugccgguggugguguugcacugcccucuccagcugcagucucugcugggcugaccuccggcugcagucccaccagcgcugaaaccagguccgcagacagccuaaggcagauccaagucagaguuugcuguuuugugggauuuccaccagugacuacauaauggugaaggugcagacagcagagauggcugugcagggauagaguucagguguccagcccacauggugaaacuaccacacauggaccauggccccucucuagggacagcucuggccaccuuugccaacagugaaccccccggggacuggaaccagaucuguuuacuguugugcuccccaacagcccucugagagccacaagccuguccacagccuccacaggggugccaggggcacccuaagagucacgugcaaaaugcugcugggcacguggaagaagacccucagucugaggggggaggaggaggagcccccacuucagcugcagcuuggaagagagggcagccuguuuugccaggguggaaaccaaggcccagucacagcagucagagcagcccaagccacggauggggaggacagcgcuggucgccaggccaugcccucuggcucccuggguucugcaggaaugggccacauccugcauuuuguuuuugugucaccagauucucccuuuggugaauccuucuuaggcccugagagaacuuucuuuuugagacaacagaacaggguugagagcagggcacagaugccaagaugaggagcccuccaggcccacugaggcaggcagggaaggcggcagaucacaagugggaggcacccacauuagugcugcaugcugaugccugggcucuguccuaaguguguaucucucuaccugucaucucacuugaucuccacgacaaccccaagagguaggcacuguuauccccaucuuacagaugaagacauugagacucagagagggggccugcuggaggucacacacacagccagguuaugaccgccagccuguacuucuucagcacucugcauaaugggucuugugacauccuccccucagucccuccucccagucccacccuuggccugccaaggugugccugagacacugaggccuuaauacaagccagucaauuguuccccagguauuuacuguguaccuacuacguguacacugucuugcagcccagucucccaagccucucauaccaucuguaauggacguggcaacccaagccugccaccgccucccucuaaggaaaguccuucagagagcagcggcuuccggcaacacucaaacccgucgccucuaacuucccaccauggccaggagugggcaccugacccuuaaggcagcugacccaaacuggccaaaagccucuggagcuugaagcugcacggucaggugcccaaagggucaggugcagaagcuccagagcccaaggucuggcuaaagcccucggcuucuuucuucguaaacuagaaacacagugcugguuucugagcugaggagaagcuccaggacccagcagcacauucguggcgcaguaaugcagccgugugggauggcugaccccaggguuuuguccccaggauguguguugaaacaugcucauuaacacacacgcuacagucggaaccaaaccaaagcugauucaguuuuguccuggagcaaacucuauuaaaccaacuuaaccacuuggucaauuucucuaugggccaauuuaaacaauuucuaaauguuuucacuuuuauuuguauuuucauuuauucuaaaaaugagcuguccccuucagcgugucagauucuccuacuaugggaccccuagcuguguuaggagacagcuccccaugggucugccgcgugucugugcaucuugcaagcaggggcauggacuccuguucuagacuaucuuuccaaagauuuuuuaaaagagacuaggucuuggccagguguaguggcucacgccuguaaucccagcacuuugggaggccgagacggacggaucacgaggugaggagaucgagaccaucccagcuaacacggugaaauccugucucuacuaagaauacaaaaaauuagccuggcgugguggcacacaccuguaguccccgcuacucuggaggcugaggcaggagauucgcuugaaccccaagagguggagguugcagugagccgagaucgcaccacugcacuccagccugggagacagagugagacucugucucaaaaaagagagagacugggucucauucugucacccaagcuggagugcaguggugugaucauaguucauugcagccuccagcucuugggcucaagugauccucccaccucaggcucccaaguagcugggacuauagguguguaccacugugcccugcaaucuuuccaaagauguauauacagcaggcagcaggacuuccugagaucgaauuagaaagucucuggccccuaaacauuuaagggcccagcuacacaaggaagcaggacgcuaacacggugggggcugcccugacaagcagcaaggacuuucccaucaaaacaacccccuccccaaccaccccaagcuccuccauuccagcuucuuuucuuuauuucucuguagaucucaagcucuagccuuccauuuuaacauaaacugguuggcagucaguugggaauagauuucuaagauauacuggacugaacagugcccccuccacaccugccguauucauguccuuccuggaaccucacaaugugacuuuuaucuggcacuaggcucacugcagauguaauugguuaggauggugucacacucaaguagggugggcccuucauccgauaugaccagaguccuucuaagggacccagacacaggaagggaacgauaugucaagauggggcaaagacuggagcaaugggucuacacguccaggaaagccaugacaagcaagaaacaagcugggagaggcaaggaaggacccuccccuagagccuguggagaagcauggcccugccacaccuugaucgcugacugccagccuccagaacugagagggcaauuuuguguuguuugaagacucccagucugugguacuuugucauggcaaccacagggaacuggcauguaugaggaggagacagacuuaugcgggccacagggaucuccacaacagcgcugucuucacauuccucaacaugacuugcuucuggggccccacuuaccccuguccagcaccuucugggccucccagauggcacaguccuccugcugucgguaauacaucugcacugacacagcuucccgccacuggaccaggaccuaugggcaggcaaggagcacagcaagagucacuauaccuccuggcuuccggguccaccccaggucugugacgguggcuccuggagaggcaaggccaagcuguugccauuugcuucucacacacgguccaggaaguaacugccuugcacgcagaccacugagcaauaggacagggccccagccccucacaggaagcccagcauuucagcugcugggacucuucuaccaggauuuacauaucauaccaugccauaaaguagugaagucauuauauacaugggucuuaauucuauuuuuauauauauauaaaauauauauauguaauuuuuuuuuugagacauagucucgcucugucaccugggcuggagugcaguggcaugaucucgguucacugcaaccucugccucccagguucuagcgauucuccugccucagccuucugaguagcugggauuacaggcaugcaccaccacacccagcuaauuucuguauuuuuaguagagacggaguuucaccauguuggccagguuggucucgaacuccugaccccaagugauccacccgacucagucuccuaaagugcugggauuacaggugugagccacugcgcccggccucuauuacuauuuaguaaauggaacacaccuacgucguauacauucuuuuguaugagugaugccuacaaaaucacaauaacaaaacacuugcccagggaaugccuggugccugcucugcgagcugucaugaacuccauucccaccaaaaaggccuccucuucaagcucugaagccaagcaaagauuccuguguuccuucuuccaggggaagggaggcacaggcuagcuucggguauuuuuucuuuucuuuucuuuuuuuugagacaaccuugcucuguuguccaggcuggagugcaguggugcaauucggcucacugcaaccuccaccuccuggauucaaagagccuguaaucccagcacuuugggaggcugaggcagauggaucaccugaggucaucaguucaagaccagccuagccaauguggugaaaccccaucucuacuaaaaauacaaaaauuagucggacgugguggcgcaagccuguagucccagcuacucgggagguugaggcaggagaaaucgcuugaaccugggggauggagguugcagugagcugagaugauaccacugcacucuagccugggugacagagugagacugucucaaaaaaaaaaaaaaaaaaaaaaagaaaaaaagaaaauacugguucugauaagaacuaguucacuuaugauguguuauguuucuauuuaaugcauauugguuuguaauucaguaaaaaacuaaacaugugcccacauggauguuugugugugugcuggaggaaaguuacccauuuucuagguuccuuauucaguucaaaucucuggcaccacccccuacaucccacgcccucaccagaacacagucccaacucuccugggugaccagcuugccuccuuauaccucaccuuggaacauaugguccuucuguaaugaguacuugcuugaaagguuuuuuuggcuucauccacucgggccaugguguucucuuuccagcgacguaaugccccgcugcagaugcaugggugcgaggaaggcagaugacaccaggauagagagagaagggaggcuucugugaaucauuccuacuucuuccccuacuccugagucagggacucuacaccuaagaaugucuguuucaccaacaccuauguuuacuugcacaucuauguccaacaaauggcuacugagcagcugcucugggcugggcaccaagagugcaugagggacccagcacugcuggagaccaaacuccaggugcuacggggauaacagggcauaaccaggcaguggcaacacaggugacucacacugugauaagagaaguguggagagacagggaaccuggaggaagguugccuacgccucagcuugcugcugaguuagcucagggaguucuugcuuauuccacccugucugaagagcgggaugggugcucuaugggacuccauaugagggauggaggcauuuauuuuauuuauuuacuuuugagagacagggucucacuccaucgcccaggcuggagugcaguggcauaaucacggcucacuguggccuugaccuucaagguucaagugacccucccaccuaagccucccaaguaccugaaccacaggcauacaugaccgugccuagcuaauuuuuuuuauauuuaguacagacaaggucucgcuauguugcccaggcuggucugaaacuccuggugucaaacagccuccuaaagugcugggauuacaggcaugagccaccgcgcccagcuaaggauggagguguuuaaaguccacgagacccacuguccauaggccaccaggaguaucaugugcugaacaaauacaaaggaaggaaaugaaagggggcaugugggaggacugcugggaaggagugagguuagaguugggcuuagaaagaguggcagaagcugcagaagcacccuccacaggggugaguggugcagauggucugacagggccuagaggugacgcuggagagucagugacaggccugcagagcaagcuggaaggggacuacuuggaaauugacaggaaagggagucgcugaagccucuggaguggaagagaugacaaggugccuugcaaagcugaauuuuguaggcgugaagcagggaggaaaaagugcucagaagagcaagacaaguggccuuuaaggcaugcagguaacagcugcuuuccaagguccugcccugcacacagcaggggcuuaagacaugaaggcgaacccgugagugaaguggaaaagccaagaccaugauauuagcgacuaggaacccgggaucauccccgaccuggcccucagcaggacccccuaaaaggcugggguuuggagugcauuccuuguuccccagcuggagcuugggaggcgcccgggagacucaccgcagcagcugccuguugugcuggcucucccuggcugccaccucccggaggaugcuucgcacccugcccugguaagucuguaggggacaaggaagacugaggcugcucuugggcccacacuucccccuguuuaggcaggccucagaggugcaucuaccacaaggcugccaugcccagagaacucaaaaaggguaggaagaggccaacagccccuggucccagggccagcagacccucccagacgacagggagaaacugucucacaggcccucaccuccuaagucaaaccaugggacuccagggaaaggagcugcuuucgcuacaaggcuaguacccacagacagcacuuguuuccacuuggccaagcaagaaucaaagaacccuauggccuaaggcccgcuguccggggcaccugcuugguuugaggugugucacgugacucuguucugggacggacaggaagaacaaggaaggaaaacaaagucuccagaaaccuccccuguccccacagcaagaucaggagggaagcagcaguuccuaccacccaugccugcagcgcccugugcagcacgcugugcugguggugcaggucugcucgcaucagcuucugccgcuccgcuccccgcagggccaggcacugcagacagaggagaaagcagcuaccgugggcuggggucugaguuggggguggcuuccugcuuugccuccauuuuauacaucaucugugugaguguaaauuaaccucucuggccucaucuauaaauacgugcuucuuagggguucugugaugauuugaugagguaagugcuugauuugcgguaaaagcucaauuaaugugaguuuaaacauguuuuacacucaguaggacguaggacuccuguaaaugguuagaucaggaauuuuagaugcaguaaguucaaauaagaacagccuaggaucugaaagaacacaaaauuuugagccaaaucagcucauaaaacugaguuaacacuuucuaugcugccuguucuccuccuucagcucagagguaggugguguggcccauauguugccugugaguccugcugacacacagcccaccuguccaaaagucauacacggguggcaccucgcaccaaagccuuaccucccuccacuggcuccaggcccaacgcaggagcugggccauguggaauucugcugcccgcacccugcccguccuccuguggggagauggcagagcucagugcugcagcccccacccagugagggcacccucuauggguuccuccucauaguccauagcccuaccugguuaaguuuuugggggagccaagacccucucugaagagcugccaaagaacuugcagucucagaaaaaagcaccuaugaucaaauuuuggccuacaacuucccagggcuucaggugccauugaagcucacaugugcaggugugaagcccccaacugagaaacugguuaaacauggucagugugcgacagggagugagauccucagaacacacaguggacacugaaaggccccaaagcaggacagucucuauagugacugggcugccuccccuccucucucuuaacuacguggugugguuaaaaacugccacaacccacccacuggccacagcugcugucccuaucccuuaucugcagcagucagcuaucacaauaugggcccaucaguuuauucccuggcuauggucacuuuuguucguuugaggcagagucucgcucuguugcacaggcuggaguguagcggugccaucucgguucacugcaaccuucacuucccggguucaugccaauuuccgugcuucacucuccugaguaacugggauuacaugcuugcgccaccacgccuggcuaauuuuuguauuauuaauagagaggguuuucuccauguuggucaggcuggucucgaacuccugaccucuggugaucugcccgccucagccucccaaagugcugggauuacaggcgugagccacugugcccggccaaccuaguuuuacuuaagacucuuuuagguugaacuuccagaacuuacaaccagagucugggguaaugcaguccuccagacaggcacuuggagcucauggugcugcuagaacaagcaaagcuggccugugauggaaaggcuuguaaggcagaacuggccacucacucuguucugagcccuugggcacuuucccuccagaggcagaaagcuuucuugagccgcccguggcgguggugggcacaggccacuguuugccacuccugcuccuggugacgugcugcugccugcuggugccacaugaaccaagaccuauacagaagcugucgcucugcgugaaggauggccugaggcaggacaggaaggagagaacagaauaaaucaaguaggagagaggcacagaagccaggaaagaauuuacaggccacaaauaaugacuaaggcaaaaggaauggaugucaggacgugguccagcccagaagcugucuguaggcuccacugagaaaggacagaugccccagagccugcccugccucaacagucacaggcaggggcccuccagugagguccgagcaacuuccugaggaggggaggccgugagugcaauggcuugaaucagauccugccccuccacacaucuccucagggacagccauuuaccauucucucugccaggcgguuuucucgaugcugaaacaucuucugccuccagagagaaaauacuugcuucucuaaugucucccuaaaaaacaaggaagaauguaaagcacuuaaaacaaacauaaaaauuaacccaaacagaacuagaaguuccaaauaauuggauuuuuccuuuuauaccaugcuaucguauaagaggugaauuaaguggcugggcacaguggcccaugucugcaauccuaauacuuugggaggccaaggcaggaggaucgcuggaggccaagaccagccugggcaacauagcaaaacuccaucucuacaaaaaaauuuuaaaauugcugggugugauggugugugccuguaguaccaacuaccugggaggcugagguggggggaucgccugagcccaggaguuugaggcuguggugaacuaugaucacgccacuccacuccagccugggcaacagagugagaccccgucucugaaaaaaauaaaagaggugaauaagcuuagaugagggagaaagcaacacaaagagaaagggaaggaaagcagacagccaaaaaaccauaaacuguuaaaaaggccaacauuuuccagguuguuucugguaucagccaagccuucacaccguacgaaaaagacucagacccugagaccccaggucuucauuaauucuauauugacuuaacagcacugauaaaggauuguucaugagagcccuuuccagugcaugcugaccaacgcuuuggggaccuguugaaaaacaaggggcagaccccuaaggcugacugagcaagucugagggggggucccaggaaauaguauuuuaaacaaguauuucaggugaauuagaaaaguagaaagguuggccgggcauaguggcucacgccuguaaucccagcacuuugggaggccgaggugggcggaucaugaggucaggagaucgagaccauccugccuaacacggugaaaccccaucucuacuaaaaauauaaaaaauuagcugggccugguggugggcgccuguagucccagcuacuugggaggcugaggcaggagaaugacaugaacccgggaggcggagcuugcagugagccgagaucgugccacugcacuccagccugggccacagagguugcaaaaaaaaaaaaaaaaaaaaaaguaaagaaaaguaaaaagguuugggaaccacuguuuugucaucucugccuaggccuacagaucaccauuaacaacaucaaauccugcagcagcagugcugggacaauugaccaacagccacuaggggcuacauguuggugaagccacaggauccauguucagcacugggggaucuugcuccccugacauuuaacacgcaagacacaucacuuaaagcaaagauuccacuucuagucagaacacagucacugguccuggaucugcccucuggccauauaugacaaaacuagacaaaauacauauggcaacugucuucaggcgcuggacaguaaguguagauucugaugcugaaaagauaggacacgggcgaggugagccccuaggccgcccagacuuucugccugggggcaccuucuaaacagugaggggaagggaggcuaagcagagccucccucagucucagugagcugaggaggcaaagacuggaguucaugacugccagaggggcuggaauuuggggucaggguacuagaaaggagacagcugaacagagggaaauacccaaaauuuuacugagguugucccagguccucagaugagggccuggaggccuagcagagagugacugcugcagggccaagaggggaacagagacagcagaagcuggacaggguugaaagacggagcucuggcccagccagagggcagagaccagacacaaaagcugagaucguucaaccccaguugaccuuaguauaaaaacacuaaaagaucaucuuuaggcugaagggaaaugauacagaugaacauucaaauguacaggaagacacaaggaacacuggaaagggaaaauauguggguaaauauaagaggcugaauuuuuuucuucucaauuuauaaaaagaguacugauuauuuaaagcaaaaauaguaacguuguaggcugggccugguggcucaugccuguaauccuaacacuucaggaggcugaggcaggaggauugcuugaacucaggaguucaaaaccagccugggcagcauagugagaccucgucucuacaaucaaucaaucguuagacauaaaauguaugacaaaaaguaccacugguugggggugguggcucacuccuguaaucccagcacuuugaaaggcugaggcaggaggaugucuugagcccagaaguucaagaccagccuggacaacauagugaauccccacuaugauuuauuucuuaaaaaaaaaaaaaauaacaacaauaaaaauaucaucaaggauggggacaaaauagaauuuuauuguuuucauguucuugcacuaaacaugaaaugguauauuaauucuaaacagaacugggccaggcaugguggcucacgccuguaaucccagaacagugagaggccauggcaggaggaucacuugaccccaggaguuugagaccagacugggugacauagugagacccuuuuucuacaaaaaauuagaaaaaaaaauuagucugggcuaggcacgguggcucacgccuguaaucccagcacuuugggaggccaaggcagguggaucacgaggucaagagauggagaccauccuggccaacccaacauggugaaacccugucucuacuaaaaauacaaaaauuagcugggcgugguggcgugugccuauagucccagcuacuugggaggcugaggcaggagaaucgcuuaaaccugggaggcgaagauugcagugagccgagauugugccacugccacugcacuccagccuggcaauagagcgagauucugucucaaaaaaaaaggcuuuucaacaaauggugcuggaaaaaccugauaaacacagaaaaaaauaaaccuugacuccuacgucauaucauauguagaaaaaaaauucaagaugaucauugaccuaaauguaaaugcuaaaacuauaaagcuuccagauaaaauauaggaaaauauauuuucagaucuuagaguagcaaauauuucuuagggaggacccuaaaaucacuaaccauaaaaaaaaaggauaaauugggccgggcgcgguggcucacaccuguaaucccagcacuuugggaggccgaggcgggcggaucacaagcuuaggaguucgagaucagccugaccaacacagugaaaccccgucucuacuaaaaacacaaaaauuagcuggucgugguggugugcgcuuguaaucccagcuacucaggaggcugaggcaggagaguugcuugaaccugggagguggaggcugcagugagcugagaucgugccacugcacuccagccugggcaacagagcaagacuccaucucaaaaaaaaaaaaaaaaaaaaaagauaaacuggacuguaucaauccaacagaauucaaacacuucugcucaucaaaaaaaaaaaaaaaaaaaaaaaggccaggcgcaguggcuuaugccuguaaucccagcacucugggaggccgaggcgggcggaucacgaggucaggagaucgagaccauccuggcuaacagugaaaccccgucucuacuaaaaauacaaaaaauuagcugggcgugguggcaggcgucuguagucccagcuacucgggaggcugaggcaggagaauggcaugaaccugggaggcagagcuugcagugagcugagacagcgccacugcacuccagccugggcgacaagaaaaaaaccaugcaaaacuaaccuaugaugacggaaaucagaauacugguuaccuaugcaggguagggacugacuggaggggacaugaaggaacuuucugggguaacagaaauguucuguaucuugacuggaguguugauuauauaggugcauaaauuaugaaaacucggccgggcaugguggcucacgccuguaaucccagcauuuugggaggccaaggcgggcggaucaugaggucaggagauccagaccauucuggcuaacacagugaaaccccuucucuacuaaaaaaaaaaaaauacaaaaaauuagccgggugugguggugggcaccuguagucccagcuacucaggaggcugaggcaggagaauggcaugaacccagaagguggagcuugcagugagccaagaucacgccacugcacuccagccugggcaacagagcgagacuccgucucaaaaaaaaaaaaaaccuaugaaaacucaucgaacuuuauuuaaaaucuaugccuuucacuguauacacauuuuaucucgauuaaaauaaaagacaaaccaauuuugucucauucucaguaccuuucacuggaggguuauaaaaauuauuuuuagccauaauucaugagauuccaucauaaaaucugucuauauuccuaaaacauuaaaaaauacccuaagaauaucaaagauacauauuuauuuggaacuuuaauuugcuaaacuccaaaccaauccucugaaaauguacuuaccaugagagucacaaauuaaaacaacuccaggggccacagggacaguucauauuuuuaugcuaggcccuugguuugcauuuuacauguuuucccauuucauuuucaugacaaccauaugagauagagacuaugaccacaucaucucaauuuuacauucgaggagacugaggcucagagagacagacugacuuguccagggucacagagcuggcaggcgacagagcauaggucugaacucaggcuuguccagcuucuaagccagacucucaaucacucugcucaugaacaaggaaaacaggaauccaaaaaaccaaguuuacugaaaagguccaaccaagccaaaacagguaaaaaucuagaucaggccuacaccguccugcaagccuccuggcuauacccugucuccaagucgcccucugcccuuuuucuccagagugauagcucuaaaaccacccaaacugcucccuagcaaaaauccuuuaaaggcuccucuuggcuauuuggaagguacuuuuaauuuuugguucucacagcauacaaaauacaaaaaaagaauagaaccaagcacggcuacuugacaguaaaaaaagaaacggguacugugugugcauguuuucaguacugaagccauuuggaaacggguacugugugugcgugucuucaguacugaagccauuuagaaacggguaccgugugugcgugucuucaguacugaagccauuuagaaacggguaccgugugugcgcguuuucaguacugaagccauuuagaaacggguaccgugugugcgugucuucaguacugaagccauuuagaaacggguacugugugugcgugucuucaguacugaagccauuuagaaacggguacugugugugcguguuuucaguacugaagccauuuuuuuuuuuuuuuuuugagauggaaucuugcucugucaccuaggcuggagugcaguggugcgaucucggcucacugcaaucuccaccuccuagguucaagcgauucuccugccucagccucccgaguagcugggaugugcgccaccaugccuggccaauuuuuguauuuuuaguagagaugggguuuugccauguuggucagacuggucuccaacuucugaccucaggugauccaccugccuuagcuuccccaaguacugggauuacaggugugagccaccgcguccagccugaagccauuuuugaaugaaucuuauaccagcccacaauacaugacuagguaaaggcaaagcugcucugucugcagaagccagaagagacaagagauguccuuucaucagccucuauuucccguggccaccaccuaaaaccaucucccuggacuucguacuaaggaagccagaguucuggcuaaccucaaacuagcauucaaagcccuccagauggauagacagauagauagagagagagagagauauuuauuuugagauggagucucgcucugucauccaaggcuggagugcaguggcgccaucucaacucacuguagccucugccuccuggguuaaagugauucuugugccucagccuccggaguagcugggauuauaagcaugcaccaccacgccccgcuaauuuuuguauuuuuaguagacaugggguuucaccauguuggccaggcuggucugaaacuccugaccuccaaugauccacccaccucugccucccaaagugcugggauuacaggcaugagccgccacaccuggccugaaauccuccagauuaaagaugacugcaacuucucccaaugcaugccccuccaucucaccccucuguccuaagauaaaguacacugaacuuaagguaauuuccaaaacugucauuuuacuaguuccauguaccugcucaaauaucuuucgaauaucuaucuauagggucagcccaaucucuucagucugggccuccccaucuugcccacuccagccaccauccucacccucucacucacaggaagccucucccagauacuuccaugcucagucucccucagcacuagcucugagcacuggaagaacuuguggcugacaugacuggggacacguggaucuguucucuugaauugguucucaguuguuucuuaucuccucacaaaaauuucacccuccuacaaagucaucaaaaagaucuuccucuugaucaagaagaaagcaccuggacuuuggaacuggagaugugaauuaaccuggcuguaccacuuacugguuguguuaccauuuaucauuuugaaccugaccucucagaaucacugugaaaaggaaauuauuaaugaagauaaugaugccaugggcagaaugaguuuauguauuuguuuucugucucccaucacacaaugcccaacacaguggcagacauacaguuagugauuaauaauuucuucauuacaggcugggcgugguggcucaugccuguaaucccagcacuuugggaggccaaggcggguggaucacgaggucaggaguucgagaccagccuggccaacauggugaaaccccgucccuacuaaagauacaaaaaauuagccgggcgugguggcgcacaccuguaaucccagcuacuugggaggcugaggcaggagaauuacuugaacccaggauguggaguuugccgugagucaagauggugccacugcaugccagccugggcgaaaggacaagacuccaacucaaaaauaaauaaauaaauaaauaaauaaauuauuauuauuucuucauuaugucccaccauauacuaagaaccugcugugggcaaguuugucccugugggaacuaaaaagauguagaucugcuccuugagcuuucuaauuuuuuuuuuuuuuuuuuuuuuugagacagagucucacucugucgcccaggcuagagugcaguggugugaucucagcucacugcaagcuccgccucccagguucaugccauucuccugccucagccuccugaguagcugggacuacagucgcccaccaccacgcccggcuaauuuuuuguauuuuuagcagagacaggguuucuccguguuagccaggauggucuugaucuccugaccucgugauccgcccgccuuggacucccaaagugcugggauuacagacaugagccaccaggcccggccuuuuucuuuucuuuuuuuuuuuuuuugagacggcgucucgcccugucacccaggcuggagugcaaugaugcgaucucagcucacggcaaccuccaucucccaaguucaagcaauucuccugccucagccucccgaguagcugggauuacaggcaugugccaccagaccgggcuaauuuuuguaucuuuaguaaagagaggguuucaccauguuggccaggcuggucuugaacucuugaccuugugauccgcccgcuccggccucccaaagugcugggauuacaggugugagccacugcacccggcccgaccuuuguaauuuuguugaugacuaucauuucaagacuucaaaaagccaggucuagcagaacaggaacuaaguguuucggggaaaugacacuuaagaaugucugccaaggugaggcaaggucccaccgugcucugauccagaaagcuaaugggcugcuuuaauggagcucucaguggcuaauaaugaagguuacaaacaggcuguuuugaaagcccuugaaauaaagauggacaccucccucucccucucccucucccugucccucucccucucccucgucuccgucuccccauggucucccucucaugcggagccgaagcuggacuguacugcugccaucucggcucacugcaaccucccugccugauucuccugccucagucugccgaaugccugcgauugcaggcacgcgccgccacgccugacugguuuugguggagacgggguuucgcuguguuggccgggccggucuccagccccuaaccgcgagugauccaccaaccucggccucccgaggugccaggauugcagacggagucucguucacucagugcucaauggugcccaggcuggagugcaguggcgugaucucggcucacuacaaccuacaccucccagccgccugccuuggccucccaaagugccgagauugcagccucugcccggccgccaccccgucugggaagugaggagugucucugccuggccgcccaucgucugggaugugaggagccccucugccuggcugcccagucuggaaagugaggagcgucuccacccggccgccaucccaucuaggaagugaggagcgccucuucccagccgccaucacaucuaggaagugaggagcgucucugcccggccgcccaucgucugagauguggggagcgccucugccccgccgucccaucugggaugugaggagcgccucugcccggccgagaccccgucugggaggugaggagcgucucugcccggccgccccgucugagaagugaggagacccucugccuggcaaccaccccgucugagaagugaggagccccuccgcccggcagccgccccaucugggaggugaggagcgucuccgcccggcagccaccccguccgggaaggaggugggggggggucagccccccgcccggccagccgccccauccgggagggagguggggggucagcccccccgcccggccagccgugccguccgggagggaggugggggggucagccccccaccuggccagccgugccguccgggagggaggugggggggucagccccccgcccggccagccgccccguccgggaggugaggggcgccucugcccggccgccccuacugggaagugaggagccccucagcccggccagccagcccguccgggagggagaugggggggucagcccccccgccuggccagccgccccguccgggagggaggugggggggucagcccuccccccggccagccgccccgucugggaggugaggggcgccucugcccggccgccccuacugggaagugaggagccccucugcccaaccagccgccccauccgggagggaggugggggggucagccccccgcccggccagccgcccugucugggagggaggugggggggucagcccuccgccuggccagccgccccgucugggaggugaggggcgccucugcccggccgccccuacugggaagugaggagccccucugcccggccagccgccccguccgggagggaggugggggggucggccccccgcccggccagccgccccauccgggagggaggugagggggucggccccccgcccggccagccgccccguccgggagggaggugggggggucagcccccugcccggccagccgccccguccgggagggagguggggggggucagccccccugcccggccagccaccccgucugggaggugaggggcgccucugcccggccgccccuacugggaagugaggagccccucugcccaaccagccgccccauccgggagggaggugggggggucagccccccgcccggccagccgcccugucugggagggaggugggggggucagcccuccgccuggccagccgccccgucugggaggugaggggcgccucugcccggccgccccuacugggaagugaggagccccucugcccggccagccgccccguccgggagggaggugggggggucggccccccgcccggccagccgccccauccgggagggaggugagggggucggccccccgcccggccagccgccccguccgggagggaggugggggggucagcccccugcccggccagccgccccgucugggagggagguggggggggucagccccccugcccggccagccaccccgucugggaggugaggggcgccucugcccggccgccccuacugggaagugaggagccccucugcccggccagccgccccguccgggagggagguggggggggucagcccccccgcccagccagccgccccguccgggaggugaggggcgccucugcccggccaccccuacugggaagugaggagccccucugcccagccagccgccccguccgggagggaggugggggguucagccccccgcccggccagccgccccguccgggagggagguggggggggucagccccccugcccggccagccgccccguccgggaggugaggggcgccucugcccggccaccccuacugggaagugaggagccccucugcccggccaccaccccgucugggaggugugcccaauagcucauugagaacgggccaggaugacaauggcggcuuuguggaauggaagggcgggaaagguggggaaaagauugagaggucggaugguugccgugucuguguggaagggaguagacaugggagacuuuucauuuuguucugcacuaagaaaaauuccucugccuugggauccuguugaucugugaccuuacccccaacccugugcucucugaaacaugugcuguguccacucagaguuaaauggaucaagggcggugcaagaugugcuuuguuaaacagaugcuugaaggcagcaugcucauuaagagucaucaccacucccuaaucucaaguaaccagggacacaaacacugcggaaggccgcaggguccucugccuaagaaaaccagagaccuuuguucacuuguuugucugcugaccuucccuccacuauugucccaugacccugccaaaucccccucugugagaaacacccaagaauuaucaauaaaaaaauaaauaaauaaauaaauaaauaaauaaaaagaaaaaaguuggaauauagaaaagccaguaguaaaacuaaucaagaaaaagagagaagcaauucaaauuuaaaaauauauauaaaaauaaaaauaaaauaaaaagagaaggggaaauggacacauucucuuaaaaacuugaaacgcuggccgggcgcaguggcucacgccuguaaucccagcacuuugggaggcccaggcagguggaucaccugaggucaggaguucgagaccuugcugacauggugaaagccccgucucuacuaaaaacacaaaaaauuagcugggcaugguggcaggcaccuguaauuccagcuacucaggaggcugaggcaggagaaucgcuugaacccgggaggcggcgguugcagucagcugagaucacaccaccgcacuucagccugggcaacaggagugaaacucugucucaaaaaaaaacuugaaaugauuaauugacauaagaauuagaaaaucugaauagcucaacagccaauuaccaaaaucugaauaacccuuugagguaagcacuauuacucccccacugcagagaugagaaaacuagagaauuggucauuugaguaccuuggccaaggucacagaacagagccaggauuugaacccaagcagucugauucugugacuucucucuacuccauggugguggauucuaugugucaacuugacugggccacugggugcccagauuaaacaguguuucuggguguuugcagaugagacaagcauuugaaucugugggcucaguagagcagacuucucuuccuaauguacgggggccucagccaaccccuugagggccugaguagaacaaaaggagaaagaaucugccccuuuugcuuccugccugccugcgugggcagaucucaucucaucuucuccugcccuucaacugggauuuacaccucgaggccccuugguucccaggccuuuggacacagacuggaauugcacuacccacucuccugagucuccagcuugcagauggcaggucauggaacuucucagccuccauaauaguguaagucaauuccucauaauaagucucuucauguauauguuaacuugacuaagccacuggcuguucagauuaaacacuacacauuuuuuuuaauaaauacauauauacacacacacaaaaaaaauaaauaaauaaagauggacaaaagauuucccaggggaaacacugucuugucuuuuccugcuagaugaaaucaaugagcccacauuacugaaaauccaggaaguacuagggccuggggucugggaagcugaaaagcacagcaaaugggcugugugguugucagaguuagauuugaaacaccugccccagugcagacaggagcugcgcaacauaccuguggaaacguguugcucuugcacugaggacauuuuccugguggcgccaucgccagagucuguuccauguguggaaggcagcaggcagggcucucugcuggaaaugaccauccgcucuggccuguagcagcuaaaguaaaagaaugaauaaccuuuguacuuaacuuuuuuuuuuuuaaacaugaccucucagggucacacccuugugggaggauugcuuccuauauaauaaaaaugagaaaaagaugaaucauuauuuauuaucuuugccaauaugcuaggugaaaaaugaaauaggauagguaaaaaaauuuucacuuaaacauuaguuaaacauuucuacacacacacacacacacacacacgcacacacauacacacacucucacucacucucucuucccccuggcuuagguguucauacccauuaccuguuucacugucuguuagcauuugacucagugauauguaugggguuuuugaaccuaaacaauuuauuaguccuuugucauguguuauaaaucuuaaauauuuccccaccccauaauauaucuuuugauuuuguuuauaguguuugucauacacauuaauguaauuauaaaagucuacuauuuuacugauacaucaguaggaagacagacaauggacauaagaauauaccauauaugucuccaugauccaaaacuuuggggggaaaaagcauauaugcauguauagagguuuuauguuuuuguuuuuuuuguuguuuuuuguuuuuuuuuuuuugagacagagucucacucuguugccaggcuggagugcaguggcacaaucucagcucacugcaaccuccgccucccggguucaagugauucuccugccucagccucccgaguagcugggacuacaggcgugcgccaccacgcccagcuaauuuuuguauuuuuaguagagacaggguuucaccauguugaccagaauggucuugaucucuugaccucacgaucugccugccuuggccucccaaagugcugggauuacaggcaugagccaccgugcccagcccaaauguguagagguuuuaaaaacauggcugcaaauuauuugcuccuccuucacugagaagugaucuauguucccuccccuugaaucuggcugggauagugacugcucugaccaauagcacaugguaaaaguggcacugugugaguucugaggcuauacaaagagccacagagcuucugacuuguucacuggaacacucauuuugaagcucugauagcugacuaccccaaggccaccaugcuguaaggaagcccaagccucacagagaggucauacacagguucuuugguuaacauucccaguugagcccagucuuugagucauucuaauccaggaucuagaugugugugaagaaaacgucuagauaauucuaaccccuugccauuagaaucuuuucaguugaggcugaucuuggagcagaaaccaaccauucccauuaaguccugucucaaucuuugauaauccauaaagcauaauagaaugguuguugucuuauaccacugaguuuggggugauuuuuuacauagcaauagauaauuggaucaguaugcauauguauguguaugugaauagauagguacauacacuccuacccaaacagaggaagagagauaccaggcuuacccaucaaaugucaugaaugguuuuauuuuuucuucuuuauaucuuuuuauacuuccuaaauuuucuauaauaucuacacauugcuuuucuauuuuuuauuaugggcauuuucaaauguaaacaaaaguagaagccgacaguauaaugaauacccaugacccuaccaucaagcuucaacaguuagcaaacauucgccauucugcaaagagccauccuuugguauuugugggggacugguuccagggccccucucagauaccaaaauccauggauacucaaguaucuuauauaaaaugguauagcaggccgggugcaguggcucaugccuguaaucccagcacuuugggaugcugaggcaggcagagcuugggaguuugagaccagccuggguaacaugguggcaccccaccucuacaaaaaaaaaaacaaaacacaaacauuagcugggcgugguggcuugcaccuguagucccagcuacuugggaggcugaggcaggagaaucgcuugagccuggggagagugaggcugcagugagccaagaucaugccacuguacuccagccugggugacaaagugaaaccugucucaaaaacaaaacaaaacaaauaaauuggcaucugcauauaaccuacacaguccuccuguaugcaucucuagauuacucauaauacccaauacaaugucaaugcuauguacauaguuguuaugcuauauuguuuauauauuguuuaggggcuaaugacaagaaaaaaaggucugaauauguucaguacagacacaacuacucuuuuuuuccucugaauauuuuuuauccaugguugguugaaucuauggauguggaacccacagauacagagggcugacuguauguuacuuuuuaaaaaggaagaaacccacaaaaaauaauauuuuuaucuugucuaagaauagaaagaucugaugugcuccugggauaccuauaccaagaggugauauucagauuguuagcuaaagguuuaggaaugacuaagcagugcucuucccauuuuucagacccgcuauaccuuugaaagcaggccgugcuagaucagugugagagaugaaaacgcugacccuggacuguccgccaguguugggccccugugucaaggggagugcucguuuuccaggaaggaaauaaaagagacccucugcucuccaccuugaauaaauacaaccuuucaacucugacacucauagucuuuuucugaaaggcuuuccugcauucuggugaacuuguauuacaugaacuuaagauaacaaguggcaaugucuuuucaaagccaguaacauaauccaaaggcaugucaaagaaugcagugacucuagcauuucuuaaguguaggaggcaagagugacgcaaaaagaggccaugcccuguagcauccaagcucuaucgacuuagaucauccuuggaaaaaaacucugaagaaaucaacagcaguucauuuguuggucugugcauuaauucauccaaauauuagcacauaucccaugccaagcacugugggcuaaggaggcaaaagggacaggcuguacucuaaaggacuucacagccuguggggaaagagaagccagugaacaacuauaagaugaauguucugauaaagcuaugccucugggguagggguggagguggacuggccugggggaggaggugacaucugagcuggaagggagugugaaauagagaacuggagguacaaagagaagcaggagggcacagaggaccuuuagggaaccacuggcagcuuaacuggucagagugcaguugugaaggaacagagugguaacaggaaaggggagagaaacagacagggaccagcucccgaaggaguuuguaggccuugcuaaaaauuuggauucuauccccaaacuauagggaacuagcuaacaggugaaucuaaagauucaccuguuagacuccaacagaagauggagguacggguagggugggcagcacgaaaauaacugggaggaguuugguuugugucuuccucuguuucacugccagagaugaccaaaaagggggcacuucucacaauggcagaugccaucaacugaacccuuucccacugaguguaaauauggccuugaaauccuucucacuucaacauuccagacagguacucccaauugguagaacgggcuuguaaggucacacucauuugucacccuggugcuaaaguaugagcccugggagagcaggaauuuuauugacuuuauaucacaguuguauccucagugcuuagugcagugucugaagaacagcaguugcucaauaaguauuucuuaaauggaauugaaucuaucuuucucaaucugccuuuacuuauuugugguccugaccucacauccuccacccccgggagacaugugucucacacuguuuagcacugggaugcagcacuuaugcucugcaccucucccuguaccucuugcaggucccacugggugaagggcuggcuaacucagagacuaaaugaauuugaguaaagaugugaauggcugauaagagcucaguacuuucagagagaacuuguauuuucauagcagauaagaaaugggaguuaugcagacuuucugauauuagaggugggaacuggaagaaaugacuuugagcuuuuucaacacccucucuuccaaagcagaacgauaagacuucuuggcauaggucuuuuccaagaaucuuuccaaagcaaauggguccaagaauguaagccaguagagcuaucugcuaaaaaguacuccauaccugcuuguaccgccucuucugaguauacuguagccacaauucgauacauuugcacagcagugcuauucugaaacaaaaggaagaacaccuucagguuucaaguuuuuaaaacuuuguuuuaaggcagguaaauugcgguacaguuacuuccugugaguuaaaggcaccccaugggcuuacuaguuucauucuaggagagacggcaauaagaaccugauaucuaauauaaaauuugucaaccucugauuuuggacuguggauugccuaaaauguugcaacuuucuuguaaaaccuaauuagaccaccgaaagcacaguagcucuggaauuuaggaaauaugugugaaauccccuagauauccugaacuuucugguuucauggccaaacgcuggggguccacgacauguugccucucacacuagguuuuguaaaccaggguuuggaauaauaugccuugauaacucuaaaugagucaguuuauuauugggauucucacuaacucauuaaaaaaugcuucaaaauuggagcuaaacuaugcaaauuaaguugauuauacuguggggagaggaaaaaaggagggcaaagaaaggaaggacauauugaacauuucuggcagcaagaaaguuuauacguagugcuuccuucugaggaguaagaucuuacucuuacuuguagggagggggccaggcaacuuuuauuuuucccuuuauacuuuccacccuauacauucugaguuuuccucacagaaauguaguguuuuuauuuauuuaacugaaugacuagcucuaaaauauugaggacauucccugcacacuuuaagacugagucacaaaugucccugacccuucucuuuaacacuagcaaugcaugaauucuaacuugugaacauauugaugccuguaggaccaaggcagugagcgaccaggcacauacuucagacuaugguggccaagaaccaaugcaaauaugcucauucuaucucccaucugaucagccaaaaacccaaagucaggaacaaaugguuuacagcaggaccuccaccccagcaggccuuucugaaucugccacacuaacgcauagaagggcaagcaauuacuccuggaaaacaguaagucagaggcacaaagucccugagagccagggaugaaaccagagucccuaccuguaguggucccaggcagcaugcaguaaggggagcagcucucuuuccuuuuucugcucaaucugagaccgccagagguuccagaaccugugcagcagcuaaagcaagggaggaagaagauggaaauguacugagaugaaagguaaaacagugaauccuuacuccaacagacugugagcucccccaaagcagaaaugaccucaguuaggagcagccaacauacagugggcauacaaauuaaugagggcucaacuauagagcuauucugggccaacauaaaaggcaaaaagaugguucuuccagucuauggaaauuagaugaagaagcuauuccuaaucccacagaagacaaugacauuuuagaaagccauuuuagaaauuaaaacugauuuuaaugcauauucccaccuaugaaguagucucgcauaaauguuuaacuucaaucuaaacaagcccucagauguaacgauuauaggaaccauguagacuaaaggaaaauuaaaugauauaaaugauaucaaaaggaaacaaucagauaaaucaauaacauaaaacacugggcugggcgcaguagcucacaccuguaaucccagcacuuugggaggccaaggcggguggaucaccugaguucuugggaguuugagaccagccugaccaacagggagaaacccugucucuacuaaaaauacaaaauuagccgggcgugauggcacaugccuguaaacccagcuacuugggaggcugaggcaggagaaucgcuuaaacccgggagguggagguugcagugagccgagauggcaccauugcacuccagccugggcaacaagagugaaacuccaucucaaacaaacaaacaaacaaacaacaacaaaaaaaauuauacaaggcuaggcauggugguaugcaccuguaguccuagcuccucaggagguugaggcaggauauucucuugagcccaggaggaugaggcuacgaugagcuacaaucacaccauugcacucuagccuggaugacagagugagacccugucucuaacaauaauuauuauaauaauaaauaaauuguauaaacaaaauaacuggccuguccuuuuuuaaaaaaaggcagucauuuuaaaaaguauacauuaugcuaagugaaauaagccaguugcaaaaggacaaauacuauaugauuccaccuaugaggucucuagaauaaucuaauuuauagagacagaaaguagaauggugguuuccaggggcugaggaaagaggaaauggguacagaguuucaauuuugcaagaugaaaaaguucuagagaugaauagugaugaugauugcacaauguggauguacaugucacugaacuguacacuuaaaaaugguuaaggugauaaaguuuaagugauguaucuuuuaccacaauuaaaaaauauaauaggccgggugucguggcucacgccuguaaucccaacacuuugggaggccgaggugggaggaucaccaaaggucaggaguuugagaccagccuggccaacacggugaaaccccaucucuacuaaaaauacaaaaauuggccaggcgugauggugugcgucuguagucccagcuaccugggaggcugaggcaggagaacaguuugaacacggaagguggagguugcagugagccgagaucaagcuacuuacugcacuccagccugggcgagagcgagacccgguuucaaaaaaaaaaaaaaaaaaaaaaaaaaaaaaauauauauauauauauauauauauauauauaaaauguaauaaagaaguguuguugggggaaggaaaguucuagauuaaaagcuuuaagaaauauagcaacaaaauccauuucugcuaaaaaucaaucagaaaagaaccaaauggaguuagugauccuuaacugcauucugguuuguaaaaagcagcuacaaauaagacauuuuuaagacaacuauggaaauuugaauguugacuagauauuaauguuagggaaucacuguuacuuuucuuagggaugauaaugacauugucguuacauaagaaaaugucucugagugacgcaugcugaaauauuuaggugcaaagugucaugaugucuauaauuuacuuugaaauuauucagcaaaaaacaaugaggcaaacauagcaaauauuaacaauuacuauauccagguagugacuauauagaggcuuauuauacuuuuuuuuccuauuuuucuguauguuuaaacauuuuucauaaaauaguaacagggaaaaaaauccuacaccaagaaaguagagacaauauauguuggcaucaaguaaacaaaccauuguuuuauaauggacuuacaauggaagugaauagacuuacaauagaaacacaaccaaagccuccuauuggggccgggcaugguggcucaugucuguaaucccagcacuuuaggaggccgaggcagguggauugcuugaggccaggaguuugcgaccagcccaaccaacauggggaaaaacccgucucuacuaaaaauacaaaaaaauuagcugggcuugguggugcacaccugugaucccagcuacuugggaggcugagacaugagaaucgcuugaacuugggagguggagguugcagugaguugagaucgcaccacugcagcugcacaccagccugggcaacagagcaagacccugucucaaaaaaaaaaaaaguauauuugggccaggugcgguggcucacaccuguaaucccagcacuuugagaggcgaaggugggcagaucacuugagcccaggaguuugagaucagccuaggcaacauaguaggaccccaucuacaaaaaauacaaaaauuagcugggugugguggcuuacagcuguagucccaacuacuugggaggcugaggcaggaggaucacuugaaccugcagugaucuacugcacuacagccugggugacagaacaagacccugccucuaaauaaguaaagaaaaaaagaaaguauuuguaucacuauauccccuaggucagguuuaaaauccacagucccugaacuuugagucaacuauccauuucuuggcaaauagauaaaaaaaugggaucaaacaaguuuuucuaucagcagguauggauuaccaaagaaaaugcaaacuaaaaaggccgagcauggugacucacgccuguaaucccagcacuuugggaggcugaggcggguggaucaucugaagucaggaguucgagacaagccuggccaacauggugaaaccucgucucuacuacaaauacaaaaauuaggaagguguaguggcgcaugccuguaaucccagcuacucaagaggcugaggcaggagaauugcuugaacccgggaggcggagguugcagugagcugagaucgugccacuguauuacagucugggcaauagagaaagacugucucaaaaaaaaaaaaaaaaaaaagaaaagaaaagaaagaaagaaaaugcaaacuaagguuuuacaguugacagucuggacaaaucuugaagcacaaaaaguuuuuuuaaaaagaguucugcuuaauuuggcaagacugaaaaaaagagcgagagagaauggccuucagaagaggucccuugauacagaagacaacccucaccgugacaccaugcugcuggugagcaagauuccuucuuauuugcuggagaugagcgugggucacauugucuuuuagggcucuaaagcaaaaauacugugcaaagaaaggacacaacugauuacaaggacugggaucaguagagucuguaaacuaagaguagaggaaggcaaacagugccucaaaucagcggggagaagcuuggucacagcuucuuguagcuguuccaucucccugaguguuucucugcuuugagauucaacugggagccuaacacaagccagccugcacagcaggcacuuaauaaauauuugcugaacccucccugcuguccaucuauacugcacaagaacaaacacacccacaccaggaaagaaccccaugacccacaugacaauucuacagaccaagguaaacaucaacuguugccucucaggagaagacagacuuuuugucuguggugguuuuuguuuuuuuaccaugugggcucagugcauacauuuguaugauuauaaaugcagugcugcuaaaauggaagaaggaaucuuuagugaaaggaaggguuggaguugggccaggauggaccuggauccagcuccaucaauaaugccuaaaaggccaggugcaguggcucacaccuguaaucccaacacuuuaggaugcugaggcaggaggacugcuugagcacaggaguucaagaccagccuggccaacagaaggagacuccgucuguauaaaaaaacuaaaaaauuaggccgggcgugguggcucacgccuguaaucccagcacuuugggaggccgaggcgggcggaucacgaggucaggagaucgagaccaucuuggcuaacauggugaaaccccgucucuauuaaacauacaaaaaauuagcugggugugguggcaggcaccuguagucccagcuacucgggaggcugaggcaggagaauggcgugaaccccggaggcagagcuugcagugagccaagauagcaccacugcacuccaggcugggugacagagcgagacucugucucaaaaaaaaaaaaaaucuaaaaaauuaguugggcaugguggcaugugccuguggucccagcugcuugggaggcugaaguggaaggaucacuugaguccaggaguucaaggcugcagcaagcuaugauuuuaacacugcacuccagccugggugacagaggagacccuaucucuaauaauaauaguaaugauaauaauacuaaugccucaacacugggccugguggcacaugccuauagucccagcuacucaggaggcugaggugggaggauugcuugagcccagaaguuugaaucuagccuggacaacauagugagaccgcaucucuaaaaaauaauaauaaugccucacaaauuggcuaagcaaagcugauuugcccauacuuccccaugccuuaggcuucaauuuucugagacagaagugaagauaucagacuggauuagggguuuucguacugugcuuuguggagccccagaggcuccugaaaacauaugaagaccaccucguguagcaagggaagggaagaguagcagguagaacagggacggacucccugacgugcuucaaccacagcauggcuacuuugaccuauuuuauaggugaggcuuccgccacucaaaagggguuuuaccauguaaaaaaagcucaggacuaaauaaucucugagguuccuuuacagcuccauaccccucugacccuacaacauuagcaccuguaauccaaaaugaaaagaaggacacccacaaugaaaggagggcuucaugaccaaaacucacccauagcugacugcauuuaaugaaggugauaggggucagggucccccaagaguggauacccaagcaaggcugccaagcggacccgugccaggaugcagggcucuuaccagcuggcugugccuguggugcucuucugccaucucaaacugggcagcuucuucugcacacagcagcaugucugccaggaagugaaggccuccagucccaacaagguucugaccccuacacagugcauucucagcaagccaccuugaagggccguggcuaucggggauaacacacgugccaggugggcugagguccaccucugucuacuccugaugacccagggaagcagugggcaaagggaaacccugucaguuacugaucaaacaucuggucuugcauuccuccccuugaaugcccaugagaugagacgcaaaaaauaccugagauaaacugcuaucaauuucaguaaacauuuagaaaucaccauaucuaaagcagaaucugcuccuuuuucuauagucucuguuuuggcaucacaauccaguuagauauuugagcuaaaaaccuuggaguuauuuucaaaccuuuucuccucccacucucaucuaaucggucgccaaguccaucuguucccuuccuaaaucucuuggcucucuccauccccuucugcucuucuguccccacccccaacacccugcaguucauccaacucgucccuuacguagacugguaagugagccuccucccauaacuggucucccaccagugcuagccucucuccgcuaauccagaauuauccuuuccaaagcacaaaucugacugcacuucuuuucuuuuuuaagagacugggucucacucugucacccaggcuguagggcaagggugccaucauaguucacuguagccucaaacuccugaguucaagcgauccucccaaagcacuuggauuacaggugugagccacugcccccagccucuucucuucuuaaaaaccccugaagccgggugugauggugugugccuguaguuucaccuacuucguaggcugaggggggaggauugcuuaagcccaggaguucaagacuguagugagcuaccauugcgccugugaaagccacugcacuccagccugggcaacaugugacccugucucuaaauuuuuaaaaguuaaaaaaccuccagagguuccugcaucuaccuucccaccaucccuaccuccacagcccacuggauucuugaaugcuuuuccucacugaaaugccuuuuccaaccuucugcagucuuccccuaagacaucaaccuucccaacuucucaucuccuaugacuuagacucugcacaaacauuaccuccuuggcugaaucuccacagucgcucucacaggacuucauacaaaucuuuaugauaggaauuaucaugccauauuuaaagacauauuuucaugucuauuucccccacuagacaaugaacuaucauuagucugagcuuccucauaucccagaauuuaagcaggaguuuauacaaagcaagacuuugaugaacaaauaaaauguguggaugaacauccuaggcaguccaaauucucacacuugggcacacaguaugguagggguagugauuaagaauauggcugggugcgguggcucaggccuguaaucacagcacuuuggaaggccgaggcgggcagaucaccugaggucgucaggaguuugagaccagccugacuaacauggagaaacccugucucuacuaaaaauacaaaaaaauuagccggacaugguggugcaugccuguaaucccagcuacucguggggcugaggccggagaaucgcuugaacccggaaggcagagguuguggugagccaagauugggccauugcacuccagcuugggcuacaagagcgaaacuccaucucaaaaaaaaaaagggaaaaaaaagaguuuauacauagagcuggacgcgguggcucacgccgguaaucccaguacuuuaagaggccgaggcaaguggaucacuuugggucaggaguucgagaccagccuggccaacauggagaaaccccaugucuacuaaaagcacaaaaauuagcugggcauggugguggccgccuguaaucccagcuacucaggaggcugagacaggacaaucacuugaacccgggaggcagagguugcgguaagcugagauggcaccacugcaauccagccugggugacagagcgagacucugucucaaaaaaaaaaaagaggcuggguacgcuggcucaugccuguaaucccagcacuucgggaggcugagguggguggaucaccugaagucaagaguucgagaccagccuggccaacauggcgaaaccccgucucuacuaaaaauacaaaaauuagccaggcgugguggcacaugccuguaaucccagcuacucgugaggcuaaggcaggagaaucgcuugaaccugggaggcggagauugcagugagccgagauuguaccacugcacuccagccugggugacagagcaagaguccaucucaaaaaaaaaaaaaaagaauauguacacaggaguuaaaggccuagguuuugaaaaucuugacucugccaaugaccugugacuuuagaauacacucagcuccucugaaucucuuuccucgucuguaaaaugguaauaguggcaccuacuccacagcguugcuaugaggaugaagaggaugaugcauaaugucugcuacguaguaaaagcgcaauaaauggaaacuaugaucacggugaugguaucaccaagaaaaagauagugguggcuauuuccaccaccuaguggguagagaaaagcacuuaaauuguaacaccaaaaaaugugaaucaggaaagugggauuaccucugagggaaaagaaaaagaacgcagucagggaggagcaaauaggugugcuaggaagguucuauuuugaaaguugggugauaagauauauaguuguucauuuuauuauuuuuaaacuauauauaagcacucuuuuuauacacaaucccaauuaaacaaaaauuuuaagacugucaacagagauaaggcuguuuugaaucguuuggcaauuguuucccauguaucucaugacuuucguuucacaugcugcugagcucaugcuguccuggcugaggcaauggacagccugaguaucugaaaggauacaguguuuccagugaguaaaggcgcgccgcagggccaucuuccuggccaguuucuccaccugggcauggugagcguacaagcucucccuccgcucccaggccugcugccagucacagaaguauaucuggagcacagugacaugauggaaucgcucagccaucucugcaacagagaaauaacuuaagugcuacuccccuaagguuagaugagcuggaaacaucuuuaagacaagcugaaccccacuacuggcagagagcagggguucaaggccacacacacacacacacacacacacacacacacacacgcacuaaguuuuuuuuuuuuuuucuuugaguuggagucucgcucuguugcccaggcuggagugcaguggcgggaucucggcucacugcaaccuaugccucccagguuccagcgauucuccugccucagccucccaaguugcuagaauuacaggcaugugccaccaccccuggcugauuuuucugcauuuuuaauagagaugggguuucaccauguuagccaagcuggucucgaacuccugaccucaagugauccgcccgccucagccucucacagugcugggauuacagacgugagccaccgcgcccggccaaaauacaaguuuuuuaaaccuugaaaggucauuaggaaucccugagcuacaucuccucucuccaaggaaagagaaaaggucugugauuuuagggaggaggaugcuauaaaaucaguuacaucaaagggcugaggcuucuaguuagauacugaugaacagaaaugaaaacuguuacuuucaaaaaggacuguuuuacuuuugcuucuaaacaaaugucuccuggauaggacuuagagauugagucaaugacauaaaauucaguugccacgcuggcauaggcuuuuuugagcuuucagccaaccugauccuggcugccagcuucaucuccuuuuaaugcuagucagauaauggucugaugagcuagggccugggaaggggaugggaaucagaccuggaauuugaaugcuguaauuggaggcaggcauuagucuauagcuuaucauacuaaacagcuuaaugccuucacauuccaggacugggcaacuggacuguuggucuggggucacuauccuccaaugaacauauucaaacucucccaagagacaguguuggcagcguaagagauuucugcagggagguuugggugaacgccagagacccuuaacccagugucuagcacagugcuugacuuacuuugguauaaacucaauaaacuuaaguuaaaaaguguacuaauguucacauuucuauguauuauuacuucugaaucuaauugggaaacaaaaccauauaaacaguauccaaaaaacucaacaucaaaaucacaugcauuugcauaacuggagacaaacagaaacuauccaaauaucuauuaauaggagaauggcuaaguauauuaagguaagccauccuauaaaauaugaauaguuguuaaaaaauaacauuuacgacaaauacuuaagauguagggaaguguugauuaacuguguggaaaaaaggaagauacaaaaccauagguuaucaacauauuaaucaaaauaauuacaauacuuauagcaaaaugaaaacccuauuuagauaaaaaauauacagaagaggccggaaacaguggcucacgccugcaaucccagcacuuugggaggcugaggcaggcggaucaccugaggucaggaguuugagacuagccuggccaaaguuaugaaaccccaucuuuacuaaaaauacaaaaauuagccgggcgagguggugggcaccugugaucccaacuacuagggaggcugaggcagaagaaucaccugaacccaggagacggagguugcagugagccgagauugcgccacugcacuccagccugggugacaagagcgaaacuccaucucaaaaaaaaaaaaaaaaucuaucuacagauagcuagauagauauagauacagauauauaaauaaaagcccaaagagaaauaaaugugacucaaggaugauguauuuuccuccuuaaucuccuuuuaccaaaauuucuggaguagcaccauuauauuacuucuuaguacaguaccacuggcagcaggagagugaaacugugaccagauccucuaucucgagagccuggagcuuccuacucaccauucugcugucucuucacucugcggacuugcagguauucaagccaggccuuuagaaaucuccguuuuugccagugcugaugauguuucacugcagagacaaccuuuuguuucuccuucuggacauacaggagcuguucccgccacugugaccaagccugaaaaccagagaagaggcaacagucaaaggagaggcaggaaaacagggugaaguacagguggagagggaaaagagaaaggcacacacgcuggaaaggcugaaauuagaaacaaggaaguggcaauccccuagcaggaugauaagcuaugggaccgugggguaaaagggucuuuaagagggacauucugcuuucaaaaguaauuuuuuccuggauuaaaaaaaagaagaauaaaaucaacaagcagaaagcagauggcuggugcaguggcucucgccuguaaucccagcacuuugggaggccgaggagggcagaucaccugagguuaggaguuugagaccagccugcccaacauggcaaaaccccgucucuacuaaaaauacaaaaaauuagcugggcgugauggugggugccuauaaucccagcuacucaggaggcugaggcaggagaaucacuugaacccaggacguggagguugcagugagcugagaucacaccacugcacuccagccugggcgacaagagcgaccaacucaaaacaaaaacaaaaacaagcagacaaggagcagaaacaauccgaggggugauauaauuaauucagauuugggauaagugagggucugccuuuucuuccaaagucagaggaagccuacuguaaaguaguccuuuuucaggcagauuaguuccagggaugccuauauauagaagcuaagggucuacaagggucuauaaaugcacacccuuagaucagugauaaugcauguccuaaucugaagacgacuuagacaaagacuucauaucuuuucuucagccugucgcaccucuccuuucccuccucucaacugaauaccaucguucccauuucacuaagaaaauaaaagcaaucaaaaggaaauuuccuuaagguccaccauguuuaacuacccaccugcccacgggcucugucuucucucuuuccugcuacucuggaugaaccgcccaugcucccaccaacgucaguccccucccaacccuguccagcucuggcuaucucucaccuucccgaguuuacugccuuggcaguuccccucuuacgaaucaucaguuuucacucucuauagauuuuugaaaucagcauaucaaugugcuauuauuuuuccuauccuaaaaaaaaaaaucuucaagauguaacaacuaaaagcaaugggugaccuuuaauuagacuauggaaaugaaaauagcaacaauauacaguuuuaauaugaacugcauguuauauauuauaucaauauuaaauuucuuggaauauaauaaugauauuaugguuaugugggagaccauccuuuuuaggagauauacacuuuaagauaaacuuugugucuacaauuuuagagcagcucagacaaaauaaauguauuuauauacuuaaagaaagcaaauguggcaagauguuaacaauggguugguggggcgggguggcucacaccuguaaucucagcacuuugggagcccaaggcaggaggauugcuugaccucaggaguuugagcccagccugggaaacauggcgaaacucugucucuaccaaaaaaaaaaaaaaauuagccaggcauggugguguguaccuguagucccagcuacuugggaggcugaggugggaggaucgcuugagccugguagguugaggcugcagugagcagugaucauaccacugcacucuagucugggcaacagagugagacccugucucaaaaaaaccaaaccaaaccaaaccaaaaaaccacaaucgguuaaacuaggugaaacacagacaguauccaccuuuucuaugauuugguguuugucaguaauaaaaaguuguuggggaaagacugccaucacaaaaauacuuucugaaaggaauaaaccagugauucuuaaacaaacaaagcaacaccccucucuagacucuagaccgcauugugccauccagcuaacacuuugguucuuucuguuucaagcuccucaaaagagcuauuuucuaaucuuucugucucccaggcaggcuuucuugagcccgcucccacaggcuuacugaaugaaacuacucuuaucaagugcaucggcaaucuccacaucgcucaauccaaaggucagauuuugguccucaccucccuugaccugccagaagugucugacaaagccuuccuccuuccuucaccuggcuuucgggaugugucccugcuuuguuccuguugcugacucccaccucugugcaccucgcaggcucagcccuggaaccucucaucuagcuacacucacuccuuuuauuuuuucacccacccuaguagcuuuuuuuaaaaaaacagauggggucucucuauguugcccaggcuggucuugaacucuugggcucaagcaauccucccgccucagcgucccaaaguguugggauuuacaggcaugagccaccgcaccccgcucacucuaguaacuuuacauaccaucugccuacuaagaacuccugaauuucccaaauguaccucccauccuggccccauccucaguauuccacacauauaucccaauaucccacugccuccuuaacauagcuucuuguggcuauucaaaaggccuaucaggcugaagauagaguccagaauugggcuccuccuaaucucuucccacaaaccugcuucuccugcagucuuuccuauuucaguaaauggcacuccauuguuccaacugcuuaggccaaaacuuggaagucaucuuggacgcuaaaacuucguaucucauccauacaucuuuuaaagaugucaguuacaucuuuuaaagacauugagaauccaaccaccgucuucuuaucaucuuuguggaaaaucucaccuggaauuuuguaauagcuucuuaccuguccucccuguuuauauccuugaucaucucugauuuauuuauuuauuuauuuauuuauuuauugacagagucucauucuguuacucagacugccagacugaagugcaauggcaagaauacggcucacugcagccucaaccuccugggcuuaagcaaucuuccugccucagccuccugagcagcugggaccacaggcaugcaccaccaugcccagcuaauuuuuuuuuuuuuuuuuuuugagauagguucuugcuccauugcccaggcuagagggcagugguacaaucauagcucacuacagccucaauuucccggacucaggugauccucccacuuagccuccugaguagcugggacuacagacacaugccaccauaacaggauaauuuuuuguauuuuuuguagagacaggguuucaccauguugcucaggcuggucucagaugcuagggcucaagcuguccccccgccuuggcuucccaaagugcugggauuacagacaucugccaccacgccuggcucugauguacuccuaacacaacagccagagugguccauuuugguucgcuuuaauuguuaggucacuuaaaguucuguuuuauaugacaacuucccuuccugcuuuuuuucucuuucaugccaucaaucuacuagagaaaucaagucaucuauccuauaaaauguccuacauuuuggauuuggcugacuguaaccucgaggugucuuuaacuuguuccucugaccccuguauuuccuauaaacugagagauuugcauuaggcuuggagucauguucaauuuuuuaggcaagaacaguucaugaauguggcuggguacuuccccuuacauaguaucaugaggcacaucaugucuggcugccacaguuguagcaaugccaagauuguuugguggauucagauggcagguagccagauuucuccuauauuuucccaccauccucucaccuagugauggcuuccuagaucuauguccucauuagggguggcaaaacagcaauuuucuaguucuaguauuccuucagcauuuauuaacuggaauucuucuauaaagaaggcuucucucucauuaacccucugguuucuuggaguuaacaguuuauauaggaaaggugggauaaaugcuuaauuuuuugccuuuaauuuuuaaagaauuaaaaugcuuuaauuuuuaaagaauuuaguuaacuccccuaacaacccaaaaucaugaccgaugaguuccacuuucuuugaaaauuauuucaaaugcaugaauuuuuauguauuugauguuuucaaucuacugggcucaagugauccuccugccucagcuuccugaguagcugggacuacaggcaccacuaugccuagcuuauuguuuuuugaugcucaaacuuuucuaucuuaagcccugggaacccuuccaaauugguuccugaguccuucugacacaauuccauuagcuuuuguuaaguuccuuaguccuagguguaucuugucuauuuccugccccggaccuauaaucagccauuucucuaaaaagcccugguuccuauuagugggaaauaguuaagaccacaacuugggcacuggggauacuaaaugcuauauuacugucacugcuucuaaugcuuuuuuuuuuuuuuuuuuuuuuuuugagacagggucucacccugucgcccaggcugaagugcaguuggcacaaucucagcucacugcaaccucugcuuccuggauucaagugauucucgugcucagccucccagguagcugggauuacaggugcccaccaccaccaugcccggcuaauuuuuuuguauguuuaguagagacgggauuucaccauguuggccaggcuagucucgaacuccugaccucgggugauccaccugccucugccucccaaagugcugggagccaucgcgccagaccagaaaugcauuuaugguaaaaaaaaaaaaauauauauauauauauacacacacacacacacaacacacacacacacacacacacacacacauauauauauagagagagagagaguccauauugauauuuacaguuccaauugcagauuucuuugcuuuuuauacuuguaaucuuuucuuuucuauugaagaucuuuauuccuaacaacacugccauaauuauuugcuuuaucuuacaauguaacuauaauacuuucaauguaacaauuucaaaccuccuagcaacaauaacacuuguuuuacuaagaaugugguuuuagauuucuuagcaguucauuacguccuuuuaacacauuccaccagggugaacagucaaaauauuguauuuuaaaguuacuugaaguaauuauucucuguguagucauugccacaaacuugauauguucguuucaguuuguuuugaaaaucuggcaauuguuuuuuuauuuacucuugcuuuguaauuauauaaaauauaugcauaguuccaaaguuaaaacuauguaacaaaguaaauucacagaaguacuuuauuccuauacccuucucucccuccuccuauagguaaccauuuuuugguaaguuuuucauuuauuuuuccauuauuccuucuugaaaauauaagcaaacagacacacacacccccccccuccacaaacacacagacacacauucauauauauccuucccuuucuuaccccaaaagcagcacacuaugaaucaaagaauccuguuaagagguagguauaaucaugucacuccucugcucagagccagcagcucuucaccuucccaggaauaaaagucaaagccuuuuuuaucaggcacagccugccaggcccugcguucuggcucccuguuaccucauaaccucauccuuccuacucuccuucucaagcucagcaauauauuaugagauauaucaaauucaaagaugaaaugacucaauaugacaauuuuucuaaccuaauaagcugucagucaguacauuguaauaaaaauccuaauaggcuuggccaggugcgguggcucacgccuguaaucccaacacuuugggaggccgaggugggcggaucaugaggucaggagaucgagaccauccuggcuaacacggugaaaccccgucucuacuaaaaauacaaaaaauuagccaggcgugguggcaggugccuauagucccagcuacucgggaggcugaggcagaagaauggcgugaacccaggagguggagcuugcagugagccgagaucgcaccacugcacuccagccugggugacagagugagacaugucucaaaagaaaaaaaaaauuccuaauaggcuuuguuauagaacuugacaaguugcuccuaaaauuaauaagaaagaguacagaagaacaauuaagacaaguuuaaaaacaaaacaagaauaaaggagauucucugucaaauauagagccuugagaacuauaugucaaguaggaauauaaacagcuagcauuuacugagcauuuccacauuccaggcauugcucugaguauauuaauaacuggaucauccuccugaagccucaauaaucucaugagguagguacuauuacaaucuacuuacagauaagaauucugagguacaaacagaugaaauaacucauucaaaggcacaaagcuaauaggugauagaggcagaauuccacuuggacagucugacucaagaaccuacacuguugcuuacugcuucaucaaaucguaacuaaaccaguauggcauugguauggucuggauagacaaauacaugaauggaagacagagccgagaaacagauccgugaauaauuaaaagaaacugggggccgggcaugguggcucacgccuguaaucccaacacuuugggaggcagaggcaggcggaucacuugagguaaggaguucaagacagccuggccaacauggugaaaccccaucucuacuaaaaauacaauaauuagcuggaugugguggagcacaccuguagucccagcuacaugggaagcugaggcagaagaauugcuugaaccugggaggcggagauugcagugagcugagauugugccacugcacggagucucaaaaaaaaaaaaaaaauagaaaaagaaugcucuugguaguacuguucguaauucuaaaaagcagaggaagucaacaguccaucaguaaguaagcagauaaauggugccuuguuuauacaauggcauaauauacacaguuaauagaucucugucuauccacauagauagggccaggcaugguggcucaggccuguaaucccagcacuuuaagaagccaagguguaagaacugcuugaggccgugaguucaagaacagccugggcaacagagaaagacccugucucuauuuuaaaaaaggaagaaagaaaucacauggcuaaaccucaaaaauauaccguugcacuaaaaaaacaaguugcaaagcacaguaugacaacauucauaaauguccuaacuacacaaagccauaccauuuacuuauuuauuuauuuauuuuugagacagggucuugcucuguugcccaagcuggagugcaguggcaugaucaauggcucacugcagccuugaccucccagguucaagugauccuccaaccuaagccucccaaguagcugggacaacaggcaugcgccaccacgucuagcuaauuuuuuuuuuuuuuuuguagagauggggucucacuauguugccuagucuggucuugaacuccuaaacucaagugauccucuuauuuuggccucccaaaguccuaguauucagguguaggccaccgugaccccucccgccuuuuuaagugauggggucucauuauauugcccaggcuagccucaaacacuugaccucaagugaucauccugccacagccucccgaguagaugggacuacaggaguguaccacauguuuauucuuuacagauaugugcacauauuuuuauaagaaaaaagaauauaggagaacaaucauaccagaaucaaaagaguggcuaucucuaaggaggagaggcaguagaagggacggagggaggguaaagcuuuggcaguguccauuaaauuuuguuacuuuaaaaaauucugggccgggcacgguggcucacgccuguaaucccagcacuuugggaagccaaggcaggcggaucacgaggucaggagaucgagaccauccuggcuaacauggugaaaccccaucuccacuaaaaaauacaaaaaaaaaaaaaaauuagccaggcguuguggcgggcgccuguagucccagcuacuugggaggcugaggcaggagaaugacgugaacccgggaggcggagcuugcagugagccaacaucgcgauacugcacuccagccugggcgacagagcaagacuccgucucaaaaaaaaaaaaaaaaauucugggccaggcaugguggcucaugccuguaaucccagcacuuugggaggccgaggcggguggaucacuugagcucaggaguuucagaccagccugggcaacauggugagaccucgacuccacaagggaaaaaaaaaaaauauuagccaggcaugguagcacaugccuguguucucagcuacuugggaggcugaggugggaggaucacuuaagccugggaggucaagacuacagugagccaugaugguaccacugcacuccagacugggcagcagaguaagauccugucccccaaaaaauaacuuaaaaaaaauucuggagcaaguauagaaaaugcuaacaccuuuuaaaucugggugaggguguugaguacuuggcuaucugcuaauuuuuuuuuuuuugcaaguauagaaaaugcuaacaccuuuuaaaucugggugaggcuggugaguacuuggcuagcugcuaauuuuuuuuuuuuuuuuuugagauggagucuugcucugucgcccaggcuggagugcaguggcgugaucucagcucacugcaagcucugccucccagguucaugucauucuccugccucagccuccugaguagcugggacuacaggcacccaccaccacgcccggcuaauuuuuuguauuuuuaguagagacgggguuucaccguguuagccaggauggucuccaucuccugaccucaugauccgcccaccucagccucccaaagugcugggauuacaggugugagccaccgcgccuggccuaucugcuaauauuuuucuaaguguuuuauauuuuauguguuucuauguuugaaauaccaaauuuaauuuuaaauuuuaaauuaaaauuaaaauuuuacauauuucaugaugucuuaccugccuagugcauagagaugcuguguagauuaagacguguaggcugggugugguggcucaccccuguaaucccagcacuuugggaggccgaggggcagguggaucacuugcggucaggaguucgagaccagccuggccaacauggcaaaaccccgucucuaucaaaaauacaaaauuagacaggcaugguggcgcgugccuguaaucccagcuacuugggaggcugaggcaggagaaucgcuugaacccgggaggcagggguugcagugagccaagaucgugccacugcacuccagccugggcaaaagagugagacugucucaaaacaaaaaaacaaacaacaacaaacaagaaaaggggaauucuaaacauguucugagcaacaguagcaucaguagaaugaguuuauggccucucaaaguggcucuuagaaagggaagaaaacuagcacaguuguccaccgaugacagaaaaucagucucauuauguuuaguuucccuauauucacagucagucuauaaguuuagucaguaucccugcauuuauagcauuuucccauuuaucaguuccaucucccuccugagguuacaagucuauucagcacaauacugcauggugauuaugauaaugaugcaggccaggcgcggugguucacgccuguaaucccagcacuuugggaggcugaggcaggcagauugccugagcucaggaguuagcaaccacccugggcaacacggugaaaccccaucacuacuaaaauacaaaaaauuagccaggcguggcggcaugcgucugagucccagcuacuugggaggcugaggcaggagaauugcuugaaccugggaggcagagguugcagugaggcaagaucgcgccacugcacuccagucugggugacagagcgagcaauacucugucucaaaacauauauauauauauauauaaaagaugaugaugcagcuuucuggcugcuuagguuaaaaccuggcuccaagcggccggaugugguggcucacgccuguaauaccaguacuuugggaggccgaugcaggccaucacaaggucaggagaucaagaccauccuggcuaacauggugaaaccccgucucuacuaaagauacaaaaaauuagccgggcgugguggcgggcaccugcagucccagcuacucaggaggcugaggcaggaugauggcgugaacccaggaggcagagcuugcagugagccaagacugugccacuccacuccagccugggugacagagcgagacucugucucaaaaaaucaaaaaaaaauaaaaaaaccuggcucuaagcuucacuauacaugugacccuaguucaaguuauuuaaccuuccugguucccuuaacaauaauaugggacuuuuaaaaaagguuuaugaaaauuagauaaugcacguaaagcacuuagucuagcaccuaacacaaguaagaccacaauaaaaucuacuucuuuuuuuuuuuuuuuuuugagacagggccccaacucagucacucaggcugcaguugcuacugcuauugguacuguuauuauuauuggcgagaacugugucucuuauuuccuugcuauugccucagaagaccuuacaaguucagaggucagcaaacuuuuucuuaaagggucagaaaacaaauaguuuagucuuuguagaccauaaggucucuguuacaacuacccuacacugcucuuguaaucugaaagcagccucagaugauauauaaaugaaugaguguagcagcaucccaauaaaacuuuauuuacaaaaacagaaagcaggccaaauuuggccugugagccaguuugcugaucacugaucuagaugacuauauaugcuauuugcaugugaucugcacguauucacauggacuaugcaauuuguuguuagaauaagaagauacuauuccuacauuuggaaacaggcacuaauuuuuuuuuuccucuucucuguucuauuuccuauaacuuauuuggcagcucuguaaguacccagcagacacaaaaacaugacaagaauucagagaauaugucaaaggauaagaaaguuuuaguacaggccuuagccauuuaugauugacaaaaaaagcuaguggcuugccuaaaagaacacucuaagacaaucaaaacuauaaagaaaaggaagacagguuuucuuuucagucuuaaguuucuuuucugccccaauuauuuucugauuugcuguaggaaaacagcaacgaggaaaucagaguauacugcuguuucucuaaacauguuuauaacuaauucauaaaucccucuccagcuccacaauuaccagaagcacucuggaagccacugaucuaggcucaucuaggacaagccucuacuuuauuccuaacagcagccucccucuggaagagcccagccuuccagauuaccucuguccccacccccucucaggcccugagcugcagggaaggcccagcacugcccucugugggugagaggcuugacaacacugacagaggaugccaaaucccacgucugcuggacucaccugcaccuggaggcucagggcccugugcuucaaagcagaggcauggagggcacggcucacacggaccuguccuagucgcugccuccacgugcuccaccacacccugugaaacagcaaaucaaagauggaauccaucaguaaaaagccacucaggaaagagaggagcaguuaguguggggccucagacccucagcucuaguccucuccuucauaguaccaucucuagauucacugcuggggaaaaaaauaaaacaaaacaauugagaaaaagucccagaucugcccauuaaugguuggaaacuuaugguuccuacggucagauccugcuuuagacaccacagacaugcucuguuugaccuacacaguuugauuuguuaaaagauauguuauggccugguacgguggcuuacaccuguaaucacagcacuuugggaggccgaggagaguggauuaccugaggucaggaguuaaaagacuagccuggccaacacagugaaacccugucucuauuaaaaauacaaaaauagccaggugguaguggcaugcuccuguaaucccagcuacucgggaggcugaggcaggagaauagcuugaacccaggaagcagagguugcagugagcugagaucacgccacugcacucuagccugggugacagagugagacuccaucucgggaaaaaaaaaaaaaaggccaggcgugguggcucacgccuguaauccuagcacuuugggaggcugaggcagguggauuacuugaggucaggaguucaaaaccagcuuggccaucauggugaaaccccgucucuacuaaaaauacaaaaaauuagcuggacaugguggugugugccuguaaucccugcuacuugggaggcugaggcaggagaaucucuugaacccaggaggcagagguggcugugagccaagaucgugccacuauacuccagccugggugacagagugagacuccaccucaaaaaaaaaaaaaaaaaaagaguauuaccaacauuugaaaaucaggagauuucacaaaauaaucugcaaucaaguggcuuuuagauuucuagucuuguauguauccuuuucuuuccuagaauccuggucagacuuuuguuucagucuuguuuuuuuuuuccuacuaauuuucgaauuugcucuaggaaaagagucauggggaaauaagaguuuacaaccugugcuuuacagaaacacucacuuuuccuggucacucuaaccuacaaagauuucucuuagaccaggcucacuugcagcacucacugcaaaaccucaagcuaucucacauuaucacuuaucuucuuaugcauccagggaaucacaaauucccugaauacagccccagcaucaauacaguaccaauaacauuuuacuuauuuauuacuuuauuuauauuuuuuagguauauaaacuacuuauuaacagacaaggccugcagacuuauuucuucuuggacccgcccaugguacagccaugguggccaguggucuuggugugcuggccucggacacgaaggccccagaaguggugcgguccucuaugggccugaaucuucuucagucgcuccacaucugcacggagcuucuuguccagaccacuggcuaggaccuggcuauauuuuccauccuuuacauccuuccgucuguucaagaaccagucugggaucuuguacuggcauggauucugcauaauggucaucacacguuccaucucauccucagugaguucuccugcccacuuggugaggucaacgucagcuuuccucaacacuaugaguguacugucaacccacauccuuaauggcagugauggcaaagccuauuuucugcugcccguugauguugcuguugaguauucgcaaaauacgcuggaacuuuucagggaucacuagagacauagcaggaacacaacuggcgguguguaggccucccgcggaagccauuuuuuuuauuuuuucgagacagagucucacucuguugcccagggugcaguggaguggcacaaucucgacucacugcaacgucugccuuguuuguucaagcgguucucaugccucagccucccgaguagcugggauuauaggcgugcaccaucaaaccaggcuaacuuuuguauuuuuuuaguagagacaguuucacuauguuggccaggcuggucuuaaacuccuggccucagguaauucaccagccucagccucccaaagugcugggauuacaggcaugagucccugugccuggcccaguaccaagaacauuuuaaacccucaauaaauaggcugggcccgguggcucaugccuauaaucucagcacuuugggaagccgaggcggguggaucaucugaggucaggaguucaagaccagccuggccaauguggugaaaccccaucucuacuaaaaauacaaaaaauuagcuagguaugguguaaucccaguuacuugggaggcugaggcaggagaaucacuugaacccaggaagcagagcuugcagucagccaagauugugccauggcacuccagccuggacgaaacagugagacucugucucaaauaaauaaauaaauguacguugaguaaaugaauuaauuauauaaaaauaucacucaggccaggcgcgguggcucaugccuggaaucccagcacuuggagaggcugaggccggugaaucaugaggucaggaguucgagacaaggcuggccaacauggugaaacccugccucuaguaaaaauacaaaaaauuagcugggcaugguggcaggcgccuguaaucccagcuacucgagaggccaaggcagaagaaucgcuugaaccuggaaggcuugaacccagaagguugcagugagccaagaucacaccacugcacuccagccuggggaacagugugagacuccaucucauaaaaaaaaaaaaaaaauucacucagacucaaguaaaacugcauacuaauuaggcauuuugaaauacuugcuaaauacauuuuaaguaaugauuuuaauuauuuaaaaaaauuuuuuguguguagagauagggucuuggcuuuguugcccaggcuggucucaaacucccggccucaagcaagccucccaucuuagccucccaaaguguugggauuacagguuugaacuacugcacucugccuauuuuauuucuacuuaaauaacuucuuuauguccacugauuuucuggacacuguuaaauacuuuacagauauuacuuuauuuauuccugaugacaaaccuuuaaguaugguguaacuauuucacagaugaggaaaauaagagcugaagagaugaaaugacccaauaauacagguuggaagagggauucaaacccaaguaagugcagcugcaaagccucuccuauuauccauacuuuguucaauacccaacuuucaggcaggaagugaauuauuaauauauuaccauucaggacaccaguggacaacuacagacaacauagagugaaaucugucccaugauaaugcagcucauuguuacauaucuggcuauaaaaguggacuaauucauguucuuccaguaugucuacaaugcugaugggcugcaaugcagaagaccaguuaagagcaugggugggugagcccuaguuuugccaauuacaaccuguaugugcuaggcaaguuacucaaccucucugagccuuauuguacaucuuaaucuguacaauaaugguacuuacaguuuacgguaaggguuaaauaagauacuuuacauuacaaaauuaacacaugcacacacaaacuuaacacaggguuuagaacacaguaagcacucaauucauguuaauuaugauuaugugaaaaucgaucuuauaaacaaguuaucaguaaaucuuuauuaggcaucaacuauguucaaaauauuguuucaaggugggaagggggcaugguggcucaugccuauaaucccagcacuuugggaggcugaggugggcagaucgcuugagcccacgaacucaagaccagccugggaaacaugauaaaaccucgccucuacaaaaaaaugaaaaaaaaaaaaacauuagcugggcauaguggcgcaugccuguaguccuagcuacuugggaggcugagguggaaggacugcuugaaccugggagguggaaguugcaguaagcugagauugggccacuacacuccaaccugggugacagaguaagacccuaucucgaaaaaaacaaaacacaaaaauaaaaccaaauacaaaccauuguuuuaaggugagguuuuaugcuguuuuccagcaccauaaagcugaugagguaaaaugauggcugguacuuuguagggcaguugagcagacucaccguaagauaauccguugccuaaacuccagagcuguagucugcaucugaaguuugguccuacgaacaaccacguagaucaaccaggacuuccaggccugucgcaucuuuugcuuugcaucuagauucaccaaagagauuuuucaaaaggcauggggagagauggauuacucuggguuaugauaaaagcucaagggcucuccuuugaauaccuaaaucccuccagccuacaagugaccccugcuggaaaaguugugaagcacuagaaaauuaauuagagugcaagaacacaugaaggcucugugcaaguaacgacauuuacaaagcauuuaaaggaaaacccauguacugaacugcucaaaaacccuuugcuuuaaaagcgcuuauuucuauagauauacucugcaauuuuuagacgaaaugauaugaauaaacaggcagcaaagaaguggagagauggaucuaacaaaaauggcaugagugauaaucaaagcuggguaauggauacauggagguucauuauucuauuaaauaucuuucagucugggcacaguggcucacgccuguaaucccagcacuuuggaaggccgagaugggcagaucaccugaggucaggaguucgagaccaaccugaccaacguggugaaaccccaucucuacuaaaaguacaaaaauuagccaggugugguggcgugcgccuguagucccagcuacucaggaggcugaggcaggagaauugcuaaaccugggagggagagguugcagugagcugagaucacgccauugcacucuagccugggcgacagagcaagacuccgucucaaaaaaaaaaaaaagaaaagaaaaaaaaauuucaauuguauagauauuuaaaguuuuccauaauacaaagcuaaagaagaagaaaucaugauauaaaacuugcuguuugacuccaagcucacucuuuuuaguaaagaaaagauaauuuacuagauauggaagaugcaauggcccacaggucucccuuugugguaaauuguauuuucauuaugaaagucaccacuaauaaguaaauuaccacuuauaagcaaauuucucuucuuuuuagaagacaaaggagaaaauaaaauuauauaaaucauuuuuaggacagccuccaagauguagucgacaggacuauaacuauauauuucacaguuguugacaagacaaaucaacauacgaaggagaauuuaacauguaucuuccuugguuucacuguggaccucaggaaucagcauacuucagguaaucaggacuaguauagugcugugguuuagaguuugggauccugaguaagacaagccagacuuacuggcccuuucauuuauuacacaccuaaucucauacaaguuccucaucuguaaaauggugccucucucagaguuauguuuggaaaguguaaaugagaugauuuaacuaugaaaaauaucuaaaauaaacacuaacugcucuuuccagaguauggaacacaggaaucucauuaacugucucugccaugauucugaugcacgugacaacugagaaccaugcuuccuuaaggccuaaaaguacuugcaaacuuuucauuuaacaguccaagagugaauggacacucccugaggucuaggggaauggccugaaauaacuugucuuaugucagaaauaacucuugccucuugaguagcugggacugcaggcaugcaccaccacaccuggcuaauuuuuguauuuuuuuguagagaugagguuuugccauguugcuugggcuggucucgaacuccugggcccaagcaaucuucccaccucagccucccaaagugcugggauuauaggcgugagccaccgccuauaaaaaagucauccaagugacuuuuuccuucuauuccauaauaucuagcuagauucacuguaacuauaaauaagacagcagaauguacauucuucaaguaaauauagaacauuuacaagauagagcauauuuggggccacagaacaaaccuuaacaaaaauaaaggaacugaaaucauacuaagucuuguucucugacaauaauagaauaaacuagaaauccuuaacagaaagauauugggaaacucccaaauauuagaaaacuaaacacacuucuaaauaaucuguggggcaaagaugaggucucagggaaaaucagaaaacaaguuuuuacugaaugaaaacagaaauauaacuuauuaaaauucguguaauauaguuaguguuuaagagaacuuuauagcaguaaaugucucuacuaaaaauacaaaaaaaaaauuagccgggcgugguggcagguaccuuuacucccagcuacucaguagucugaggcaagauaauugcuugaacccaggaggcagaggcugcagugagccgagaucacgccacucugcacuccauccugggugacaaagugaggcuccaucugaaaaaaaaaaaaaaaggcugggcgcaguggcucaagccuguaaucccagcacuuugggaggccgaggugggcggaucacgaggucaggagaucaagaccauccuggcuaacacugugaaaucccgucucuauuaaaaauacaaaaaauuagccgggcgggguggugggcaccuguagucccagcuaauugggaggcugagguaggagaauggcgugaauccgggagguggagcuugcggugagccgagaucgugccacugcacuccagccugggcaauagagcgagacuccaucucaaaauuuaaaaaaaagaaaaaagaaaaagaaauaauaaauuaacuuagcaaggaugcaggauauacaagauccauauguaaaacuacagaauguuuaggagaaaacauaagaggaaaucuuugugacccuggguuaaggcaaaguucuuagagaugacaucuaagauaggauaugaaaaaauauaauccagcugggcacaguggcucaugacuguaaucccagggcuuugggaagccgaagugggagaacugcuugaggccaggaguuucagaccagccugggcaacaaagcaagacccccaucucuguaaaauauaaaaaacuuagccagguaugguggggcauugucuguagucccagcuacuugggaggcugaggucagagccuaggaguuccaggcugcaauggguuauccucacaccacugcacuccaaccugggcaacagugggacucucgcaaaaaaaaaaaaaaaaaaaaaaaaaaaaaacauaauccauuaaaaaaaaauagaauggacuucaucaaaauuaaaaacuuuuccucugcaaaagauacuguuaagagaaugaaaagacaagucacagacuaggagaaaacauagcaaaucaugcuuugacaaaaugcuuauaacagaauacauauuuuaaaaaaccagcugggcuugguggcucaccccuguggucccagcacuuugggaggccgaggcagguggauccccugaggucaggaguuccagaucacccuggcuaacauggugaaacccugucucuacugaaaaaaaaaaaaaaaaaaaaaauacaaaaauuagcugggcaugguagcgcaccauguagucccagcuacucgggaggcuaaggugggagaaucacuuaaacccgggaggucgagguugcagugagccgagauugcgccacugcacuccagccugggcaagagugagauuccgugucaaaaaaaaccaaaccaaccaaacaaacaaaaaacuuucaaaucucaaaaagaacacaaacaacccaauuuaaaaggacaaaagaucaugaacagauacuucaccaaacagauauaaauagcaaauaagcacaggaaaagauacucaacaucacuaauuaucagagaaaugcaaacuaaaaccacaaugagauaucaucuuacacuagucagaacgacuguuauuaaaaaguuaggcugggugcaguggcuuaugcuuguaauccuagcacuuuuggaggcugaggaaggagaaucacuggagcccagggguccaagaccagcuugggcaacauagccagacccugucuccauaacauauaaaaaguuagccaggugugguagcacaugccuacggucccagcuacucaggagucugaggugggaggauuacuuggcccaggaagucaaggcugcagugagcuaugaccaagccacugcacuccagccugggugacacagcaagacauccccugucuuuaaaaaaaaaaaguuuaauaacagauguuggcaugcacguggagaaagggaacacuuaacacacugguggugggaauauaaauuaguugaaccucuauggaaaacaguauggagauuucucaaagaacuaaaaacagaaccaccauucgacccagcaaucccacuagcgggaaucuacccaaacgaagagaaauuauuauauuaaaaagacaccugcucucauauguucacugcagcacuauucucaacagcaaagucauggaaucaaccucagcauccaucaacagauacagaaaauauacaccacagccgggcgugguggcucaugccugcaaucucaguacuuugggaggccgaggcaggcagaucacugaggucaggaguuugagaccagccuggccaauauagugaaaccuugucucuacuaaaaauacaaaaauuaguugggcaugguggcacacgccuguagucccagguacuugagaggcugaggcagaagcaacacuugaacccaggagguggaggcugcagugagccgagaucacaccacugcacuccagccugggugacagagugagacagucucaaauaaaaaaaaaagaaagaaaauacacaccauggaauaccacccagccauaaaaaagaaugaaaucauguccuuugcaccaacauggauggagcuggaggccauuauccuaagugaacuaacucagaaacagaaaaucaaauaccacauauucucacuuauaagcgggagcuaaacuguugguacacacagacauaaagguggagauaauagacacuggggacuccaaacgaggggaagggaggguggaagaggcccaaggguugaaaaauuaccuaucauguacaacguucacuauuuggguaguggacagucaaaucuccaucauuaugcaguauacucauguaacaccaauuuuuaaaaacccacaauuaaaugccuguauacaccuauuaguauggccaaagaaaaaauuuuaaugacaauacaaagaggucaagaggaugcagagcaaguagaacucucgugaauuacuggugggaaugcaaaauggcacagccaugauaaaaaaccuugccaguuucuuauagaauuaaacuuaaggccaggcacaguggcucacaccuguauugccagcacuuugggagagcgaggcagguggauugcuuuaguccaggaguuugaaaccagccugggcaacauggcaaaagcccaucucuaccaaaaauacaaaaauuuagcuguaugugguaguguguaucaaagucuuagaacugaacuucaaaaagaaugaaucuuacuguauguauuaaaaaaauaaacaacaaacagcguaaguuacuuaccagugaaacagugcauuuggugcaguaaucaugaggcuuggguaagagcuucucauacuuugggaauacagacaggggaaagaucacugggcugggggagaucaaggaaagcuacacauuuaaaugggccugaaggaagaacuacagggacaaagauggaaagauaaagaagugcacauccagugugucaagggcagagggugcaaagcagaagaaaugaagaccuuguacgacauaccaagcaggguuaacuuuacguaaaggagugucaugaucuuaucuaugucuuaccacucuugcagcuauguguacaaugagaagcacgaaaaaauaaaugagggagauuaaugaaguggcacuuacaacacucugggaaaaagaugaggauuacucucaggcaguagcaaugcaacgaugauugcaagugaugccucagagggccuucuuaaaagauuagguaagugaugacaugaggcaugaggaauggacaccauuccuaaguaagucuuccuagacagaagagucaaaggaacagcagguguaagugguaggggaguugacagguuguacuugugacuugcagaguuugagcuaccuuuaggacauucugcugcuaaugcagccuguauuaucauuuugaaacucuaggucuuuuucccuuagacucuccauguguuucugggcucaauucacaagagaaaccagacucugaccagaccuaaaguggccacaguaucacuaagggacaacuugagcaaagcagaucagaaaagagcacugcagcucugcuccagagucucugggcaacuugacgcagcaagauagauggcagccccaggugccacaggagagucacagccagcccacugaaccagcaggccaggaacagccaguucacacaaauucugauuaaaugaguuuuaagggcucaaaccaugccauauggagaaaaccauagggaucaaucauacaggugcccacucagagaucacacuuucugaaaaauaugaaagagaaucaaacaaaucuuccuuuggccuagaguuccucucucucugagacaauguguuuguccuuccuaugaccuucugcaaaguaaaugugggcaucuucuucagacauggacuucuuuuucucaccaugaaccucggcucuaauguacuuguuccucaucuccugcugcugacgcacauaggucuuccacgucuggaacaucagguuguacagguaauaccugaggagccaaaaaaaguaaauggcauuucuucaaaauaacaggccgggcgcgguggcucacaccuguaacccuagcacuuugggaggccaaggcaaggaguucaagaccagccuggccgauauggugaaaccccaucucaacuaaaaauaccgugugccgggugugguggcacacgucuauaaucccaccuacuccggaggcugaggcaggagaaucacuugaacccaggagguggagguugcagugagccgagaucgcaugccacugcacuccagccuggacaacagagcaagacucugucucaagaaacaaacaaacaaacaaacaacaacaacaaaacaacuccuaacccaacacaccaagucuguucuauacucagaagaaaugaacagggacgcuucugauuaaaaaaaaaaaaaagccauaucugcaccaaagcuaaaauuucauuuccuacaaucacaaugaacucuauucucuuugaagaagagucauucucuauaccuuaaagugucacugaggaagaaaaggcuugacuucuccaagaauaaguucacuuucaucauccacaaauucaugauguuugggccaggcacaguagcucacgccuguaaucucagcacucugggaggcugaggcaggcagaccaccugagguugggaguucgagaccagccuggucaauauggugaaaccccgucuuuacuaaaaauauaaaaauuagccacucguaguagcaugugccuguagucucagcuacucaggaggcugaggcaggagggaggcugaggcaggagaauggcuugaaccugggaggcagugguugcagugagccaagauuguuccacugcacuccagcccgggugacaccgagacucugucucaaauucaauuaaaaaaaaaaaaauccaugauguuuggaaugacaaucuugucuuuuuuuuuuuuuuuuuuuuuuuuuuuacacagggucucacucugucaccuaggcuggaguacaguaaugugaacauggcucacuguagccuugagcccucccugggcucagguacuccucccaccuuggccucagaguagcugggacuacaggaacgcaccaccacuccuggcuaauuuuuguauuuuuuuguagagggggauuuugccauguucccuaggcuggucucgaacuccugggcucaagugauccucuugcccuggccucccaaagugcuaggauuacaggugugagcuaccaugccuggccgacagucacauccuaauuaucuuaacuauccacacuguaaaaaacaucacuucucguuugcacuacaauaugcucauugacaccuuuuccuucuucuugauacauacacuauacaucuuaagaccuucaucucuucauauuuuccuaguuuuaaauauuuuauuaacauucauuuaaaaaagaauuuuuuuuuuuuugagacagagucucacucugucguccagacuggagugcaguggcaugaucuuggcccacugcaaccuccgacuccuggguucaagcaauucuucugccucagccucccgaguggcugggacuacaggcacaugccaccaugcccagcuaauuuuuuuuuuuuuuuuggagacggagucuugcuuuguugcccaggcuggaguacaguggugcgaucucgacucacugcagucuccgccuccuggguucaauuaauuuuccugucucaaccuuccgaguagcugguacuacaggcgcaugccgccaugcccggcuaauuuuuuuuuuuuuguauuuuaguugagaugggguuucucuguguuguacaggcuggaauuuuuguuuuguuuuguuuuguuuuuuaauagagacaagguuucaccaauguuggccaggcuggucuggaacuccuaacgucaagugauccacccgccucagccucccaaaguacugggauuauaggagugagccaccacacucggccuuccccauauauuuucucccauaaucaauguaaauuaaaacaauuuauuuauuuacuuauuuucugagauggagucucgcuccacuguugcccaggcuggagugcaguggcgcagucuuggcucacugcaagcuccaccuccuggguucacgccauucuccugccucagccucccgaguagcuggaacuacaggcgccugccaccacgccuagccaauuuuguuuuuuguauuuuuuaguagagacgggguuucaccauguuagccaggauggucucgaucuccugaccucgugauccgcccaucucggccucccaaagugcugggauuacaggcaugagccaccaugcccggccacaauuuauuauuuuuaaaacaaggccggguguggugguucaugccuguaaucccagcacuuugggaggccaagguggcaggaucaccugaggucaggagauugagaccagacugaccaacauggagaaaccucaucauuacacgccauuacaggcgugguggcacaugccuguaaucccagcuacuagggaggcucaggcaggagaaucacuugaacccaggcggcggagguugcagugagucaagauggcgccauugcacuccagccugggcaacaagagcgaaauuccaucucaaaaacaaaaaaaaacaaaaaaaacaggccuggcgcggugacucaugccuguaaucccagcacuucgggaggccaaggcaggcggaucaccugaagucaggaguucaagaccagcccagccaacaugaaauaacccugucucuacuaaaacuacaaaaauuagccaggcgugauggcacaugccuguaaucccaauuacuugggagacugaggcaguagaaucgcuugaaccuaggagacggaaguugcagugagccaagaucgugccacugcacuccagcuugggcaacagagugagacucugucucaaaacaaaacaaaacaaacaaacaaacaaaaaacccagaauacuuucagaaugagaaauuauauagaaaugaaaaucggugggaaaaucccauucaaaguauuagcauaaccaauacauaaugguuaccugaauuagaggugugggaggugugugugugugucugugugcacgugcccagcaugugcaugcaugcuuggguuuaauuuggaacucugaucuugcuaacuccaaaaaggauuugaagaaaaaccaaaagugacccaaaguuugcuucuuuugaccauaaacacgccaacaaauaaucaucugauaaugugcaucaguaaaacugaaggaguguaacaugaaaccugaccuguagugacagucagcucgaacacagaguuuccacucgugcuggaaaacccaccacuccucuuuccauucuucgaagaccuuccguaguaaucgcugcucauaguaaaaucuacggcaaaaaaaaaaucauauauauauaugaugauguuggagcuaacaucucuucccaaaucacauauucuugccgucucaugaaaaaguacagccgggcgugguggcucacaccuguaaucccagcacuuugggaggcugaggcggguggaucacaaggucaggagaucgagaccauccuggcuaacauggugaaaccccgucucuacuaaaaaaaaaaaaaaaaaaaaguaaacaucggucgggcgcagugccucacaccuguaaucccaguacuuugggaggccaaggcggguggaucacaaggucaagagauccuggccaacauggugaaaccgcaucucuacuaaaaaugcaaaaauuaccugggcaugguggcacgcaccuguagucccagcuacucaggaggcugaggcaggagaauugcuugaacccgggaggcagagguugcagugagcugagacugcaccacugcacuccagccugaugacagagcaagacucccucucaaagaaaaaaaagaaaaaguaaacaccaagauagauuaaaaauagaggccaggcaugguggcucaugccuguaauaccaacacuuucagaggucaagguaggaggacugcaugaggccaggaguucaagaccaaccugggcaacauagcaagacuccaucuagggcuggaugugguggcuuaugccuguaaugccagcaccuugggaggcugagguaguuggacugcuggaguucaggaccagguugggugacaugguggaacccaaucucuacaaaaaauaaaaaauuagccaggcauagcgggggcaugcucuuguagucccagcuaccugggaggcugaggugggaggaucgcuugagcccaggagggagagguuccagugaacugagauugcaccacuguacuccagccugggcgaaagaguaagagccugucucaaauacauuaaaaaaaaaaaaaaaaaaaaaaaagcuggacacgguggcucacaccugcaaucccagcacuuugggaggccgaggcagguggaucacaaggucaggaguucgagaccagccuggccagcauaguaaaacccgaucucuacuaaaaauacaaaaauuagccaggcaugguggugcacgccaguagucccagcuacuugggaggcugagacaggagaaucgcuugaaccagggggcagagguuguggugagccgagaucgagccacugcacuccaacaugggcaacaaagugagacuucgucucaaaauaaaauaaaauuaaauuaaauuaaauuaaauuaaauuaaauuaaauuaaaaacuccaucucuacccaaaaaauaagaaaaaaaaaugugugacaaugucuuacuguauuacccaagcuguucucaaacccuugggcucaaguaauccucaccugagccucccaaaaugcugggauuacagacaugagccacuguacccagcucuacaaauuuuuuuuuucuuuuuuuuuugagacggaguuuugcucuuguugcccagguuggagagcaauggugugaucucgguucaucgcaaccucugccucccggcuucaagcgauuucccugacucagccuccugaguagcgggauuacaggcaugugccaucacgcccagcuaauuuuguaauuuuaguagagaugggguuucuccauguuggucaggcuggucucaaacuccugaccucaggugaucugccugccucggccucccaaaaugcugggauuauaugccugaaucaccacauccagcccccccuaaauuuuuuuaguuagccaaguauggaggcacgcaccuguggugucagcuauuccagaggcuuacgugggaggaucgcuugagccccagaggucaaggcuguagugagccgugaaugugucacugcacucuggucugugcaacagagcaagaccuugucucuuaaacaaucaaaaaaacuuaaaaagagggaaaauagauauauuuggcuuuuucaggucagaaucucagagcuacuuaaacuagaaaugagguuaaaaauuuuuuaauauugauuuuaccgauuaaagauguuaaaguaaaauaaaaaucugacuuuuuuuuggagacagggucucgcucuguugcccaggcuggaaugcagugguacagucauggcucacugcagccuuaacaucccaggcucaagugauccuuccaccucagccucccaaauagcugugacuacagacaugcuccacuacuaugccuggcuaauuuuuuauuuuuuguagaggcacgguuucacuauguuacccuagcuagucuugaacuccugagcucaggugauccuccucccuuggucucccaaaaucugacuuuucaaacaccaugaagugaauugaaaauuauuauuuuuaauuuuuuucauucaccagaaugaaaaauauuuuuauuacuaaaaaguaguaaugucuuauuuacaaacauaggaaauuaaacuuauaaaauaaguaaaugccuaauaauauuccuaguacuuaacaggaacacaggauauuaauuuagcugaaaucugaagaggggagucauaacaacagcaaaagaugaguaagagaaauuagucaggaaaaagguaauaaggaacacagaaaagcagugacagauggugcugauuuuuuaaaaauuuuuuugagacagucuugcuauaucacccaagcuggagugcaguggcaugaucucugcucacuguaaucuccaccucaugcauucaaguuauucucgugccucagucucuugaguagcugugacuccaggcacacgccacccaaacgagcuaauuuuuuguauuucaguagagacggguuuucgccauguugcccaugcuggucuugcacuccugagcucagacaaucugcugaccuuggccucccaaagugcugggauuacaagcaugagccaccacacuggccugucaaucacuuuaaauuucuuuucaugguucugcagguuacuaacaugucacuccuccuaacccacucauaguuuuuuuucuuuuuuuuuuuuuuuugagauggagucucgcuuugucgcccaggcuggagugcaguggcgcgaucuuggcucacugcaagcuccgccuccuagguucaaaggauucuccugccucagccuccagaguagcugggacuacaggcgugugccaccaugcccagcuaauuuuuguacuuuuaguaaagaugggguuuugccacgauggccaggcuggucucgaacuccugagcucgggugguccacuggccucagccucccaaagugcugggauuauaggcaugagccaccaugcucaauuccacucacgguuuuuaaaaacuagcuuacaaagacauacauaagguaauucaccucacuauugcuuauaauaauaauaagagaagagugaaccaccacaaauacccaucaaaagaggacagguuaauacaauuaaucaaugccaugugcucauuuucuaugaaugaagcagagcuaaggguacugaagggacagaugccucagaaagugauuaggugaaaaaauaaagucacugcgugguauguauaauaugguaucuuuuuaaaaaaauuaggucacgccuguaaucccagcacuuugggaggccaaggcggguggaucaugaggucaggagaucgagaccauccuggcuaacacggugaaaccccaucucuauuaaaaaugcaaaaaauuagccaggugugguggcgggcaccuguagucccaacuacucaggaggcugaggcaggagaauggcgugaaccugggaggcggagcuugcagugagccgagaugcgccacugcacuccagccugggagacagagugagacuccgucucaaaaaaaaaaaaaagaaaaaaaaaauuaagucaggcacaguggcucacacguguaaucccagcacuuugggaggccaaggugggcagaucccuugagcucaggaguuugagaccagccuggccaacguggcgaaaccccaucucuaccaaaaauacaaaaauuagcugggcguuguggugcaugccuguagucccagcuacuugggaggcugaggcacaagaauugcuugaacccaggagguggagguuggagugagcugagaucaggccacugcacuccagccuggaugauauagugagacucugucucaaagaaugaauaaauaaauaaauaaauaauaguauuuauauauauauuuuugagacagaguuucccucuugucguccagucuagagugcaauggcacgaucucaguucacugcaaccuccgccucccggguucaagcgguucuccuuccuaagccucccauguagcugggauuacagacauacaccaccaugcccagcuaauuuuuguauuuuuaguagagaugggguuucaccauguuggccaggcugggcuugaacuccugaccucaggugauccgccugccguggccucccaaagugcugggauuacagguaugugccaccaugcccggccuauuuuuauguauuuauagcacccauauguuggaauacaucaaauauacacacacacacacauuuguguacauauaaacaagcauguguguaugcauacauaaaugauuacaucauacacauuaaaagccugaaaagacuccagaauaucaaacuaaugccagugguucucucucggggggugggggagagauuauaggagacuggcuccuaaacuguacauuucuuuuuuuuuuuuuuuuuuuaaagacggggucucacucugucacccaggcuggagugcaguggugugaucucggcucacugcaagcuccgccucccagguucacgccagucuccuuccucagccuccggaguagcugggacuacagguacccaccaccaugcccagcuaauuuuuguauuuuuaguagagacgggguuucaccauguuagccaggauggucuugaucuccugaccucgugauccgcccaccucggccucccaaagugcugggauuacaggcgugagccacuaugcccagccuaaacuguacauuucuauaauauuugaaagacuguugaacagauuuauucacaauucuuuuuuuuuuuuuuuuuuuugagauggagucuuguucuguuaccuaggcuggagugcaguggcaccaccucggcucacugcaaccucugccuccugaguucaagcaauucuccugccucagccuccugaguaacuggaauuacaggcacaccuggcuaauuuuuguauuuuuaguacaaacgggguuucacuauguuggccaggcuggucuugaacucuugaccuugugauccacuuccacggccucccaaagugcugggauuacaggcgcaagcaaccacgccuggccuacaauucuaaaaaauuguaauaaaaaggaaccguuugcacauggugaaaugaacauaaccauuuaccuccuuccauuccccacgccgcauuaaauaacagcaaauguauucaaaaagguguaagccuaaaaagaccaagagaauaggagaaagggugacagacaagagccgucaacaaauuuuagucaauuuuaggcaagagaguggcagaugaaucaccagauaaaggagagaacuaagugucuucuuguagggggagaagggagacaagaagcacccagcugguggcacaggccccagaaagggguggaaaugagacgcaucaggaggcgaggagcuguggacugagaugaaaacacaggacuguuugcaagccuaugugucagaagugguuaggccccuggaucccauuauucacucauauucacucaagcaaagacucagguauaucuccggagaggcgagccagaggagaacuggacuccagaauacuaggcaaagcuugggagaugguccuagaccaaaagucuacaaacugaacaaugacacccaccaucccuuucccugcuugcagccaagcuuauaauuaacaccuucagcuggaugcagugucaugucuauaaucccagcacuuugggaggccaagguggguggaucacuugagggcaguccgagaccggccuggccaacauggcgagacccccaucucuacuaaaaauacaaaaauuagccaggcgugguggcgcaugccuauggucucagcuacuugggaggcugaagcaggcaacucgcaugaaccugagagguggcgguugcagugagccgagaucaugccauugcacuccagccuggguaacagaguaaaacucuguuuaaaaaaaaaaaaaaaauguaggcugggcgcgguggcucacgccuguaaucccagcacuuugggaggucaagguggguggaucacaaggucaggaguucaauaccagccuggccaagagggugaaaccccgucuuuacuaguaacacaaaaaucagccaggcaugguggugggcaccugugaucucagcuacucaggaggcugaggcagaagaauugcuugaaccugggagguggagguuacagugagucaauugcgccacugcacucuagccugggugacagaguaagacucugucucaaaaauaaaauaaaauaaaaauaaauaaauaaauaaaauaaaauaaaauauaaauaaauaacaaauuaaaaaauuaaaaaauuaccaccuucaucucaaucccacccccccaccccgugccagaaggaguuagaggguaucucuuuugucuggggaaaacugaucaaccuaaggggaaaggccuucagagacacagacagcuagauucccuggugaaaucugccccaaaagccuacagugaagccuucaaguuauaagucuucaugcuuacauauaaaagcuucuggcugggugugguggcucacaccuguaaucccagcacuuugggaggccgagguaaggcagaucaccugaagucaggaguuugagaccagccugaccaacguggugaaaccccaucucuacuaaaaauucaaaaaguagccaggcgugguggugcaugccuguaaucccagcuacucuggaggcugaggcaggagaaucacuugaacccaggaggcagagguugcagugggcugagauuaugccauugcacucuagccuaggcaagagugagacccugucucaaaaaaaaaaggcuucuaaaauaagcuuuuuaggguccugcucuuaaauauaaacagacaauaaagaaucucuugacauuugaggaaaggcuccaacaugacagagugaccaaaaauacaaagaaaaaaggaucuuagaagaaacacaguguaagcagauaaaaaucuuaaaccacauuauccucaaaaaauuuugagccuccaggauacuauuaaaaagaaaggaaacaugcagagaacaaaagaagcuuuuggaaauuaaaaagggaacaugcagagaacaagaacaagcucucggaaauuaaaaauaugacagcagaaaugaaaaacaaacucaauaggugacacaaaaaguugguuggucuuauagaccacaguaaggacucugggcuuuuacuuucagcaggaagccacuggaaguuugacagaaugaugugacuugauuuacucagacuaccuccugagaagauacugacuaggggcaagacaggaagcaggagaccaaugaggggccauuggagucacucgggggagagaugcugauggcuuggacugggugguagcuacuggaggucugaaaaguggcuggauucugaaugcauuuugaagguugaagcaacaugauuuuggcauauggcauuuuaaauuggggugugaaagaacaagaggugugaaggaugacuucaccauuucugaccugagcacuuggaaggauggaguuuccacucacugagagggggaggaugacgauuucaguuucgggcauacuauggugugacacccaguggaguugucacguacguaaaaguccagaguuucaaggcagaggucuuggcugggcauacacaucugagaaucacugugagauuuaaugagauuuugguugugaggcagcuagagaagcagugcaaagacuagguguugggauauucagaugaggaagaaucaacaaaggagaguuagaaggggcagucaaacagguaggagaaaaaacacaagaggaugguaacuagaaccugggagaagaaagguauucuagaagaaggaaaugauggacucucuaaugcuaccugguaggucaaguuaaagaaaguuuaggaauucaucauugauuuuagcaaauguagugacuuuaacaaaaacaggagaaauucaucauuugaaacacaguagaggcugcagcagucagggacauuucugaagugaggaucuuugaugccuaggugcuacccaagccauauaugaagcuaccuuaauaugugaguugugccauucacagcaaaguaguuagaaaucaaucucaugaaggcugcuaggacugaauacccacaccuccauuucgaccugcaggcguugccccaugacucccacuaaaacccguuaagaaacuguguccuuaaggacugaagaaaaauuauucuccagagaaaaauaaaauggaaauuguacuuaaaaaaaaaaaaaaaagguuaaggcugggugcaguggcccaugccuguaaucccagcacuuugggaggcugagguggguggaucaucugagguuaggaguucgagaccaacauggugaaaccccgucucuacuaaaaauacaaaaaauagccggccaugguggcgcaugccuguggucccagcuacuuggcaggcugaggcaggagaauugcuugaacccgggaagcgaaaguugcagugagccaagaucgcgucacugcacuccagccugggcaacaagagugaaacucggucucaaaaacaaacaaacaaacaaaaaacaaagcuaaaacauuaucuaagcacauaaaggcauuauucuguaguuugugguaugauauuauucccgccuaacacuccuaaaauugagaaauaaauaacucaguauggaaaaagccuaaaaacaaagaucaggaugcccaauguucccccaaguaacaaagaaccuacuugauuuuaacagauugauauuugauauugauauauagauauuagaaaauaacuaucccuucacaaauuucuaagucaauggaaacacaguaucagaauucuaauucugguagcugcuuagaaaacaaauauucucacucuaucauuuuguaauuugcaaaacugaggccuacaggcguaacuauccucagaucaaacaauuagcuagggccuggguuagaaccgaagcucaggucuccuuaauucuaguccaguauucuuuccucuacacccgccuaccacugaagagcgaagacaugaaaaacagcauaaugcgaauguuuuaaagcaauguagcagguuagcuagcagucacuggcuaacccaacacccacugccaagcccuuuuucucguaaguauccacuacagaggccagaaagauuucuuuccaaaccuccucuguagcuaaagguggccggugacaaagcucuggccaaugaggcagaagcagaaugcaguggggaacuuccagggaaguuuucuuuccugauaaagagaucaaacugacgccacccuuacccccaccuuccuguguaaagcuagaauagucaucuugcaacuacgaaguguuaccuaugaggacaaagggccaaugugcuaaggauguugaacuagaaagguacuagaagccugagucuaaaacgacaucacugaacagcugaagcaauaccaguaacugccaaucuccagguggcuuguuaaaaaaaaagaaguaaauccccucaugccuguaauccuaacacuuugggaggcagagcagggaggaucgcuugagugcaggaguucaagaccagccuggaaaacauagugagacccugucucuaaagguaaaaaaaaaguuaauuuuaaaaaaaaaaacaaaaaacagaaaaaacaaaucucaauuuguuucagccauuguuaggcuuucucuuagagucaauguacuucuaacauacaaucagcauuucccaaggacuuggaaggcauuauuugaaaagagguucccagucaaauaugggucaaauauagauaaauaaaauugaguaaaaaauagauuuuagggccgggcaugguggcauaugccuguaaucccagcauuuugggaggccaaggcagguggaucacuugaggucaggaguuugagaccacucuggccaacagggugaaaccccgucucuacuaaaaacacaaaaaauuagcagagcaugguggcgugcaccuuuaaucccagcuacucaggaggcggaggcaggagaauugcuugagcccagaagguggcgguugcagugagccaagaucgugccaccgcacuccagccugggcaacaagagcaaaacuucgucucaaaaaauaaauaaauaaauaaaacggauuuuaggaaaauaguggagguagcaacacaguuuucaaucuuuggauccccgaguagcaucugaggaaccuaacaacaggagaacccuaaaauagccaaugagcuguuguuggaagguacagaggcccaauuuaagaccagcagcugaaacuaugaguuuuauccucuccagcacgagggcucacauaagaacugaaacagcuagagcaguccagccccuagggaaucucaaaacucaucugccaggguacccuucuaggacagggcuucauauggaggagaaacagccacggguagaaaaaaauuugagcaggagagggucaaaagagacaaggaaaaagaaaauccagaccaagugugguaagggaacaaaaccaggauaccccauuaaaaaagccacuauauuuuugaacccuaaacaaaaacaacagaagaaggaguucuaugaaauuaguaaaacuuaaccgaaccuugacucacucuaaaaguucaguauaauaaggcaggugugguggcuugugccuacagucucagcuacuugggaggcagaggcagaaggauuaauugagcccaugaguucaaggcugcagugagcuaugaucacaccacugcagggcaauacagcgagaccucgucucuaaaaaauauauaaagacauauaaauuuaaaaacuaaaauucaggaaaacuaauuucacauaaaaauaagcaauaaaauuagccgggcaugguggugcacgucuguaaucccagccacuugggaggcugaggcagaggcaggagaggcaguagaauugcuugaaucuaggaggcagagguugcagugagccaagaucgcgccacugcacuccagccugggcaacagagcgagacucugucucagcaaaaagaaaaaaaagaaaaaacaaaaaaaaggucaggcgcgguggcucaugccuguaauccaaacacuuugggagguugagggcgggcggaucacaaggucaggaguucgagaccagccugaucaacauggugaaaugcugucucuacuaaaaauacaaaaacuagcugggugugguagcacgcaucuguaaucccagcuauuugggaggcuuaggcaggagaaucgcuugaacccggaaggcagagguuacagugagccgagaucgcgucauugcacuccagccugggcaacggagcaagcaacacuaugucucaaaaaaaaaaaaaaaaaagcaauaaaaaagcauuugaggccgggcaccguggcucaugccuguaaucccggcacuuugggaggcugaguugggcagaucaccugaggucaggaguucaagacuagccuggccaacaaggugaaacccugucucuacuaaaaauaaaaaaguuagcuggguguggugccuguagucccagcuauguggaaggcugagguagaagaauugcuugaacucaggaggcggagguugcacugagcugagaucauggcacugcacuccagccugggcaacagggugagaugcggucucaggaaaaaaaaaaaaaagcauuugaaguuauaugaggaaagaagauaaggagcagaauaacacauauauaaacacaaguaugccagaagauuuguccacaaaaaagaaaaaaaaaaaccuuguuuacaaucucaaaaugagauaaaagauuauaagaaaauaaauuccaagcuucugaaaacuaagacaagcaaugaaucuucaaaagagcaaaaauuagacuaacagcuuagaaauggaagccauaggacagugauggaauaucuuugaggugcugggaaaaaaccagcagcccagacuuucauacccagugaaaauauccuuccaaggugaagauggaauuagacaaaauaugagagaauuucucacuagcagaccuacccgaaagagaauacccugggacguucugauaggagaaggaaaauuaucacagauagaaaccuggagaugugagaagaaagaaaaaaggcaacagaaaggguaaauauuuguuguaauguuagggcaaaaaaagaaaaacaaaugaaaaaggaaggguaaguaggguaaauaugugaauaaaucuaaauaaauauuggcuauauaaaaugagaauaauaggcugggcacaguggcucaggccuguaaucccagcacuuugggaggccgagguggguagaucaccugagaucaggaguucaagaccagccuggccaacaugguaaaaccuugugccacugcacugcagccugagcgacagagcgagacucugucucaaaaaauaaaauaaaauaaaaugagaguaauaaugcuuuauagauuuaaaaauauacacaaagagagggagaugggcagagcuaaaguauucuaaggacucugucuuaucuaggaagaggguaaagaaccaauuaacauuagauucugguaaguuacaaauauacauuuguauuugaaugaaaauacacauucacauuuguaacuuaucuggacagucaguaaaggaagaguaaaacagaauauaacuucuaagcuaacaguggagaauagaauaugcaauaaauuaaacaaaaaagagagaauucugacaauagcaauuuagaucaauucucccaaugaacaacaaaaaaagcagagcaaaaaaauuuauuuaaggcacugaagagcuaccaaggcagugaaggaugacaugcccaagauucagaagaagguaaaauagaggugaacaaugccuagcacuugcagcugggacaggcuacagcugaaaacaagggaguaacaugaucagcucagcugcccugcuugcuuuuggucgcugcuuguuucuuuuuuuuuuuguuucuuuuucuuugaagcugaaggccacaccacugaacgcuacaacuuuuuugagacagauucucuguugcucaggcuggaguacagucacaugaucucggcucacugcaaccucggccucccggguucaaacaauucuccugcuucagccucccuaguagcuggaauuacaggcaccugccaccaugccuggcuaauuucuuuguauuuucaguagagacaaaguuucaccauguuggccagguugguuucaaacuccugaccucaaguaauccgccugucuuggccucccaaagugcuaggauuacaggcaggagccaccacgcccggcccgaacacuaaaacuuaaccuucauuggcuacuuuguagauaacauucauaggucaccauggcaauggucacuucaguuauucuucaggaaaccugggcuagcuccuguacaguucaaacugauagagaccaccaacccuucaacugggccugugaaggagcccgagagggacuuuugaugccugagggccaaaaacuccacccuuggaucauguuaacgccucuauuuucuguacacguguccuaugacaugccaugaacccugacuacacuugugugcaaugaauguuacugcauuuuccccacugccaaucaccuuuccccacaccuuaaaccaccccaauucccuaacccacaaauaucccuaaggcuuaucuuuggggaggccgguuugagaccuguucuccuaccuccucgcucaguggccuugcaaguaaguuuuuucucuuuugcaaaaccugugucacagugauugauuuaccacacaugggcagaauggaccuagaccuggccaguaacauagccacaucaggagcuucacuguaaacauacaaaaaggaagagauggaacagcagggccccucauaaaguauacaaagaaaagauuucagaaaacacacacaggccaaguuggcuugagagacauugaaugaaggagucagacugucaaaaaaugaaacaggaaagauuacaguaagggaaagaaaaggggaagaggggagcaggagggaacccaagacauuucaguuuuuaagaagugcuuacauucucaaaggcugccaauucuccuuuggaaacauaccucgcacuggucccuucucuccagcuccccugccuucuguauggugucccugacuccugugacucucucuugcaguccacucuuagcacugcagcuaaagcaauuauaacccaaaaccacagcaaugggcagcacuggucuauacaaaaugaagcuaugacagaggaauuugcuccucacuaaaauuucauuuccuuugccaaagccaauuuuuucccccagguucugcacuugaucaagccaaucugucagucucaccagugcccugaaagagcucaauuacuucucuugggcaaacacuuuucccagagagaucuuaucuauccugauuuacuuaaguaugauucuuuuuuauucuuauuuuuauucauuuauuuuuuuuuugagauggaguuucacucuguugcccagccuggagugcaauggcgcgaucucggcucaccaccaccuaugccuccaggguucaagugguucuccugccucagccucccgaguagcugggauuauaggcauaugccaccaugcucagcuaauuuuuuuuuuuuuuuuuugagagggacuuucgcucuuguugccgaggcuggagugcaacugugcaaucuuggcucaucgcaaccuccgccuccaggguucaagcaauucuccugccucagccucccaaguagcugggauuacaggcaugcgccaccacguccggcuaauuuuguauuuuuaguagagacgggguuucuccauguuggucaggcuggucucaaacucccgaugucaggugacccgcccaccuuggccucccaaagugcugggauuacaggcaugagccaccaugccuggcugcucggcuaauuuuuguagagacgggguuucaccagguuggccaggcuggucucgaacuccuaaccucagaugauucacccgccucggccucccaaagugcuggguuuacaggcgugagccacggcgcccugccugauucuuucauuuggucacuugcuuguuauuuuuuuuucuuucuuuuucuuugaagcugaaggccacaguagcuagcuaaaggccacaccacugaacacuaaaacuuaaccuuuacuggcuacuuuguagauaacauucacagcucaccaugaaugcagcugcagucaacuaacagauaugaaguuaccacuguauuacaugguuauauuagggacugcuucuaccuacuggaggcuggggaggaauguaacagcacaagccauaaugaaguuuauauacaggcuuaauauaaaagaaaacccuagaaugaacucaacacaauuauguuguucugagcuaauacuaccuggcuuuagagggaaauacucuuccaaaagucauucgaauccauaaauauaagaacuuucuggccacgcaucugaaagaaggaaaaaaagcauauacauauuuuaaaauuccauuuggcuuacaucagcaguuuucuggaaaggaaaggaagccuuuaaggucucagcagagggauguuaguaugaaucaaaaggcgguaucauagcuaauuuugcaucauacagggcauaggauggggcagauuuauaaagcuaaaaucaagcagauuauuuuuaaaaaauauuuucaacauaaauugucagugaagagauuaaaaacuucaaaaaugagguacaggaaguacauaauaauucuuuuguucauauuauucuuccugccuaaaauggccggcaaaugccugaaccuucuccaauguaaacagagugaguagcuguguacucucagcacucuguucaaaccccuccuguaauguuaugacaccauaucacagagaucagcucacagggugucugucauucccucugcacugugagccccugaaagcagaaauuggugcuuuauaguaccuccaguaccuagcacagugucugguauacacacaaagguggcuugucuuuuuuuuuuuuuuuuuuuuuuuugagacagaguuuugcucugucgcccagguuagaguacaguggcccaaugucugcucacugcaagcuccgccuccuggguucacaccauucuccugccucagccucccgaguagcugggaccacaggcacccgccacugcaccuggcuaauuuuuugcauuuuuaguagagaccagguuucaccauguuagccaggauggucucgaucuccugaccucaugauccacccgccucggccucccaaagugcugggauuacaggugugagccaccgcgcccggccuugucuuuuuuuuuuuuuuuuuuuuuuuuuuuuuuuugagauggagucucacucugucgcccaggcuggagugcaguggugugaucucggcucacugcaaccuccaccuccuggguucacgccauucuccugccucagcuuccagagaguaucugcgacuacaggcaccugccaccacgcccaguuaauuuuuuguauuuuuaguagagacgggguuucacuguguuagccaggauggucucgaucuccugaccucgugauccacccgccucggccucccaaagugcugggauuacaggcgugagccaccauacccggccaaagguggcuugucuuauagaguuaaaccuugagcucaacuuaaaacacaccuucuccugcccuuuaucuggcuuauucuuacauuauccuucagggcugagcuuaaacuccacuuccuccagagaguaacugcuggcuauacuaguguggcuguucucgccguauuugccugugguaccacauccuucuccucucauugcacuaaucucacuuuauuguuguggcuuaagagucuaucaagccuaccugauuuuaaacucucauuaagucauaaaccaagaugaucuuacucacuuuauaugcucagcaucuagcguaacaccuggcauggguaagcaccagauaaaucuguuguuguuguucugagacagagucucacucucgcccaggcuggagggcaguggagcaauuucagcucacugcaaccucggccucccagguucaagcgauucucgugccuuagccucccaaguagcugggauuacaggcaugugccaccacacccagcuaauuuuuuguauuuuuaguggagacggggucucaaacuccugaccucaggugauccaccugccucggccucccaaagugcugggauuacaggugugagccaccguaccugaccugauaaauuuuugaaugaagaaacagaugucucuaauauaucuaaucgagaguagcagaaguguuacagcucuucuagaauucaccagaaaaucuggggggaaaaaaagaauagcaaaaaagaguaguuccuucuuucuuggaccacguuuagacuuuuucuggaagaaucuugauagcgucauauugugaggcacaaguggagaaaugaaaacacucaaugacagauuuuaugucugcagguuccugaauauccuuuucaucugaacauucuacuaccaagaacaggcaucaagaucucccacuaauugcgguggaagaauaagaaucauucccccauuuuaaccaagaaaggagaacaaaagcaaaguacccauagacugguggccacucauaagcucaccugaugcgcaguucucuuaaccggcccugucggguacaaguaugugugccacgauacugcacuagaugacugguacuagguaacucccuccggaucccaaaggaugcagaagacuucuuguuggacagugucuuugcagaauaagguuucuuaacugcaccauccuuaaaauaccuuaaauuugaggacgaaagaggcaaggagagaauaaaguuaucucugcaugugaugcaaauacuuuuaauauacaagcaaaauuaaacagauaagcucauugagacugacaauaccuaugcugcaaggauaauaagcagcccaaucugacagaaauauuggccaaccacuagagguggguacugcugggucagcucuaggcaggaacuacagagcuggagggcacccccuggagucauuaggccuaacacaguuuucuuuuguuugagacagguucuuacuccguugcccaggcuggauugcuguggcaugaccacagcucacugcagccucgaccucccaggcucaagugauccucccaucucagccucccaagcaacuaggcaacuaggaccacaggugcucgccacuguguccugauaauuuuuuuuuuuaagagaugaggucucacuguguugcccaggcuggucuugaacuccugggcucaaggaauccuccuaccacauccuccugaguagcugacacuacaggcaugcaccaccaugaccagcuaacuuuuuauuuuuauuauuuuuuugagauaaggucuuacucuguugcccaggcuggagugcaguggcgcgaucucagcucguuuaaccuccgccucccggguucaagcaauucuccugccucagccucccuaguagcugggacuacaggcacccacuaccgugcccagcuaaguuuuguauuuuuauuagagacgggguuucaccauguuggccaggcuggucuugaacuccugaccucagguuauccacccaccucggccucccaaagugcugggauuacaggcuugagccacuguucccggccaauuuuuuauuuuuauuuuuuuagagacagggucucacuauauugcccaggcuagucucaaauuccugggcucaaguaauccucuugccucaaccccccaaagggguggcauuacagacauguaccacuguacccggccugaucucauucuugaucucuugcuucagaauaucugcacugaggguaaagcacacguauguacacacaaacacacacacaaaguuuaauauacuuuuuaaaaaauuuuauuguauuguuuucuugaaauagggucuugcuauguugccuaggcuggucuugaacuccugggauuaagcaauccucccaacuaagccuuccaaaaugcuggcauuacaggugugagcuaccacaaucagucucuuagauuuuguuuuuuaagaacaauucgaaguuuacugcaaaauugugaagaacgaacagacuguucccacauaccccuuuuucuuuacacacacacagcuguauaugcuaaaaugaauauguuuaaagaaaugaaagucaagagugaacauauuugcagggcacgggguaacuauaaaaaguaagguagaagcauuaaucacaacagccaaaagguagaagcaaucuaauuuuuuuuuuaaagacagguucucagccagguacaguggcucaugccuguaaucccagcacuuugagaggccgaggcgggagggucaccugaggucaggaguuugagaccagccuggccaacauggcgaaaucccgucucuauuaaaaauacaaaagucagccggaugugguggcgggugccuguaaucucagcuacuugggaggcugaggcaggagaaucgcuugaacccgggaggcggagguugcggugagccaugccauugcacuccauccagccugggcgacaggacaggacaagacaggacaggaagaaagaaaaaaauaaaauucccugauaguuccaacguagguauugauggccaggcacgguagcucaagccuguaauuccagcauuuugagaggcugaggcaggcggaucaccugagguuaggaauuugagaccagcuuggacaacauggugaaaccccgucucuacuaaaaauacaaaauacaaaaauuagccgggugugguggcacacgccuguagucccagcuacucaggaggcuggggcacgagaaucacuugaacccagggggcagaggcugcagugaacugaaugcacuccagccugggcgacaaagugacacucuugucucaacaacaacaacaaaacauagguauugauaugguuuagcugugcccccacccaaaucgcaucugcaauuguagcucccauaauccccacgugucaugggagggaccucauggaaggugauuagauuauggugguaguucccccaugcuguucucaugauagugaguaaguuuccacgagaucugaugguuuuauauggggcuuucccccacuucacccugcacuuucuuuccugccgccaugugaaaaaggacguguuugcuuccccuuccaccaugauuguaaguuucuugaggccucucuagaaaugcagaacuaugagucaauuaaaccuccuuccuuuauaaauuacuuaucucagauauuucuucauagcagcaugagaaugcucuaauacagguaucauauuugaguaugguacuguucagugcuuugcuucuauaagauuaucuaguacuacucccaaaaaauaaaacuuaaaucuaauuaagucucuaaauccaguuaccaauuugcagaaaaagguugagaacagaggacagaagaacaugcuaaaaugcacacaggcccuauaaaaauaccagugacauucuucacauaaauaggaaaaacaucuuaaaaauuguauaggaccacaaaagaucccaaauagccaaagugauccucagcaaaaagaacaaagcuggaggcaucacaccaccagacuucaaaauaaaccacaaagcuguaguaaccaaaacagcaugguacuggcauaaaaacagacacauaggccaauggaacagaacagagaguaucaaguuauuaagcuacuuuaucuaucuaucuaucuaucuaucuaucuaucuaucuaucuaucuaucuaugaaugacagagucucauucuguugccccacuggaauacagugaugcaaucacggcucacugcauccuugaccucccagauucaggugaucuucccaccucagccuccugaggagcugcaacuacaaguacaugcuaccaccuggcuaauuuuuuguagagaugggguuuugccacaugcgcaggauggucuugaacucccaggcucaagugauccgccuguccuggugucccaaagugcugagacuacaggugugacccaucgcacccagugccaauuuauuuuugacaaaggcuccaagaacauuggggaaaggacacccuccuuaauaaauggugcugggaaaagugaguaucuacaugcagaaaaaugaaacuagacuccccaccucucacccuauacaaauaucaacucaaaauggaucaaagaccuaaauguaagauccaaaacuagaaagcuacgagaagaaauacuucaaacgucuaggaaaagauuuuaugaauaaaacaucaaaagcacaggcaacaaaagcaaaaguaaacaaaaugggauaaucucaaaaacuucugcucagcaaaggaaacaaucaacagaguaaaaagacaaccuauagaaugagauuacaggcugggcgugguggcucaugccuguaaucccagcaguuucggaggccaaggcagucagaucacuugaggucaggaguucaagaccagccuggccaacauggugaaaccccaucucuacuaaaaauacaaaauuagcugggcgugguggcaugcaccuguaaucccaguuacucgggaggcugaggcaggagaaucgcuugaaccugggagguggugguugcagugagccaaauuuguaccacugcacuccugacugggugacagaguaagacuccauaaaaaaaaaugggauuacaaauauuauaaaaaauaugugcaaacuaucugacagaggauuaauaugcagaauauacaaagaacucaaacaucucaacagcaaaaaaaaaaaaaaaaauccaauuaaaaaaggggcaacuuugggaagcugagacaggcagauggcuucgguccaggaauuuaacaccagccugggcaacacggcaaaauccugucucuacaaaaaauuggccaagcaugguggugugugcuuguagucccagcuacuccggaggcugaucugagaggauagcuugagccugggaggcagagguugcagugagcugagaucccaccacuguacuccagccugggugacagagugagacccugucucaaaaaaaaaaaagugaggggagcaaauucucugaauagacauuucucaaaagaagacauacaaauggcuaacacauauacgaagaaaugcucaacaucacuaucaggaaaaugcaaaugaaaaccacaaugaggugucaucuuacuuguuaggugacuguugucaaaaagaccaaaaaacauaacaaaugcuggcaaggaagcagagaaaagggaacacuuuuuauuuuuauuuuuuuugagauggaaucucacucugucgcccaggcuggagugcaauggcgccaucucggcucacugcaaccuccgccuccuggguucaagcaauucuucugccucagucucccaaguaggugggacuacaggugcacgccaccaagcccggcuaauuuuuguauuauuaguagacacaggguuucaccauauuggccaggcuagucucgaaucccugaccuggagugcaauggcacaaucucaaaaaaaaaaaaaaaaaaaguaguccuugccauggugugcuauuguugcaacuuagguuuaauacaaaaaucacuugcuuaaucuacaaggaacacuuauaauugccaauuaaagaguagaauaguagaaauauaucaagauuuggaguaaaaaaaaacacccugauuccacagauuugaaguuuauggcaaaucacuugauuuuuuccuacccucaguauccuccccuguagauggagauaauauuguuugggguugugggaaucaaaggagauaauggacuucacagauuugaaguuuauggcaaaucacuugauuuuuccuacccucaguauccuccccuguaaauggaaauaacauugcuugggguugugggaaucaaaagagauaacggacuucacacucuaaagacaaacuguuuacuauucagauaccugaauuucuaaggugugaugauagacuggcuuauucuucaggcucaacuucauaaaauaaauuuauggaaccacaauacauauauuuaauuguguuaacuuggaaauuaaaacuggauuuuuuccuccugauuugggaaagugguuucuaauuucuaaaacauaacaucaucaguuuauacauuuacacugaaggugggugagacucuggccaaauacuggucauuuguaaauggcccuccuuaacaagacaaucuguacaggaaauuacauuauaaaaagaaaauaucauuguauuuacuggcaguagaaggaaugugaaggagaaaauaauuaucuauuacuacaaugagauauguauccuauggccugaauuuucugcuuuaaaaauauuuauuuucuuauuauaaaagcaauacagcauauguccacagaaaaacuuguacacaauguucacagcagcauaauucacaauagccaaaagguggaaacaacccagauguucauaaacugauaauggauuuaaaaaauggcguacaguucacaauggaauauuauagagcuauaaaaaggaauaaggccgggugcuguggcucacaccuguaaucccagcacuuugggagucccaggcggguggaucacaaggucaaaagaucaagaccauccuggccaacauggugaaaccccgucucuacuaaaaauacaaaaauuagcugggcaugguggcacacgccuguaguccuagcuacuugggaggcugaggcaagagaaucgcuuaaacacgggaggcagagguugcagugagcugacaucacaccacugcacuccagccuggugacagagcgagacuccaucucaaaagaaaaaaaggaauaaaauucugauacagaaaccuugaaaacacuaugcuaacugaaauaagccagacacaaauggaaaaaugucguaugauuccacuuacaugagguaccuagaacaagcaaauucuuagaaacagaaaaguauaauaaagguuauaaaggguuaggguaggaggaaugaggagauaccauuuaaugaauacagaauuuccacaugggaugaugaaaaguuuuggguauggauaguggugaugguuacacauugucaauguacuuaaugguacuaaauuguacacuuaaaaacaguuaaaauaggccaggcgugguggcucacgcauguaauccuaccacuuugggaggcugaggcagguggaucaggaguucgagagcagccuggccaacauggugaaacacugucucuaccaaaaauacaaaaauuaucugggcaugguggcacgcgccuguaaucccagcuaccugggaggcugaggcgggagaacagcuugaacccgugagguggagguugcagugagcagagauugugccacugcacucgagccugggcgacagagcaaaaguccaucucaaaaaaaaaaaaaaaaaaaaaggccagguguaguggcucacacuuguaauccuagcacuuugggaggccaaggcagguggaucccucgaggccaggaggucaagaccagucuggccaacaugaugaaaccccgucucuacuaaaaauacaaaaaguuagccaagcauggugacgcaugccugcagacccagcuacuugggaggcugaagcacaagcagcacuugaaccuaggagguggagguuacagugagccaagaucacgccacugcccuccagccugggcaacacagugagacugucucaaaaaaaaagaaaaaaaaagguuaaaauaaaauaguaaguuuuuuguuauguauacguuaccacacacacacaaaacauaaacucucugggcaguuucaaucaccgugccaugaagcaguaggugguaggaucucacugugugucugacuagcccuuucucugccuuguuugagcuuugacagaauuugcaaggguggcguuaaggcugagcaggacacuggaaaggccagaacaaaggugguuguuucccgcucacagagagccuccuuacaguuccgggugggccauauucauagacagacaccucaaauguaggacgaccagucauggauguguaggggcgugacugccacugugaacagugcagccauccuuggauaccucacugcagagauacuugaagugacaucaaaggcaccaaaagauuuaaagguaaagcuauuaccccucaucauuugcaaccugcuauuagugaagaagaagaauuggacucucucaucaaggcuacaauugcuggugauggugucauuccacacauucgcaagucucugauugggaagaaagaacaacagaagacuauguaaaggaugccuguauuucuuauuaucucaggucucuaauuaaucuaacagcucuaacaguguuggugauuccaggggaauacaggcaugccccaugacaccuggcuaauuuuuaaaaauuuuuuuaguaaagacaaggucucacuauguugcccaggcuggucuugaacucuacuuuuuuuuuuuuuuuuuuuuuuuugagacagggucuggcucuguugcccaggcuggaaugcaguggaacaaucacaaauuacacagccuuagucucccaggcucacgugauccucccacuuuagacuccugagcagcugguacuacaggcaagcacuaccacaccuggcuauuuuuuuuuuuuuuuuacuuuuuguagagacggggucuuacuauguugcucaggcuggucucgaacuccuggacucaaggaauccucccaccucaaccucccaaaguucugggauuauaagugccugagccaccaugcccaaauggaaguaguggauuuugauugagaugacuauuuuuuuagauacucccuggauuuuaauuaugaugcagaaguuauaucaacaaacauuugguuuuguacauauauuacuuucccucuggcaauagaagucauaccccaaacuaaaacaaaaaacaaaaaaccaacccuccgugaguauuagaaaagccauugaauugcacacuugaaaugaaugaauuguguaguaugugaauuauaucucaaugaauuuuaaaaauaaaaaagcaauauagaaccauuuuaggaaaucugaaaaauguugguaacuauaaugaaaacaaugaaaguagcuuauaauccugcucaaaaaacccacaagcaaagcuaaacuauacaguguuuaaggauacacaguuggguaauaaaaccgugaagaaaagugagaaaguaauuaccauucaagucaagcuaguaguuuacucucugaggggcagucaguggguuuggaaggaaguucagaaaugacugccaaggucuuaucuuuuuuuuuuuuuuuuuaaacagguggugauuacaaaggugucugccauauaauaauucgcuagggcacccacuuguuucaugccguuuucuguauuuguguuauauuuaucaguaaauaauuuuuggccaggcacgguggcucaugccuguaaucccagcacuuugggaggcugaggcggguggaucacuugagcccaggaguucaagaccacccugggcaacaggugaaaccccaucucuaccaaaaauacaaaaauuagccagugucauaacccagucucaaaauuaauuaauuaaaaguuuaaaauaaaaaaacuuuuggccaggcagugacucaugccuaucaucccagcacuacaggaggccaagguggguggauugcuuaaggcuaggaguugagaucagcugggcaacacagagagaccccaucucuacaaaaaauuaaaaaauuaggccgggugcaguggcucacggcuguaaucccagcacuuuggaaagccaaggcggguggaucaccugaagucaggaguuggagaccagccuggccaacauggugaaacccugucucuacuaaaaauacaaaaaauuagcugggcgugguggcacacgccuguaaucccagcuacucggggggcugaggcaggagaauugcuugaacccacgaggcagauguugcagugagccaagaucaugccacugcacuccagccugggcgggagagcaagacugugucucggaaaaaaaaaaaaaaauuagccagaugugaugaugcaugccucuacucccagcuacaugggagacugacauaggaagaucacuugaacccaggaguucaaggcugcagugagcuaugaucaugccacugcacaccagccugagcgacagagcaagacccuguaucaaaaaaaaaaaaaaauggaaaauaaaagaaaaaaugauagaugcauaguucgcugguuuucagucuuaauuccuuuauaauacaugcauuuaaugcuauacauuaaaugcauuaaacccaucauacauuccucuaagcaugacuguaguuguauuucauauauugauauguaguauuuuuaugagcauuacaacguauuugcuaacuuccauuacgauuuuuucuucaaucuuuaugcaaaaggaugcaaagcaaaucaacaaagggaagaggggcacagggcauagucuggaagaaaucaagcgcaagcuuccaagaauccucucccagcggaaucacaaaggacacucuuaauuccuccggcaaugaauugugauaacacgugagaaguguuguguaucaaugaagcuuauuagagacucaguacccaaguuuuuacugagggcuggucagacagguacccucugccuaacacauaccaaaauuccagacuccuagagggagugcuaguauucagcauaaacaacauugcaugaacacacaacaguguagguccaguuaacuauucaucaguuagggaauggugggaacccuucugaaaucuaaguuuccagacaccagccaagggucagccuuguaagcaguuauuuucuaagaacagcagccacaaagggacgacaaacauaacagagaagaucaaagagaaaagcugguuccuuaaaaagacuaauacaguugacagccagugaaacugaccaggaagagagaaaaccaaauaaaugagggucaacucuauauuucuauaaacuagcaauaaggaaaaaauaguuauauauauuuauauacuauuuucaaauggcaucacaaauaucaaauauaggaguaaaucuaauaauuuuauaggcaaaauggagaacucaguacaauacagaugucaguuuuucccacucugaucuauagauucaaaguaaucucaauuaaaaccacaauagagggcugggcacaguggcuuacacuuguaaacccaguacuuuggaaggccaaggcgggcagaucaccuugacugaggacaggaguucaagaccaccagccuggccaacauggugaaaugccaucucuacuaaaaauacaaaaaacagccaggcgugguggugggugccuguaaucccagcuacucugggggcugaggcaggagaauggcuugaaccugggaggcaggcauugcagugcgccaagauugugccacuccugcugggcgacagaggaagacugucuuaaaaaacaaacaaacaaaaaaaccaacaacaauagauucuauuuuggggagggagaggacuucacaaguugauucugaagcuuucauagaauuacaaaagaccaagaauagcuuagacauucuuaaaaguacuagauaagcagucuuacuuagauaucaggcuuaucgcaaggcuacauauucaagacaucacgauuuuguauagcagaaacaaauugaccgaaggaacaagguacauagccaagagacagacuuggccuuaauggacacuugaguaaugauuaaaauggcacuauagagcaguuuuuucaauaaacugugcuaggacaauuacauacccaugugaaaaaaaaagaaauagggucccuaacucacaugaucaacaaaagucaauuucaggaggucuggacaauaaaauguaaacagcaaaauaaugaguucuuaaagaugauacagaauaucuuaggccaggcaugguggcccgcaccuguaaucccagcacuuugggaggccaaggcaggcgaauugcuugagccgaagaguuugacaccagcuugggcagugcgaugaaagcccaucucuacaaaaaauacaaaaauucgcugggugugguggcacaugccuguagugccaucuauuugggaggcugagaugggaggacuccucaagccugggagguugaggcugcagugacccugauugugccacugcaauccagccagugugacagugcgagacccugucuccaaaaaacaaaaaccagaauaucuucaugacaucagggaagaaauagauuccuuaaaccugagagaacacauauuaauuauaaaggaaaagacacaaauuuuacuaaguuaaauuuuuuuuucuuuuuuuuuugagacagagucucacucugucacccaggcuggaguauaguggcaccaucucggcucacugcaaccucugccuccuggguucaagugauucucccgcuucagccucccaaguagcugggauuauaggcaugcgacaccacaucuggcugauuuuauuuuuauuuauuuguuuguuuauuugagacugaguuucgcucuuguugcccaggcuggagugcaauggcgcaaucucggcucacugcaaccuccgccucccagguucaagcgauucucucaccucagccucccgaguagcugggauuacaggcaugugccaccaugcccggcaaauuuuguauuuuuaguagagacgggguuucuccauguuggucaggcuggucucgaacucccgaccucaggugauccgcccaccucagccucccgaagugcugggauuacaggcaugaaccaccacuccuggccugacuuuuuaauuuuuaguagagaugggguuucgccauguuggccaggcuggucuugaacuccugaccucaaaugaucugccugcguuggccuuccaaagugcugggauuacagggguugagccacugugccuggcuuucuuuuuuuuuucuuucuuucuuuuugagaguuucacucuguugcccaggcuggagugcaggggugccaucucagcucacuguaacccccaccucacagguucaagcaauucuccugccucagccccccaaguagcugggacuacaggcacacaccacaauacccagcuaauuuuuguauuauuaguagagacgggguuuugccauguuggucaggcuugucucuaacuccugaccucaagugauccacccuccuuggccucucaaagugcuagaauuccagacguaagccacggcacccggcuuaaaauuuaaaacaucuuaauucaucaaaugaugaagagagcagagggagaagauauuuaucacacauaaaacauacaaaagauucauauucaaaaacagaaaaccuccuauauauuaauuaguacaaauacucaauauacaacucaugagaaaaacaggaauaagacuugaauauguacuucaaaaagagaaaauccagauacccaauaaacacauaaaaagguacuaagccccagcacuuugggaggccaaggcagguggaucacgaguucaagaccagccuggccaacauggugaaacuccgucucuacuaauaauacaaaaauuagccagacaugguggugcgugacuguaguuccagcuacuugggaggcugaggcaggagaauugcuugaacccaggggaugcagguugcagugagccgagaucacgccacugcacuccagccugggcaacagagggagacgccaucucaaaaaaagaaaaaaaaaaaaaagguacuaagccacaacaggaauucaggaaaugaaaauaggaaucacaaugaggcuggcacauggcucaugccuauaaucccaguacuuugggagggugaggcaggaggaucacuugagcucuggaguucaagaccagcgugggcaaccaagcaagacccugucuacacacacacacacacacacacacagagccaggcacagugaugcauauuuguagucccagcuacuugggaggcugaggaaggaggauugcaugagcugggaggcugaggaaggaggauugcaugagcuggcaggucgacgcugcagugagccaugaucaugccacuguacuccagccuggguaaaagaaugagauccugucccaaaaaaaagaaaaagaaaaaagaaacacacacacacacacacacacgaacaaugagacauaccuaccagauuaguauaguguugguaagucaaugaacauguucauacacugccagcaagaguauaaacugguucaaacaauucagaaaaucauuaucuagcaaaauugaagauucccauaaucuuugguccacaaucuauucugagguggauaccauagaacagugguuaucaaagugugauaccaaagccaacagcauaaccaucacuugggaacuuacuagaaauacagaugguuagcccggcacaguggcucacaccuguaaucccagcacuuugagaggcugaggugggcaaucaugaggucaagagauugagaccauccuggccaacauggugaaacccugucucuacuaaaaauacaaaaauuagcugggcaugguggcacacgccuguagucccaacuacucaagaggcugaggcagaagaaucgcuugaauccgggagguagagguugcagugagcugagauugugccacugcacuccagccuggcgacagagugagacuccgucucaaaaaaaaaaaaaaaggaagaaauucugucguuuucgacaacaugaauuucggaaauggagaacauuauauuaagugaaauacuccaaacacacaaagacaaauaugaccuguucucacuuauauguggaaucuaaaauaauugaaugcauagaaacagagaggagaauggugguuaccaaaggcuaggaguagggagaauugggaagaugguaaucaaaggacacaaagccucaguuaaauaggagaaauacaguugauuuuuuuuuuuuuuuuuuuuuuuugagacagagucucacucugucgcccaggcuggaguguaguggagcaaucuuggcucacugcaagcuccaccuccuagguccacgccauucuccugccucagccucccaaguagcugggacuacaggcgcccgccaccacgcccagcuaauuuuuuuuuguauuuuuaguagagacaggguuucaccauguuagccaggauggucucaaucuccugaccucaugauccgacugccuuggccucccaaagugcugggauuacaggcaugagccaccgcacccggccaguugauuuuuaauaucuauugaacagcauggugacuauagcuaacaauucaguacuacauuuuuuuuuuuuuuuuuuuuuuugagauggaguuucacuccgucacccgggcuggagugcaguggcacaaucuccaaucucggcucacugcaaccuccaacucccagauucaagugauucuccugccucagcuucccgaguagcuggaauuauaguagcaugccaccaugccagacuaauuuuuguauuuuuagcagagacagggucuugccaugucagccaggcuggucuccaacuccugaccucagguaauccacccgccucagccucugaaagugcugggauuggccgggccaguggcucaugccuguaaucccagcacuuugggaggcugaggugggcggaucacgaggucaggaguuugagaccagccugaucaacauggugaaacccugucucuacuaaaaauucaaaaaaaauuagccaggcaugguggugugcaccuguaaucccagcugcccaggaggcugaggcaggagaaucgcuugaacccaggagacggagguugcagugagcugagaucgcaccacugcacuccagccugggcgacagagcaagacucugucuaaaauaaaacaaaacaaaacaaaacaaaacaaaacgaaaaaccaaagugcugggauugccagcacgagucaccacgcccgaguacuauauauuucaguaucccuaagagaguaaaucucaaaucuucucaucacaaaaaaugucaaggcugggugcagcaucuaacgccuguagucugagcacuuugggaggggcagauugcuugaggccaggaguucaagaccagccuaggcaacguggugaaaccccauuucuacaaaaaauacaaaaauucaccagacaugguggugcauuacugaagucccagcuacuugggggucugaggcaugaagauugcuugaucccaggaggcugaggcugcagugagccaugaucacaccacugcacuccagccugggcaacaaagcgagacccugucucaaaagaaaaaaaaaagucaaauacuugaggugacagauaaguuaaacagcuugauuucaucauuuuacauuguauuaaaaaaucauaacaucagccgggcaugguggcugacgccuguaaucccagucaggagcuugagaccagccuggccaacauggugaaacccuaucuguauuaaaaauacaaaaacuggcugggcgcuguggcucaugccuguaaucccagcacuuugggaggccaaggcaggcggaucacaaggucagaagaucaagaccauccuggcuaacauggugaaacccccucucuacuaaaaauacaaaaaauuagccgggcgugguggcaggcgccuguagucccagguacuugggaggcugaggcaggagaauggcaugaaccugggaggcagagcuugcacugagccgagauugcgccacuaaacuccagccugggcaacagagcuagacuccgucucaaaaaaaaaaaauacaaauauuagcuggguaugguggcgggugccuguaaucccagcuacuugggaggcugaggcaggagaauuguuugaaccccugagguggagguugcagugagccaagauugugccauugcaacuccagccugggcgacagggcgagacuccgucucaaaaaaaaaaauaguaauaauaaauaaauaauaacaucacuuuguauccuauaaauacauacaacuauaauuugucaauauauaaaaaaaggaauuuaaaaacugaaaacaguccaaaugcccaucagcaaaauagauaaacugaaauauucuuaccauguaauuuuuuuuuuuuuuuugagauggaguuucgcuguuauugcccuggcuggagugcaauggcacaaucucagcuuaccgcaaccuccgccucccggguucaagcaauucuucugccucagccuccccaauagcugggauuacagacaugugccaccacacccggcuaauuuuguauuuuuaguagagaugggguuuuaccauauuggucagacuggucucaaacuccuggccucagaugaucugcccgccucggccucccaaaguguggggauuacagugcugggauuacaggcgugagccacugcgccggccaauaaccuauuucuuuaccuguguuaugguuacauuguuuguuucaaaaugauaucuuaaacgauacauuuucccauaccuuucugaaucugcaaauuuaacaccuaaggcuggggcacggugacucacaccuguaaucccagcacuuugggaggccaagacaggcggaucacuugaggccaggaguucaagaccagccagaccaacauggcgaagcuccuucucuacuaauauaaaaaaauuaccugggcgugguggcauguaccuguaaucccaguuacucgggagauuaaggcaggagaaucacugaacccgggaggcagaggcuucagugagccaagaucacgccauugcacuccagccugggcaacagagcaagacucugucucaaacaaacaaacaaaaaacuuaaaggaaauacauucccuucuuagccuccccagccuaaagcagcaggguauuugaagaaaccaggcugaggcaggagaauugcuugaacugggaggcagagguugcagugagcggagaucgcgccaugcacuccaaccugagcgacagagcagaacuccaucucaaaaaaaaaaaaaaaaaaaaaacagaaacuaugccagaguuagaggccacagagcuucauauuaaggccaucguuaauuugcuugagaagaugaaauaaagcaggccuaaagaguacucugcggaccauguaguaaacacugucagggugcugguucagcuuacgaggacuccuucuaugagaacgucuaucaacaggggcaggaucucagcagcuaugcuugaacucaaugaccuuccuccaaguccuaguugauuacacugggggaaaaaacugacccuugcuggaucaaccaaauucauucucccacgaugaaauuuugaagcacaaagauggcucugcucaggaagaaggguccauaauaccugcugaauaggucucaaacaguucucucucccacuuugcccaagacccaguggauucuauaagaaacuucuguauauucauagcacccuaaguugcaagcuacaggaacccaauucaaauuaguuuaagaaaaaaaagagcguaaccauaagggucccucauuaaaacugacaagucuuuaccuagaucaaccaaugagaaaagagagaagacauggaucaccaaaauuagguaugaaagagaggacauuuaccacugacccuucauaaauuaaaaguauuauaagggcauacaauuaacuuuaugccaacaaauuagacaacauaaaugaaauggaaaaauuucuagaaaaacugaaauuaccaaaauuaacucaggaagaaacacagcugggcucaguggcucaugccuguaaucccaguacuuugggaggccgagguaggugggugauuugaggucacgaguucaagacaagccaggccaacaugguaaaaccccaucucuaauaaaaauacaaaaauuagccaggcgugguggcaugcaucuguaaucucagcuacucgggaggcugaggcaggagaauugcuugaaccagggaggcagagguugcagugagcugagaucacaccaccguacuccagucugggugacaagagugagacuccaucucaaaaaacaaacaaaaacaauaaauagaaaccuaauagaucucuaacaaguaaaaaaaauuaaaugaguaauuaaaaauuuuccuacaaagaggccaggcuugguagcucacaccuguaaucccagcacuuugggaggcugaggcagcaagauugccugagcccaggaguuagaaacugcacugagcugugaucgugccacuguacuccagcccaggcaacagagcaagacccugucucuaaaauaaauaauuuuuccuacaaaaaaaagcacagauaguuucagugauuaauucuaccaaagauuuaaaaagaaauaauaggccgagcacuaucgcucaacaccuguaaucccagcacuuuggcaggcagaggugggcagaucaccucaggaauuugagaccagccuggccaacaugauggagaaucgcuugaacugggcaggcagagauugcagugagccgagacuguaccacugcacuccagccugggcaacagagcgagacuccaugucaaaaauaaauaaauaaauaaauaaauaucaaaacaaugcuccauaaacucuuccagaaaauagaggaacacuuccaaauucauugagaccaguaucgccaucauaacaaagacaaagauauuaccaaaaagaaaaauaaaagaccaauagaccucgugacuacagacauaaaaauccucaaaaaauaguagcaaaccaaauccaacaacguauaaaaaccacugugaugguuaauguuaagugucaacuugauugaauugaaggacgcaaaguauuguuucuggguguaucugggcguugccagaagauauuaacauuugagucaguggacuaggagaggaagacccacccacaaugugggugggcaccauccaacggcugccagcaccacuaggaaaagcaggcagaagguaggagaagcugacuagcuaagucuucuagccugcaucuuucucccaugcuggauguuuccugcccucgaacaucagacuccaaguucuuuggcuguuggauucuuggacuuacaccaaugguuuaccaggggcucacaagccuuuggccacagauugaaggcugcacuguuggcuucccuauuuuugagguauugggacuuggacugagccacugcuggcuuccuugcuccucaacuugcagacugccuaucacgggacuucaccuugugauugugugagucaauucuccuuaacaaacucccuuucacauacacauauauccuauuaguucuguuccucuagaggacccugacuaacacaacuauaugccauauaaacaccaugacuaagugggauuuaucccaggaaugcaaggcugauuuaacauucaaaaaucaauuuauguaauacaccuauuaauagaaaaaagagcaaaaaccacaugauuaucucaauaaauguacaaaaaccaugugacaaaauccauuaacauucacgauaaaaccuaugaaaggucacaagaaaauagaugacauacuaaaaauaggauaauuugaagaugguauauuuacaaacuuguggguauagaggaacuacaagaaacagugcaggaaccugaagccaguagaagcuaaggugguacuaccucuaggcccaaagagaugaggggagggaacaauuaccaaaacccagaaagggagaguuauacagaggcugccacguuauaaggugccgagagcuucauuggagagauacagucaacugaagguaaaagucugaaagcaaccaugaucaaaaguagaagacacgagagccagccaaccuggaugauauaacuucaaagcucaggaaaauaauacucacuucugcucagaaucaaauuuuaaugauugauauuuccaugcacuacucagaauguuuuuugacuguaacauaauguacgaaauguguauuaucuuauagaugaaaaauuugaaauaucaaugacaaaaaaaacuuacccacaguuacuaccucacucauaauuuauaauuuuuucauacacaaaauguuuaguuuuauaugaaccaucauuccaguuauauuuuuuucucaagucccaucacucaccuggaaucaaccuucuucuccauucucugcuuaaucacuuuuugauggaaauuguggcuugauauacacuucucagugagcagauucuucaugaaucaaagucuuuuaucuuccccuucuaacuacaagaaaaagagaauaaaaaagagagaaaaugauuugcagccucucaggagccacauuucugaacuauaugccagcuccuagucuccugcucuccuuaauucaacacuagaugaaugugggcuaggucucugacuuaaaauauuauauuuaaauuacuuuuuuuuuuaauuuuuuugagacgaagucuugcucuuucacccaggcuggagugcaguggcacgaucucagcucacugcaaccuccaccuccugggcucaagcgauucuccugccucaaccucucaaguagcugggauuacagguaccugccaccacacccaacuaauuuuuguauuuuucaguagagacaagauuccaccauguuggccaggcuggucucaaacuccugaccucaagugaucugcccaccuuggccucccaaagugcuaaaauuacaguggugagccaccacacccagccucauuguggcuuugauuugcauuucucuaaugaucagugauauugagcuuuuuuucauguuuguucaccauauauaugucuucuuuugaaaagugucuguucauguuguuugcccacuucuuaauggggcuguuuuuaucucauaauguuguaaaugcuagauguuagaccucugucagauggacagagugcaaaaauuuucucccauucuguagguugucuguuuacucugaugauaguuucuuuugcugugcagaagugcuuuaguuuaauuagaaauuaaacuaaauuugucaauuugugauucuguugcaauugcuucuggcaucuucaucaugaaaucuuugccugugccuaugucuugaaugguauugccuagauuuucuuccaggguuuuuauaguuuuggguuuuaaauuuaagucuuuaacccaucuugaguuaguuuuuauauaugguguaaagaagggguccagcuucaauauuugaauauggcuagccaguucucccagcaccuguuauuaaauagggacuccuuuccccauugcugguuuuggucacauuugucaaagaucagaugguuguaggugugcagucuuauuucuggguucucuauucuguuccauuagucuauguuucuguuuuugugccaguaccauucuguuuuuguuacuguaaccucgcaguauaguuugaaguuggguagcaugaugccugcagcuuuguucuuuuugcuuaggauuguccuggcuauucaugcuuuuuuguuccauaugaauuuuaaaguaguuuuuucuaauucugugaagaaugucaaugguaguuaaugguaacagcauugaaucuguaaauugcuuugggcaguauggccauuuucaugauauugauuuuuccuauacaugagcauggaauguuuuuccauuuguuugugucaccucugauuucuuugagcagugguuuguagcucuacuugaagaggucuuucacuucccuuguuagcuguauuccuagguauuuuauuauuuuuguggcaacugugaauaggaauucauucaugauuugguucucugcuugccuguuguugguguacaggaaugucugcaauuuuugcacauugaucuguauccugaggcuuugcugagguugguuaucagcuuaagaagcuuuugggcugagacgaugggguuuucuagauacagaaucaugucaucugcaaaauguuauuuucuaaugaaggaaacugagaggagagcgagccacacucagaaguugugccugguucuuucuucaugucuagaugcuucagcaccuucaacuucccuucacaaaaacaccaguagaggccaagauuucuuauuuuuccucagauuaauuuuuaugguuaucaguguuacuguguguaguuuucauuuucuuucuuuucuuuuuuuuaaagacagaauuucuggccaggcacaguggcucacgccuguaaucccagcccuuugggaggcugagucgggcagaucaccugaagucaggaguucaagaccagccugcccaacaugggaaaacuccaucucuacuaaaaguacaaaaaugagccaggcaugguggugggcaccugcaaucccagcuacucaggaggcugaggcagaagaaucacuugaacccgugaggcagguugcagugaaccgagaucacaccacugcacugcagccugggcaacagagcaagacucugucucagaaaaaaaaaaaaaaaagacaggauuucccucugucacccaggcuggaaugcagcagugcaaucgcagcucacugcagccucgaccuccucaggcucaggugauccucccaccucagccucccaaaguguuacgauuacaggcaugagccaccaugccuggccuuuuuucuuucucacgcugucacccagggucucauguuauuauccaggcugaaguacugcggcaccaucacggcucacugcagccucaaccucccaugcucaagcaguccucucaccauagccucccaaguagcugggaccacagguaugugccaccaugcucagcuuauuuuuuauuauuuguagagacagggucuugcuauauugcucaggcuggucucaaacuccugagcucaacugaucuauccaccuuagccucccaaagugccuuuuuuuguguguagagauagggucucacucugucacucaggcuggagugcagugguguucucauagcugacuguaaucucaaacuccuggccucaagcaauucuccugucucggccucccaaguagcugggacuacagacaggcaccacugcaccuugccuaguuuucauuuuuucuuuuucuuuuucuuuuuuuccgagacagucucgcucuguugcccaggcuggaaugcaguggugcaaucuaggcucacugcaaccuccacuucccggguucaaccgauucuccugcuucagccucccauguagcugggauuacaggaaugcaccaccacaacuggcuacuuuuuguauuuuuaguagagaugggguuuccccauguuggccaggcuggucuuaaacuccugaccuuaaaugaucugcccaccucggccucccaaagugcugggauuauaggcgugagccacugugccugagcccauuuuucauuuucaauuggugauaauuuguaucaaaaauauucauuaggaacugaauaaauuauggcauaguuuuuuaaauuauuauuauuauuacuauuuuucuuuuagugccaggaauagcaguguuguggguugaauuguguuccccaaaaaagauuugcugaaauccucaccccugcuaccugcgaaugugacauuaucugaaaacagggucuuugcagaaguaauuaagauguaaguuaagaugaggucacaugggaguagggugggcccauaauccaacacgauuugugucuuucuuaaaagagaagagauacagggacagauacacauaaagaggagaaugcaaugugaugacagaggcagagacuagagugauguaucuacaagaauugccaaagauugcuggcaacaucagaagcuaagagaaaggcauggaacagauucuccccugagccuucagggagaggaugacaccuugauuucagacuucuagccucuaaaacugugaaagaauaaacuucuauuaguuuuaagccacccgguuugugguacuuuguuacagcagcccuaggaaacuaauacaaguaguaagacagaagaguaagauuuaaguaaaugguggaggcaagcuaacagggugaacacauccuguguugaguaacggugaugcauuuacaaguuguuucauucuaaaagaaugaagucacccuuauaaucaaggucacauauuucaaugacaaucagacaaggaauuagccaguuuauccauacaaaacgaauaauccuuacuuacaucaaaccgauguccuaguuuuucugauacuacacuccaaguaacagaggucaucauaagugauuauuucuauaaauaaaucaaauggaguauucaaauagugauuuuucgugaaauacugcuauaaucaaugugucaccgccuuggguuucugucauaaugauccuguggaauguccuucauggucaaggacucccuucuguuauauacucuauaccagcauucuaccuauuuguacaugucugccuuccccacuaaaauauaaauuccauggaaacaggaaucacaucugaucuucucuccauucuaucuccagccucuaaaacaacgucuguaaccucacagauaaaauacacauauacuggaaaaacuaggacacagguuugcuuucaauaaggacauguaugaauauaaacuugcuuauaaguuggaauauaaugaauauaaugauaaucaaauacaaaacauggccgaggacaguggcgcaugccuguaauccuagaacuuugggaggccgaagcagguggaucaccugaggucaggaggucgccaccagccugacuaacguggugaaacccugucucuacuuaaaaaaaaaaaaaaaaaauuggcaugguggcgaaugccuguaauccgagcuacuugggaggcugaaacaagagaaucacuuguaccuaggaggcggagguugcagugagccaagaucgcaccacuguacuccagccugggcaacaagagcgaaacuccaucucaaaaaaaaaaaaaaaaaaaacaguccaagaaaaacaaaaauuauuagguguugacucccaguuaaacauguagauugaccuucuaagguggcagcaaagaauacaaaggaacgaaccauaagguuaaagagaugacagaagcgauuauaggacaugagggauuuccacagguuuuacaagaaaggaaaaugaaguggccuaacagguuugaggaaaugaaaaacuucagaguggauaccaaaggaaaguggaccacacagaauuccaacccugucagacaggguauucacgccacuucugcugucccgcuuccaaaauucugguagcuagaugguaccucucaggcaggagacuggaaaagucuucucagaaaacaauaaaaacuaacacaucuccagauucugagaccugugccuuacucuccaucaaugaaaaagcagacuugucccuagauuacccuaaagugaagccccugaacucacaaguccugcucagacacaaggagcuuccaacuaauuucucaguuacaccuuuuuuuuuuuuuuuuuuugagacagagucucgcuuuguugcccaggcugcagugcaguggcucaaucucggcucacugcaaacucugccuccuggguucaagcgauucuucugucucagccuccugaguaccaucacaccuggcuaagcuagacuggucuugaauuccugaccucaagugaucugcccgccucagccucccaaagugcugggauuacaggugggacccaccacgcucggccauaaucucucaguuacacuuaaguauaaacagacaauugagaaucauaaaacauuuagaaaagaccuccaacaaauaaaaaagagaccaaaauaaacccaacaaagcacugaugaagugcuaccacccaugaugaaaucuugcuaaaaaauugaaccuggccgggcgcaguggcucacgccuguaaucccacgacuucaggaggccgaggcagguggaucaccuaaggucaggaguucaagaccagccuggacaacauggugaaaccccgucucuaauaaaaauacaaaaauuagccgggcaugguggcaggugccuguaaucccagcuacuugggaggcugaggcaggagaaucgcuugaacccaggagguggaggcugcaggagccgagaucacgccauuacacuccagccugggugacaagcgugaaacuccaucucaaaaaaaaaaaaaaauugaaccugaauaucauccagccucaucuagaacuaaguacaguaaguccucacuuaaugucauugauagguucuuggaaacggcaacuuuaagcaaaaugauguauaaggagaccaauuuuaccauaaaagguaguugauacaaacaagauuuaaguuccuguaacauauuucuggucagaaaacaucaccaaacuucuaaauaaagauccaaacccuuuuaauauuaaacacugaaauaaaugugagcuauacauauauguacagaagauucauaagaacaaguaagauaauuauuuacccacuuauuccaguucagggucaagguuggcuagaguguauccuggcagcucagggcacaaggggggaugccacccuggacaggaagccauucauggcauugcacacucacacacacacucacugacacuaggaucauuuagacaugucaaugaagcuaaugugcuuaucguggggacaugggaggaaaucagagcauccggcaaaaacccacauaggcaugaggaaugugccaacuacagacagacaguggacccauccagaaucaauuuuuucuuaucaauguuauguuuuaacaaaauguugagaguaccacacaaucaaaaauguauagacuauaaucaaaauaacaucuauagauaagguacucugcuacgcauuagugcuaagcacuuuucaugaacuaccuacuuuaauauaacuaccucagcaagugguuaucaacuucauuuuacagcuggagggcucaagguucccagcuaacaaguggcggaacugggacuaguacaggcagaccucagagauacugagaguucagcugcagaccacauaaauaaagccagucacaugaauuuuuugauuucccaguucauauaaaaguuaugucagcugggcacggugacucacgccuguaaucccagcacuuugggaggccgagaugggcggucaugaggucaggagaucgagaccauccuggcuagcacagugaaaccccgucucuacuaaaaauacaaaaaauuagccgggcgugguggcgggcgccuguagucccagcuacucgggaggcugagggaggagaauggcgugaacccaggaggcagaacuugcagugagccaagaucacgccacugcacuccagccugggcaacagagcuacacuccgucucaaaaaaaaaaaaaaguuaugucuacacuuguaguuaagugugcaauagcauugucuaaaaaacuaauguacauaccuuaauuuaaaaauauuuggccgggcacaguggcucacaccuguaaucucagcacuuugggaggccaaggugggugggucacggggucaggaguucgagaccagccuggccaauauggugaaaccccguucuacuaaaaauacaaaaauuagcugguggugguggugggcaccuguaaucccagcuacucaggaggcugaggcaggagaauugcuugaaccugggagacggagguuguagcaagccgagaucacgccauugcauuccagccugggugacagagcaacacucagacucaaaaaaaaaaacaaaaaacaaaaacaaaacaaacacacacacacaaaaacaccacuuuauugggcaggcacaauggcucacgccuguaaucccagcacuuugggaggcccaggcgggagaaucaccugagaucaggaauuugagaccagccuggccaacauggcaaaacccugucucuacuaaaaacacaaaauuagcuggguguaguggcaggugccuguaauuccagcuacucaggaggcugaggcaggagaaucgcuugaacccaggaggcagagguugcagugagccaagaucaugccaaugcauuccaccgugggugaugagaugaaacugucucaaaaauaaaaauaaaaauaaauaaaaacaccuuauugcuaaaaaaugcuaacaauuaucugauucuucagugaguuguaauauuuuugccaguagagggucuugccuccauguuaauagcugcugacugaucaggguagugauugcugaagguuggaauggcuauggcaauuuauuuuuucuuuuuuuuuuuuuuuuuuugagacagagucucacucuguggugcgaucucagcucccggguucaagcgauucuccugccucagccucccaaauaguggggauuacaggugcccgccaccacaacuggcuuuuauauucuuaguagagucaggguuucaccauguuggccaggcuggucuugaacuacugaccucaagugaucgcccaccucagccacccaaagugcuaggauuacaggcaugagccuguaaugcaggauuauacugcauccggcaacuguggcauuuucaauguuuuuuuuuuuuuuuuuuuaagauggagucucacucugucgcccaggcuggagcacagugguugcaaugcucacugcaaccuccgccuccuggguucaagcgauucuccugccucagccucuggaguagcugggacuacaggcgcauaccaccgugccugguaauauuuguauuuuuaguagagacgggguuucaccauguuggccagacuggucucgaacuccugaccucagguaauccgcccgccucagccucccaaagugcuaugacaauuucuuaaaauaagacaauagugaugugugucacaucgauggacucucuuccuuucaucaaagauuucucuauagcauguaaugcuauuuaauagcauuuuacccacaguagaacaucuuucaaauugaagucaauccucuuaaauccuaccacugcuuugucaacuaaguuuauguaauacucuaaauccuuugcugucauuucaacaauguucacagcaucuucaccagguguagauuucaacucaagaaaccacuuucaccaggcacggugauucacaccuguaaucccagcacuuugggaggcugagagauggagaccauccuggcuaacacagugaaacccugucucuacuaaaaauacaaaaaauuagccaggcguggugacacaugccuguaaucccagcuacucgggaggcugaggcagaagaaucacuugaacccgggaggcggagguuguggugagcacuuugggaggccaaggcaggaggacugcuugagaccaggaguucaagaccagccugcucaacuaacaagacccucaucucaaaaaaaaaauuagcgaggcaugguauuacacacccagguacugaggaggcaggaggcuaaggcaggaggaucacuuucgccuagaaguucaagucugcaaugagccaugaucaccacugcacuccagccuggacaacagaacaagacccugucugaaaacaaaaguaaaaacaaagccgggcauguaguggcucaggucuguaaucccagcacuuugggaggccgaagcagguggaucacaugaggucaggaggucaagagugugccaugcacuccagccugggcaauaagagugaaacuccaucucaaaaaaaaaaaaaaagaaaaaaagaagccacuccucauccauccaaguuuuaucaugagguugcagcaauuggucacauuuuuaggcuccccuucuaauuccaguuugcuugauuuuucuaucauaucugcaguuacuuccuccacucgggucuugagucucucaguuauccauggcggccugacucaacuuuuucaaacuccuuuuaaugauuuuuuuuuuuuuuagacggagucuugcucugucgcccaggcuggagugcaguggugcagucuuggcucacugcaaccucugccuccuggguucaagcaauucucaugccucagccuccugaguaacugggauuacaggcgcccaccaccacacccagcuaauuuuuguauuuuuaguagacacaggguuucuucaaguuggccaggcuggaauugauauuuuaaccccuucccacaaaucaugaauguucuuaauggcaccuagaaauccuuuccagaacauuuucaauuuacuuugcccagauccaucagaggaaucacuaccuauggcagcuauggggucacaaaauauauauauauuuuuuugauauggagucucaucacucugucgcccaggcuggagugcaauggcgcaaucuuggcucacugcaagcuccgccucccggguucaagugauucuccugccucagccuccccaguagcugggauuaugggugcccgccaccacauccggcuaauauuuuguauuuuuuaguugagacgggguuucacuauguuggccaggcuggucucaaacuccugaccucgugauccacccgccucggccucccaaagugcugggauuacaggcaugagccaccaugcccagcccacaaaauguauuucuuaaauaaugacuugaaagucaaaauuacuccuugaaccaugggcuauagaaugcauacuguguuagcagacauguaaaguaacauuaaucucuuuguacaucuucaucagaguuccuuggugaccaggugccuuguuaaugaccaguaauaucuugaaaggaauccuuuuuucugaacaguaggucucgauaguaggcuuaaaauauucaguaaaccacacuguaaauaugauguaaagacauucaguaaagagauguguggucauccuggguuuguuguugcauuuacagagcauaggcauuucuagcuucgucauuucuagcuucgucauuucuagcuuuugauauaaagugagagacauggaacucuuccuuucacugaacacuuaggggccacuguggggcuauuaauuggccuaauuucaauauuguugccucucaggcuacaaggaggaccgagagggaggagagaaacagggaacuggcagguaguggagcagucagacacaacacuuaaguuugcugucuuauaccagugagguucguggccaccuaaaacaauugcaauaacaacaucaaagaucacugaucacagaucacuguaacggugcaccugaaauaaaaaguuugaaauauagcgauaguuaccaaaguguaagugacaggaagugggcacaugcuguugaaaaaauaguugcucggugcagggcugcuugcuacaaacuuucaauuuguaaaaaacacgguaucugugaagugcaauaaagcgagguauggcuguacucaagucccucacaucauucauucaacaaauauuuacaacacaucuacacagcaguuaagaaaccugaacagccucccauaaaaacagguacccaccucccacgcggggaaggcuuccagguuuguuuacugcguuacucccugcgggcucagugggaguaaggucgcccauauaccagcccuuccgcuccugggccacggagccgggaggaggaaaccccugauuuggauccgcgcacgcuaaggggcauugcguggacucgagcaccggccaggagcgcacuagacgccugggaggaugcggugcccccagggcggaagacaagaagccgagaagacgcggcgggagaggauggcaggcuccgggccccguccugcgcccucuugucgcacuuccuccauucccgcaccacagacccgcagguagacaacaucaccugcacuuucaggggaggaagcggaggcucggacagauuucaccgggcucggaggaacccgacugagguccuugccgggcucacugccggaaaggccgagcccagaagaggguggggacguuagggccgggccucguaccuggggaagccgagccaucgggccugacguugggagaaaacccggcgguauacggcgauccgggaccugcuucuuaacucccgcgcgguccacgcccgccucagcgcuucgcgcgccucuagacgccagucucgcgcgggcccgcccucgucuccacggcgacgcggcgcgcacgaggaccaccccgcccagaccccggggcuugcgcagccucagucggguagguggcgcacuucggguugcuuugcagcagcagcaaugagaaucgguuucgaggggcguggagcaugcacccucugggcauccccaccgaggguucuuuaucuccuuggcucgccagcuucgcucugagcucagcuugcu

SEQ ID NO: 192204 - RNA, 122274 nt, Homo sapiens
agcaagcugagcucagagcgaagcuggcgagccaaggagauaaagaacccucgguggggaugcccagagggugcaugcuccacgccccucgaaaccgauucucauugcugcugcugcaaagcaacccgaagugcgccaccuacccgacugaggcugcgcaagccccggggucugggcggggugguccucgugcgcgccgcgucgccguggagacgagggcgggcccgcgcgagacuggcgucuagaggcgcgcgaagcgcugaggcgggcguggaccgcgcgggaguuaagaagcaggucccggaucgccguauaccgccggguuuucucccaacgucaggcccgauggcucggcuuccccagguacgaggcccggcccuaacguccccacccucuucugggcucggccuuuccggcagugagcccggcaaggaccucagucggguuccuccgagcccggugaaaucuguccgagccuccgcuuccuccccugaaagugcaggugauguugucuaccugcgggucuguggugcgggaauggaggaagugcgacaagagggcgcaggacggggcccggagccugccauccucucccgccgcgucuucucggcuucuugucuuccgcccugggggcaccgcauccucccaggcgucuagugcgcuccuggccggugcucgaguccacgcaaugccccuuagcgugcgcggauccaaaucagggguuuccuccucccggcuccguggcccaggagcggaagggcugguauaugggcgaccuuacucccacugagcccgcagggaguaacgcaguaaacaaaccuggaagccuuccccgcgugggagguggguaccuguuuuuaugggaggcuguucagguuucuuaacugcuguguagauguguuguaaauauuuguugaaugaaugaugugagggacuugaguacagccauaccucgcuuuauugcacuucacagauaccguguuuuuuacaaauugaaaguuuguagcaagcagcccugcaccgagcaacuauuuuuucaacagcaugugcccacuuccugucacuuacacuuugguaacuaucgcuauauuucaaacuuuuuauuucaggugcaccguuacagugaucugugaucagugaucuuugauguuguuauugcaauuguuuuagguggccacgaaccucacugguauaagacagcaaacuuaaguguugugucugacugcuccacuaccugccaguucccuguuucucuccucccucucgguccuccuuguagccugagaggcaacaauauugaaauuaggccaauuaauagccccacaguggccccuaaguguucagugaaaggaagaguuccaugucucucacuuuauaucaaaagcuagaaaugacgaagcuagaaaugacgaagcuagaaaugccuaugcucuguaaaugcaacaacaaacccaggaugaccacacaucucuuuacugaaugucuuuacaucauauuuacagugugguuuacugaauauuuuaagccuacuaucgagaccuacuguucagaaaaaaggauuccuuucaagauauuacuggucauuaacaaggcaccuggucaccaaggaacucugaugaagauguacaaagagauuaauguuacuuuacaugucugcuaacacaguaugcauucuauagcccaugguucaaggaguaauuuugacuuucaagucauuauuuaagaaauacauuuugugggcugggcaugguggcucaugccuguaaucccagcacuuugggaggccgaggcggguggaucacgaggucaggaguuugagaccagccuggccaacauagugaaaccccgucucaacuaaaaaauacaaaauauuagccggaugugguggcgggcacccauaaucccagcuacuggggaggcugaggcaggagaaucacuugaacccgggaggcggagcuugcagugagccaagauugcgccauugcacuccagccugggcgacagagugaugagacuccauaucaaaaaaauauauauauauuuugugaccccauagcugccauagguagugauuccucugauggaucugggcaaaguaaauugaaaauguucuggaaaggauuucuaggugccauuaagaacauucaugauuugugggaagggguuaaaauaucaauuccagccuggccaacuugaagaaacccugugucuacuaaaaauacaaaaauuagcugggugugguggugggcgccuguaaucccaguuacucaggaggcugaggcaugagaauugcuugaacccaggaggcagagguugcagugagccaagacugcaccacugcacuccagccugggcgacagagcaagacuccgucuaaaaaaaaaaaaaaucauuaaaaggaguuugaaaaaguugagucaggccgccauggauaacugagagacucaagacccgaguggaggaaguaacugcagauaugauagaaaaaucaagcaaacuggaauuagaaggggagccuaaaaaugugaccaauugcugcaaccucaugauaaaacuuggauggaugaggaguggcuucuuuuuuucuuuuuuuuuuuuuuugagauggaguuucacucuuauugcccaggcuggagugcauggcacacucuugaccuccugaccucaugugauccaccugcuucggccucccaaagugcugggauuacagaccugagccacuacaugcccggcuuuguuuuuacuuuuguuuucagacagggucuuguucuguuguccaggcuggagugcaguggugaucauggcucauugcagacuugaacuucuaggcgaaagugauccuccugccuuagccuccugccuccucaguaccuggguguguaauaccaugccucgcuaauuuuuuuuuugagaugagggucuuguuaguugagcaggcuggucuugaacuccuggucucaagcaguccuccugccuuggccucccaaagugcucaccacaaccuccgccucccggguucaagugauucuucugccucagccucccgaguagcugggauuacaggcaugugucaccacgccuggcuaauuuuuuguauuuuuaguagagacaggguuucacuguguuagccaggauggucuccaucucucagccucccaaagugcugggauuacaggugugaaucaccgugccuggugaaagugguuucuugaguugaaaucuacaccuggugaagaugcugugaacauuguugaaaugacagcaaaggauuuagaguauuacauaaacuuaguugacaaagcagugguaggauuuaagaggauugacuucaauuugaaagauguucuacuguggguaaaaugcuauuaaauagcauuacaugcuauagagaaaucuuugaugaaaggaagagaguccaucgaugugacacacaucacuauugucuuauuuuaagaaauugucauagcacuuugggaggcugaggcgggcggauuaccugaggucaggaguucgagaccagucuggccaacauggugaaaccccgucucuacuaaaaauacaaauauuaccaggcacggugguaugcgccuguagucccagcuacuccagaggcugaggcaggagaaucgcuugaacccaggaggcggagguugcagugagcauugcaaccacugugcuccagccugggcgacagagugagacuccaucuuaaaaaaaaaaaaaaaaaaacauugaaaaugccacaguugccggaugcaguauaauccugcauuacaggcucaugccuguaauccuagcacuuuggguggcugaggugggcgaucacuugaggucaguaguucaagaccagccuggccaacauggugaaacccugacucuacuaagaauauaaaagccaguugugguggcgggcaccuguaauccccacuauuugggaggcugaggcaggagaaucgcuugaacccgggagcugagaucgcaccacagagugagacucugucucaaaaaaaaaaaaaaaaaaagaaaaaauaaauugccauagccauuccaaccuucagcaaucacuacccugaucagucagcagcuauuaacauggaggcaagacccucuacuggcaaaaauauuacaacucacugaagaaucagauaauuguuagcauuuuuuagcaauaagguguuuuuauuuauuuuuauuuuuauuuuugagacaguuucaucucaucacccacgguggaaugcauuggcaugaucuuggcucacugcaaccucugccuccuggguucaagcgauucuccugccucagccuccugaguagcuggaauuacaggcaccugccacuacacccagcuaauuuuguguuuuuaguagagacaggguuuugccauguuggccaggcuggucucaaauuccugaucucaggugauucucccgccugggccucccaaagugcugggauuacaggcgugagccauugugccugcccaauaaagugguguuuuuguguguguguguuuguuuuguuuuuguuuuuuguuuuuuuuuuugagucugaguguugcucugucacccaggcuggaaugcaauggcgugaucucggcuugcuacaaccuccgucucccagguucaagcaauucuccugccucagccuccugaguagcugggauuacaggugcccaccaccaccaccagcuaauuuuuguauuuuuaguagaacgggguuucaccauauuggccaggcuggucucgaacuccugaccccgugacccacccaccuuggccucccaaagugcugagauuacaggugugagccacugugcccggccaaauauuuuuaaauuaagguauguacauuaguuuuuuagacaaugcuauugcacacuuaacuacaaguguagacauaacuuuuuuuuuuuuuugagacggaguguagcucuguugcccaggcuggagugcaguggcgugaucuuggcucacugcaaguucugccuccuggguucacgccauucuccucccucagccucccgaguagcugggacuacaggcgcccgccaccacgcccggcuaauuuuuuguauuuuuaguagagacgggguuucacugugcuagccaggauggucucgaucuccugaccucaugaccgcccaucucggccucccaaagugcugggauuacaggcgugagucaccgugcccagcugacauaacuuuuauaugaacugggaaaucaaaaaauucaugugacuggcuuuauuuauguggucugcagcugaacucucaguaucucugaggucugccuguacuagucccaguuccgccacuuguuagcugggaaccuugagcccuccagcuguaaaaugaaguugauaaccacuugcugagguaguuauauuaaaguagguaguucaugaaaagugcuuagcacuaaugcguagcagaguaccuuaucuauagauguuauuuugauuauagucuauacauuuuugauugugugguacucucaacauuuuguuaaaacauaacauugauaagaaaaaauugauucuggauggguccacugucugucuguaguuggcacauuccucaugccuauguggguuuuugccggaugcucugauuuccucccauguccccacgauaagcacauuagcuucauugacaugucuaaaugauccuagugucagugagugugugugugagugugcaaugccaugaauggcuuccuguccaggguggcauccccccuugugcccugagcugccaggauacacucuagccaaccuugacccugaacuggaauaaguggguaaauaauuaucuuacuuguucuuaugaaucuucuguacauauauguauagcucacauuuauuucaguguuuaauauuaaaaggguuuggaucuuuauuuagaaguuuggugauguuuucugaccagaaauauguuacaggaacuuaaaucuuguuuguaucaacuaccuuuuaugguaaaauuggucuccuuauacaucauuuugcuuaaaguugccguuuccaagaaccuaucaaugacauuaagugaggacuuacuguacuuaguucuagaugaggcuggaugauauucagguucaauuuuuuuuuuuuuuugagauggaguuucacgcuugucacccaggcuggaguguaauggcgugaucucggcuccugcagccuccaccuccuggguucaagcgauucuccugccucagccucccaaguagcugggauuacaggcaccugccaccaugcccggcuaauuuuuguauuuuuauuagagacgggguuucaccauguuguccaggcuggucuugaacuccugaccuuaggugauccaccugccucggccuccugaagucgugggauuacaggcgugagccacugcgcccggccagguucaauuuuuuagcaagauuucaucaugggugguagcacuucaucagugcuuuguuggguuuauuuuggucucuuuuuuauuuguuggaggucuuuucuaaauguuuuaugauucucaauugucuguuuauacuuaaguguaacugagagauuauggccgagcguggugggucccaccuguaaucccagcacuuugggaggcugaggcgggcagaucacuugaggucaggaauucaagaccagucuagcuuagccaggugugaugguacucaggaggcugagacagaagaaucgcuugaacccaggaggcagaguuugcagugagccgagauugagccacugcacugcagccugggcaacaaagcgagacucugucucaaaaaaaaaaaaaaaaaaagguguaacugagaaauuaguuggaagcuccuugugucugagcaggacuugugaguucaggggcuucacuuuaggguaaucuagggacaagucugcuuuuucauugauggagaguaaggcacaggucucagaaucuggagauguguuaguuuuuauuguuuucugagaagacuuuuccagucuccugccugagagguaccaucuagcuaccagaauuuuggaagcgggacagcagaaguggcgugaauacccugucugacaggguuggaauucugugugguccacuuuccuuugguauccacucugaaguuuuucauuuccucaaaccuguuaggccacuucauuuuccuuucuuguaaaaccuguggaaaucccucauguccuauaaucgcuucugucaucucuuuaaccuuaugguucguuccuuuguauucuuugcugccaccuuagaaggucaaucuacauguuuaacugggagucaacaccuaauaauuuuuguuuuucuuggacuguuuuuuuuuuuuuuuuuuuugagauggaguuucgcucuuguugcccaggcuggaguacaguggugcgaucuuggcucacugcaaccuccgccuccuagguacaagugauucucuuguuucagccucccaaguagcucggauuacaggcauucgccaccaugccaauuuuuuuuuuuuuuuuuuaaguagagacaggguuucaccacguuagucaggcugguggcgaccuccugaccucaggugauccaccugcuucggccucccaaaguucuaggauuacaggcaugcgccacuguccucggccauguuuuguauuugauuaucauuauauucauuauauuccaacuuauaagcaaguuuauauucauacauguccuuauugaaagcaaaccuguguccuaguuuuuccaguauauguguauuuuaucugugagguuacagacguuguuuuagaggcuggagauagaauggagagaagaucagaugugauuccuguuuccauggaauuuauauuuuaguggggaaggcagacauguacaaauagguagaaugcugguauagaguauauaacagaagggaguccuugaccaugaaggacauuccacaggaucauuaugacagaaacccaaggcggugacacauugauuauagcaguauuucacgaaaaaucacuauuugaauacuccauuugauuuauuuauagaaauaaucacuuaugaugaccucuguuacuuggaguguaguaucagaaaaacuaggacaucgguuugauguaaguaaggauuauucguuuuguauggauaaacuggcuaauuccuugucugauugucauugaaauaugugaccuugauuauaagggugacuucauucuuuuagaaugaaacaacuuguaaaugcaucaccguuacucaacacaggauguguucacccuguuagcuugccuccaccauuuacuuaaaucuuacucuucugucuuacuacuuguauuaguuuccuagggcugcuguaacaaaguaccacaaaccggguggcuuaaaacuaauagaaguuuauucuuucacaguuuuagaggcuagaagucugaaaucaaggugucauccucucccugaaggcucaggggagaaucuguuccaugccuuucucuuagcuucugauguugccagcaaucuuuggcaauucuuguagauacaucacucuagucucugccucugucaucacauugcauucuccucuuuauguguaucugucccuguaucucuucucuuuuaagaaagacacaaaucguguuggauuaugggcccacccuacucccaugugaccucaucuuaacuuacaucuuaauuacuucugcaaagacccuguuuucagauaaugucacauucgcagguagcaggggugaggauuucagcaaaucuuuuuuggggaacacaauucaacccacaacacugcuauuccuggcacuaaaagaaaaauaguaauaauaauaauaauuuaaaaaacuaugccauaauuuauucaguuccuaaugaauauuuuugauacaaauuaucaccaauugaaaaugaaaaaugggcucaggcacaguggcucacgccuauaaucccagcacuuugggaggccgaggugggcagaucauuuaaggucaggaguuuaagaccagccuggccaacauggggaaaccccaucucuacuaaaaauacaaaaaguagccaguugugguggugcauuccuguaaucccagcuacaugggaggcugaagcaggagaaucgguugaacccgggaaguggagguugcagugagccuagauugcaccacugcauuccagccugggcaacagagcgagacugucucggaaaaaaagaaaaagaaaaagaaaaaaugaaaacuaggcaaggugcaguggugccugucuguagucccagcuacuugggaggccgagacaggagaauugcuugaggccaggaguuugagauuacagucagcuaugagaacaccacugcacuccagccugagugacagagugagacccuaucucuacacacaaaaaaaggcacuuugggaggcuaagguggauagaucaguugagcucaggaguuugagaccagccugagcaauauagcaagacccugucucuacaaauaauaaaaaauaagcugagcaugguggcacauaccuguggucccagcuacuugggaggcuauggugagaggacugcuugagcaugggagguugaggcugcagugagccgugauggugccgcaguacuucagccuggauaauaacaugagacccugggugacagcgugagaaagaaaaaaggccaggcaugguggcucaugccuguaaucguaacacuuugggaggcugaggugggaggaucaccugagccugaggaggucgaggcugcagugagcugcgauugcacugcugcauuccagccugggugacagagggaaauccugucuuuuuuuuuuuuuuuucugagacagagucuugcucuguugcccaggcugcagugcaguggugugaucucgguucacugcaaccugccucacggguucaagugauucuucugccucagccuccugaguagcugggauugcaggugcccaccaccaugccuggcucauuuuuguacuuuuaguagagauggaguuuucccauguugggcaggcuggucuugaacuccugacuucaggugaucugcccgacucagccucccaaagggcugggauuacaggcgugagccacugugccuggccagaaauucugucuuuaaaaaaaagaaaagaaagaaaaugaaaacuacacacaguaacacugauaaccauaaaaauuaaucugaggaaaaauaagaaaucuuggccucuacugguguuuuugugaagggaaguugaaggugcugaagcaucuagacaugaagaaagaaccaggcacaacuucugaguguggcucgcucuccucucaguuuccuucauuagaaaauaacauuuugcagaugacaugauucuguaucuagaaaaccccaucgucucagcccaaaagcuucuuaagcugauaaccaaccucagcaaagccucaggauacagaucaaugugcaaaaauugcagacauuccuguacaccaacaacaggcaagcagagaaccaaaucaugaaugaauuccuauucacaguugccacaaaaauaauaaaauaccuaggaauacagcuaacaagggaagugaaagaccucuucaaguagagcuacaaaccacugcucaaagaaaucagaggugacacaaacaaauggaaaaacauuccaugcucauguauaggaaaaaucaauaucaugaaaauggccauacugcccaaagcaauuuacagauucaaugcuguuaccauuaacuaccauugacauucuucacagaauuagaaaaaacuacuuuaaaauucauauggaacaaaaaagcaugaauagccaggacaauccuaagcaaaaagaacaaagcugcaggcaucaugcuacccaacuucaaacuauacugcgagguuacaguaacaaaaacagaaugguacuggcacaaaaacagaaacauagacuaauggaacagaauagagaacccagaaauaagacugcacaccuacaaccaucugaucuuugacaaaugugaccaaaaccagcaauggggaaaggagucccuauuuaauaacaggugcugggagaacuggcuagccauauucaaauauugaagcuggaccccuucuuuacaccauauauaaaaacuaacucaagauggguuaaagacuuaaauuuaaaacccaaaacuauaaaaacccuggaagaaaaucuaggcaauaccauucaagacauaggcacaggcaaagauuucaugaugaagaugccagaagcaauugcaacagaaucacaaauugacaaauuuaguuuaauuucuaauuaaacuaaagcacuucugcacagcaaaagaaacuaucaucagaguaaacagacaaccuacagaaugggagaaaauuuuugcacucuguccaucugacagaggucuaacaucuagcauuuacaacauuaugagauaaaaacagccccauuaagaagugggcaaacaacaugaacagacacuuuucaaaagaagacauauauauggugaacaaacaugaaaaaaagcucaauaucacugaucauuagagaaaugcaaaucaaagccacaaugaggcugggugugguggcucaccacuguaauuuuagcacuuugggaggccaaggugggcagaucacuugaggucaggaguuugagaccagccuggccaacaugguggaaucuugucucuacugaaaaauacaaaaauuaguugggugugguggcagguaccuguaaucccagcuacuugagagguugaggcaggagaaucgcuugagcccaggagguggagguugcagugagcugagaucgugccacugcacuccagccugggugaaagagcaagacuucgucucaaaaaaauuaaaaaaaaaaguaauuuaaauauaauauuuuaagucagagaccuagcccacauucaucuaguguugaauuaaggagagcaggagacuaggagcuggcauauaguucagaaauguggcuccugagaggcugcaaaucauuuucucucuuuuuuauucucuuuuucuuguaguuagaaggggaagauaaaagacuuugauucaugaagaaucugcucacugagaaguguauaucaagccacaauuuccaucaaaaagugauuaagcagagaauggagaagaagguugauuccaggugagugaugggacuugagaaaaaaauauaacuggaaugaugguucauauaaaacuaaacauuuuguguaugaaaaaauuauaaauuaugagugagguaguaacuguggguaaguuuuuuuugucauugauauuucaaauuuuucaucuauaagauaauacacauuucguacauuauguuacagucaaaaaacauucugaguagugcauggaaauaucaaucauuaaaauuugauucugagcagaagugaguauuauuuuccugagcuuugaaguuauaucauccagguuggcuggcucucgugucuucuacuuuugaucaugguugcuuucagacuuuuaccuucaguugacuguaucucuccaaugaagcucucggcaccuuauaacguggcagccucuguauaacucucccuuucuggguuuugguaauuguucccuccccucaucucuuugggccuagagguaguaccaccuuagcuucuacuggcuucagguuccugcacuguuucuuguaguuccucuauacccacaaguuuguaaauauaccaucuucaaauuauccuauuuuuaguaugucaucuauuuucuugugaccuuucauagguuuuaucgugaauguuaauggauuuugucacaugguuuuuguacauuuauugagauaaucaugugguuuuugcucuuuuuucuauuaauagguguauuacauaaauugauuuuugaauguuaaaucagccuugcauuccugggauaaaucccacuuagucaugguguuuauauggcauauaguuguguuagucaggguccucuagaggaacagaacuaauaggauauauguguaugugaaagggaguuuguuaaggagaauugacucacacaaucacaaggugaagucccgugauaggcagucugcaaguugaggagcaaggaagccagcaguggcucaguccaagucccaauaccucaaaaauagggaagccaacagugcagccuucaaucuguggccaaaggcuugugagccccugguaaaccauugguguaaguccaagaauccaacagccaaagaacuuggagucugauguucgagggcaggaaacauccagcaugggagaaagaugcaggcuagaagacuuagcuagucagcuucuccuaccuucugccugcuuuuccuaguggugcuggcagccguuggauggugcccacccacauugugggugggucuuccucuccuaguccacugacucaaauguuaauaucuucuggcaacgcccagauacacccagaaacaauacuuugcguccuucaauucaaucaaguugacacuuaacauuaaccaucacagugguuuuuauacguuguuggauuugguuugcuacuauuuuuugaggauuuuuaugucuguagucacgaggucuauuggucuuuuauuuuucuuuuugguaauaucuuugucuuuguuaugauggcgauacuggucucaaugaauuuggaaguguuccucuauuuucuggaagaguuuauggagcauuguuuugauauuuauuuauuuauuuauuuauuuuugacauggagucucgcucuguugcccaggcuggagugcagugguacagucucggcucacugcaaucucugccugcccaguucaagcgauucuccaucauguuggccaggcuggucucaaauuccugaggugaucugcccaccucugccugccaaagugcugggauuacagguguugagcgauagugcucggccuauuauuucuuuuuaaaucuuugguagaauuaaucacugaaacuaucugugcuuuuuuuuguaggaaaaauuauuuauuuuagagacagggucuugcucuguugccugggcuggaguacaguggcacgaucacagcucagugcaguuucuaacuccugggcucaggcaaucuugcugccucagccucccaaagugcugggauuacaggugugagcuaccaagccuggccucuuuguaggaaaauuuuuaauuacucauuuaauuuuuuuuacuuguuagagaucuauuagguuucuauuuauuguuuuuguuuguuuuuugagauggagucucacucuugucacccagacuggaguacgguggugugaucucagcucacugcaaccucugccucccugguucaagcaauucuccugccucagccucccgaguagcugagauuacagaugcaugccaccacgccuggcuaauuuuuguauuuuuauuagagaugggguuuuaccauguuggccuggcuugucuugaacucgugaccucaaaucacccaccuaccucggccucccaaaguacugggauuacaggcaugagccacugagcccagcuguguuucuuccugaguuaauuuugguaauuucaguuuuucuagaaauuuuuccauuucauuuauguugucuaauuuguuggcauaaaguuaauuguaugcccuuauaauacuuuuaauuuaugaagggucagugguaaauguccucucuuucauaccuaauuuuggugauccaugucuucucucuuuucucauugguugaucuagguaaagacuugucaguuuuaaugagggacccuuaugguuacgcucuuuuuuuucuuaaacuaauuugaauuggguuccuguagcuugcaacuuagggugcuaugaauauacagaaguuucuuauagaauccacugggucuugggcaaagugggagagagaacuguuugagaccuauucagcagguauuauggacccuucuuccugagcagagccaucuuugugcuucaaaauuucaucgugggagaaugaauuugguugauccagcaagggucaguuuuuucccccaguguaaucaacuaggacuuggaggaaggucauugaguucaagcauagcugcugagauccugccccuguugauagacguucucauagaaggaguccucguaagcugaaccagcacccugacaguguuuacuacaugguccgcagaguacucuuuaggccugcuuuauuucaucuucucaagcaaauuaacgauggccuuaauaugaagcucuguggccucuaacucuggcauaguuucuguuuuuuuuuuuuuuuuuuuuuugagauggaguucugcucugucgcucagguuggagugcauggcgcgaucuccgcucacugcaaccucugccucccaguucaagcaauucuccugccucagccugguuucuucaaauacccugcugcuuuaggcuggggaggcuaagaagggaauguauuuccuuuaaguuuuuuguuuguuuguuugagacagagucuugcucuguugcccaggcuggagugcaauggcgugaucuuggcucacugaagccucugccucccggguucagugauucuccugccuuaaucucccgaguaacugggauuacagguacaugccaccacgcccagguaauuuuuuuauauuaguagagaaggagcuucgccauguuggucuggcuggucuugaacuccuggccucaagugauccgccugucuuggccucccaaagugcugggauuacaggugugagucaccgugccccagccuuagguguuaaauuugcagauucagaaagguaugggaaaauguaucguuuaagauaucauuuugaaacaaacaauguaaccauaacacagguaaagaaauagguuauuggccggcgcaguggcucacgccuguaaucccagcacuguaauccccacacuuugggaggccgaggcgggcagaucaucugaggccaggaguuugagaccagucugaccaauaugguaaaaccccaucucuacuaaaaauacaaaauuagccgggugugguggcacaugucuguaaucccagcuauuggggaggcugaggcagaagaauugcuugaacccgggaggcggagguugcgguaagcugagauugugccauugcacuccagccagggcaauaacagcgaaacuccaucucaaaaaaaaaaaaaaaauuacaugguaagaauauuucaguuuaucuauuuugcugaugggcauuuggacuguuuucaguuuuuaaauuccuuuuuuuauauauugacaaauuauaguuguauguauuuauaggauacaaagugauguuauuauuuauuuauuauuacuauuuuuuuuuuugagacggagucucgcccugucgcccaggcuggaguugcaauggcacaaucuuggcucacugcaaccuccaccucagggguucaaacaauucuccugccucagccucccaaguagcugggauuacaggcacccgccaccauacccagcuaauauuuguauuuuuuuuuuuugagacggagucuagcucuguugcccaggcuggaguuuaguggcgcaaucucggcucagugcaagcucugccucccagguucaugccauucuccugccucagccucccaaguaccugggacuacaggcgccugccaccacgcccggcuaauuuuuuguauuuuuaguagagaggggguuucaccauguuagccaggauggucuugaucuucugaccuugugauccgccugccuuggccucccaaagugcugggauuacaggcaugagccacagcgcccagccaguuuuuguauuuuuaauacagauaggguuucaccauguuggccaggcuggucucaagcuccugacugggauuacaggcgucagccaccaugcccggcugauguuaugauuuuuuaauacaauguaaaaugaugaaaucaagcuguuuaacuuaucugucaccucaaguauuugacuuuuuuuuuucuuuugagacagggucucgcuuuguugcccaggcuggagugcaguggugugaucauggcucacugcagccucagccuccugggaucaagcaaucuucaugccucagacccccaaguagcugggacuucaguaaugcaccaccaugucuggugaauuuuuguauuuuuuguagaaaugggguuucaccacguugccuaggcuggucuugaacuccuggccucaagcaaucugccccucccaaagugcucagacuacaggcguuagaugcugcacccagccuugacauuuuuugugaugagaagauuugagauuuacucucuuagggauacugaaauauauaguacucgggcguggugacucgugcuggcaaucccagcacuuugguuuuucguuuuguuuuguuuuguuuuguuuuguuuuauuuuagacagagucuugcucugucgcccaggcuggagugcaguggugcgaucucagcucacugcaaccuccgucuccuggguucaagcgauucuccugccucagccuccugggcagcugggauuacaggugcacaccaccaugccuggcuaauuuuuuuugaauuuuuaguagagacaggguuucaccauguugaucaggcuggucucaaacuccugaccucgugauccgcccaccucagccucccaaagugcugggauuacaggcaugagccacuggcccggccaaucccagcacuuucagaggcugaggcggguggauuaccugaggucaggaguuggagaccagccuggcugacauggcaagacccugucucugcuaaaaauacaaaaauuagucuggcaugguggcaugcuacuauaauuccagcuacucgggaagcugaggcaggagaaucacuugaaucugggaguuggagguugcagugagccgagauuggagauugugccacugcacuccagcccgggugacggagugaaacuccaucucaaaaaaaaaaaaaaaaaaaaaaauguaguacugaauuguuagcuauagucaccaugcuguucaauagauauuaaaaaucaacuggccgggugcgguggcucaugccuguaaucccagcacuuugggaggccaaggcagucggaucaugaggucaggagauugagaccauccuggcuaacauggugaaacccugucucuacuaaaaauacaaaaaaaaauuagcugggcgugguggcgggcgccuguagucccagcuacuugggaggcugaggcaggagaauggcguggaccuaggagguggagcuugcagugagccaagauugcuccacuacacuccagccugggcgacagagugagacucugucucaaaaaaaaaaaaaaaaaaaaaaaaucaacuguauuucuccuauuuaacugaggcuuuguguccuuugauuaccaucuucccaauucucccuacuccuagccuuugguaaccaccauucuccucucuguuucuaugcauucaauuauuuuagauuccacauauaagugagaacaggucauauuugucuuuguguguuuggaguauuucacuuaauauaauguucuccauuuccgaaauucauguugucgaaaacgacagaauuucuuccuuuuuuuuuuuuuuugagacggagucucacucugucgccaggcuggagugcaguggcacaaucucagcucacugcaaccucuaccucccggauucaagcgauucuucugccucagccucuugaguaguugggacuacaggcgugugccaccaugcccagcuaauuuuuguauuuuuaguagagacaggguuucaccauguuggccaggauggucucaaucucuugaccucaugauugcccaccucagccucucaaagugcugggauuacaggugugagccacugugccgggcuaaccaucuguauuucuaguaaguucccaagugaugguuaugcuguuggcuuugguaucacacuuugauaaccacuguucuaugguauccaccucagaauagauuguggaccaaagauuaugggaaucuucaauuuugcuagauaaugauuuucugaauuguuugaaccaguuuauacucuugcuggcaguguaugaacauguucauugacuuaccaacacuauacuaaucugguagguaugucucauuguucguguguguguguguguguguguuucuuuuuucuuuuucuuuuuuuugggacaggaucucauucuuuuacccaggcuggaguacaguggcaugaucauggcucacugcagcgucgaccugccagcucaugcaauccuccuuccucagccucccagcucaugcaauccuccuuccucagccucccaaguagcugggacuacaaauaugcaucacugugccuggcucuguguguguguguguguguguguguagacagggucuugcuugguugcccacgcuggucuugaacuccagagcucaagugauccuccugccucacccucccaaaguacugggauuauaggcaugagccaugugccagccucauugugauuccuauuuucauuuccugaauuccuguuguggcuuaguaccuuuuuuuuuuuuuucuuuuuuugagauggcgucucccucuguugcccaggcuggagugcaguggcgugaucucggcucacugcaaccugcauccccuggguucaagcaauucuccugccucagccucccaaguagcuggaacuacagucacgcaccaccaugucuggcuaauuuuuguauuauuaguagagacggaguuucaccauguuggccaggcuggucuugaacucgugauccaccugccuuggccucccaaagugcuggggcuuaguaccuuuuuauguguuuauuggguaucuggauuuucucuuuuugaaguacauauucaagucuuauuccuguuuuucucaugaguuguauauugaguauuuguacuaauuaauauauaggagguuuucuguuuuugaauaugaaucuuuuguauguuuuaugugugauaaauaucuucucccucugcucucuucaucauuugaugaauuaagauguuuuaaauuuuaagccgggugccguggcuuacgucuggaauucuagcacuuugagaggccaaggaggguggaucacuugaggucaggaguuagagacaagccugaccaacauggcaaaaccccgucucuacuaauaauacaaaaauuagcuggguauuguggugugugccuguagucccagcuacuuggggggcugaggcaggagaauugcuugaaccugugagguggggguuacagugagcugagauggcaccccugcacuccagccugggcaacagagugaaacucucaaaaagaaagaaagaaaaaaaaaagaaagccaggcacaguggcucaaccccuguaaucccagcacuuuggaaggccaacgcaggcagaucauuugaggucaggaguucaagaccagccuggccaacauggcgaaaccccaucucuacuaaaaauuaaaaagucaggccaggaguggugguucaugccuguaaucccagcacuucgggaggcugaggugggcggaucaccugaggucgggaguucgagaccagccugaccaacauggagaaaccccgucucuacuaaaaauacaaaauuugccgggcaugguggcacaugccuguaaucccagcuacucgggaggcugaggugagagaaucgcuugaaccugggaggcggagguugcagugagccgagauugcgccauugcacuccagccugggcaacaagagcgaaacucagucucaaauaaacaaacaaauaaauaaaaauaaaaucagccagauguggugucgcaugccuauaaucccagcuacuugggaggcugaagcgggagaaucacuugaacccaggaggcagagguugcagugagccgagauggugccacuauacuccagccugggugacagagugagacucugucucaaaaaaaaaagaaaaaaaaauuuaacuuaguaaaauuugugucuuuuccuuuauaauuaauauguguucucucagguuuaaggaaucuauuucuucccugaugucaugaagauauucugguuuuuguuuuuuggagacagggucucgcacugucacacuggcuggauugcaguggcacaaucagggucacugcagccucaaccucccaggcuugaggaguccucccaucucagccucccaaauagauggcacuacaggcaugugccaccacacccagcgaauuuuuguauuuuuuguagagaugggcuuucaucgcacugcccaagcuggugucaaacucuucggcucaagcaauucgccugccuuggccucccaaagugcugggauuacaggugcgggccaccaugccuggccuaagauauucuguaucaucuuuaagaacucauuauuuugcuguuuacauuuuauuguccagaccuccugaaauugacuuuuguugaucaugugaguuagggacccuauuucuuuuuuuuucacauggguauguaauuguccuagcacaguuuauugaaaaaacugcucuauagugccauuuuaaucauuacucaaguguccauuaaggccaagucugucucuuggcuauguaccuuguuccuucggucaauuuguuucugcuauacaaaaucgugaugucuugaauauguagccuugcgauaagccugauaucuaaguaagacugcuuaucuaguacuuuuaagaaugucuaagcuauucuuggucuuuuguaauucuaugaaagcuucagaaucaacuugugaaguccucucccuccccaaaauagaaucuauuguuguugguuuuuuuguuuguuuguuuuuuaagacagucuuccucugucgcccagcaggaguggcacaaucuuggcgcacugcaaugccugccucccagguucaagccauucuccugccucagcccccagaguagcugggauuacaggcacccaccaccacgccuggcuguuuuuuguauuuuuaguagagauggcauuucaccauguuggccaggcugguggucuugaacuccuguccucagucaaggugaucugcccgccuuggccuuccaaaguacuggguuuacaaguguaagccacugugcccagcccucuauugugguuuuaauugagauuacuuugaaucuauagaucagagugggaaaaacugacaucuguauuguacugaguucuccauuuugccuauaaaauuauuagauuuacuccuauauuugauauuugugaugccauuugaaaauaguauauaaauauauauaacuauuuuuuccuuauugcuaguuuauagaaauauagaguugacccucauuuauuugguuuucucucuuccuggucaguuucacuggcugucaacuguauuagucuuuuuaaggaaccagcuuuucucuuugaucuucucuguuauguuugucgucccuuuguggcugcuguucuuagaaaauaacugcuuacaaggcugacccuuggcuggugucuggaaacuuagauuucagaaggguucccaccauucccuaacugaugaauaguuaacuggaccuacacuguuguguguucaugcaauguuguuuaugcugaauacuagcacucccucuaggagucuggaauuuugguauguguuaggcagaggguaccugucugaccagcccucaguaaaaacuuggguacugagucucuaauaagcuucauugauacacaacacuucucacguguuaucacaauucauugccggaggaauuaagaguguccuuugugauuccgcugggagaggauucuuggaagcuugcgcuugauuucuuccagacuaugcccugugccccucuucccuuuguugauuugcuuugcauccuuuugcauaaagauugaagaaaaaaucguaauggaaguuagcaaauacguuguaaugcucauaaaaauacuacauaucaauauaugaaauacaacuacagucaugcuuagaggaauguaugauggguuuaaugcauuuaauguauagcauuaaaugcauguauuauaaaggaauuaagacugaaaaccagcgaacuaugcaucuaucauuuuuucuuuuauuuuccauuuuuuuuuuuuuuugauacagggucuugcucugucgcucaggcuggugugcaguggcaugaucauagcucacugcagccuugaacuccuggguucaagugaucuuccuaugucagucucccauguagcugggaguagaggcaugcaucaucacaucuggcuaauuuuuuuuuuuuuuuccgagacacagucuugcucucccgcccaggcuggagugcaguggcaugaucuuggcucacugcaacaucugccucguggguucaagcaauucuccugccucagccccccgaguagcugggauuacaggcgugugccaccacgcccagcuaauuuuuuguauuuuuaguagagacaggguuucaccauguuggccaggcuggucuccaacuccugacuucaggugauccacccgccuuggcuuuccaaagugcugggauuacagccgugagccacugcacccggccuaauuuuuuaauuuuuuguagagauggggucucucuguguugcccagcugaucucaacuccuagccuuaagcaauccacccaccuuggccuccuguagugcugggaugauaggcaugagucacugccuggccaaaaguuuuuuuauuuuaaacuuuuaauuaauuaauuuugagacuggguuaugacacuggcuaauuuuuguauuuuugguagagaugggguuucaccuguugcccaggguggucuugaacuccugggcucaagugauccacccgccucagccucccaaagugcugggauuacaggcaugagccaccgugccuggccaaaaauuauuuacugauaaauauaacacaaauacagaaaacggcaugaaacaagugggugcccuagcgaauuauuauauggcagacaccuuuguaaucaccaccuguuuaaaaaaaaaaaaaaaaagauaagaccuuggcagucauuucugaacuuccuuccaaacccacugacugccccucagagaguaaacuacuagcuugacuugaaugguaauuacuuucucacuuuucuucacgguuuuauuacccaacuguguauccuuaaacacuguauaguuuagcuuugcuuguggguuuuuugagcaggauuauaagcuacuuucauuguuuucauuauaguuaccaacauuuuucagauuuccuaaaaugguucuauauugcuuuuuuauuuuuaaaauucauugagauauaauucacauacuacacaauucauucauuucaagugugcaauucaauggcuuuucuaauacucacggaggguugguuuuuuguuuuuuguuuuaguuugggguaugacuucuauugccagagggaaaguaauauauguacaaaaccaaauguuuguugauauaacuucugcaucauaauuaaaauccagggaguaucuaaaaaaauagucaucucaaucaaaauccacuacuuccauuugggcaugguggcucaggcacuuauaaucccagaacuuugggagguugaggugggaggauuccuugaguccaggaguucgagaccagccugagcaacauaguaagaccccgucucuacaaaaaguaaaaaaaaaaaaaaaauagccaggugugguagugcuugccuguaguaccagcugcucaggagucuaaagugggaggaucacgugagccugggagacuaaggcuguguaauuugugauuguuccacugcauuccagccugggcaacagagccagacccugucucaaaaaaaaaaaaaaaaaaaaaaaaguagaguucaagaccagccugggcaacauagugagaccuugucuuuacuaaaaaaauuuuuaaaaauuagccaggugucauggggcaugccuguauuccccuggaaucaccaacacuguuagagcuguuagauuaauuagagaccugagauaauaagaaauacaggcauccuuuacauagucuucuguuguucuuucuucccaaucagagacuugcgaauguguggaaugacaccaucaccagcaauuguagccuugaugagagaguccaauucuucuucuucacuaauagcagguugcaaaugaugagggguaauagcuuuaccuuuaaaucuuuuggugccuuugaugucacuucaaguaucucugcagugagguauccaaggauggcugcacuguucacaguggcagucacgccccuacacauccaugacuggucguccuacauuugaggugucugucuaugaauauggcccacccggaacuguaaggaggcucucugugagcgggaaacaaccaccuuuguucuggccuuuccaguguccugcucagccuuaacgccacccuugcaaauucugucaaagcucaaacaaggcagagaaagggcuagucagacacacagugagauccuaccaccuacugcuucauggcacggugauugaaacugcccagagaguuuauguuuugugugugugugguaacguauacauaacaaaaaacuuacuauuuuauuuuaaccuuuuuuuuucuuuuuuuuugagacagucucacuguguugcccaggcuggagggcaguggcgugaucuuggcucacuguaaccuccaccuccuagguucaagugcugcuugugcuucagccucccaaguagcugggucugcaggcaugcgucaccaugcuuggcuaacuuuuuguauuuuuaguagagacgggguuucaucauguuggccagacuggucuugaccuccuggccucgagggauccaccugccuuggccucccaaagugcuaggauuacaagugugagccacuacaccuggccuuuuuuuuuuuuuuuuuuuuugagauggacuuuugcucugucgcccaggcucgagugcaguggcacaaucucugcucacugcaaccuccaccucacggguucaagcuguucucccgccucagccucccagguagcugggauuacaggcgcgugccaccaugcccagauaauuuuuguauuuuugguagagacaguguuucaccauguuggccaggcugcucucgaacuccugauccaccugccucagccucccaaagugguaggauuacaugcgugagccaccacgccuggccuauuuuaacuguuuuuaaguguacaauuuaguaccauuaaguacauugacaauguguaaccaucaccacuauccauacccaaaacuuuucaucaucccauguggaaauucuguauucauuaaaugguaucuccucauuccuccuacccuaacccuuuauaaccuuuauuauacuuuucuguuucuaagaauuugcuuguucuagguaccucauguaaguggaaucauacgacauuuuuccauuugugucuggcuuauuucaguuagcauaguguuuucaagguuucuguaucagaauuuuauuccuuuuuuucuuuugagauggagucucgcucugucaccaggcuggagugcaguggugugaugucagcucacugcaaccucugccucccguguuuaagcgauucucuugccucagccucccaaguagcuaggacuacaggcgugugccaccaugcccagcuaauuuuuguauuuuuaguagagacgggguuucaccauguuggccaggauggucuugaucuuuugaccuugugauccacccgccugggacucccaaagugcugggauuacaggugugagccacagcacccggccuuauuccuuuuuauagcucuauaauauuccauugugaacuguacgccauuuuuuaaauccauuaucaguuuaugaacaucuggguuguuuccaccuuuuggcuauugugaauuaugcugcugugaacauuguguacaaguuuuucuguggacauaugcuguauugcuuuuauaauaagaaaauaaauauuuuuaaagcagaaaauucaggccauaggauacauaucucauuguaguaauagauaauuauuuucuccuucacauuccuucuacugccaguaaauacaaugauauuuucuuuuuauaauguaauuuccuguacagauugucuuguuaaggagggccauuuacaaaugaccaguauuuggccagagucucacccaccuucaguguaaauguauaaacugaugauguuauguuuuagaaauuagaaaccacuuucccaaaucaggaggaaaaaauccaguuuuaauuuccaaguuaacacaauuaaauauauguauugugguuccauaaauuuauuuuaugaaguugagccugaagaauaagccagucuaucaucacaccuuagaaauucagguaucugaauaguaaacaguuugucuuuagagugugaaguccguuaucucuuuugauucccacaaccccaagcaauguuauuuccauuuacaggggaggauacugaggguaggaaaaaucaagugauuugccauaaacuucaaaucugugaaguccauuaucuccuuugauucccacaaccccaaacaauauuaucuccaucuacaggggaggauacugaggguaggaaaaaaucaagugauuugccauaaacuucaaaucuguggaaucaggguguuuuuuuuuacuccaaaucuugauauauuucuacuauucuacucuuuaauuggcaauuauaaguguuccuuguagauuaagcaagugauuuuuguauuaaaccuaaguugcaacaauagcacaccauggcaaggacuacuuuuuuuuuuuuuuuuuuugagauugugccauugcacuccaggucagggauucgagacuagccuggccaauauggugaaacccugugucuacuaauaauacaaaaauuagccgggcuugguggcgugcaccuguagucccaccuacuugggagacugaggcagaagaauugcuugaacccaggaggcggagguugcagugagccgagauggcgccauugcacuccagccugggcgacagagugagauuccaucucaaaaaaaauaaaaauaaaaaguguucccuuuucucugcuuccuugccagcauuuguuauguuuuuuggucuuuuugacaacagucaccuaacaaguaagaugacaccucauugugguuuucauuugcauuuuccugauagugauguugagcauuucuucguauauguguuagccauuuguaugucuucuuuugagaaaugucuauucagagaauuugcuccccucacuuuuuuuuuuuugagacagggucucacucugucacccaggcuggaguacaguggugggaucucagcucacugcaaccucugccucccaggcucaagcuauccucucagaucagccuccggaguagcugggacuacaagcacacaccaccaugcuuggccaauuuuuuguagagacaggauuuugccguguugcccaggcugguguuaaauuccuggaccgaagccaucugccugucucagcuucccaaaguugccccuuuuuuaauuggauuuuuuuuuuuuuuuuugcuguugagauguuugaguucuuuguauauucugcauauuaauccucugucagauaguuugcacauauuuuuuauaauauuuguaaucccauuuuuuuuuauggagucuuacucugucacccagucaggagugcagugguacaaauuuggcucacugcaaccaccaccucccagguucaagcgauucuccugccucagccucccgaguaacugggauuacaggugcaugccaccacgcccagcuaauuuuguauuuuuaguagagaugggguuucaccauguuggccaggcuggucuugaacuccugaccucaagugaucugacugccuuggccuccgaaacugcugggauuacaggcaugagccaccacgcccagccuguaaucucauucuauagguugucuuuuuacucuguugauuguuuccuuugcugagcagaaguuuuugagauuaucccauuuuguuuacuuuugcuuuuguugccugugcuuuugauguuuuauucauaaaaucuuuuccuagacguuugaaguauuucuucucguagcuuucuaguuuuggaucuuacauuuaggucuuugauccauuuugaguugauauuuguauagggugagagguggggagucuaguuucauuuuucugcauguagauacucacuuuucccagcaccauuuauuaaggaggguguccuuuccccaauguucuuggagccuuugucaaaaauaaauuggcacugggugcgaugggucacaccuguagucucagcacuuugggacaccaggacaggcggaucacuugagccugggaguucaagaccauccugcgcauguggcaaaaccccaucucuacaaaaaauuagccaggugguagcauguacuuguaguugcagcuccucaggaggcugaggugggaagaucaccugaaucugggaggucaaggaugcagugagccgugauugcaucacuguauuccaguggggcaacagaaugagacucugucauucauagauagauagauagauagauagauagauagauagauagauagauagauaaaguagcuuaauaacuugauacucucuguucuguuccauuggccuaugugucuguuuuuaugccaguaccaugcuguuuugguuacuacagcuuugugguuuauuuugaagucugguggugugaugccuccagcuuuguucuuuuugcugaggaucacuuuggcuauuugggaucuuuugugguccuauacaauuuuuaagauguuuuuccuauuuaugugaagaaugucacugguauuuuuauagggccugugugcauuuuagcauguucuucuguccucuguucucaaccuuuuucugcaaauugguaacuggauuuagagacuuaauuagauuuaaguuuuauuuuuugggaguaguacuagauaaucuuauagaagcaaagcacugaacaguaccauacucaaauaugauaccuguauuagagcauucucaugcugcuaugaagaaauaucugagauaaguaauuuauaaaggaaggagguuuaauugacucauaguucugcauuucuagagaggccucaagaaacuuacaaucaugguggaaggggaagcaaacacguccuuuuucacauggcggcaggaaagaaagugcagggugaagugggggaaagccccauauaaaaccaucagaucucguggaaacuuacucacuaucaugagaacagcaugggggaacuaccaccauaaucuaaucaccuuccaugaggucccucccaugacacguggggauuaugggagcuacaauugcagaugcgauuugggugggggcacagcuaaaccauaucaauaccuauguuuuguuguuguuguugagacaagagugucacuuugucgcccaggcuggagugcauucaguucacugcagccucugcccccuggguucaagugauucucgugccccagccuccugaguagcugggacuacaggcgugugccaccacacccggcuaauuuuuguauuuuguauuuuuaguagagacgggguuucaccauguuguccaagcuggucucaaauuccuaaccucaggugauccgccugccucagccucucaaaaugcuggaauuacaggcuugagcuaccgugccuggccaucaauaccuacguuggaacuaucagggaauuuuauuuuuuucuuucuuccuguccugucuuguccuguccugucgcccaggcuggauggagugcaauggcauggcucaccgcaaccuccgccucccggguucaagcgauucuccugccucagccucccaaguagcugagauuacaggcacccgccaccacauccggcugacuuuuguauuuuuaauagagacgggauuucgccauguuggccaggcuggucucaaacuccugaccucaggugacccucccgccucggccucucaaagugcugggauuacaggcaugagccacuguaccuggcugagaaccugucuuuaaaaaaaaaauuagauugcuucuaccuuuuggcuguugugauuaaugcuucuaccuuacuuuuuauaguuaccccgugcccugcaaauauguucacucuugacuuucauuucuuuaaacauauucauuuuagcauauacagcuguguguguguaaagaaaaagggguaugugggaacagucuguucguucuucacaauuuugcaguaaacuucgaauuguucuuaaaaaacaaaaucuaagagacugauugugguagcucacaccuguaaugccagcauuuuggaaggcuuaguugggaggauugcuuaaucccaggaguucaagaccagccuaggcaacauagcaagacccuauuucaagaaaacaauacaauaaaauuuuuuaaaaaguauauuaaacuuuguguguguguuuguguguacauacgugugcuuuacccucagugcagauauucugaagcaagagaucaagaaugagaucaggccggguacagugguacaugucuguaaugccaccccuuugggggguugaggcaagaggauuacuugagcccaggaauuugagacuagccugggcaauauagugagacccugucucuaaaaaaauaaaaauaaaaaauuggccgggaacaguggcucaagccuguaaucccagcacuuugggaggccgagguggguggauaaccugaggucaggaguucaagaccagccuggccaacauggugaaaccccgucucuaauaaaaauacaaaacuuagcugggcacgguagugggugccuguagucccagcuacuagggaggcugaggcaggagaauugcuugaacccgggaggcggagguuaaacgagcugagaucgcgccacugcacuccagccugggcaacagaguaagaccuuaucucaaaaaaauaauaaaaauaaaaaguuagcuggucaugguggugcaugccuguagugucagcuacucaggaggaugugguaggaggauuccuugagcccaggaguucaagaccagccugggcaacacagugagaccucaucucuuaaaaaaaaaaauuaucaggacacaguggcgagcaccugugguccuaguugccuaguugcuugggaggcugagaugggaggaucacuugagccugggaggucgaggcugcagugagcuguggucaugccacagcaauccagccugggcaacggaguaagaaccugucucaaacaaaagaaaacuguguuaggccuaaugacuccagggggugcccuccagcucuguaguuccugccuagagcugacccagcaguacccaccucuagugguuggccaauauuucugucagauugggcugcuuauuauccuugcagcauagguauugucagucucaaugagcuuaucuguuuaauuuugcuuguauauuaaaaguauuugcaucacaugcagagauaacuuuauucucuccuugccucuuucguccucaaauuuaagguauuuuaaggauggugcaguuaagaaaccuuauucugcaaagacacuguccaacaagaagucuucugcauccuuugggauccggagggaguuaccuaguaccagucaucuagugcaguaucguggcacacauacuuguacccgacagggccgguuaagagaacugcgcaucaggugagcuuaugaguggccaccagucuauggguacuuugcuuuuguucuccuuucuugguuaaaaugggggaaugauucuuauucuuccaccgcaauuagugggagaucuugaugccuguucuugguaguagaauguucagaugaaaaggauauucaggaaccugcagacauaaaaucugucauugaguguuuucauuucuccacuugugccucacaauaugacgcuaucaagauucuuccagaaaaagucuaaacgugguccaagaaagaaggaacuacucuuuuuugcuauucuuuuuuuccccccagauuuucuggugaauucuagaagagcuguaacacuucugcuacucucgauuagauauauuagagacaucuguuucuucauucaaaaauuuaucaggucagguacgguggcucacaccuguaaucccagcacuuugggaggccgaggcagguggaucaccugaggucaggaguuugagaccccgucuccacuaaaaauacaaaaaauuagcugggugugguggcacaugccuguaaucccagcuacuugggaggcuaaggcacgagaaucgcuugaaccugggaggccgagguugcagugagcugaaauugcuccacugcccuccagccugggcgagagugagacucugucucagaacaacaacaacagauuuaucuggugcuuacccaugccagguguuacgcuagaugcugagcauauaaagugaguaagaucaucuugguuuaugacuuaaugagaguuuaaaaucagguaggcuugauagacucuuaagccacaacaauaaagugagauuagugcaaugagaggagaaggaugugguaccacaggcaaauacggcgagaacagccacacuaguauagccagcaguuacucucuggaggaaguggaguuuaagcucagcccugaaggauaauguaagaauaagccagauaaagggcaggagaagguguguuuuaaguugagcucaagguuuaacucuauaagacaagccaccuuuggccggguaugguggcucacgccuguaaucccagcacuuugggaggccgaggcggguggaucacgaggucaggagaucgagaccauccuggcuaacacagugaaaccccgucucuacuaaaaauacaaaaaauuaacugggcgugguggcaggugccuguagucgcagauacucucuggaagcugaggcaggagaauggcgugaacccaggagguggagguugcagugagccgagaucacaccacugcacuccagccugggcgacagagugagacuccaucucaaaaaaaaaaaaaaaaaaaaaaaaaaaaaaaagacaaggccgggcgcgguggcucacaccuguaaucccagcacuuugggaggccgaggcggguggaucaugaggucaggagaucgagaccauccuggcuaacauggugaaaccuggucucuacuaaaaaugcaaaaaauuagccaggugcaguggcgggugccuguggucccagcuacucgggaggcugaggcaggagaauggugugaacccaggaggcggagcuugcagugagcagacauugggccacuguacucuaaccugggcgacagagcaaaacucugucucaaaaaaaaaaaaaaaaaaaaaaaagacaagccaccuuuguguguauaccagacacugugcuagguacuggagguacuauaaagcaccaauuucugcuuucaggggcucacagugcagagggaaugacagacacccugugagcugaucucugugauauggugucauaacauuacaggagggguuugaacagagugcugagaguacacagcuacucacucuguuuacauuggagaagguucaggcauuugccggccauuuuaggcaggaagaauaauaugaacaaaagaauuauuauguacuuccuguaccucauuuuugaaguuuuuaaucucuucacugacaauuuauguugaaaauauuuuuuaaaaauaaucugcuugauuuuagcuuuauaaaucugccccauccuaugcccuguaugaugcaaaauuagcuaugauaccgccuuuugauucauacuaacaucccucugcugagaccuuaaaggcuuccuuuccuuuccagaaaacugcugauguaagccaaauggaauuuuaaaauauguauaugcuuuuuuuccuucuuucagaugcguggccagaaaguucuuauauuuauggauucgaaugacuuuuggaagaguauuucccucuaaagccagguaguauuagcucagaacaacauaauuguguugaguucauucuaggguuuucuuuuauauuaagccuguauauaaacuucauuauggcuugugcuguuacauuccuccccagccuccaguagguagaagcagucccuaauauaaccauguaauacagugguaacuucauaucuguuaguugacugcagcugcauucauggugagcugugaauguuaucuacaaaguagccaguaaagguuaaguuuuaguguucagugguguggccuuuagcuagcuacuguggccuucagcuucaaagaaaaagaaagaaaaaaaaauaacaagcaagugaccaaaugaaagaaucaggcagggcgccguggcucacgccuguaaacccagcacuuugggaggccgaggcgggugaaucaucugagguuaggaguucgagaccagccuggccaaccuggugaaaccccgucucuacaaaaauuagccgagcagccaggcaugguggcucaugccuguaaucccagcacuuugggaggccaaggugggcgggucaccugacaucgggaguuugagaccagccugaccaacauggagaaaccccgucucuacuaaaaauacaaaauuagccggacgugguggcgcaugccuguaaucccagcuacuugggaggcugaggcaggagaauugcuugaacccuggaggcggagguugcgaugagccaagauugcacaguugcacuccagccucggcaacaagagcgaaagucccucucaaaaaaaaaaaaaaaaaauuagcugagcaugguggcauaugccuauaaucccagcuacucgggaggcugaggcaggagaaccacuugaacccuggaggcauaggugguggugagccgagaucgcgccauugcacuccaggcugggcaacagagugaaacuccaucucaaaaaaaaaauaaaugaauaaaaauaagaauaaaaaagaaucauacuuaaguaaaucaggauagauaagaucucucugggaaaaguguuugcccaagagaaguaauugagcucuuucagggcacuggugagacugacagauuggcuugaucaagugcagaaccugggggaaaaaauuggcuuuggcaaaggaaaugaaauuuuagugaggagcaaauuccucugucauagcuucauuuuguauagaccagugcugcccauugcugugguuuuggguuauaauugcuuuagcugcagugcuaagaguggacugcaagagagagucacaggagucagggacaccauacagaaggcaggggagcuggagagaagggaccagugcgagguauguuuccaaaggagaauuggcagccuuugagaauguaagcacuucuuaaaaacugaaaugucuuggguucccuccugcuccccucuuccccuuuucuuucccuuacuguaaucuuuccuguuucauuuuuugacagucugacuccuucauucaaugucucucaagccaacuuggccuguguguguuuucugaaaucuuuucuuuguauacuuuaugaggggcccugcuguuccaucucuuccuuuuuguauguuuacagugaagcuccugauguggcuauguuacuggccaggucuagguccauucugcccaugugugguaaaucaaucacugugacacagguuuugcaaaagagaaaaaacuuacuugcaaggccacugagcgaggagguaggagaacaggucucaaaccggccuccccaaagauaagccuuagggauauuuguggguuagggaauuggggugguuuaagguguggggaaaggugauuggcaguggggaaaaugcaguaacauucauugcacacaaguguagucaggguucauggcaugucauaggacacguguacagaaaauagaggcguuaacaugauccaaggguggaguuuuuggcccucaggcaucaaaagucccucucgggcuccuucacaggcccaguugaaggguugguggucucuaucaguuugaacuguacaggagcuagcccagguuuccugaagaauaacugaagugaccauugccauggugaccuaugaauguuaucuacaaaguagccaaugaagguuaaguuuuaguguucgggccgggcgugguggcuccugccuguaauccuagcacuuugggaggccaagacaggcggauuacuugaggucaggaguuugaaaccaaccuggccaacauggugaaacuuugucucuacugaaaauacaaagaaauuagccaggcaugguggcaggugccuguaauuccagcuacuagggaggcugaagcaggagaauuguuugaacccgggaggccgagguugcagugagccgagaucaugugacuguacuccagccugagcaacagagaaucugucucaaaaaaguuguagcguucagugguguggccuucagcuucaaagaaaaagaaacaaaaaaaaaaagaaacaagcagcgaccaaaagcaagcagggcagcugagcugaucauguuacucccuuguuuucagcuguagccugucccagcugcaagugcuaggcauuguucaccucuauuuuaccuucuucugaaucuugggcaugucauccuucacugccuugguagcucuucagugccuuaaauaaauuuuuuugcucugcuuuuuuuguuguucauugggagaauugaucuaaauugcuauugucagaauucucucuuuuuuguuuaauuuauugcauauucuauucuccacuguuagcuuagaaguuauauucuguuuuacucuuccuuuacugacuguccagauaaguuacaaaugugaauguguauuuucauucaaauacaaauguauauuuguaacuuaccagaaucuaauguuaauugguucuuuacccucuuccuagauaagacagaguccuuagaauacuuuagcucugcccaucucccucucuuuguguauauuuuuaaaucuauaaagcauuauuacucucauuuuauuuuauuuuauuuuuugagacagagucucgcucugucgcucaggcugcagugcaguggcacaagguuuuaccauguuggccaggcuggucuugaacuccugaucucaggugaucuacccaccucggccucccaaagugcugggauuacaggccugagccacugugcccagccuauuauucucauuuuauauagccaauauuuauuuagauuuauucacauauuuacccuacuuacccuuccuuuuucauuuguuuuucuuuuuuugcccuaacauuacaacaaauauuuacccuuucuguugccuuuuuucuuucuucucacaucuccagguuucuaucugugauaauuuuccuucuccuaucagaacgucccaggguauucucuuucggguaggucugcuagugagaaauucucucauauuuugucuaauuccaucuucaccuuggaaggauauuuucacuggguaugaaagucugggcugcugguuuuuucccagcaccucaaagauauuccaucacuguccuauggcuuccauuucuaagcuguuagucuaauuuuugcucuuuugaagauucauugcuugucuuaguuuucagaagcuuggaauuuauuuucuuauaaucuuuuaucucauuuugagauuguaaacaagguuuuuuuuuuucuuuuuuguggacaaaucuucuggcauacuuguguuuauauauguguuauucugcuccuuaucuucuuuccucauauaacuucaaaugcuuuuuuuuuuuuuuccugagaccgcaucucacccuguugcccaggcuggagugcagugccaugaucucagcucagugcaaccuccgccuccugaguucaagcaauucuucuaccucagccuuccacauagcugggacuacaggcaccacacccagcuaacuuuuuuauuuuuaguagagacaggguuucaccuuguuggccaggcuagucuugaacuccugaccucaggugaucugcccaacucagccucccaaagugccgggauuacaggcaugagccacggugcccggccucaaaugcuuuuuuauugcuuuuuuuuuuuuuuuuuugagacauaguguugcuugcuccguugcccaggcuggagugcaaugacgcgaucucggcucacuguaaccucugccuuccggguucaagcgauucuccugccuaagccucccaaauagcugggauuacagaugcgugcuaccacacccagcuaguuuuuguauuuuuaguagagacagcauuucaccauguugaucaggcuggucucgaacuccugaccuugugauccgcccgcccucaaccucccaaaguguuuggauuacaggcaugagccaccgcgccugaccuuuuuuuuguuuuuucuuuuuuuucuuuuugcugagacagagucucgcucuguugcccaggcuggagugcaguggcgcgaucuuggcucacugcaaccucugccuccuagauucaagcaauucuacugccucuccugccucugccucagccucccaaguggcugggauuacagacgugcaccaccaugcccggcuaauuuuauugcuuauuuuuaugugaaauuaguuuuccugaauuuuaguuuuuaaauuuauaugucuuuauauauuuuuuagagacgaggucucgcuguauugcccugcaguggugugaucauagcucacugcagccuugaacucaugggcucaauuaauccuucugccucugccucccaaguagcugagacuguaggcacaagccaccacaccugccuuauuauacugaacuuuuagagugagucaagguucgguuaaguuuuacuaauuucauagaacuccuucuucuguuguuuuuguuuaggguucaaaaauauaguggcuuuuuuaaugggguauccugguuuuguucccuuaccacacuuggucuggauuuucuuuuuccuugucucuuuugacccucuccugcucaaauuuuuuucuacccguggcuguuucuccuccauaugaagcccuguccuagaaggguacccuggcagaugaguuuugagauucccuaggggcuggacugcucuagcuguuucaguucuuaugugagcccucgugcuggagaggauaaaacucauaguuucagcugcuggucuuaaauugggccucuguaccuuccaacaacagcucauuggcuauuuuaggguucuccuguuguuagguuccucagaugcuacucggggauccaaagauugaaaacuguguugcuaccuccacuauuuuccuaaaauccguuuuauuuauuuauuuauuuuuugagacgaaguuuugcucuuguugcccaggcuggagugcgguggcacgaucuuggcucacugcaaccgccaccuucugggcucaagcaauucuccugccuccgccuccugaguagcugggauuaaaggugcacgccaccaugcucugcuaauuuuuuguguuuuuaguagagacgggguuucacccuguuggccagaguggucucaaacuccugaccucaagugauccaccugccuuggccucccaaaaugcugggauuacaggcauaugccaccaugcccggcccuaaaaucuauuuuuuacucaauuuuauuuaucuauauuugacccauauuugacugggaaccucuuuucaaauaaugccuuccaaguccuugggaaaugcugauuguauguuagaaguacauugacucuaagagaaagccuaacaauggcugaaacaaauugagauuuguuuuuucuguuuuuuguuuuuuuuuuuaaaauuaacuuuuuuuuuaccuuuagagacagggucucacuauguuuuccaggcuggucuugaacuccugcacucaagcgauccucccugcucugccucccaaaguguuaggauuacaggcaugaggggauuuacuucuuuuuuuuuaacaagccaccuggagauuggcaguuacugguauugcuucagcuguucagugaugucguuuuagacucaggcuucuaguaccuuucuaguucaacauccuuagcacauuggcccuuuguccucauagguaacacuucguaguugcaagaugacuauucuagcuuuacacaggaagguggggguaaggguggcgucaguuugaucucuuuaucaggaaagaaaacuucccuggaaguuccccacugcauucugcuucugccucauuggccagagcuuugucaccggccaccuuuagcuacagaggagguuuggaaagaaaucuuucuggccucuguaguggauacuuacgagaaaaagggcuuggcaguggguguuggguuagccagugacugcuagcuaaccugcuacauugcuuuaaaacauucgcauuaugcuguuuuucaugucuucgcucuucagugguaggcggguguagaggaaagaauacuggacuagaauuaaggagaccugagcuucgguucuaacccaggcccuagcuaauuguuugaucugaggauaguuacgccuguaggccucaguuuugcaaauuacaaaaugauagagugagaauauuuguuuucuaagcagcuaccagaauuagaauucugauacuguguuuccauugacuuagaaauuugugaagggauaguuauuuucuaauaucuauauaucaauaucaaauaucaaucuguuaaaaucaaguagguucuuuguuacuugggggaacauugggcauccugaucuuuguuuuuaggcuuuuuccauacugaguuauuuauuucucaauuuuaggaguguuaggcgggaauaauaucauaccacaaacuacagaauaaugccuuuaugugcuuagauaauguuuuagcuuuguuuuuuguuuguuuguuuguuuuugagaccgaguuucacucuuguugcccaggcuggagugcagugacgcgaucuuggcucacugcaacuuucgcuucccggguucaagcaauucuccugccucagccugccaaguagcugggaccacaggcaugcgccaccauggccggcuauuuuuuguauuuuuaguagagacgggguuucaccauguuggucucgaacuccuaaccucagaugauccacccaccucagccucccaaagugcugggauuacaggcaugggccacugcacccagccuuaaccuuuuuuuuuuuuuuuuaaguacaauuuccauuuuauuuuucucuggagaauaauuuuucuucaguccuuaaggacacaguuucuuaacggguuuuagugggagucauggggcaacgccugcaggucgaaauggagguguggguauucaguccuagcagccuucaugagauugauuucuaacuacuuugcugugaauggcacaacucacauauuaagguagcuucauauauggcuuggguagcaccuaggcaucaaagauccucacuucagaaaugucccugacugcugcagccucuacuguguuucaaaugaugaauuucuccuguuuuuguuaaagucacuacauuugcuaaaaucaaugaugaauuccuaaacuuucuuuaacuugaccuaccagguagcauuagagaguccaucauuuccuucuucuagaauaccuuucuucucccagguucuaguuaccauccucuuguguuuuuucuccuaccuguuugacugccccuucuaacucuccuuuguugauucuuccucaucugaauaucccaacaccuagucuuugcacugcuucucuagcugccucacaaccaaaaucucauuaaaucucacagugauucucagauguguaugcccagccaagaccucugccuugaaacucuggacuuuuacguacgugacaacuccacugggugucacaccauaguaugcccgaaacugaaaucgucauccucccccucucagugaguggaaacuccauccuuccaagugcucaggucagaaauggugaagucauccuucacaccucuuguucuuucacaccccaauuuaaaaugccauaugccaaaaucauguugcuucaaccuucaaaaugcauucagaauccagccacuuuucagaccuccaguagcuaccacccaguccaagccaucagcaucucucccccgagugacuccaauggccccucauuggucuccugcuuccugucuugccccuagucaguaucuucucaggagguagucugaguaaaucaagucacaucauucugucaaacuuccaguggcuuccugcugaaaguaaaagcccagaguccuuacuguggucuauaagaccaaccaacuuuuugugucaccuauugaguuuguuuuucauuucugcugucauauuuuuaauuuccgagagcuuguucuuguucucugcauguucccuuuuuaauuuccaaaagcuucuuuuguucucugcauguuuccuuucuuuuuaauaguauccuggaggcucaaaauuuuuugaggauaaugugguuuaagauuuuuaucugcuuacacuguguuucuucuaagauccuuuuuucuuuguauuuuuggucacucugucauguuggagccuuuccucaaaugucaagagauucuuuauugucuguuuauauuuaagagcaggacccuaaaaagcuuauuuuagaagccuuuuuuuuuugagacagggucucacucuugccuaggcuagagugcaauggcauaaucucagcccacugcaaccucugccuccuggguucaagugauucuccugccucagccuccagaguagcugggauuacaggcaugcaccaccacgccuggcuacuuuuugaauuuuuaguagagaugggguuucaccacguuggucaggcuggucucaaacuccugacuucaggugaucugccuuaccucggccucccaaagugcugggauuacaggugugagccaccacacccagccagaagcuuuuauauguaagcaugaagacuuauaacuugaaggcuucacuguaggcuuuuggggcagauuucaccagggaaucuagcugucugugucucugaaggccuuuccccuuagguugaucaguuuuccccagacaaaagagauacccucuaacuccuucuggcacggggugggggggugggauugagaugaaggugguaauuuuuuaauuuuuuaauuuguuauuuauuuauauuuuauuuuauuuuauuuauuuauuuauuuuuauuuuauuuuauuuuugagacagagucuuacucugucacccaggcuagagugcaguggcgcaauugacucacuguaaccuccaccucccagguucaagcaauucuucugccucagccuccugaguagcugagaucacaggugcccaccaccaugccuggcugauuuuuguguuacuaguaaagacgggguuucacccucuuggccaggcugguauugaacuccugaccuugugauccacccaccuugaccucccaaagugcugggauuacaggcgugagccaccgcgcccagccuacauuuuuuuuuuuuuuuuaaacagaguuuuacucuguuacccaggcuggagugcaauggcaugaucucggcucacugcaaccgccaccucucagguucaugcgaguugccugcuucagccucccaaguagcugagaccauaggcaugcgccaccacgccuggcuaauuuuuguauuuuuaguagagaugggggucucgccauguuggccaggccggucucggacugcccucaagugauccacccaccuuggccucccaaagugcugggauuauagacaugacacugcauccagcugaagguguuaauuauaagcuuggcugcaagcagggaaagggauggugggugucauuguucaguuuguagacuuuuggucuaggaccaucucccaagcuuugccuaguauucuggaguccaguucuccucuggcucgccucuccggagauauaccugagucuuugcuugagugaauaugagugaauaaugggauccaggggccuaaccacuucugacacauaggcuugcaaacaguccuguguuuucaucucaguccacagcuccucgccuccugaugcgucucauuuccaccccuuucuggggccugugccaccagcugggugcuucuugucucccuucucccccuacaagaagacacuuaguucucuccuuuaucuggugauucaucugccacucucuugccuaaaauugacuaaaauuuguugacggcucuugucugucacccuuucuccuauucucuuggucuuuuuaggcuuacaccuuuuugaauacauuugcuguuauuuaaugcggcguggggaauggaaggagguaaaugguuauguucauuucaccaugugcaaacgguuccuuuuuauuacaauuuuuuagaauuguaggccaggcgugguugcuugcgccuguaaucccagcacuuugggaggccguggaaguggaucacaaggucaagaguucaagaccagccuggccaacauagugaaaccccguuuguacuaaaaauacaaaaauuagccaggugugccuguaauuccaguuacucaggaggcugaggcaggagaauugcuugaacucaggaggcagagguugcagugagccgagguggugccacugcacuccagccuagguaacagaacaagacuccaucucaaaaaaaaaaaaaaaaaaaagaauugugaauaaaucuguucaacagucuuucaaauauuauagaaauguacaguuuaggcugggcauaguggcucacgccuguaaucccagcacuuugggaggccgaggugggcggaucacgaggucaggagaucaagaccauccuggcuaacauggugaaaccccgucucuacuaaaaauacaaaaauuagcugggcauggugguggguaccuguagucccagcuacuccggaggcugaggaaggagacuggcgugaaccugggaggcggagcuugcagugagccgagaucacaccacugcacuccagccugggugacagagugagaccccgucuuuaaaaaaaaaaaaaaaaaaagaaauguacaguuuaggagccagucuccuauaaucucucccccaccccccgagagagaaccacuggcauuaguuugauauucuggagucuuuucaggcuuuuaauguguaugauguaaucauuuauguaugcauacacacaugcuuguuuauauguacacaaauguguguguguguguauauuugauguauuccaacauaugggugcuauaaauacauaaaaauaggccgggcaugguggcacauaccuguaaucccagcacuuugggaggccacggcaggcggaucaccugaggucaggaguucaagcccagccuggccaacauggugaaaccccaucucuacuaaaaauacaaaaauuagcugggcauggugguguaugucuguaaucccagcuacaugggaggcuuaggaaggagaaccgcuugaacccgggaggcggagguugcagugaacugagaucgugccauugcacucuagacuggacgacaagagggaaacucugucucaaaaauauauauauaaauacuauuauuuauuuauuuauuuauucauucuuugagacagagucucacuauaucauccaggcuggagugcaguggccugaucucagcucacuccaaccuccaccuccuggguucaagcaauucuugugccucagccucccaaguagcugggacuacaggcaugcaccacaacgcccagcuaauuuuuguauuuuugguagagaugggguuucgccacguuggccaggcuggucucaaacuccugagcucaagggaucugcccaccuuggccucccaaagugcugggauuacacgugugagccacugugccugacuuaauuuuuuuuuucuuuuuuuuuuuuuugagacggagucucacucugucucccaggcuggagugcaguggcgcaucucggcucacugcaagcuccgccucccagguucacgccauucuccugccucagccuccugaguaguugggacuacaggugcccgccaccacaccuggcuaauuuuuugcauuuuuaauagagaugggguuucaccguguuagccaggauggucucgaucuccugaccucaugauccacccgccuuggccucccaaagugcugggauuacaggcgugaccuaauuuuuuuaaaaagauaccauauuauacauaccacgcagugacuuuauuuuuucaccuaaucacuuucugaggcaucugucccuucaguacccuuagcucugcuucauucauagaaaaugagcacauggcauugauuaauuguauuaaccuguccucuuuugauggguauuuguggugguucacucuucucuuauuauuauuauaagcaauagugaggugaauuaccuuauguaugucuuuguaagcuaguuuuuaaaaaccgugaguggaauugagcaugguggcucaugccuauaaucccagcacuuugggaggcugaggccaguggaccacccgagcucaggaguucgagaccagccuggccaucguggcaaaaccccaucuuuacuaaaaguacaaaaauuagcugggcaugguggcacacgccuguagucccagcuacucuggaggcugaggcaggagaauccuuugaaccuaggaggcggagcuugcagugagccaagaucgcgccacugcacuccagccugggcgacaaagcgagacuccaucucaaaaaaaaaaaaaaaagaaaaaaaacuaugaguggguuaggaggagugacauguuaguaaccugcagaaccaugaaaagaaauuuaaagugauugacaggccagugugguggcucaugcuuguaaucccagcacuuugggaggccaaggucagcagauugucugagcucaggagugcaagaccagcaugggcaacauggcgaaaacccgucucuacugaaauacaaaaaauuagcucguuuggguggcgugugccuggagucacagcuacucaagagacugaggcacgagaauaacuugaaugcaugagguggagauuacagugagcagagaucaugccacugcacuccagcuugggugauauagcaagacugucucaaaaaaauuuuuaaaaaaucagcaccaucugucacugcuuuucuguguuccuuauuaccuuuuuccugacuaauuucucuuacucaucuuuugcuguuguuaugacuccccucuucagauuucagcuaaauuaauauccuguguuccuguuaaguacuaggaauauuauuaggcauuuacuuauuuuauaaguuuaauuuccuauguuuguaaauaagacauuacuacuuuuuaguaauaaaaauauuuuucauucuggugaaugaaaaaaauuaaaaauaauaauuuucaauucacuucaugguguuugaaaagucagauuuugggagaccaagggaggaggaucaccugagcucaggaguucaagacuagcuaggguaacauagugaaaccgugccucuacaaaaaauaaaaaauuagccaggcauaguaguggagcaugucuguagucacagcuauuugggaggcugagguggaaggaucacuugagccugggauguuaaggcugcagugagccaugacuguaccacugcauuccagccugggcaacagagcgagacccugucuccaaaaaaaagucagauuuuuauuuuacuuuaacaucuuuaaucgguaaaaucaauauuaaaaaauuuuuaaccucauuucuaguuuaaguagcucugagauucugaccugaaaaagccaaauauaucuauuuucccucuuuuuaaguuuuuuugauuguuuaagagacaaggucuugcucuguugcacagaccagagugcagugacacauucacggcucacuacagccuugaccucuggggcucaagcgauccucccacguaagccucuggaauagcugacaccacaggugcgugccuccauacuuggcuaacuaaaaaaauuuagggggggcuggauguggugauucaggcauauaaucccagcauuuugggaggccgaggcaggcagaucaccugaggucaggaguuugagaccagccugaccaacauggagaaaccccaucucuacuaaaauuacaaaauuagcugggcgugauggcacaugccuguaaucccgcuacucaggaggcugagucagggaaaucgcuugaagccgggaggcagagguugcgaugaaccgagaucacaccauugcucuccaaccugggcaacaagagcaaaacuccgucucaaaaaaaaaagaaaaaaaaaauuuguagagcuggguacaguggcucaugucuguaaucccagcauuuugggaggcucaggugaggauuacuugagcccaaggguuugagaacagcuuggguaauacaguaagacauugucacacauuuuuuuuucuuauuuuuuggguagagauggaguuuuuaauuuaauuuaauuuaauuuaauuuaauuuaauuuaauuuuauuuuauuuugagacgaagucucacuuuguugcccauguuggagugcaguggcucgaucucggcucaccacaaccucugcccccugguucaagcgauucuccugucucagccucccaaguagcugggacuacuggcgugcaccaccaugccuggcuaauuuuuguauuuuuaguagagaucggguuuuacuaugcuggccaggcuggucucgaacuccugaccuugugauccaccugccucggccucccaaagugcugggauugcaggugugagccaccguguccagcuuuuuuuuuuuuuuuuuuuuuuuuaauguauuugagacaggcucuuacucuuucgcccaggcuggaguacaguggugcaaucucaguucacuggaaccucucccuccugggcucaagcgauccucccaccucagccucccagguagcugggacuacaagagcaugcccccgcuaugccuggcuaauuuuuuauuuuuuguagagauuggguuccaccaugucacccaaccugguccugaacuccagcaguccaacuaccucagccucccaaggugcuggcauuacaggcauaagccaccacauccagcccuagauggagucuugcuauguugcccagguuggucuugaacuccuggccucaugcaguccuccuaccuugaccucugaaaguguugguauuacaggcaugagccaccaugccuggccucuauuuuuaaucuaucuugguguuuacuuuuucuuuuuuuucuuugagagggagucuugcucugucaucaggcuggagugcaguggugcagucucagcucacugcaaccucugccucccggguucaagcaauucuccugccucagccuccugaguagcugggacuacaggugcgugccaccaugcccagguaauuuuugcauuuuuaguagagaugcgguuucaccauguuggccaggaucucuugaccuugugauccacccgccuuggccucccaaaguacugggauuacaggugugaggcacugcgcccgaccgauguuuacuuuuuuuuuuuuuuuuuuuuaguagagacgggguuucaccauguuagccaggauggucucgaucuccugaccuugugauccacccgccucagccucccaaagugcugggauuacaggugugagccaccacgcccggcuguacuuuuucaugagacggcaagaauaugugauuugggaagagauguuagcuccaacaucaucauauauauauaugauuuuuuuuuugccguagauuuuacuaugagcagcgauuacuacggaaggucuucgaagaauggaaagaggagugguggguuuuccagcacgaguggaaacucuguguucgagcugacugucacuacaggucagguuucauguuacacuccuucaguuuuacugaugcacauuaucagaugauuauuuguuggcguguuuauggucaaaagaagcaaacuuugggucacuuuugguuuuucuucaaauccuuuuuggaguuagcaagaucagaguuccaaauuaaacccaagcaugcaugcacaugcugggcacgugcacacagacacacacacacaccucccacaccucuaauucagguaaccauuauguauugguuaugcuaauacuuugaaugggauuuucccaccgauuuucauuucuauauaauuucucauucugaaaguauucuggguuuuuuguuuguuuguuuguuuuguuuuguuuugagacagagucucacucuguugcccaagcuggagugcaguggcacgaucuuggcucacugcaacuuccgucuccuagguucaagcgauucuacugccucagucucccaaguaauugggauuacaggcaugugccaucacgccuggcuaauuuuuguaguuuuaguagagacaggguuauuucauguuggcugggcuggucuugaacuccugacuucaggugauccgccugccuuggccucccgaagugcugggauuacaggcaugagucaccgcgccaggccuguuuuuuuuguuuuuuuuuguuuuugagauggaauuucgcucuuguugcccaggcuggagugcaauggcgccaucuugacucacugcaaccuccgccgccuggguucaagugauucuccugccugagccucccuaguagcugggauuacaggcaugugccaccacgccuguaauggcguguaaugaugagguuucuccauguuggucagucuggucucaaucuccugaccucaggugauccugccaccuuggccucccaaagugcugggauuacaggcaugaaccaccacacccggccuuguuuuaaaaauaauaaauuguggccgggcaugguggcucaugccuguaaucccagcacuuugggaggccgagaugggcggaucacgaggucaggagaucgagaccauccuggcuaacauggugaaaccccgucucuacuaaaaaauacaaaaaacaaaauuggcuaggcgugguggcaggcgccuguaguuccagcuacucgggaggcugaggcaggagaauggcgugaacccaggagguggagcuugcagugagccaagacugcgccacugcacuccagccugggcaacaguggagcgagacuccaucucagaaaauaaguaaauaaauaaauuguuuuaauuuacauugauuaugggagaaaauauauggggaaggccgagugugguggcucacuccuauaaucccaguacuuugggaggcugaggcggguggaucacuugacguuaggaguuccagaccagccuggccaacauuggugaaaccuugucucuauuaaaaaacaaaacaaaacaaaacaaaaauuccagccuguacaacacagagaaaccccaucucaacuaaaauacaaaaaaaaaaaaauuagccgggcauggcggcaugcgccuguaguaccagcuacucggaagguugagacaggaaaauuaauugaacccaggaggcggagacugcagugagucgagaucgcaccacuguacuccagccugggcaacaaagcaagacuccgucuccaaaaaaaaaaaaaaaauuagcugggcaugguggcaugugccuguagucccagccacucgggaggcugaggcagaagaauugcuugaacccaggagucggagguugcagugggccaagaucaugccacugcacuccagucuggacgacagagugagacucugucucaaaaaaaaaaaaauucuuuuuuaaaugaauguuaauaaaauauuuaaaacuaggaaaauaugaagagaugaaggucuuaagauguauaguguauguaucaagaagaaggaaaaggugucaaugagcauauuguagugcaaacgagaagugauguuuuuuacaguguggauaguuaagauaauuaggaugugacugucggccaggcaugguagcucacaccuguaauccuagcacuuugggaggccagggcaagaggaucacuugagcccaggaguucgagaccagccuagggaacauggcaaaaucccccucuacaaaaaaauacaaaaauuagccaggagugguggugcguuccuguagucccagcuacucugaggccaaggugggaggaguaccugagcccagggagggcucaaggcuacagugagccauguucacauuacuguacuccagccuaggugacagagugagacccuguguaaaaaaaaaaaaaaaaaaaaaaaaaaagacaagauugucauuccaaacaucauggauuuuuuuuuuuuuaauugaauuugagacagagucucggugucacccgggcuggagugcaguggaacaaucuuggcucacugcaaccacugccucccagguucaagccauucuccugccucagccucccuccugccucagccuccugaguagcugagacuacaggcacaugcuacuacgaguggcuaauuuuuauauuuuuaguaaagacgggguuucaccauauugaccaggcuggucucgaacucccaaccucagguggucugccugccucagccucccagagugcugagauuacaggcgugagcuacugugccuggcccaaacaucaugaauuuguggaugaugaaagugaacuuauucuuggagaagucaagccuuuucuuccucagugacacuuuaagguauagagaaugacucuucuucaaagagaauagaguucauugugauuguaggaaaugaaauuuuagcuuuggugcagauauggcuuuuuuuuuuuuuuaaucagaagcgucccuguucauuucuucugaguauagaacagacuugguguguuggguuaggaguuguuuuguuguuguuguuuguuuguuuguuuguuucuugagacagagucuugcucuguuguccaggcuggagugcaguggcaugcgaucucggcucacugcaaccuccaccuccuggguucaagugauucuccugccucagccuccggaguaggugggauuauagacgugugccaccacacccggcacacgguauuuuuaguugagaugggguuucaccauaucggccaggcuggucuugaacuccuugccuuggccucccaaagugcuaggguuacaggugugagccaccgcgcccggccuguuauuuugaagaaaugccauuuacuuuuuuuggcuccucagguauuaccuguacaaccugauguuccagacguggaagaccuaugugcgucagcagcaggagaugaggaacaaguacauuagagccgagguucauggugagaaaaagaaguccaugucugaagaagaugcccacauuuacuuugcagaaggucauaggaaggacaaacacauugucucagagagagaggaacucuaggccaaaggaagauuuguuugauucucuuucauauuuuucagaaagugugaucucugagugggcaccuguaugauugaucccuaugguuuucuccauauggcaugguuugagcccuuaaaacucauuuaaucagaauuugugugaacuggcuguuccuggccugcugguucagugggcuggcugugacucuccuguggcaccuggggcugccaucuaucuugcugcgucaaguugcccagagacucuggagcagagcugcagugcucuuuucugaucugcuuugcucaaguugucccuuagugauacuguggccacuuuaggucuggucagagucugguuucucuugugaauugagcccagaaacacauggagagucuaagggaaaaagaccuagaguuucaaaaugauaauacaggcugcauuagcagcagaauguccuaaagguagcucaaacucugcaagucacaaguacaaccugucaacuccccuaccacuuacaccugcuguuccuuugacucuucugucuaggaagacuuacuuaggaaugguguccauuccucaugccucaugucaucacuuaccuaaucuuuuaagaaggcccucugaggcaucacuugcaaucaucguugcauugcuacugccugagaguaauccucaucuuuuucccagaguguuguaagugccacuucauuaaucucccucauuuauuuuuucgugcuucucauuguacacauagcugcaagagugguaagacauagauaagaucaugacacuccuuuacguaaaguuaacccugcuugguaugucguacaaggucuucauuucuucugcuuugcacccucugcccuugacacacuggaugugcacuucuuuaucuuuccaucuuugucccuguaguucuuccuucaggcccauuuaaauguguagcuuuccuugaucucccccagcccagugaucuuuccccugucuguauucccaaaguaugagaagcucuuacccaagccucaugauuacugcaccaaaugcacuguuucacugguaaguaacuuacgcuguuuguuguuuauuuuuuuaauacauacaguaagauucauucuuuuugaaguucaguucuaagacuuugauacacacuaccacauacagcuaaauuuuuguauuuuugguagagaugggcuuuugccauguugcccaggcugguuucaaacuccuggacuaaagcaauccaccugccucgcucucccaaagugcuggcaauacaggugugagccacugugccuggccuuaaguuuaauucuauaagaaacuggcaagguuuuuuaucauggcugugccauuuugcauucccaccaguaauucacgagaguucuacuugcucugcauccucuugaccucuuuguauugucauuaaaauuuuuucuuuggccauacuaauagguguauacaggcauuuaauuguggguuuuuaaaaauugguguuacaugaguauacugcauaaugauggagauuugacuguccacuacccaaauagugaacguuguacaugauagguaauuuuucaacccuugggccucuuccacccucccuuccccucguuuggaguccccagugucuauuaucuccaccuuuaugucuguguguaccaacaguuuagcucccgcuuauaagugagaauaugugguauuugauuuucuguuucugaguuaguucacuuaggauaauggccuccagcuccauccauguuggugcaaaggacaugauuucauucuuuuuuauggcugggugguauuccaugguguguauuuucuuucuuuuuuuuuuauuugagacugucucacucugucacccaggcuggagugcaguggugugaucucggcucacugcagccuccaccuccuggguucaaguguugcuucugccucagccucucaaguaccugggacuacaggcgugugccaccaugcccaacuaauuuuuguauuuuuaguagagacaagguuucacuauauuggccaggcuggucucaaacuccugaccucagugaucugccugccucggccucccaaaguacugagauugcaggcaugagccaccacgcccggcugugguguauauuuucuguaucuguugauggaugcugagguugauuccaugacuuugcuguugagaauagugcugcagugaacauaugagagcaggugucuuuuuaauauaauaauuucucuucguuuggguagauucccgcuagugggauugcugggucgaauggugguucuguuuuuaguucuuugagaaaucuccauacuguuuuccauagagguucaacuaauuuauauucccaccaccaguguguuaaguguucccuuucuccacgugcaugccaacaucuguuauuaaacuuuuuuuuuuuaaagacaggggaugucuugcugugucacccaggcuggagugcaguggcuuggucauagcucacugcagccuugacuuccugggccaaguaauccucccaccucagacuccugaguagcugggaccguaggcaugugcuaccacaccuggcuaacuuuuuauauguuauggagacagggucuggcuauguugcccaagcuggucuuggaccccugggcuccagugauucuccuuccucagccuccaaaagugcuaggauuacaagcauaagccacugcacccagccuaacuuuuuaauaacagucguucugacuaguguaagaugauaucucauugugguuuuaguuugcauuucucugauaauuagugauguugaguaucuuuuccugugcuuauuugcuauuuauaucuguuuggugaaguaucuguucaugaucuuuuguccuuuuaaauuggguuguuuguguucuuuuugagauuugaaaguuuuuuguuuguuugguugguuugguuuuuuuugacacggaaucucacucuugcccaggcuggagugcaguggcgcaaucucggcucacugcaaccucgaccucccggguuuaagugauucucccaccuuagccucccgaguagcugggacuacauggugcgcuaccaugcccagcuaauuuuuguauuuuuuuuuuuuuuuuuuuuuucaguagagacaggguuucaccauguuagccagggugaucuggaacuccugaccucaggggauccaccugccucggccucccaaagugcugggaccacaggggugagccaccaagcccagcugguuuuuuaaaauauguauucuguuauaagcauuuugucaaagcaugauuugcuauguuuucuccuagucugugacuugucuuuucauucucuuaacaguaucuuuugcagaggaaaaguuuuuaauuuugaugaaguccauucuauuuuuuuuuaauggauuauguuuuuuuuuuuuuuuuuuuuuuuuuuuuuugcgagagucccacuguugcccagguuggagugcaguggugugaggauaacccauugcagccuggaacuccuaggcucugaccucagccucccaaguagcugggacuacagacaaugccccaccauaccuggcuaaguuuuuuauauuuuacagagaugggggucuugcuuuguugcccaggcuggucugaaacuccuggccucaagcaguucucccacuucggcuucccaaagcccugggauuacagucaugagccacugugcccagcuggauuauauuuuuucauauccuaucuuagaugucaucucuaagaacuuugccuuaacccagggucacaaagauuuccucuuauguuuucuccuaaacauucuguaguuuuacauauggaucuuguauauccugcauccuugcuaaguuaauuuauuauuucuuuuucuuuuuucuuuuuuuuaaauuuugagauggagucucgcucuauugcccaggcuggagugcaguggcacgaucucggcucaccgcaagcuccaccucccggauucacgccauucuccuaccucagccucccaauuagcugggacuacaggugcccaccaccccgcccggcuaauuuuuuguauuuuuaauagagacgggauuucacaguguuagccaggauggucuugaucuccugaccucgugauccgcccaccucggccucccaaagugcugggauuacaggcuugagccacugcgcccagccuuuuuuuuuuuuuuucagauggagccucacuuugucacccaggauggagugcagaguggcgugaucucggcucacugcagccucugccuccuggguucaagcaauuaucuugccucagacuacugaguagcugggaguaaagguaccugccaccacgcccggcuaauuuuuuuuuuguauuuuuaguagagacauuuacugcuauaaaguucucuuaaacacuaacuauauuacacgaauuuuaauaaguuauauuucuguuuucauucaguaaaaacuuguuuucugauuuucccugagaccucaucuuugccccacagauuauuuagaaguguguuuaguuuucuaauauuugggaguuucccaauaucuuucuguuaaggauuucuaguuuauucuauuauugucagagaacaagacuuaguaugauuucaguuccuuuauuuuuguuaagguuuguucuguggccccaaauaugcucuaucuuguaaauguucuauauuuacuugaagaauguacauucugcugucuuauuuauaguuacagugaaucuagcuagauauuauggaauagaaggaaaaagucacuuggaugacuuuuuuauaggcgguggcucacgccuauaaucccagcacuuugggaggcugaggugggaagauugcuugggcccaggaguucgagaccagcccaagcaacauggcaaaaccucaucucuacaaaaaaauacaaaaauuagccaggugugguggugcaugccugcagucccagcuacucaagaggcaagaguuauuucugacauaagacaaguuauuucaggccauuccccuagaccucagggaguguccauucacucuuggacuguuaaaugaaaaguuugcaaguacuuuuaggccuuaaggaagcaugguucucaguugucacgugcaucagaaucauggcagagacaguuaaugagauuccuguguuccauacucuggaaagagcaguuaguguuuauuuuagauauuuuucauaguuaaaucaucucauuuacacuuuccaaacauaacucugagagaggcaccauuuuacagaugaggaacuuguaugagauuagguguguaauaaaugaaagggccaguaagucuggcuugucuuacucaggaucccaaacucuaaaccacagcacuauacuaguccugauuaccugaaguaugcugauuccugagguccacagugaaaccaaggaagauacauguuaaauucuccuucguauguugauuugucuugucaacaacugugaaauauauaguuauaguccugucgacuacaucuuggaggcuguccuaaaaaugauuuauauaauuuuauuuucuccuuugucuucuaaaaagaagagaaauuugcuuauaagugguaauuuacuuauuaguggugacuuucauaaugaaaauacaauuuaccacaaagggagaccugugggccauugcaucuuccauaucuaguaaauuaucuuuucuuuacuaaaaagagugagcuuggagucaaacagcaaguuuuauaucaugauuucuucuucuuuagcuuuguauuauggaaaacuuuaaauaucuauacaauugaaauuuuuuuuucuuuucuuuuuuuuuuuuuugagacggagucuugcucugucgcccaggcuagagugcaauggcgugaucucagcucacugcaaccucucccucccagguuuagcaauucuccugccucagccuccugaguagcugggacuacaggcgcacgccaccacaccuggcuaauuuuuguacuuuuaguagagaugggguuucaccacguuggucagguuggucucgaacuccugaccucaggugaucugcccaucucggccuuccaaagugcugggauuacaggcgugagccacugugcccagacugaaagauauuuaauagaauaaugaaccuccauguauccauuacccagcuuugauuaucacucaugccauuuuuguuagauccaucucuccacuucuuugcugccuguuuauucauaucauuucgucuaaaaauugcagaguauaucuauagaaauaagcgcuuuuaaagcaaaggguuuuugagcaguucaguacauggguuuuccuuuaaaugcuuuguaaaugucguuacuugcacagagccuucauguguucuugcacucuaauuaauuuucuagugcuucacaacuuuuccagcaggggucacuuguaggcuggagggauuuagguauucaaaggagagcccuugagcuuuuaucauaacccagaguaauccaucucuccccaugccuuuugaaaaaucucuuuggugaaucuagaugcaaagcaaaagaugcgacaggccuggaaguccugguugaucuacgugguuguucguaggaccaaacuucagaugcagacuacagcucuggaguuuaggcaacggauuaucuuacggugagucugcucaacugcccuacaaaguaccagccaucauuuuaccucaucagcuuuauggugcuggaaaacagcauaaaaccucaccuuaaaacaaugguuuguauuugguuuuauuuuuguguuuuguuuuuuucgagauagggucuuacucugucacccagguuggaguguaguggcccaaucucagcuuacugcaacuuccaccucccagguucaagcaguccuuccaccucagccucccaaguagcuaggacuacaggcaugcgccacuaugcccagcuaauguuuuuuuuuuuuucauuuuuuuguagaggcgagguuuuaucauguuucccaggcuggucuugaguucgugggcucaagcgaucugcccaccucagccucccaaagugcugggauuauaggcaugagccaccaugcccccuucccaccuugaaacaauauuuugaacauaguugaugccuaauaaagauuuacugauaacuuguuuauaagaucgauuuucacauaaucauaauuaacaugaauugagugcuuacuguguucuaaacccuguguuaaguuugugugugcauguguuaauuuuguaauguaaaguaucuuauuuaacccuuaccguaaacuguaaguaccauuauuguacagauuaagauguacaauaaggcucagagagguugaguaacuugccuagcacauacagguuguaauuggcaaaacuagggcucacccacccaugcucuuaacuggucuucugcauugcagcccaucagcauuguagacauacuggaagaacaugaauuaguccacuuuuauagccagauauguaacaaugagcugcauuaucaugggacagauuucacucuauguugucuguaguuguccacugguguccugaaugguaauauauuaauaauucacuuccugccugaaaguuggguauugaacaaaguauggauaauaggagaggcuuugcagcugcacuuacuuggguuugaaucccucuuccaaccuguauuauugggucauuucaucucuucagcucuuauuuuccucaucugugaaauaguuacaccauacuuaaagguuugucaucaggaauaaauaaaguaauaucuguaaaguauuuaacaguguccagaaaaucaguggacauaaagaaguuauuuaaguagaaauaaaauaggcagagugcaguaguucaaaccuguaaucccaacacuuugggaggcuaagaugggaggcuugcuugaggccgggaguuugagaccagccugggcaacaaagccaagacccuaucucuacacacaaaaaauuuuuuuaaauaauuaaaaucauuacuuaaaauguauuuagcaaguauuucaaaaugccuaauuaguaugcaguuuuacuugagucugagugaauuuuuuuuuuuuuuuuaugagauggagucucacacuguuccccaggcuggagugcaguggugugaucuuggcucacugcaaccuucuggguucaagccuuccagguucaagcgauucuucugccuuggccucucgaguagcugggauuacaggcgccugccaccaugcccagcuaauuuuuuguauuuuuacuagaggcaggguuucaccauguuggccagccuugucucgaacuccugaccucaugauucaccggccucagccucuccaagugcugggauuccaggcaugagccaccgcgccuggccugagugauauuuuuauauaauuaauucauuuacucaacguacauuuauuuauuuauuugagacagagucucacuguuucguccaggcuggagugccauggcacaaucuuggcugacugcaagcucugcuuccuggguucaagugauucuccugccucagccucccaaguaacugggauuacaccauaccuagcuaauuuuuuguauuuuuaguagagaugggguuucaccacauuggccaggcuggucuugaacuccugaccucagaugauccacccgccucggcuucccaaagugcugagauuauaggcaugagccaccgggcccagccuauuuauugaggguuuaaaauguucuugguacugggccaggcacagggacucaugccuguaaucccagcacuuugggaggcugaggcuggugaauuaccugaggccaggaguuuaagaccagccuggccaacauagugaaacugucucuacuaaaaaaauacaaaaguuagccugguuugauggugcacgccuauaaucccagcuacucgggaggcugaggcaugagaaccgcuugaacaaacaaggcagacguugcagugagucgagauugugccacuccacugcacccugggcaacagagugagacucugucucgaaaaaauaaaaaaaauggcuuccgcgggaggccuacacaccgccaguuguguuccugcuaugucucuagugaucccugaaaaguuccagcguauuuugcgaauacucaacagcaacaucaacgggcagcagaaaauaggcuuugccaucacugccauuaaggauguggguugacaguacacucauaguguugaggaaagcugacguugaccucaccaagugggcaggagaacucacugaggaugagauggaacgugugaugaccauuaugcagaauccaugccaguacaagaucccagacugguucuugaacagacggaaggauguaaaggauggaaaauauagccagguccuagccaguggucuggacaagaagcuccgugcagauguggagcgacugaagaagauucaggcccauagaggaccgcaccacuucuggggccuucguguccgaggccagcacaccaagaccacuggccaccauggcuguaccaugggcggguccaagaagaaauaagucugcaggccuugucuguuaauaaguaguuuauauaccuaaaaaauauaaauaaaguaauaaauaaguaaaauguuauugguacuguauugaugcuggggcuguauucagggaauuugugauucccuggaugcauaagaagauaagugauaaugugagauagcuugagguuuugcagugagugcugcaagugagccuggucuaagagaaaucuuuguagguuagagugaccaggaaaagugaguguuucuguaaagcacagguuguaaacucuuauuuccccaugacucuuuuccuagagcaaauucgaaaauuaguaggaaaaaaaaaacaagacugaaacaaaagucugaccaggauucuaggaaagaaaaggauacauacaagacuagaaaucuaaaagccacuugauugcagauuauuuugugaaaucuccugauuuucaaauguugguaauacucuuuuuuuuuuuuuuuuuuugagguggagucucacucugucacccaggcuggaguauaguggcacgaucuuggcucacagccaccucugccuccuggguucaagagauucuccugccucagccucccaaguagcagggauuacaggcacacaccaccauguccagcuaauuuuuuguauuuuuaguagagacgggguuucaccaugauggccaagcugguuuugaacuccugaccucaaguaauccaccugccucagccucccaaagugcuaggauuacaggcgugagccaccacgccuggccuuuuuuuuuuuuuucccgagauggagucucacucugucacccaggcuagagugcaguggcgugaucucagcucacugcaaccucugcuuccuggguucaagcuauucuccugccucagccucccgaguagcugggauuacaggagcaugccacuaccaccuggcuauuuuuguauuuuuaauagagacaggguuucacuguguuggccaggcuagucuuuuaacuccugaccucagguaauccacucuccucggccucccaaagugcugugauuacagguguaagccaccguaccaggccauaacauaucuuuuaacaaaucaaacuguguaggucaaacagagcaugucuguggugucuaaagcaggaucugaccguaggaaccauaaguuuccaaccauuaaugggcagaucugggacuuuuucucaauuguuuuguuuuauuuuuuuccccagcagugaaucuagagaugguacuaugaaggagaggacuagagcugagggucugaggccccacacuaacugcuccucucuuuccugaguggcuuuuuacugauggauuccaucuuugauuugcuguuucacagggugugguggagcacguggaggcagcgacuaggacagguccgugugagccgugcccuccaugccucugcuuugaagcacagggcccugagccuccaggugcaggugaguccagcagacgugggauuuggcauccucugucaguguugucaagccucucacccacagagggcagugcugggccuucccugcagcucagggccugagaggggguggggacagagguaaucuggaaggcugggcucuuccagagggaggcugcuguuaggaauaaaguagaggcuuguccuagaugagccuagaucaguggcuuccagagugcuucugguaauuguggagcuggagagggauuuaugaauuaguuauaaacauguuuagagaaacagcaguauacucugauuuccucguugcuguuuuccuacagcaaaucagaaaauaauuggggcagaaaagaaacuuaagacugaaaagaaaaccugucuuccuuuucuuuauaguuuugauugucuuagaguguucuuuuaggcaagccacuagcuuuuuuugucaaucauaaauggcuaaggccuguacuaaaacuuucuuauccuuugacauauucucugaauucuugucauguuuuugugucugcuggguacuuacagagcugccaaauaaguuauaggaaauagaacagagaagaggaaaaaaaaaauuagugccuguuuccaaauguaggaauaguaucuucuuauucuaacaacaaauugcauaguccaugugaauacgugcagaucacaugcaaauagcauauauagucaucuagaucagugaucagcaaacuggcucacaggccaaauuuggccugcuuucuguuuuuguaaauaaaguuuuauugggaugcugcuacacucauucauuuauauaucaucugaggcugcuuucagauuacaagagcaguguaggguaguuguaacagagaccuuauggucuacaaagacuaaacuauuuguuuucugacccuuuaagaaaaaguuugcugaccucugaacuuguaaggucuucugaggcaauagcaaggaaauaagagacacaguucucgccaauaauaauaacaguaccaauagcaguagcaacugcagccugagugacugaguuggggcccugucucaaaaaaaaaaaaaaaaaagaaguagauuuuauuguggucuuacuuguguuaggugcuagacuaagugcuuuacgugcauuaucuaauuuucauaaaccuuuuuuaaaagucccauauuauuguuaagggaaccaggaagguuaaauaacuugaacuagggucacauguauagugaagcuuagagccagguuuuuuuauuuuuuuuugauuuuuugagacagagucucgcucugucacccaggcuggaguggaguggcacagucuuggcucacugcaagcucugccuccuggguucacgccaucauccugccucagccuccugaguagcugggacugcaggugcccgccaccacgcccggcuaauuuuuuguaucuuuaguagagacgggguuucaccauguuagccaggauggucuugaucuccugaccuugugauggccugcaucggccucccaaaguacugguauuacaggcgugagccaccacauccggccgcuuggagccagguuuuaaccuaagcagccagaaagcugcaucaucaucuuuuauauauauauauauauauguuuugagacagaguauugcucgcucugucacccagacuggagugcaguggcgcgaucuugccucacugcaaccucugccucccagguucaagcaauucuccugccucagccucccaaguagcugggacucagacgcaugccgccacgccuggcuaauuuuuuguauuuuaguagugaugggguuucaccguguugcccagggugguugcuaacuccugagcucaggcaaucugccugccucagccucccaaagugcugggauuacaggcgugaaccaccgcgccuggccugcaucauuaucauaaucaccaugcaguauugugcugaauagacuuguaaccucaggagggagauggaacugauaaaugggaaaaugcuauaaaugcagggauacugacuaaacuuauagacugacugugaauauagggaaacuaaacauaaugagacugauuuucugucaucgguggacaacugugcuaguuuucuucccuuucuaagagccacuuugagaggccauaaacucauucuacugaugcuacuguugcucagaacauguuuagaauuccccuuuucuuguuuguuguuguuuguuuuuuuguuuugagacagucucacucuuuugcccaggcuggagugcaguggcacgaucuuggcucacugcaaccccugccucccggguucaagcgauucuccugccucagccucccaaguagcugggauuacaggcacgcgccaccaugccugucuaauuuuguauuuuugauagagacgggguuuugccauguuggccaggcuggucucgaacuccugaccgcaagugauccaccugccccucggccucccaaagugcugggauuacaggggugagccaccacacccagccuacacgucuuaaucuacacagcaucucuaugcacuaggcagguaagacaucaugaaauauguaaaauuuuaauuuuaauuuaaaauuuaaaauuaaauuugguauuucaaacauagaaacacauaaaauauaaaacacuuagaaaaauauuagcagauaggccaggcgcgguggcucacaccuguaaucccagcacuuugggaggcugaggugggcggaucaugaggucaggagauggagaccauccuggcuaacacggugaaaccccgucucuacuaaaaauacaaaaaauuagccgggcgugguggugggugccuguagucccagcuacucaggaggcugaggcaggagaaugacaugaaccugggaggcagagcuugcagugagcugagaucacgccacugcacuccagccugggcgacagagcaagacuccaucucaaaaaaaaaaaaaaaaaauuagcagcuagccaaguacucaccagccucacccagauuuaaaagguguuagcauuuucuauacuugcaaaaaaaaaaaaauuagcagauagccaaguacucaacacccucacccagauuuaaaagguguuagcauuuucuauacuugcuccagaauuuuuuuuaaguuauuuuuugggggacaggaucuuacucugcugcccagucuggagugcagugguaccaucauggcucacuguagucuugaccucccaggcuuaagugauccucccaccucagccucccaaguagcugagaacacaggcaugugcuaccaugccuggcuaauauuuuuuuuuuuucccuuguggagucgaggucucaccauguugcccaggcuggucugaaacuccugagcucaagugauccacccgccucggccucccaaagugcugggauuacaggcaugagccaccaugccuggcccagaauuuuuuuuuuuuuuuuugagacggagucuugcucugucgcccaggcuggagugcaguaucgcgauguuggcucacugcaagcuccgccucccggguucacgucauucuccugccucagccucccaaguagcugggacuacaggcgcccgccacaacgccuggcuaauuuuuuuuuuuuuuuguauuuuuuaguggagaugggguuucaccauguuagccaggauggucucgaucuccugaccucgugauccgccugccuuggcuucccaaagugcugggauuacaggcgugagccaccgugcccggcccagaauuuuuuaaaguaacaaaauuuaauggacacugccaaagcuuuacccucccuccgucccuucuacugccucuccuccuuagagauagccacucuuuugauucugguaugauuguucuccuauauucuuuuuucuuauaaaaauaugugcacauaucuguaaagaauaaacaugugguacacuccuguagucccaucuacucgggaggcuguggcaggaugaucacuugaggucaaguguuugaggcuagccugggcaauauaaugagaccccaucacuuaaaaaggcgggaggggucacgguggccuacaccugaauacuaggacuuugggaggccaaaauaagaggaucacuugaguuuaggaguucaagaccagacuaggcaacauagugagaccccaucucuacaaaaaaaaaaaaaaaauuagcuagacgugguggcgcaugccuguugucccagcuacuugggaggcuuagguuggaggaucacuugaaccugggaggucaaggcugcagugagccauugaucaugccacugcacuccagcuugggcaacagagcaagacccugucucaaaaauaaauaaauaaauaaguaaaugguauggcuuuguguaguuaggacauuuaugaauguugucauacugugcuuugcaacuuguuuuuuuagugcaacgguauauuuuugagguuuagccaugugauuucuuucuuccuuuuuuaaaauagagacagggucuuucucuguugcccaggcuguucuugaacucacggccucaagcaguucuuacaccuuggcuucuuaaagugcugggauuacaggccugagccaccaugccuggcccuaucuauguggauagacagagaucuauuaacuguguauauuaugccauuguauaaacaaggcaccauuuaucugcuuacuuacugauggacuguugacuuccucugcuuuuuagaauuacgaacaguacuaccaagagcauucuuuuucuauuuuuuuuuuuuuuuugagacuccgugcaguggcacaaucucagcucacugcaaucuccgccucccagguucaagcaauucuucugccucagcuucccauguagcugggacuacaggugugcuccaccacauccagcuaauuauuguauuuuuaguagagaugggguuucaccauguuggccaggcugucuugaacuccuuaccucaagugauccgccugccucugccucccaaaguguugggauuacaggcgugagccaccaugcccggcccccaguuucuuuuaauuauucacggaucuguuucucggcucugucuuccauucauguauuugucuauccagaccauaccaaugccauacugguuuaguuacgauuugaugaagcaguaagcaacaguguagguucuugagucagacuguccaaguggaauucugccucuaucaccuauuagcuuugugccuuugaaugaguuauuucaucuguuuguaccucagaauucuuaucuguaaguagauuguaauaguaccuaccucaugagauuauugaggcuucaggaggaugauccaguuauuaauauacucagagcaaugccuggaauguggaaaugcucaguaaaugcuagcuguuuauauuccuacuugacauauaguucucaaggcucuauauuugacagagaaucuccuuuauucuuguuuuguuuuuaaacuugucuuaauuguucuucuguacucuuucuuauuaauuuuaggagcaacuugucaaguucuauaacaaagccuauuaggaauuuuuuuuuucuuuugagacaugucucacucugucacccaggcuggagugcaguggugcgaucucggcucacugcaagcuccaccuccuggguucacgccauucuucugccucagccucccgaguagcugggacuauaggcaccugccaccacgccuggcuaauuuuuuguauuuuuaguagagacgggguuucaccguguuagccaggauggucucgaucuccugaccucaugauccgcccaccucggccucccaaaguguugggauuacaggcgugagccaccgcaccuggccaagccuauuaggauuuuuauuacaauguacugacugacagcuuauuagguuagaaaaauugucauauugagucauuucaucuuugaauuugauauaucucauaauauauugcugagcuugagaaggagaguaggaaggaugagguuaugagguaacagggagccagaacgcagggccuggcaggcugugccugauaaaaaaggcuuugacuuuuauuccugggaaggugaagagcugcuggcucugagcagaggagugacaugauuauaccuaccucuuaacaggauucuuugauucauagugugcugcuuuugggguaagaaagggaaggauauauaugaaugugugucuguguguuuguggagggggggggugugugugucuguuugcuuauauuuucaagaaggaauaauggaaaaauaaaugaaaaacuuaccaaaaaaugguuaccuauaggaggagggagagaaggguauaggaauaaaguacuucugugaauuuacuuuguuacauaguuuuaacuuuggaacuaugcauauauuuuauauaauuacaaagcaagaguaaauaaaaaaacaauugccagauuuucaaaacaaacugaaacgaacauaucaaguuuguggcaaugacuacacagagaauaauuacuucaaguaacuuuaaaauacaauauuuugacuguucacccugguggaauguguuaaaaggacguaaugaacugcuaagaaaucuaaaaccacauucuuaguaaaacaaguguuauuguugcuaggagguuugaaauuguuacauugaaaguauuauaguuacauuguaagauaaagcaaauaauuauggcaguguuguuaggaauaaagaucuucaauagaaaagaaaagauuacaaguauaaaaagcaaagaaaucugcaauuggaacuguaaauaucaauauggacucucucucucucuauauauauauguguguguguguguguguguguguguguuguguguguguguguguauauauauauauauauuuuuuuuuuuuuaccauaaaugcauuucuggucuggcgcgauggcucccagcacuuugggaggcagaggcagguggaucacccgaggucaggaguucgagacuagccuggccaacauggugaaaucccgucucuacuaaacauacaaaaaaauuagccgggcauggugguggugggcaccuguaaucccagcuaccugggaggcugagcacgagaaucacuugaauccaggaagcagagguugcagugagcugagauugugccaacugcacuucagccugggcgacagggugagacccugucucaaaaaaaaaaaaaaaaaaaaaaaaagcauuagaagcagugacaguaauauagcauuuaguauccccagugcccaaguuguggucuuaacuauuucccacuaauaggaaccagggcuuuuuagagaaauggcugauuauagguccggggcaggaaauagacaagauacaccuaggacuaaggaacuuaacaaaagcuaauggaauugugucagaaggacucaggaaccaauuuggaaggguucccagggcuuaagauagaaaaguuugagcaucaaaaaacaauaagcuaggcauaguggugccuguagucccagcuacucaggaagcugaggcaggaggaucacuugagcccaguagauugaaaacaucaaauacauaaaaauucaugcauuugaaauaauuuucaaagaaaguggaacucaucggucaugauuuuggguuguuaggggaguuaacuaaauucuuuaaaaauuaaagcauuuuaauucuuuaaaaauuaaaggcaaaaaauuaagcauuuaucccaccuuuccuauauaaacuguuaacuccaagaaaccagaggguuaaugagagagaagccuucuuuauagaagaauuccaguuaauaaaugcugaaggaauacuagaacuagaaaauugcuguuuugccaccccuaaugaggacauagaucuaggaagccaucacuaggugagaggauggugggaaaauauaggagaaaucuggcuaccugccaucugaauccaccaaacaaucuuggcauugcuacaacuguggcagccagacaugaugugccucaugauacuauguaaggggaaguacccagccacauucaugaacuguucuugccuaaaaaauugaacaugacuccaagccuaaugcaaaucucucaguuuauaggaaauacaggggucagaggaacaaguuaaagacaccucgagguuacagucagccaaauccaaaauguaggacauuuuauaggauagaugacuugauuucucuaguagauugauggcaugaaagagaaaaaaagcaggaagggaaguugucauauaaaacagaacuuuaagugaccuaacaauuaaagcgaaccaaaauggaccacucuggcuguuguguuaggaguacaucagagccaggcgugguggcagaugucuguaaucccagcacuuugggaagccaaggcggggggacagcuugagcccuagcaucugagaccagccugagcaacauggugaaacccugucucuacaaaaaauacaaaaaauuauccuguuaugguggcaugugucuguagucccagcuacucaggaggcuaagugggaggaucaccugaguccgggaaauugaggcuguagugagcuaugauuguaccacugcccucuagccugggcaauggagcaagaaccuaucucaaaaaaaaaaaaaaaaaaaauuagcugggcaugguggugcaugccuguggucccagcugcucaggaggcugaggcaggaagauugcuuaagcccaggagguugaggcugcagugagccguauucuugccauugcacuucagucuggcagucugaguaacagaaugagacucugucaauaaauaaauaaauaaauaaauaaauaaaucagagaugaucaaggauauaaacagggaggacagguaagaagcuauuacaaaauuccaggugagauuuuccacaaagaugauaagaagacggugguuggauucucaaugucuuuaaaagauguaacugacaucuuuaaaagauguauggaugagauacgaaguuuuagcguccaagaugacuuccaaguuuuggccuaagcaguuggaacaauggagugccauuuacugaaauaggaaagacugcaggagaagcagguuugugggaagagauuaggaggagcccaauucuggacucuaucuucagccugauaggccuuuugaauagccacaagaagcuauguuaaggaggcagugggauauugggauauauguguggaauacugaggauggggccaggaugggagguacauuugggaaauucaggaguucuuaguaggcagaugguauguaaaguuacuagagugagcggggugcgguggcucaugccuguaaaucccaacacuuugggacgcugaggcgggaggauugcuugagcccaagaguucaagaccagccugggcaacauagagagaccccaucuguuuuuuuaaaaaaagcuacuagggugggugaaaaaauaaaaggagugaguguagcuagaugagagguuccagggcugagccugcgaggugcacagaggugggagucagcaacaggaacaaagcagggacacaucccgaaagccaggugaaggaaggaggaaggcuuugucagacacuucuggcaggucaagggaggugaggaccaaaaucugaccuuuggauugagcgauguggagauugccgaugcacuugauaagaguaguuucauucaguaagccugugggagcgggcucaagaaagccugccugggagacagaaagauuagaaaauagcucuuuugaggagcuugaaacagaaagaaccaaaguguuagcuggauggcacaaugcggucuagagucuagagagggguguugcuuuguuuguuuaagaaucacugguuuauuccuuucagaaaguauuuuugugauggcagucuuuccccaacaacuuuuuauuacugacaaacaccaaaucauagaaaagguggauacugucuguguuucaccuaguuuaaccgauugugguuuuuugguuugguuugguuugguuuuuuugagacagggucucacucuguugcccagacuagagugcagugguaugaucacugcucacugcagccucaaccuaccaggcucaagcgauccucccaccucagccucccaaguagcugggacuacagguacacaccaccaugccuggcuaauuuuuuuuuuuuuuugguagagacagaguuucgccauguuucccaggcugggcucaaacuccugaggucaagcaauccuccugccuugggcucccaaagugcugagauuacaggugugagccaccccgccccaccaacccauuguuaacaucuugccacauuugcuuucuuuaaguauauaaauacauuuauuuugucugagcugcucuaaaauuguagacacaaaguuuaucuuaaaguguauaucuccuaaaaaggauggucucccacauaaccauaauaucauuauuauauuccaagaaauuuaauauugauauaauauauaacaugcaguucauauuaaaacuguauauuguugcuauuuucauuuccauagucuaauuaaaggucacccauugcuuuuaguuguuacaucuugaagauuuuuuuuuuuaggauaggaaaaauaauagcacauugauaugcugauuucaaaaaucuauagagagugaaaacugaugauucguaagaggggaacugccaaggcaguaaacucgggaaggugagagauagccagagcuggacaggguugggaggggacugacguuggugggagcaugggcgguucauccagaguagcaggaaagagagaagacagagcccgugggcagguggguaguuaaacaugguggaccuuaaggaaauuuccuuuugauugcuuuuauuuucuuagugaaaugggaacgaugguauucaguugagaggagggaaaggagaggugcgacaggcugaagaaaagauaugaagucuuugucuaagucgucuucagauuaggacaugcauuaucacugaucuaagggugugcauuuauagacccuuguagacccuuagcuucuauauauaggcaucccuggaacuaaucugccugaaaaaggacuacuuuacaguaggcuuccucugacuuuggaagaaaaggcagacccucacuuaucccaaaucugaauuaauuauaucaccccucggauuguuucugcuccuugucugcuuguuuuuguuuuuguuuugaguuggucgcucuugucgcccaggcuggagugcaguggugugaucucagcucacugcaaccuccacguccuggguucaagugauucuccugccucagccuccugaguagcugggauuauaggcacccaccaucacgcccagcuaauuuuuuguauuuuuaguagagacgggguuuugccauguugggcaggcuggucucaaacuccuaaccucaggugaucugcccuccucggccucccaaagugcugggauuacaggcgagagccacugcaccagccaucugcuuucugcuuguugauuuuauucuucuuuuuuuuaauccaggaaaaaauuacuuuugaaagcagaaugucccucuuaaagacccuuuuaccccacggucccauagcuuaucauccugcuaggggauugccacuuccuuguuucuaauuucagccuuuccagcgugugugccuuucucuuuucccucuccaccuguacuucacccuguuuuccugccucuccuuugacuguugccucuucucugguuuucaggcuuggucacaguggcgggaacagcuccuguauguccagaaggagaaacaaaagguugucucugcagugaaacaucaucagcacuggcaaaaacggagauuucuaaaggccuggcuugaauaccugcaaguccgcagagugaagagacagcagaauggugaguaggaagcuccaggcucucgagauagaggaucuggucacaguuucacucuccugcugccagugguacuguacuaagaaguaauauaauggugcuacuccagaaauuuugguaaaaggagauuaaggaggaaaauacaucauccuugagucacauuuauuucucuuugggcuuuuauuuauauaucuguaucuauaucuaucuagcuaucuguagauagauuuuuuuuuuuuuuuugagauggaguuucgcucuugucacccaggcuggagugcaguggcgcaaucucggcucacugcaaccuccgucuccuggguucaggugauucuucugccucagccucccuaguaguugggaucacaggugcccaccaccucgcccggcuaauuuuuguauuuuuaguaaagaugggguuucauaacuuuggccaggcuagucucaaacuccugaccucaggugauccgccugccucagccucccaaagugcugggauugcaggcgugagccacuguuuccggccucuucuguauauuuuuuaucuaaauaggguuuucauuuugcuauaaguauuguaauuauuuugauuaauauguugauaaccuaugguuuuguaucuuccuuuuuuccacacaguuaaucaacacuucccuacaucuuaaguauuugucguaaauguuauuuuuuaacaacuauucauauuuuauaggauggcuuaccuuaauauacuuagccauucuccuauuaauagauauuuggauaguuucuguuugucuccaguuaugcaaaugcaugugauuuugauguugaguuuuuuggauacuguuuauaugguuuuguuucccaauuagauucagaaguaauaauacauagaaaugugaacauuaguacacuuuuuaacuuaaguuuauugaguuuauaccaaaguaagucaagcacugugcuagacacuggguuaagggucucuggcguucacccaaaccucccugcagaaaucucuuacgcugccaacacugucucuugggagaguuugaauauguucauuggaggauagugaccccagaccaacaguccaguugcccaguccuggaaugugaaggcauuaagcuguuuaguaugauaagcuauagacuaaugccugccuccaauuacagcauucaaauuccaggucugauucccauccccuucccaggcccuagcucaucagaccauuaucugacuagcauuaaaaggagaugaagcuggcagccaggaucagguuggcugaaagcucaaaaaagccuaugccagcguggcaacugaauuuuaugucauugacucaaucucuaaguccuauccaggagacauuuguuuagaagcaaaaguaaaacaguccuuuuugaaaguaacaguuuucauuucuguucaucaguaucuaacuagaagccucagcccuuugauguaacugauuuuauagcauccuccucccuaaaaucacagaccuuuucucuuuccuuggagagaggagauguagcucagggauuccuaaugaccuuucaagguuuaaaaaacuuguauuuuggccgggcgcgguggcucacgucuguaaucccagcacugugagaggcugaggcgggcggaucacuugaggucaggaguucgagaccagcuuggcuaacauggugaaaccccaucucuauuaaaaaugcagaaaaaucagccaggggugguggcacaugccuguaauucuagcaacuugggaggcugaggcaggagaaucgcuggaaccugggaggcauagguugcagugagccgagaucccgccacugcacuccagccugggcaacagagcgagacuccaacucaaagaaaaaaaaaaaaaaacuuagugcguguguguguguguguguguguguguguguguguguggccuugaaccccugcucucugccaguagugggguucagcuugucuuaaagauguuuccagcucaucuaaccuuaggggaguagcacuuaaguuauuucucuguugcagagauggcugagcgauuccaucaugucacugugcuccagauauacuucugugacuggcagcaggccugggagcggagggagagcuuguacgcucaccaugcccagguggagaaacuggccaggaagauggcccugcggcgcgccuuuacucacuggaaacacuguauccuuucagauacucaggcuguccauugccucagccaggacagcaugagcucagcagcaugugaaacgaaagucaugagauacaugggaaacaauugccaaacgauucaaaacagccuuaucucuguugacagucuuaaaauuuuuguuuaauugggauuguguauaaaaagagugcuuauauauaguuuaaaaauaauaaaaugaacaacuauauaucuuaucacccaacuuucaaaauagaaccuuccuagcacaccuauuugcuccucccugacugcguucuuuuucuuuucccucagagguaaucccacuuuccugauucacauuuuuugguguuacaauuuaagugcuuuucucuacccacuaggugguggaaauagccaccacuaucuuuuucuuggugauaccaucaccgugaucauaguuuccauuuauugcgcuuuuacuacguagcagacauuaugcaucauccucuucauccucauagcaacgcuguggaguaggugccacuauuaccauuuuacagacgaggaaagagauucagaggagcugaguguauucuaaagucacaggucauuggcagagucaagauuuucaaaaccuaggccuuuaacuccuguguacauauucuuuuuuuuuuuuuuugagauggacucuugcucugucacccaggcuggagugcagugguacaaucucggcucacugcaaucuccgccucccagguucaagcgauucuccugccuuagccucacgaguagcugggauuacaggcaugugccaccacgccuggcuaauuuuuguauuuuuaguagagacgggguuucgccauguuggccaggcuggucucgaacucuugacuucaggugauccacccaccucagccucccgaagugcugggauuacaggcaugagccagcguacccagccucuuuuuuuuuuuugagacagagucucgcucugucacccaggcuggauugcaguggugccaucucagcuuaccgcaaccucugccucccggguucaagugauuguccugucucagccuccugaguagcugggauuacaggcggccaccaccaugcccagcuaauuuuugugcuuuuaguagacaugggguuucuccauguuggccaggcuggucucgaacuccugacccaaagugauccacuugccucggccucuuaaaguacugggauuaccggcgugagccaccgcguccagcucuauguauaaacucuuuuuuuucccuuuuuuuuuuugagauggaguuucgcucuuguagcccaagcuggagugcaauggcccaaucuuggcucaccacaaccucugccuuccggguucaagcgauucuccggccucagccccacgaguagcugggauuacaggcaugcaccaccauguccggcuaauuuuuuuguauuuuuaguagagacaggguuucuccauguuagucaggcuggucucaaacuccugacgaccucaggugaucugcccgccucggccuuccaaagugcugugauuacaggccugagccaccgcacccagccauauucuuaaucacuaccccuaccauacugugugcccaagugugagaauuuggacugccuaggauguucauccacacauuuuauuuguucaucaaagucuugcuuuguauaaacuccugcuuaaauucugggauaugaggaagcucagacuaaugauaguucauugucuagugggggaaauagacaugaaaauaugucuuuaaauauggcaugauaauuccuaucauaaagauuuguaugaaguccugugagagcgacuguggagauucagccaaggagguaauguuugugcagagucuaagucauaggagaugagaaguugggaagguugaugucuuaggggaagacugcagaagguuggaaaaggcauuucagugaggaaaagcauucaagaauccagugggcuguggagguagggauggugggaagguagaugcaggaaccucuggagguuuuuuaacuuuuaaaaauuuagagacagggucacauguugcccaggcuggagugcaguggcuuucacaggcgcaaugguagcucacuacagucuugaacuccugggcuuaagcaauccuccccccucagccuacgaaguaggugaaacuacaggcacacaccaucacacccggcuucagggguuuuuaagaagagaagaggcugggggcaguggcucacaccuguaauccaagugcuuugggaggaucgcuugaacucaggaguuugaggcuacagugaacuaugauggcacccuugcccuacagccugggugacagagugagacccagucucuuaaaaaagaaaagaagugcagucagauuugugcuuuggaaaggauaauucuggauuagcggagagaggcuagcacuggugggagaccaguuaugggaggaggcucacuuaccagucuacguaagggacgaguuggaugaacugcaggguguuggggguggggacagaagagcagaaggggauggagagagccaagagauuuaggaagggaacagauggacuuggcgaccgauuagaugagagugggaggagaaaagguuugaaaauaacuccaagguuuuuagcucaaauaucuaacuggauugugaugccaaaacagagacuauagaaaaaggagcagauucugcuuuagauauggugauuucuaaauguuuacugaaauugauagcaguuuaucucagguauuuuuugcgucucaucucaugggcauucaaggggaggaaugcaagaccagauguuugaucaguaacugacaggguuucccuuugcccacugcuucccugggucaucaggaguagacagagguggaccucagcccaccuggcacguguguuauccccgauagccacggcccuucaagguggcuugcugagaaugcacuguguaggggucagaaccuuguugggacuggaggccuucacuuccuggcagacaugcugcugugugcagaagaagcugcccaguuugagauggcagaagagcaccacaggcacagccagcugguaagagcccugcauccuggcacggguccgcuuggcagccuugcuuggguauccacucuugggggacccugaccccuaucaccuucauuaaaugcagucagcuaugggugaguuuuggucaugaagcccuccuuucauuguggguguccuucuuuucauuuuggauuacaggugcuaauguuguagggucagagggguauggagcuguaaaggaaccucagagauuauuuaguccugagcuuuuuuuacaugguaaaaccccuuuugaguggcggaagccucaccuauaaaauaggucaaaguagccaugcugugguugaagcacgucagggaguccgucccuguucuaccugcuacucuucccuucccuugcuacacgagguggucuucauauguuuucaggagccucuggggcuccacaaagcacaguacgaaaaccccuaauccagucugauaucuucacuucugucucagaaaauugaagccuaaggcauggggaaguaugggcaaaucagcuuugcuuagccaauuugugaggcauuauuauuauuuuuuagagaugcggucucacuauguuguccaggcuagauucaaacuucugggcucaagcaauccucccaccucagccuccugaguagcugggacuauaggcaugugccaccaggcccaguguugaggcauuaguauuauuaucauuacuauuauuauuagagauagggucuccucugucacccaggcuggagugcaguguuaaaaucauagcuugcugcagccuugaacuccuggacucaagugauccuuccacuucagccucccaagcagcugggaccacaggcacaugccaccaugcccaacuaauuuuuuagauuuuuuuuuuuuuugagacagagucucgcucugucacccagccuggagugcaguggugcuaucuuggcucacugcaagcucugccuccgggguucacgccauucuccugccucagccucccgaguagcugggacuacaggugccugccaccacacccagcuaauuuuuuguauguuuaauagagacgggguuucaccauguuagccaagauggucucgaucuccugaccucgugauccgcccgccucggccucccaaagugcugggauuacaggcgugagccaccacgcccggccuaauuuuuuaguuuuuuuauacagacggagucuccuucuguuggccaggcuggucuugaacuccugugcucaagcaguccuccugccucagcauccuaaaguguugggauuacaggugugagccacugcaccuggccuuuuaggcauuauugauggagcuggauccagguccauccuggcccaacuccaacccuuccuuucacuaaagauuccuucuuccauuuuagcagcacugcauuuauaaucauacaaauguaugcacugagcccacaugguaaaaaaacaaaaaccaccacagacaaaaagucugucuucuccugagaggcaacaguugauguuuaccuuggucuguagaauugucaugugggucaugggguucuuuccugguguggguguguuuguucuugugcaguauagauggacagcagggaggguucagcaaauauuuauuaagugccugcugugcaggcuggcuuguguuaggcucccaguugaaucucaaagcagagaaacacucagggagauggaacagcuacaagaagcugugaccaagcuucuccccgcugauuugaggcacuguuugccuuccucuacucuuaguuuacagacucuacugaucccaguccuuguaaucaguuguguccuuucuuugcacaguauuuuugcuuuagagcccuaaaagacaaugugacccacgcucaucuccagcaaauaagaaggaaucuugcucaccagcagcauggugucacggugaggguugucuucuguaucaagggaccucuucugaaggccauucucucucgcucuuuuuuucagucuugccaaauuaagcagaacucuuuuuaaaaaaacuuuuugugcuucaagauuuguccagacugucaacuguaaaaccuuaguuugcauuuucuuucuuucuuuucuuuucuuuuuuuuuuuuuuuuuuuugagacagucuuucucuauugcccagacuguaauacaguggcacgaucucagcucacugcaaccuccgccucccggguucaagcaauucuccugccucagccucuugaguagcugggauuacaggcaugcgccacuacaccuuccuaauuuuuguauuuguaguagagacgagguuucaccauguuggccaggcuugucucgaacuccugacuucagaugauccacccgccucagccucccaaagugcugggauuacaggcgugagucaccaugcucggccuuuuuaguuugcauuuucuuugguaauccauaccugcugauagaaaaacuuguuugaucccauuuuuuuaucuauuugccaagaaauggauaguugacucaaaguucagggacuguggauuuuaaaccugaccuaggggauauagugauacaaauacuuucuuuuuuucuuuacuuauuuagaggcagggucuuguucugucacccaggcuguagugcaguagaucacugcagguucaagugauccuccugccucagccucccaaguaguugggacuacagcuguaagccaccacacccagcuaauuuuuguauuuuuuguagaugggguccuacuauguugccuaggcugaucucaaacuccugggcucaagugaucugcccaccuucgccucucaaagugcugggauuacaggugugagccaccgcaccuggcccaaauauacuuuuuuuuuuuuugagacagggucuugcucuguugcccaggcuggugugcagcugcaguggugcgaucucaacucacugcaaccuccaccucccaaguucaagcgauucucaugucucagccucccaaguagcugggaucacaggugugcaccaccaagcccagcuaauuuuuuuguauuuuuaguagagacggguuuuuccccauguugguugggcuggucgcaaacuccuggccucaagcaauccaccugccucggccuccuaaagugcugggauuacagacaugagccaccaugcccggccccaauaggaggcuuugguuguguuucuauuguaagucuauucacuuccauuguaaguccauuauaaaacaaugguuuguuuacuugaugccaacauauauugucucuacuuucuugguguaggauuuuuuucccuguuacuauuuuaugaaaaauguuuaaacauacagaaaaauaggaaaaaaaaguauaauaagccucuauauagucacuaccuggauauaguaauuguuaauauuugcuauguuugccucauuguuuuuugcugaauaauuucaaaguaaauuauagacaucaugacacuuugcaccuaaauauuucagcaugcgucacucagagacauuuucuuauguaacgacaaugucauuaucaucccuaagaaaaguaacagugauucccuaacauuaauaucuagucaacauucaaauuuccauaguugucuuaaaaaugucuuauuuguagcugcuuuuuacaaaccagaaugcaguuaaggaucacuaacuccauuugguucuuuucugauugauuuuuagcagaaauggauuuuguugcuauauuucuuaaagcuuuuaaucuagaacuuuccuucccccaacaacacuucuuuauuacauuuuauauauauauauauauauauauauauauauuuuuuuuuuuuuuuuuuuuuuuuuuuuuuugaaaccgggucucgcucucgcccaggcuggagugcaguaaguagcuugaucucggcucacugcaaccuccaccuuccguguucaaacuguucuccugccucagccucccagguagcugggacuacagacgcacaccaucacgccuggccaauuuuuguauuuuuaguagagaugggguuucaccguguuggccaggcuggucucaaacuccugaccuuuggugauccucccaccucggccucccaaaguguugggauuacaggcgugagccacgacacccggccuauuauauuuuuuaauugugguaaaagauacaucacuuaaacuuuaucaccuuaaccauuuuuaaguguacaguucagugacauguacauccacauugugcaaucaucaucacuauucaucucuagaacuuuuucaucuugcaaaauugaaacucuguacccauuuccucuuuccucagccccuggaaaccaccauucuacuuucugucucuauaaauuagauuauucuagagaccucauagguggaaucauauaguauuuguccuuuugcaacuggcuuauuucacuuagcauaauguauacuuuuuaaaaugacugccuuuuuuuaaaaaaggacaggccaguuauuuuguuuauacaauuuauuuauuauuauaauaauuauuguuagagacagggucucacucugucauccaggcuagagugcaauggugugauuguagcucaucguagccucauccuccugggcucaagagaauauccugccucaaccuccugaggagcuaggacuacaggugcauaccaccaugccuagccuuguauaauuuuuuuuguuguuguuuguuuguuuguuuguuugagauggaguuucacucuuguugcccaggcuggagugcaauggugccaucucggcucacugcaaccuccaccucccggguuuaagcgauucuccugccucagccucccaaguagcuggguuuacaggcaugugccaucacgcccggcuaauuuuguauuuuuaguagagacaggguuucucccuguuggucaggcuggucucaaacucccaagaacucaggugauccacccgccuuggccucccaaagugcugggauuacaggugugagcuacugcgcccagcccaguguuuuauguuauugauuuaucugauuguuuccuuuugauaucauuuauaucauuuaauuuuccuuuagucuacaugguuccuauaaucguuacaucugagggcuuguuuagauugaaguuaaacauuuaugcgagacuacuucauaggugggaauaugcauuaaaaucaguuuuaauuucuaaaauggcuuucuaaaaugucauugucuucugugggauuaggaauagcuucuucaucuaauuuccauagacuggaagaaccaucuuuuugccuuuuauguuggcccagaauagcucuauaguugagcccucauuaauuuguaugcccacuguauguuggcugcuccuaacugaggucauuucugcuuugggggagcucacagucuguuggaguaaggauucacuguuuuaccuuucaucucaguacauuuccaucuucuuccucccuugcuuuagcugcugcacagguucuggaaccucuggcggucucagauugagcagaaaaaggaaagagagcugcuccccuuacugcaugcugccugggaccacuacagguagggacucugguuucaucccuggcucucagggacuuugugccucugacuuacuguuuuccaggaguaauugcuugcccuucuaugcguuaguguggcagauucagaaaggccugcugggguggagguccugcuguaaaccauuuguuccugacuuuggguuuuuggcugaucagaugggagauagaaugagcauauuugcauugguucuuggccaccauagucugaaguaugugccuggucgcucacugccuugguccuacaggcaucaauauguucacaaguuagaauucaugcauugcuaguguuaaagagaagggucagggacauuugugacucagucuuaaagugugcagggaauguccucaauauuuuagagcuagucauucaguuaaauaaauaaaaacacuacauuucugugaggaaaacucagaauguauaggguggaaaguauaaagggaaaaauaaaaguugccuggcccccucccuacaaguaagaguaagaucuuacuccucagaaggaagcacuacguauaaacuuucuugcugccagaaauguucaauauguccuuccuuucuuugcccuccuuuuuuccucuccccacaguauaaucaacuuaauuugcauaguuuagcuccaauuuugaagcauuuuuuaaugaguuagugagaaucccaauaauaaacugacucauuuagaguuaucaaggcauauuauuccaaacccugguuuacaaaaccuagugugagaggcaacaugucguggacccccagcguuuggccaugaaaccagaaaguucaggauaucuaggggauuucacacauauuuccuaaauuccagagcuacugugcuuucgguggucuaauuagguuuuacaagaaaguugcaacauuuuaggcaauccacaguccaaaaucagagguugacaaauuuuauauuagauaucagguucuuauugccgucucuccuagaaugaaacuaguaagcccauggggugccuuuaacucacaggaaguaacuguaccgcaauuuaccugccuuaaaacaaaguuuuaaaaacuugaaaccugaagguguucuuccuuuuguuucagaauagcacugcugugcaaauguaucgaauuguggcuacaguauacucagaagaggcgguacaagcagguauggaguacuuuuuagcagauagcucuacuggcuuacauucuuggacccauuugcuuuggaaagauucuuggaaaagaccuaugccaagaagucuuaucguucugcuuuggaagagaggguguugaaaaagcucaaagucauuucuuccaguucccaccucuaauaucagaaagucugcauaacucccauuucuuaucugcuaugaaaauacaaguucucucugaaaguacugagcucuuaucagccauucacaucuuuacucaaauucauuuagucucugaguuagccagcccuucacccagugggaccugcaagagguacagggagaggugcagagcauaagugcugcaucccagugcuaaacagugugagacacaugucucccggggguggaggaugugaggucaggaccacaaauaaguaaaggcagauugagaaagauagauucaauuccauuuaagaaauacuuauugagcaacugcuguucuucagacacugcacuaagcacugaggauacaacugugauauaaagucaauaaaauuccugcucucccagggcucauacuuuagcaccagggugacaaaugagugugaccuuacaagcccguucuaccaauugggaguaccugucuggaauguugaagugagaaggauuucaaggccauauuuacacucagugggaaaggguucaguugauggcaucugccauugugagaagugcccccuuuuuggucaucucuggcagugaaacagaggaagacacaaaccaaacuccucccaguuauuuucgugcugcccacccuacccguaccuccaucuucuguuggagucuaacaggugaaucuuuagauucaccuguuagcuaguucccuauaguuuggggauagaauccaaauuuuuagcaaggccuacaaacuccuucgggagcuggucccugucuguuucucuccccuuuccuguuaccacucuguuccuucacaacugcacucugaccaguuaagcugccagugguucccuaaagguccucugugcccuccugcuucucuuuguaccuccaguucucuauuucacacucccuuccagcucagaugucaccuccucccccaggccaguccaccuccaccccuaccccagaggcauagcuuuaucagaacauucaucuuauaguuguucacuggcuucucuuuccccacaggcugugaaguccuuuagaguacagccugucccuuuugccuccuuagcccacagugcuuggcaugggauaugugcuaauauuuggaugaauuaaugcacagaccaacaaaugaacugcuguugauuucuucagaguuuuuuuccaaggaugaucuaagucgauagagcuuggaugcuacagggcauggccucuuuuugcgucacucuugccuccuacacuuaagaaaugcuagagucacugcauucuuugacaugccuuuggauuauguuacuggcuuugaaaagacauugccacuuguuaucuuaaguucauguaauacaaguucaccagaaugcaggaaagccuuucagaaaaagacuaugagugucagaguugaaagguuguauuuauucaagguggagagcagagggucucuuuuauuuccuuccuggaaaacgagcacuccccuugacacaggggcccaacacuggcggacaguccagggucagcguuuucaucucucacacugaucuagcacggccugcuuucaaagguauagcgggucugaaaaaugggaagagcacugcuuagucauuccuaaaccuuuagcuaacaaucugaauaucaccucuugguauagguaucccaggagcacaucagaucuuucuauucuuagacaagauaaaaauauuauuuuuuguggguuucuuccuuuuuaaaaaguaacauacagucagcccucuguaucuguggguuccacauccauagauucaaccaaccauggauaaaaaauauucagaggaaaaaaagaguaguugugucuguacugaacauauucagaccuuuuuuucuugucauuagccccuaaacaauauauaaacaauauagcauaacaacuauguacauagcauugacauuguauuggguauuaugaguaaucuagagaugcauacaggaggacuguguagguuauaugcagaugccaauuuauuuguuuuguuuuguuuuugagacagguuucacuuugucacccaggcuggaguacaguggcaugaucuuggcucacugcagccucacucuccccaggcucaagcgauucuccugccucagccucccaaguagcugggacuacaggugcaagccaccacgcccagcuaauguuuguguuuuguuuuuuuuuuuguagagguggggugccaccauguuacccaggcuggucucaaacucccaagcucugccugccucagcaucccaaagugcugggauuacaggcaugagccacugcacccggccugcuauaccauuuuauauaagauacuugaguauccauggauuuugguaucugagaggggcccuggaaccagucccccacaaauaccaaaggauggcucuuugcagaauggcgaauguuugcuaacuguugaagcuugaugguagggucauggguauucauuauacugucggcuucuacuuuuguuuacauuugaaaaugcccauaauaaaaaauagaaaagcaauguguagauauuauagaaaauuuaggaaguauaaaaagauauaaagaagaaaaaauaaaaccauucaugacauuugauggguaagccugguaucucucuuccucuguuuggguaggaguguauguaccuaucuauucacauacacauacauaugcauacugauccaauuaucuauugcuauguaaaaaaucaccccaaacucagugguauaagacaacaaccauucuauuaugcuuuauggauuaucaaagauugagacaggacuuaaugggaaugguugguuucugcuccaagaucagccucaacugaaaagauucuaauggcaagggguuagaauuaucuagacguuuucuucacacacaucuagauccuggauuagaaugacucaaagacugggcucaacugggaauguuaaccaaagaaccuguguaugaccucucugugaggcuugggcuuccuuacagcaugguggccuugggguagucagcuaucagagcuucaaaaugaguguuccagugaacaagucagaagcucuguggcucuuuguauagccucagaacucacacagugccacuuuuaccaugugcuauuggucagagcagucacuaucccagccagauucaaggggagggaacauagaucacuucucagugaaggaggagcaaauaauuugcagccauguuuuuaaaaccucuacacauuugggcugggcacgguggcucaugccuguaaucccagcacuuugggaggccaaggcaggcagaucgugaggucaagagaucaagaccauucuggucaacauggugaaacccugucucuacuaaaaauacaaaaauuagcugggcgugguggcgcacgccuguagucccagcuacucgggaggcugaggcaggagaaucacuugaacccgggaggcggagguugcagugagcugagauugugccacugcacuccagccuggcaacagagugagacucugucucaaaaaaaaaaaaacaaaaaacaacaaaaaaaacaaaaacauaaaaccucuauacaugcauauaugcuuuuuccccccaaaguuuuggaucauggagacauauaugguauauucuuauguccauugucugucuuccuacugauguaucaguaaaauaguagacuuuuauaauuacauuaauguguaugacaaacacuauaaacaaaaucaaaagauauauuaugggguggggaaauauuuaagauuuauaacacaugacaaaggacuaauaaauuguuuagguucaaaaaccccauacauaucacugagucaaaugcuaacagacagugaaacagguaauggguaugaacaccuaagccagggggaagagagagugagugagaguguguguaugugugugcguguguguguguguguguguguguagaaauguuuaacuaauguuuaagugaaaauuuuuuuaccuauccuauuucauuuuucaccuagcauauuggcaaagauaauaaauaaugauucaucuuuuucucauuuuuauuauauaggaagcaauccucccacaagggugugacccugagaggucauguuuaaaaaaaaaaaaguuaaguacaaagguuauucauucuuuuacuuuagcugcuacaggccagagcggauggucauuuccagcagagagcccugccugcugccuuccacacauggaacagacucuggcgauggcgccaccaggaaaauguccucagugcaagagcaacacguuuccacagguauguugcgcagcuccugucugcacuggggcagguguuucaaaucuaacucugacaaccacacagcccauuugcugugcuuuucagcuucccagaccccaggcccuaguacuuccuggauuuucaguaaugugggcucauugauuucaucuagcaggaaaagacaagacaguguuuccccugggaaaucuuuuguccaucuuuauuuauuuauuuuuuuuguguguguguauauauguauuuauuaaaaaaaauguguaguguuuaaucugaacagccaguggcuuagucaaguuaacauauacaugaagagacuuauuaugaggaauugacuuacacuauuauggaggcugagaaguuccaugaccugccaucugcaagcuggagacucaggagaguggguagugcaauuccagucuguguccaaaggccugggaaccaaggggccucgagguguaaaucccaguugaagggcaggagaagaugagaugagaucugcccacgcaggcaggcaggaagcaaaaggggcagauucuuucuccuuuuguucuacucaggcccucaagggguuggcugaggcccccguacauuaggaagagaagucugcucuacugagcccacagauucaaaugcuugucucaucugcaaacacccagaaacacuguuuaaucugggcacccaguggcccagucaaguugacacauagaauccaccaccauggaguagagagaagucacagaaucagacugcuuggguucaaauccuggcucuguucugugaccuuggccaagguacucaaaugaccaauucucuaguuuucucaucucugcagugggggaguaauagugcuuaccucaaaggguuauucagauuuugguaauuggcuguugagcuauucagauuuucuaauucuuaugucaauuaaucauuucaaguuuuuuuuugagacagaguuucacuccuguugcccaggcugaagugcgguggugugaucucagcugacugcaaccgccgccucccggguucaagcgauucuccugccucagccuccugaguagcuggaauuacaggugccugccaccaugcccagcuaauuuuuuguguuuuuaguagagacggggcuuucaccaugucagcaaggucucgaacuccugaccucaggugauccaccugccugggccucccaaagugcugggauuacaggcgugagccacugcgcccggccagcguuucaaguuuuuaagagaauguguccauuuccccuucucuuuuuauuuuauuuuuauuuuuauauauauuuuuaaauuugaauugcuucucucuuuuucuugauuaguuuuacuacuggcuuuucuauauuccaacuuuuuucuuuuuauuuauuuauuuauuuauuuauuuauuuuuuuauugauaauucuuggguguuucucacagagggggauuuggcagggucaugggacaauaguggagggaaggucagcagacaaacaagugaacaaaggucucugguuuucuuaggcagaggacccugcggccuuccgcaguguuugugucccugguuacuugagauuagggaguggugaugacucuuaaugagcaugcugccuucaagcaucuguuuaacaaagcacaucuugcaccgcccuugauccauuuaacucugaguggacacagcacauguuucagagagcacaggguuggggguaaggucacagaucaacaggaucccaaggcagaggaauuuuucuuagugcagaacaaaaugaaaagucucccaugucuacucccuuccacacagacacggcaaccauccgaccucucaaucuuuuccccaccuuucccgcccuuccauuccacaaagccgccauugucauccuggcccguucucaaugagcuauugggcacaccucccagacggggugguggccgggcagaggggcuccucacuucccaguagggguggccgggcagaggcgccccucaccucccggacggggcggcuggccgggcaggggggcugaccccccccaccucccucccggacggggcggcuggccgggcggggggcugaaccccccaccucccucccggacggggcggcuggcugggcagaggggcuccucacuucccaguagggguggccgggcagaggcgccccucaccucccggacggggcggcuggcugggcgggggggcugaccccccccaccucccucccggacggggcggcuggccgggcagaggggcuccucacuucccaguaggggcggccgggcagaggcgccccucaccucccagacgggguggcuggccgggcaggggggcugaccccccccaccucccucccagacggggcggcuggccgggcagggggcugacccccccaccucccucccggacggggcggcuggccgggcggggggccgacccccucaccucccucccggauggggcggcuggccgggcggggggccgacccccccaccucccucccggacggggcggcuggccgggcagaggggcuccucacuucccaguaggggcggccgggcagaggcgccccucaccucccagacggggcggcuggccaggcggagggcugacccccccaccucccucccagacagggcggcuggccgggcggggggcugacccccccaccucccucccggauggggcggcugguugggcagaggggcuccucacuucccaguaggggcggccgggcagaggcgccccucaccucccagacgggguggcuggccgggcaggggggcugaccccccccaccucccucccggacggggcggcuggccgggcagggggcugacccccccaccucccucccggacggggcggcuggccgggcggggggccgacccccucaccucccucccggauggggcggcuggccgggcggggggccgacccccccaccucccucccggacggggcggcuggccgggcagaggggcuccucacuucccaguaggggcggccgggcagaggcgccccucaccucccagacggggcggcuggccaggcggagggcugacccccccaccucccucccagacagggcggcuggccgggcggggggcugacccccccaccucccucccggauggggcggcugguugggcagaggggcuccucacuucccaguaggggcggccgggcagaggcgccccucaccucccagacggggcggcuggccggggggagggcugacccccccaccucccucccggacggggcggcuggccaggcgggggggcugacccccccaucucccucccggacgggcuggcuggccgggcugaggggcuccucacuucccaguaggggcggccgggcagaggcgccccucaccucccggacggggcggcuggccgggcggggggcugacccccccaccucccucccggacggcacggcuggccagguggggggcugacccccccaccucccucccggacggcacggcuggccgggcgggggggcugaccccccaccucccucccggauggggcggcuggccgggcggggggcugacccccccccaccuccuucccggacgggguggcugccgggcggagacgcuccucaccucccagauggggcggcugccgggcggaggggcuccucacuucucagacggggugguugccaggcagagggucuccucacuucucagacggggcggccgggcagagacgcuccucaccucccagacggggucucggccgggcagaggcgcuccucacaucccagaugggacggcggggcagaggcgcuccccacaucucagacgaugggcggccgggcagagacgcuccucacuuccuagaugugauggcggcugggaagaggcgcuccucacuuccuagaugggauggcggccggguggagacgcuccucacuuuccagacugggcagccaggcagaggggcuccucacaucccagacgaugggcggccaggcagagacacuccucacuucccagacgggguggcggccgggcagaggcugcaaucucggcacuuugggaggccaaggcaggcggcugggagguguagguuguagugagccgagaucacgccacugcacuccagccugggcaccauugagcacugagugaacgagacuccgucugcaauccuggcaccucgggaggccgagguugguggaucacucgcgguuaggggcuggagaccggcccggccaacacagcgaaaccccgucuccaccaaaaccagucaggcguggcggcgcgugccugcaaucgcaggcauucggcagacugaggcaggagaaucaggcagggagguugcagugagccgagauggcagcaguacaguccagcuucggcuccgcaugagagggagaccauggggagacggagacgagggagagggagagggacagggagagggagagggagagggagguguccaucuuuauuucaagggcuuucaaaacagccuguuuguaaccuucauuauuagccacugagagcuccauuaaagcagcccauuagcuuucuggaucagagcacggugggaccuugccucaccuuggcagacauucuuaagugucauuuccccgaaacacuuaguuccuguucugcuagaccuggcuuuuugaagucuugaaaugauagucaucaacaaaauuacaaaggucgggccgggugcaguggcucacaccuguaaucccagcacuuugggaggccggagcgggcggaucacaaggucaagaguucaagaccagccuggccaacauggugaaacccucucuuuacuaaagauacaaaaauuagcccggucugguggcacaugccuguaaucccagcuacucgggaggcugaggcaggagaauugcuugaacuugggagauggagguugccgugagcugagaucgcaucauugcacuccagccugggugacagggcgagacgccgucucaaaaaaaaaaaaaaagaaaagaaaaaggccgggccugguggcucaugucuguaaucccagcacuuugggaguccaaggcgggcggaucacgaggucaggagaucaagaccauccuggcuaacacggagaaacccugucucugcuaaaaauacaaaaaauuagccgggcgugguggugggcgacuguagucccagcuacucaggaggcugaggcaggagaauggcaugaaccugggaggcggagcuugcagugagcugagaucacaccacugcacucuagccugggcgacagagugagacucugucucaaaaaaaaaaaaaaaaaaaaaaauuagaaagcucaaggagcagaucuacaucuuuuuaguucccacagggacaaacuugcccacagcagguucuuaguauauggugggacauaaugaagaaauaauaauaauuuauuuauuuauuuauuuauuuauuuuugaguuggagucuuguccuuucgcccaggcuggcaugcaguggcaccaucuugacucacggcaaacuccacauccuggguucaaguaauucuccugccucagccucccaaguagcugggauuacaggugugcgccaccacgcccggcuaauuuuuuguaucuuuaguagggacgggguuucaccauguuggccaggcuggucucgaacuccugaccucgugauccacccgccuuggccucccaaagugcugggauuacaggcaugagccaccacgcccagccuguaaugaagaaauuauuaaucacuaacuguaugucugccacuguguugggcauugugugaugggagacagaaaacaaauacauaaacucauucugcccauggcaucauuaucuucauuaauaauuuccuuuucacagugauucugagaggucagguucaaaaugauaaaugguaacacaaccaguaagugguacagccagguuaauucacaucuccaguuccaaaguccaggugcuuucuucuugaucaagaggaagaucuuuuugaugacuuuguaggagggugaaauuuuugugaggagauaagaaacaacugagaaccaauucaagagaacagauccacguguccccagucaugucagccacaaguucuuccagugcucagagcuagugcugagggagacugagcauggaaguaucugggagaggcuuccugugagugagagggugaggaugguggcuggagugggcaagauggggaggcccagacugaagagauugggcugacccuauagauagauauucgaaagauauuugagcagguacauggaacuaguaaaaugacaguuuuggaaauuaccuuaaguucaguguacuuuaucuuaggacagaggggugagauggaggggcaugcauugggagaaguugcagucaucuuuaaucuggaggauuucaggccagguguggcggcucaugccuguaaucccagcacuuugggaggcagagguggguggaucauuggaggucaggaguuucagaccagccuggccaacauggugaaaccccaugucuacuaaaaauacaaaaauuagcggggcgugguggugcaugcuuauaaucccagcuacuccggaggcugaggcacaagaaucacuuuaacccaggaggcagaggcuacagugaguugagauggcgccacugcacuccagccuuggaugacagagcgagacuccaucucaaaauaaauaucucucucucucucuaucuaucugucuauccaucuggagggcuuugaaugcuaguuugagguuagccagaacucuggcuuccuuaguacgaaguccagggagaugguuuuaggugguggccacgggaaauagaggcugaugaaaggacaucucuugucucuucuggcuucugcagacagagcagcuuugccuuuaccuagucauguauugugggcugguauaagauucauucaaaaauggcuucaggcuggacgcgguggcucacaccuguaaucccaguacuuggggaagcuaaggcagguggaucaccugaggucagaaguuggagaccagucugaccaacauggcaaaaccccaucucuacuaaaaauacaaaaauuggccaggcaugguggcgcacaucccagcuacucgggaggcugaggcaggagaaucgcuugaaccuaggagguggagauugcagugagccgagaucgcaccacugcacuccagccuaggugacagagcaagauuccaucucaaaaaaaaaaaaaaaaaauggcuucaguacugaaaacacgcacacacaguacccguuucuaaauggcuucaguacugaagacacgcacacacaguacccguuucuaaauggcuucaguacugaagacacgcacacacgguacccguuucuaaauggcuucaguacugaaaacgcgcacacacgguacccguuucuaaauggcuucaguacugaagacacgcacacacgguacccguuucuaaauggcuucaguacugaagacacgcacacacaguacccguuuccaaauggcuucaguacugaaaacaugcacacacaguacccguuucuuuuuuuacugucaaguagccgugcuugguucuauucuuuuuuuguauuuuguaugcugugagaaccaaaaauuaaaaguaccuuccaaauagccaagaggagccuuuaaaggauuuuugcuagggagcaguuugggugguuuuagagcuaucacucuggagaaaaagggcagagggcgacuuggagacaggguauagccaggaggcuugcaggacgguguaggccugaucuagauuuuuaccuguuuuggcuugguuggaccuuuucaguaaacuugguuuuuuggauuccuguuuuccuuguucaugagcagagugauugagagucuggcuuagaagcuggacaagccugaguucagaccuaugcucugucgccugccagcucugugacccuggacaagucagucugucucucugagccucagucuccucgaauguaaaauugagaugauguggucauagucucuaucucauaugguugucaugaaaaugaaaugggaaaacauguaaaaugcaaaccaagggccuagcauaaaaauaugaacugucccuguggccccuggaguuguuuuaauuugugacucucaugguaaguacauuuucagaggauugguuuggaguuuagcaaauuaaaguuccaaauaaauauguaucuuugauauucuuaggguauuuuuuaauguuuuaggaauauagacagauuuuaugauggaaucucaugaauuauggcuaaaaauaauuuuuauaacccuccagugaaagguacugagaaugagacaaaauugguuugucuuuuauuuuaaucgagauaaaauguguauacagugaaaggcauagauuuuaaauaaaguucgaugaguuuucauagguuuuuuuuuuuuuugagacggagucucgcucuguugcccaggcuggagugcaguggcgugaucuuggcucacugcaagcuccaccuucuggguucaugccauucuccugccucagccuccugaguagcugggacuacaggugcccaccaccacacccggcuaauuuuuuguauuuuuuuuuuuuuaguagagaagggguuucacuguguuagccagaauggucuggaucuccugaccucaugauccgcccgccuuggccucccaaaaugcugggauuacaggcgugagccaccaugcccggccgaguuuucauaauuuaugcaccuauauaaucaacacuccagucaagauacagaacauuucuguuaccccagaaaguuccuucauguccccuccagucagucccuacccugcauagguaaccaguauucugauuuccgucaucauagguuaguuuugcaugguuuuuuucuugucgcccaggcuggagugcaguggcgcugucucagcucacugcaagcucugccucccagguucaugccauucuccugccucagccucccgaguagcugggacuacagacgccugccaccacgcccagcuaauuuuuuguauuuuuaguagagacgggguuucacuguuagccaggauggucucgaucuccugaccucgugauccgcccgccucggccucccagagugcugggauuacaggcauaagccacugcgccuggccuuuuuuuuuuuuuuuuuuuuuuugaugagcagaaguguuugaauucuguuggauugauacaguccaguuuaucuuuuuuuuuuuuuuuuuuuuuugagauggagucuugcucuguugcccaggcuggagugcaguggcacgaucucagcucacugcagccuccaccucccagguucaagcaacucuccugccucagccuccugaguagcugggauuacaagcgcacaccaccacgaccagcuaauuuuuguguuuuuaguagagacgggguuucacuguguuggucaggcugaucucgaacuccuaagcuugugauccgcccgccucggccucccaaagugcugggauuacaggugugagccaccgcgcccggcccaauuuauccuuuuuuuuuaugguuagugauuuuaggguccucccuaagaaauauuugcuacucuaagaucugaaaauauauuuuccuauauuuuaucuggaagcuuuauaguuuuagcauuuacauuuaggucaaugaucaucuugaauuuuuuuucuacauaugauaugacguaggagucaagguuuauuuuuuucuguguuuaucagguuuuuccagcaccauuuguugaaaagccuuuuuuuuugagacagaaucucgcucuauugccaggcuggagugcaguggcaguggcacaaucucggcucacugcaaucuucgccucccagguuuaagcgauucuccugccucagccucccaaguagcugggacuauaggcacacgccaccacgcccagcuaauuuuuguauuuuuaguagagacaggguuucaccauguuggguuggccaggauggucuccaucucuugaccucgugauccaccugccuuggccucccaaagugcugggauuacaggcgugagccaccgugccuagcccagacuaauuuuuuuuucuaauuuuuuguagaaaaagggucucacuaugucacccagucuggucucaaacuccuggggucaagugauccuccugccauggccucucacuguucugggauuacaggcgugagccaccaugccuggcccaguucuguuuagaauuaauauaccauuucauguuuagugcaagaacaugaaaacaauaaaauucuauuuuguccccauccuugaugauauuuuuauuguuguuauuuuuuuuuuuuuuaagaaauaaaucauaguggggauucacuauguuguccaggcuggucuugaacuucugggcucaagacauccuccugccucagccuuucaaagugcugggauuacaggagugagccaccacccccaaccagugguacuuuuugucauacauuuuaugucuaacgauugauugauuguagagacgaggucucacuaugcugcccaggcugguuuugaacuccugaguucaagcaauccuccugccucagccuccugaaguguuaggauuacaggcaugagccaccaggcccagccuacaacguuacuauuuuugcuuuaaauaaucaguacucuuuuuauaaauugagaagaaaaaaauucagccucuuauauuuacccacauauuuucccuuuccaguguuccuugugucuuccuguacauuugaauguucaucuguaucauuucccuucagccuaaagaugaucuuuuaguguuuuuauacuaaggucaacugggguugaacgaucucagcuuuugugucuggucucugcccucuggcugggccagagcuccgucuuucaacccuguccagcuucugcugucucuguuccccucuuggcccugcagcagucacucucugcuaggccuccaggcccucaucugaggaccugggacaaccucaguaaaauuuuggguauuucccucuguucagcugucuccuuucuaguacccugaccccaaauuccagccccucuggcagucaugaacuccagucuuugccuccucagcucacugagacugagggaggcucugcuuagccucccuuccccucacuguuuagaaggugcccccaggcagaaagucugggcggccuaggggcucaccucgcccguguccuaucuuuucagcaucagaaucuacacuuacuguccagcgccugaagacaguugccauauguauuuugucuaguuuugucauauauggccagagggcagauccaggaccagugacuguguucugacuagaaguggaaucuuugcuuuaagugaugugucuugcguguuaaaugucaggggagcaagaucccccagugcugaacauggauccuguggcuucaccaacauguagccccuaguggcuguuggucaauugucccagcacugcugcugcaggauuugauguuguuaauggugaucuguaggccuaggcagagaugacaaaacagugguucccaaaccuuuuuacuuuucuuuacuuuuuuuuuuuuuuuuuuuuuugcaaccucuguggcccaggcuggagugcaguggcacgaucucggcucacugcaagcuccgccucccggguucaugucauucuccugccucagccucccaaguagcugggacuacaggcgcccaccaccaggcccagcuaauuuuuuauauuuuuaguagagaugggguuucaccguguuaggcaggauggucucgaucuccugaccucaugauccgcccaccucggccucccaaagugcugggauuacaggcgugagccacuaugcccggccaaccuuucuacuuuucuaauucaccugaaauacuuguuuaaaauacuauuuccugggacccccccucagacuugcucagucagccuuaggggucugccccuuguuuuucaacagguccccaaagcguuggucagcaugcacuggaaagggcucucaugaacaauccuuuaucagugcuguuaagucaauauagaauuaaugaagaccuggggucucagggucugagucuuuuucguacggugugaaggcuuggcugauaccagaaacaaccuggaaaauguuggccuuuuuaacaguuuaugguuuuuuggcugucugcuuuccuucccuuucucuuuguguugcuuucucccucaucuaagcuuauucaccucuuuuauuuuuuucagagacggggucucacucuguugcccaggcuggaguggaguggcgugaucauaguucaccacagccucaaacuccugggcucaggcgauccccccaccucagccucccagguaguugguacuacaggcacacaccaucacacccagcaauuuuaaaauuuuuuuguagagauggaguuuugcuauguugcccaggcuggucuuggccuccagcgauccuccugccuuggccucccaaaguauuaggauugcagacaugggccacugugcccagccacuuaauucaccucuuauacgauagcaugguauaaaaggaaaaauccaauuauuuggaacuucuaguucuguuuggguuaauuuuuauguuuguuuuaagugcuuuacauucuuccuuguuuuuuagggagacauuagagaagcaaguauuuucucucuggaggcagaagauguuucagcaucgagaaaaccgccuggcagagagaaugguaaauggcugucccugaggagauguguggaggggcaggaucugauucaagccauugcacucacggccuccccuccucaggaaguugcucggaccucacuggagggccccugccugugacuguugaggcagggcaggcucuggggcaucuguccuuucucaguggagccuacagacagcuucugggcuggaccacguccugacauccauuccuuuugccuuagucauuauuuguggccuguaaauucuuuccuggcuucugugccucucuccuacuugauuuauucuguucucuccuuccuguccugccucaggccauccuucacgcagagcgacagcuucuguauaggucuugguucauguggcaccagcaggcagcagcacgucaccaggagcaggaguggcaaacaguggccugugcccaccaccgccacgggcggcucaagaaagcuuucugccucuggagggaaagugcccaagggcucagaacagagugaguggccaguucugccuuacaagccuuuccaucacaggccagcuuugcuuguucuagcagcaccaugagcuccaagugccugucuggaggacugcauuaccccagacucugguuguaaguucuggaaguucaaccuaaaagagucuuaaguaaaacuagguuggccgggcacaguggcucacgccuguaaucccagcacuuugggaggcugaggcgggcagaucaccagaggucaggaguucgagaccagccugaccaacauggagaaaacccucucuauuaauaauacaaaaauuagccaggcgugguggcgcaagcauguaaucccaguuacucaggagagugaagcacggaaauuggcaugaacccgggaagugaagguugcagugaaccgagauggcaccgcuacacuccagccugugcaacagagcgagacucugccucaaacgaacaaaagugaccauagccagggaauaaacugaugggcccauauugugauagcugacugcugcagauaagggauagggacagcagcuguggccaguggguggguuguggcaguuuuuaaccacaccacguaguuaagagagaggaggggaggcagcccagucacuauagagacuguccugcuuuggggccuuucaguguccacuguguguucugaggaucucacucccugucgcacacugaccauguuuaaccaguuucucaguugggggcuucacaccugcacaugugagcuucaauggcaccugaagcccugggaaguuguaggccaaaauuugaucauaggugcuuuuuucugagacugcaaguucuuuggcagcucuucagagagggucuuggcucccccaaaaacuuaaccagguagggcuauggacuaugaggaggaacccauagagggugcccucacugggugggggcugcagcacugagcucugccaucuccccacaggaggacgggcagggugcgggcagcagaauuccacauggcccagcuccugcguugggccuggagccaguggagggagguaaggcuuuggugcgaggugccacccguguaugacuuuuggacaggugggcugugugucagcaggacucacaggcaacauaugggccacaccaccuaccucugagcugaaggaggagaacaggcagcauagaaaguguuaacucaguuuuaugagcugauuuggcucaaaauuuuguguucuuucagauccuaggcuguucuuauuugaacuuacugcaucuaaaauuccugaucuaaccauuuacaggaguccuacguccuacugaguguaaaacauguuuaaacucacauuaauugagcuuuuaccgcaaaucaagcacuuaccucaucaaaucaucacagaaccccuaagaagcacguauuuauagaugaggccagagagguuaauuuacacucacacagaugauguauaaaauggaggcaaagcaggaagccacccccaacucagaccccagcccacgguagcugcuuucuccucugucugcagugccuggcccugcggggagcggagcggcagaagcugaugcgagcagaccugcaccaccagcacagcgugcugcacagggcgcugcaggcaugggugguaggaacugcugcuucccuccugaucuugcuguggggacaggggagguuucuggagacuuuguuuuccuuccuuguucuuccuguccgucccagaacagagucacgugacacaccucaaaccaagcaggugccccggacagcgggccuuaggccauaggguucuuugauucuugcuuggccaaguggaaacaagugcugucuguggguacuagccuuguagcgaaagcagcuccuuucccuggagucccaugguuugacuuaggaggugagggccugugagacaguuucucccugucgucugggagggucugcuggcccugggaccaggggcuguuggccucuuccuacccuuuuugaguucucugggcauggcagccuugugguagaugcaccucugaggccugccuaaacagggggaagugugggcccaagagcagccucagucuuccuuguccccuacagacuuaccagggcagggugcgaagcauccuccgggagguggcagccagggagagccagcacaacaggcagcugcugcggugagucucccgggcgccucccaagcuccagcuggggaacaaggaaugcacuccaaaccccagccuuuuaggggguccugcugagggccaggucggggaugaucccggguuccuagucgcuaauaucauggucuuggcuuuuccacuucacucacggguucgccuucaugucuuaagccccugcugugugcagggcaggaccuuggaaagcagcuguuaccugcaugccuuaaaggccacuugucuugcucuucugagcacuuuuuccucccugcuucacgccuacaaaauucagcuuugcaaggcaccuugucaucucuuccacuccagaggcuucagcgacucccuuuccugucaauuuccaaguaguccccuuccagcuugcucugcaggccugucacugacucuccagcgucaccucuaggcccugucagaccaucugcaccacucaccccuguggagggugcuucugcagcuucugccacucuuucuaagcccaacucuaaccucacuccuucccagcaguccucccacaugcccccuuucauuuccuuccuuuguauuuguucagcacaugauacuccugguggccuauggacagugggucucguggacuuuaaacaccuccauccuuagcugggcgcgguggcucaugccuguaaucccagcacuuuaggaggcuguuugacaccaggaguuucagaccagccugggcaacauagcgagaccuugucuguacuaaauauaaaaaaaauuagcuaggcacggucauguaugccugugguucagguacuugggaggcuuaggugggagggucacuugaaccuugaaggucaaggccacagugagccgugauuaugccacugcacuccagccugggcgauggagugagacccugucucucaaaaguaaauaaauaaaauaaaugccuccaucccucauauggagucccauagagcacccaucccgcucuucagacaggguggaauaagcaagaacucccugagcuaacucagcagcaagcugaggcguaggcaaccuuccuccagguucccugucucuccacacuucucuuaucacagugugagucaccuguguugccacugccugguuaugcccuguuauccccguagcaccuggaguuuggucuccagcagugcugggucccucaugcacucuuggugcccagcccagagcagcugcucaguagccauuuguuggacauagaugugcaaguaaacauagguguuggugaaacagacauucuuagguguagagucccugacucaggaguaggggaagaaguaggaaugauucacagaagccucccuucucucucuauccuggugucaucugccuuccucgcacccaugcaucugcagcggggcauuacgucgcuggaaagagaacaccauggcccgaguggaugaagccaaaaaaaccuuucaagcaaguacucauuacagaaggaccauauguuccaaggugagguauaaggaggcaagcuggucacccaggagaguugggacuguguucuggugagggcgugggauguaggggguggugccagagauuugaacugaauaaggaaccuagaaaauggguaacuuuccuccagcacacacacaaacauccaugugggcacauguuuaguuuuuuacugaauuacaaaccaauaugcauuaaauagaaacauaacacaucauaagugaacuaguucuuaucagaaccaguauuuucuuuuuuucuuuuuuuuuuuuuuuuuuuuuuugagacagucucacucugucacccaggcuagagugcagugguaucaucucagcucacugcaaccuccaucccccagguucaagcgauuucuccugccucaaccucccgaguagcugggacuacaggcuugcgccaccacguccgacuaauuuuuguauuuuuaguagagaugggguuucaccacauuggcuaggcuggucuugaacugaugaccucaggugauccaucugccucagccucccaaagugcugggauuacaggcucuuugaauccaggagguggagguugcagugagccgaauugcaccacugcacuccagccuggacaacagagcaagguugucucaaaaaaaagaaaagaaaagaaaaaauacccgaagcuagccugugccucccuuccccuggaagaaggaacacaggaaucuuugcuuggcuucagagcuugaagaggaggccuuuuuggugggaauggaguucaugacagcucgcagagcaggcaccaggcauucccugggcaaguguuuuguuauugugauuuuguaggcaucacucauacaaaagaauguauacgacguagguguguuccauuuacuaaauaguaauagaggccgggcgcaguggcucacaccuguaaucccagcacuuuaggagacugagucggguggaucacuuggggucaggaguucgagaccaaccuggccaacauggugaaacuccgucucuacuaaaaauacagaaauuagcugggugugguggugcaugccuguaaucccagcuacucagaaggcugaggcaggagaaucgcuagaaccugggaggcagagguugcagugaaccgagaucaugccacugcacuccagcccaggugacagagcgagacuaugucucaaaaaaaaaauuacauauauauauuuuauauauauauaaaaauagaauuaagacccauguauauaaugacuucacuacuuuauggcaugguaugauauguaaauccugguagaagagucccagcagcugaaaugcugggcuuccugugaggggcuggggcccuguccuauugcucaguggucugcgugcaaggcaguuacuuccuggaccgugugugagaagcaaauggcaacagcuuggccuugccucuccaggagccaccgucacagaccugggguggacccggaagccaggagguauagugacucuugcugugcuccuugccugcccauagguccugguccaguggcgggaagcugugucagugcagauguauuaccgacagcaggaggacugugccaucugggaggcccagaaggugcuggacagggguaaguggggccccagaagcaagucauguugaggaaugugaagacagcgcuguuguggagaucccuguggcccgcauaagucugucuccuccucauacaugccaguucccugugguugccaugacaaaguaccacagacugggagucuucaaacaacacaaaauugcccucucaguucuggaggcuggcagucagcgaucaagguguggcagggccaugcuucuccacaggcucuaggggaggguccuuccuugccucucccagcuuguuucuugcuugucauggcuuuccuggacguguagacccauugcuccagucuuugccccaucuugacauaucguucccuuccugugucugggucccuuagaaggacucuggucauaucggaugaagggcccacccuacuugagugugacaccauccuaaccaauuacaucugcagugagccuagugccagauaaaagucacauugugagguuccaggaaggacaugaauacggcagguguggagggggcacuguucaguccaguauaucuuagaaaucuauucccaacugacugccaaccaguuuauguuaaaauggaaggcuagagcuugagaucuacagagaaauaaagaaaagaagcuggaauggaggagcuuggggugguuggggaggggguuguuuugaugggaaaguccuugcugcuugucagggcagcccccaccguguuagcguccugcuuccuuguguagcugggcccuuaaauguuuaggggccagagacuuucuaauucgaucucaggaaguccugcugccugcuguauauacaucuuuggaaagauugcagggcacagugguacacaccuauagucccagcuacuugggagccugaggugggaggaucacuugagcccaagagcuggaggcugcaaugaacuaugaucacaccacugcacuccagcuugggugacagaaugagacccagucucucucuuuuuugagacagagucucacucugucucccaggcuggagugcaguggugcgaucucggcucacugcaaccuccaccucuugggguucaagcgaaucuccugccucagccuccagaguagcggggacuacaggugugugccaccacgccaggcuaauuuuuuguauucuuaguagagacaggauuucaccguguuagcugggauggucucgaucuccucaccucgugauccguccgucucggccucccaaagugcugggauuacaggcgugagccacuacaccuggccaagaccuagucucuuuuaaaaaaucuuuggaaagauagucuagaacaggaguccaugccccugcuugcaagaugcacagacacgcggcagacccauggggagcugucuccuaacacagcuaggggucccauaguaggagaaucugacacgcugaaggggacagcucauuuuuagaauaaaugaaaauacaaauaaaagugaaaacauuuagaaauuguuuaaauuggcccauagagaaauugaccaagugguuaaguugguuuaauagaguuugcuccaggacaaaacugaaucagcuuugguuugguuccgacuguagcguguguguuaaugagcauguuucaacacacauccuggggacaaaacccuggggucagccaucccacacggcugcauuacugcgccacgaaugugcugcuggguccuggagcuucuccucagcucagaaaccagcacuguguuucuaguuuacgaagaaagaagccgagggcuuuagccagaccuugggcucuggagcuucugcaccugacccuuugggcaccugaccgugcagcuucaagcuccagaggcuuuuggccaguuugggucagcugccuuaagggucaggugcccacuccuggccauggugggaaguuagaggcgacggguuugaguguugccggaagccgcugcucucugaaggacuuuccuuagagggaggcgguggcaggcuuggguugccacguccauuacagaugguaugagaggcuugggagacugggcugcaagacaguguacacguaguagguacacaguaaauaccuggggaacaauugacuggcuuguauuaaggccucagugucucaggcacaccuuggcaggccaagggugggacugggaggagggacugaggggaggaugucacaagacccauuaugcagagugcugaagaaguacaggcuggcggucauaaccuggcugugugugugaccuccagcaggcccccucucugagucucaaugucuucaucuguaagauggggauaacagugccuaccucuugggguugucguggagaucaagugagaugacagguagagagauacacacuuaggacagagcccaggcaucagcaugcagcacuaaugugggugccucccacuugugaucugccgccuucccugccugccucagugggccuggagggcuccucaucuuggcaucugugcccugcucucaacccuguucuguugucucaaaaagaaaguucucucagggccuaagaaggauucaccaaagggagaaucuggugacacaaaaacaaaaugcaggauguggcccauuccugcagaacccagggagccagagggcauggccuggcgaccagcgcuguccuccccauccguggcuugggcugcucugacugcugugacugggccuugguuuccacccuggcaaaacaggcugcccucucuuccaagcugcagcugaagugggggcuccuccuccuccccccucagacugagggucuucuuccacgugcccagcagcauuuugcacgugacucuuagggugccccuggcaccccuguggaggcuguggacaggcuuguggcucucagagggcuguuggggagcacaacaguaaacagaucugguuccaguccccgggggguucacuguuggcaaagguggccagagcugucccuagagaggggccaugguccaugugugguaguuucaccaugugggcuggacaccugaacucuaucccugcacagccaucucugcugucugcaccuucaccauuauguagucacugguggaaaucccacaaaacagcaaacucugacuuggaucugccuuaggcugucugcggaccugguuucagcgcuggugggacugcagccggaggucagcccagcagagacugcagcuggagagggcagugcaacaccaccaccggcagcugcugcuggaggggcuggcccgguggaagacgcaccaucugcagugugucaggaagagggugaggcugacgguggcaacucuccaaguucugccugccuggcaagggguguccaggccaggagaccauuucucaggaaggggucuuuccugacagcacuccaugcagccgguaugaguggugggugguuugggguccuguaagacaaagcugcaggagccuuucugggcguuugguggagccuagcgaguagccagccccagaauccagugucucccagggaagacggcucagcggaaaaacccgguucaugcugacccguggcuuaucagugcugggggaccuacagagugaguccucuaggcggcacucccugccuaugcaggagaccccuggcaccauccaggacuccuagcaaugggaggacauucagcugggcagaggcuggguuagaucaggacccaccccaggcugucuaggcugggucaggacgccacucucugugcacuugcucucccccagcuccugcacaggcagagcacccaacugcuggcacagagacucagccggaccugcuuccgccaguggagacaacaggugggaacccaggagauguccccucugcacuuccuucuccauccucuggccugugaggccugggcagugaaugaccuucagccuacaccucuaguucaguauuuuuacuaucacccuccccagggccaccuccucuaccaccuuccugucauuuccaggcacaucagcuuccuuccgucugcagucugcauaagaacaguuacuucaaggccaguuucucucucuacaguguuguauuaaaaaauacaucaguggaggccgggcgcaguggcucacgccuguaaucccagcacuuugggaggccgaggcaggcggaucaugaggucaggagaucgagaccauccuggcuaacacggugaaaccccgucucuacuaaaaauacaaaaaaaaucagccaggcgugguggugggcgccuguagucccagcuacucgggaggcugaggcaggagaauggcgugaaccugggaggcagagcuugcagugagcugagauagcaccacugcacuccagcccgggcaacagagcgagacucugucuaaaaaaaaaaaaaaaaaaaaauauauauauauauauauauauauauauaaucagugggccgggcaugauggcucacgccuauaaucccaggauuuugggaggccgaggcaggaggaucacuugagcccagaaguucaagaccagccugggcaacauagugagaccccaucucuacaaaaacaaaacagaaaaauuagcuggguguaggcagugcacaccuguggucccaacuacucgggaggcugaggcgggaggauugcuugagcccgggaggucaagguugcagugagcugugaucaugccacugcacuucagccuggaugagagugagauuccaucucaaaaagaaaaaucagcauaauaucuuaaaaauuaacaugaaauguguuuuaaggcuuugcugggaucuugcuuuuuaaaaagccaagagggaucacacagagcagcauccacacguccccagcucccucuucccguucuguuguccuguuuucaccauuccccggaccucaggccgcugccuccacgcaucccccugcaggagcccuuugccaccuucuuucaugaaggucauuccucaggccacagauggagcguguguugagcaucucaccgccaggcacaaggcuggcccuuccuaguggaggaagugggagccucgacuagagagggagccaagagggacgagcugggcagggccccgugaucaccacggccuccuugaaggggcuauagggaaaugaucuggucuuucuggcccuagcuggcagccaggaggcaggagcagcgggcgacagugcgggcccugugguucugggccuucucgcugcaggcaaagguaauuggggcucugcauccuaccaucccugccucucccucaggccuuagcccugccuuggguggagggagggcaccuggucugugggggagcucuaagcagggagaccugggccucaccuccugcccucccuggaggugugggccacguggcuggccuuuguacuggaaaggaggagaaagaaggcgcggcugcagugggcgcuccaggccuaccaggggcagcuccuccaggagggugccacgcggcuccugcgcuuugcagccagcaugaaggccucccggcagcagcugcaggcccagcagcagguccagguaggcccagggccccuuccuguggggagcaggcaggguguggcaugagcugaccagaggcuguguuguaggcggcucacagucuccaucgugccguccgccgcugugccacgcucuggaaacagaaagugcugggccggggcgggaagccucagccccuggcagccaucgcacccagcaggaaagugacguuugaggguccccuucucaaccgcauugcugcuggggcuggggauggcacccuugagaccaagaggccacaggcuucucggccucugggagcucugggccgccuggcugcugaggagccccacgcccuggagcugugaguagccugugcucaccuuguccucgcuuccacccugggcaaaagguuggauggcauagcagggaggaaaacagcccugacgggaugggacgggcuggucacggccuugucacagcugagcugcugggaacccccucuucuccagccagaucccaucccucccacggcaagagggagagaauggagugggauuuccaaacccucucuccuuugccugccaaagcucaggaaauagguguccccuccucugcaacaccuuccuacccucucucccguccugcugacacgaucuuuuccggagucauacacguaguugacaaagggaacaagcucagcuccuacccgugccugccggccucucuucugcuccaucacagccaagacacuggcuuuuugucagaagccccucuuucuugugugagcuggcaccugucccucugcccaccccuacuauggucuccucaaacccuaaccugcccugccccaugcugaugaagcugguggcucccacagcaaccagcacuacccgagagccuugggccucgggggagaugucaggugggugcauggggccugggucccggucccugcugugcuccucacuguuugacugaccuugaugggauccugaacgucucagaggcugcuccccugugacauggacccuggcgaccuguacaccagcgucaccaggguuguucugcaggucaaaagagacaaugugggugaagcaguccccuggcgucagguaccuuuugucggaacugcugggagcucuauggcccaggcccaccccagcuuacuugcugaccuuggccucgccuuuccugacuuucagucucccuauaaaauuggagaucccacagagaucucagaccccccugcagccccuggucagcccaggggaacagaccccauguuucuuuccagcaacacugcccacucagcgaggaagcagccgcgacgcccacacuuccuguuggagccugcgcagagccagaggucccuggggugcagcaccgugggcaggcagggggagauggucagggguccccaaaggcagcgggcaccuccauguggggccuguguuuuggcagcccugggguggguggcccccuuuccuucuuguucuuuggucccagaggaggguccuguggccugaccaggcucuugccuucccugugcucaggccucagaagccacaggaacauggccuaggcauggcucagccagcagcccccucccugacgcggcccuuccuggcagaggccccgacagcacuggucccacacagcccccugccuggggcccugucaagcgccccuggcccgaagcagcccccgacggcaagcacaggcccggagcugcugcugcugccucuuuccuccuucaugcccugcggggcggcugcaccagccaggguacguccuccaccaccaggccugggcacuggggcucucacucuggucugacuucuggugcuuucucaugccacagcuguacuaguuucuggaaaaccuuggcacagggaggccacucauccauuugacaagcauagguagccacugcacaccagguccaagggccacagcagugaacagccagccaagggcccugccauccugaagcuuauauucuagucagagacaagcaaagaaaaaccccugccugcaggccaguaaaguggcugcagaucacguaggguccugcaggccacagugagaaguagccugggauuugagaagaguaggaagucggggaaggguuuuggcagggagcaccaugucagguuucugugcaggcuguggucaccaugaccacgugguccaggcaaguaguacugguggccugggcucagcgguugccacagaggggacagguacucucuuggaggcagaugaggcaggauaugcugcucugagggaguugcugaaugaggggaaagaaggaauccaggcugaugugggcugcuggcuugaauaacuugggaaacagaguucuuugacuggaagaaggaacuggggguggggacugguuuggggugaagugucaagaguguuuugaaccaggcucuugaugucaaauuugagagaaagcaaacguugagucugaccuucaaggaagaggucagggccagagauugagaagaaucuucagcacaggccgaagguaaccccagagccacugcggccucuaggaggagaguacaggggaaggagagaggggaggaggcuccaagcagggagccuggguggggauggccagggggugugagagcucaguaauggaagugacagcugcucuaaggccaccaaagcagcugguuccugaaaggggaugaggggacaggaaggaaccaguuccuguggugaguuaggccauguggggccacuuacccuggcuggaaugguuugaauguggguuugaaaggguuuugaccccuguccggugauggaaggggcaaguccacucucaccaggagaggagggcauggaaaaggcuguagagcaguggccucucacugaccacuucucacugaugucaaagcucagcaaggucaugagcuuagagcagguggggguggaggguuggguaaggcaaggcuaggaacagcugcucaggcaguggaggcgugaggcggacuguggugacacggggugcucccugguugcuugcgggacuuuccccuacaguaccaggcccugugugcaggggcaggcuagacacugagcuggcacggccagugccugggaagcccagcuccugcagcugggagccuggucuucccccaccccugcagggcaggcagugacaaggacuuggugucccccucccuggcuuccuccuagcuuccuugcucagcaucuacccuucuuuccuuugcaggugucagcacagcgggcuacuccuagggauaagcccccgguccccucaucccuggccagugucccugacccccaucuacuccuuccuggggacuucucagccaccagggcugggccuggacuuucaacugcagguguguaccuggggccugucagggcagaaagcacucaggccacucccggaccugggacuugcuauuuacccugguccccgaggggaaaauagucugaaacaagcuuacuucugucgccauaggcagccuggaccuugaggcugaacuugaggagauccagcagcaacuacugcacuaccagaccaccaagcagaaccucuggugagcccugcgaaacgcccugcagcccuggcuacaggagcagguguugccuggagaggugggcaggcaguuccauuucccccgagccagcugccaggguccuguagguggucucggucuagccauggagggguguggggagcccucagugugugcuguccagaaagaccccaucuccaccauggcucucuacccggcucagugcugcuuaggaaggcccaagucgucagacucaccugugcacagaggcucugcuuccuaugggggggacgauaaaguugagcaaaacucuaaaaacccgaugaggccaugcuguccccagugacuaauuauaacacugauauuaaaggugcagagaagggccaggcgcagugacucacaccugucaucccagcacuuugagaggcugugauccaggcagaucacgggguuaggaguucaagaccagccuggccaauauggugaaaccccaucucuacuaaaaauacaaaaauuagccgggcaugguggugcacgcauguagucccaacuacuuggaaggcugaggcagaagaaucgcuucaaccugggaggcggagguugcagugagcugagaucacgccauugcacuccagccugggcaacacagcaacacuccaucucaaaaaaaaaaaaaaaugcagaggagacaggcccgugacucagcugcacucaguggucuggggaccauucaacaugcagcaaccucagagcuuccagggcaacagacuggcgccucauccuuggcucugcacagggggagagagacaaggaguguguucuugcccaggcccaccugaguugcugucugcuggggagggcggaggagacugggagaggaaaaagaacaaguguuuggcucccaagcaggggccugcaguucaggucaggggcccuaccagaccaccucucuccacccgauacccgcaucagaauuagcugaggugccucucccugagccggauggggcucugccaaggacccagccuggcaggcaguggguaucuccaccccucagguccugucggcggcaagcgagcagccugcgcagguggcuggagcugaacagagaggagccggggccugaggaccaggaaguagagcagcaggugcagaaagagcuggaacaggugaggccccaggccauccccaggugucccuggggacgccccgggcugugcucccucucagcccugccugucccuccauggccccagguggaaaugcagauccagcugcuggcagaggagcuccaggcucagcgccagcccauuggcgccugcguugcccgcauccaggcccugcggcaggcccugugcuagcguguucgcaccaggaacgcaggugcugggcugucggggaggccucaggccaccuccaggaacagaacacaguuuuaaguuugauuuuuuuuauuucaaaaugcuuugcaauuaaaugaauuacuguuca

SEQ ID NO: 192205 - RNA, 8602 nt, Homo sapiens
uuaugcuccgcugucugcugguuucuguuuauuguucuacaguuguguagguuguaguuacuaguucuccucgggucacacuggugucaucgugacccuggggcagaucccuuugccagaacuagggugguuggccuuucuugggagacuggaguuuaaacugguggugguaucccgaagguuaaguaccgguugcuguucacggauuccucucuccaucgcccgagcuuucugagcugcucugucaugaacuuuuuuuucagguguucauaguaguggcugaucuuuuucuuggucuucucuaaagcgcucaccuuacaaaaaacagaggugagguuaggaucaagauccuaaagaggugagauuaggauuacuucgcagcagggcagacaucugugcuacugaugggggagugggaaaagugucagcuggacccuauguacauuccauauacuuugacucacagagagccuauuucucuauuuguaaaaagcaugcauuaagcuagauaacuccaaggacuggcgcaguggcucacaccuguaaucccaacacucugggaggccaaggaggguggaucacuugaagucaggaguuugagagcagccuggccaacaaggugaaacccugucuccgcugaaaauacaaagauuagccaagcauggugguaggcaccuguaaucccagcuacucgggaggcugaggcagaagaguugcuugaacccaggagguggaggcugcaguaagccgagaccgcaccacagcacuauagccuggacaacagagugagacucugucucacacugaauucuacuuauuucuucuauuguauaacuucuguccugucccccaaaaggcgguaaggugugggaagccaacauccuaugucuuaugcauuuacuccaaugagcuagcuacaggagaggauacuaagaaaaacugccacaggucuucacaguaacuccaauguagucaggauguaagacacaugcccaaauauuucuuuuuuuuuuucuuuuuugagauggagucucgcacugucacccaggcuggagugcaguggcgcgaucucagcucacugcaagcucugccuccuggguucacaccauucuccugccucagccucccgaguagcugggacuacaugcgcccgccaccacaccuggcuaauuuuuuguauuuuuaguagagacgggguuucaccauguuagccaggauggucucgaucuccugaccucgugauccacccgcuucggccucccaaagugcugagauuacaggcaugaaccaccgugcccggcccacaugcccaaauauuucuaagagagaaagugauccacuuccaaaagaagcacagaguucaaggaagggagauaucacgacaaauuucacuuggcugggcgcuguggcucacaucuguaaucccagcacuuuggggggccaaggcagguggcucacuugaggccaggaguuugagaucagccuggccaacauggggaaaccccaucucuacucaaaauacaaaaaaaaccuagcugggugugguggcaugugccuguaaucccagcuacucaggaggcuaaggcacaagaaucgcuugaacccaggaggcagagguugcauugagccgagauuaugccacugcacuucagccugggugacagagcgagacucugucucagaaaagaaaagaaaagcuacccagagaaguuagcauauaaacugaggcuagguuuugaaggaugggaggguuuggggcauguagaaacaaugugguggguggugauccugggaauguacguuuuuuaacaagcccuccaggggauucugauaagcacuaacauuaucugaagaccuagcacaagguuaagcaaaggacuucuucauaaaggccagucaauauugacaugauuacuugacaugaggaauuaaagagggagggugggcacuaaaugucauaguucaaguccguguucuccaaaccuggcugagcaucagaagcauuucaguugcuugauagaaacguaggccccaaggauucuugcuuaauaggguuuggaugggggccagcaaucuccacuuuugucaugcaccugagauuauucugauccagccccauuaccaagucgcugcuauuaccaccauuuucuuuuuuucuuuuuuuuuugagacagggucucacucuauugcccaggcuagggagagugcaguggcacaaucuugguuaacugcaaccuccacaucuuggguucaagcgauucuugugccucagccuuccaaguaucugagauuacaggcuugagccaccacaccagguuaauuuuuguauuuuuaguagagacaggguuucaccauguuggccaggcuggucucaaacucccgaccucaagugaggcaccugccucagccucccaaagugcugggcuuacaggugugagccacugugcccaaccuuauuaccaccauuuucuuuucuuuucuuuucuuuuuuuuuuuuuuugagagggaguuucacucuuguugcccagacuggagugcaauuaugcgauauuggcucaucgcaaccucggccuccaggguucaagcaauucuccugccucagccucccaaguagcugggauuacaggcaugugccaccacaccuggcuaguuuucuauuuuuaguagagagggguuucuccguguuggucaggcuggucucgaacucccaaccucaggugauccgcccgccucggccuuccaaagugcgugagccaccacccuggcuuaccaccauuuucuaguacaccccaugacaguaggcuuuuuggccucucucaacuagugauuuuaccuugagcaugacucuuaccaaucaggguuucucaaccuugacacuacugacauuuugagcuaggcagugugugguggagggcugucccauacacugcgggauauucagcagugucccuggccucuaccuacuaaauacagaaagccacaaagggcugggcaugguggaacaugccuauaaugccagcacuuugggaagcagagaugggcagaucacuugagcccaggaguuugaggccagccugggcaauauggugaaaccccguuucuauuaaaagugcaaaacauuagcugcgcaugauggcacgugccuguaauccuagcaaccugggaggcugaggugggaggauugcuugaacucaggagguugaggcuacagcaagcugugaucaugccacugcccuccagccugagcaaaagagugagacccugucucaaaaaaaaaaaaaaagaaaaaaaaaggaaauuaaaaaaaggggauacaaagaugaugagagagaauggaagacauaccuggugguaguacagccccuggcuacuuuccccaaaaacauuggcgacucugcccuauccauccuugauuauguaaacccaacuucucuaucuugcucgaacuaguucaaguucaguuuauguuaccugcaacugagaggaucuuaauagauccuauuuuacaaaugagaaagcagagucuggaggaaguguaauucacacagggucacacaaagcuggcuugcccaucuauuuccacuacaccacacccauggaaguguagcagaaagagaaaugcccgggucccuacucuucuuuugguguuugugaccuucaagaggaucuggcaccaucucuuaaggaucuccaauuguuuuuaauguuagaauuuugugggcccauccagacuugacccuggaacauggaaggaagcucaaaagagucaagaagcaggcagcagcugugcgugguggcucacuccuguaaucccagcacuuugggagucugagguggguggaucaccugaggucaggaguuugagaccagccuggccaacauggugaaaccccgucucuacuaauaaaacaaaaauuagacgggcguaguggugcaugccuguaauuccagcuacuugggagggugaggcaggagaauugcuuaacccgggagguagagguugcagugaguugagauagcgccacugcacuccagccuggacaacaggaaugaaauucugucucaaaaaagaaaagaagguggcagcagcucaacccugggcacccugcucugcuugaaagaaugaguguguuucuggaguccaucuuguucacuugucucuuccuagcgcccaacacaguaccugucccaagcaggcccuaaggacagguuuaaugaauccaucaaucagggucuaugggaacaguggggugacagcacucaggauuucgaguaagcaggugaaacucuaccuguccauagcaaaaagugggagaagagccucagcucucaucuggaaaauggggauaauccccaaaggaaaaaauugacaagaugguguugaggcccauucaaacucuaggacccaagacuuugguuuucuguuuuuuuguuuguuuguuuuuugagauggagucuugcucuguugccacacaccuggcugccaccacaccuggcuaauuuuuguauuuuuaguagagacaggauuucaccauauuggccaggcuggucucgaauuccugaccucaagugauccuccugccucagccucccaaagugcugggauuagagguaugagccacugcguguggccuaggacccaagacuuuguaugggagaaaauaagaauccauucauggauucccuaaauagagagauaaugugcuuucagaaaaaaagacccaagagacauggagucuuucucucuggcucccuuagcccaggaacaggugcgacaccuugcgcaagucaguaaccccgaguaucaauugccuccucuguaaaauggggccugccuuagagcaccuugaugacucccuaucaccucuaugauaucccagcauauagggagaaugaaaugaauaugggucaagccacuaacacccucuaaugcaaaagcuuguggcuacuuuaccuccaucucauagauucguugugugaugcgguuaucaugaauaaucacccgagauaaauggcucuuggguaaaguuuuuuucaucgcugcuucacuggaauucauuaagcuggagcagggagggaaagguggcacagguuacagacgguuggggccugggccagagcacauuugaugggguccugagggaguggcugaggcuuccccggguuucuugggacaagugcagcucugucauaauuuucaaaagaacaggggaguaaccacaguuucuuguuguggaaaagguaugcuaaagggguauuucaugguuacccagaagaaaagccauucugaggauguaaaauggccuagugcaguccuuaagagaaggguuaucaggaacucagaaccauccucagaagcagucacccuuuuuguguuuuuuguuuuuuugaggcggaguuucacucugucucccaggcuggagugugguggugcaaucuuggcuuacugcaaacuccaccuccaguucaagcaauucuccugccucggccuccugaguagcuggcacuacaggcacucgccaccaugccuggcuaauuuuuguacuuuuaguagagacgggguuucaccauguuggacaggcuggguucaaacuccugaccucaagagauacacccaccucagccucccaaagugcugggauuacaggcaagugccaccacgcccacccagccaaaagcagucaucuugaugauccuucuuaaggaugaaauggugagaggagucuuagaggagaggaguaaaguuguaggguaggauucagaaggaugaaucugggagguguuuagcuuggggggcacuugcucuagagcauaugcuucaaggggaucugggaggugggggguugggggaguauaaaucagagcagggagaaaugcaaaugaaaagcuuggacagguguuaggcugguuaacagggaaauucuggaagaaaguuuggggaguuuagaaaagugaaggagguaugggguggcuagggguuuuaggagacucugaaaggugagaggugaaagaugggguggggugggguagaauggagccaaguacuccaggugaaaauacaacaauuuggucaaaaugagaaaauggugaaaaguggauacacuuacaggcacugaguuuucacuuuuugauaauuugguuacaccacgaaguagucuuaugaacauauaucuuuaaaugguuuuguccauuuaaaaauaauuguucaggaccgggcaaguuggcucacgccuguagucccagcacuuugggaggcugaagcaggcgaaucacuuggaagucaggaguuccagaacagccuggcaaagauggugaaaccccaucucugcuaaaaauacaaaaauuagcugggcgugguggugagcgccuguaaucccagcuacucgggaggcuggggcaggagaaucacaugaacccaggaggcggagguugcagugaacuacuuuaccauuguacuccagccugggcgacagagugagacuccgucucaaaaaaaaaaaaauuguucauauuuucuuucuaaaauguggaaacaaaauguacaauauugaauaaauuuugguaugucauaaaauaaaauacauguaauuguguaugaaacauagacacgggugguguauuagaugggagaagaaagcagguuacuagaaacugaacuuuuugugauguauuguuuuuuaaguauaaguauguugucauauauauauuauauaugaaugaagccugaacaaaaugcaccaaaauguuaacggugauugucccuagccaaucaugcugcuagucuuauuuuucuuauuuuauuuuauuuuuauuucuuugagaugggaucucacucugucgcccauguuggagugcaguggcgcaaucuccgcucaaugcaaccucagccucccaggcucaagcaauccucccaccucaggcucccgaguaacugggaccacaggccagccaccaugcccggcuaauuuuuugcauuuuugguagagacaggguuucgccauguugaccugacuggucucgaacuccugagcucaggcgauccacccuccucagccucccaaaguggugggauuacaggcaugagccacugcaccuggccuuauuuauccauaaguguaugcuacuuuuauaauuaggacaaaaaagacaacuguggaagggugaaacauuuugaaggacuagaauuuuuuucuaacugaugccgggugcaguggcucacaccuguaaucccagcacuuugggaggcagaggcaggcagaucaccugaggucaggaguuccagaccagacuggccaacauggugaaaccccgccucuacuaauaauacaaaaauuagccgagcaugguggugcacgccuguaaucccagcuacucaggaggcugaggcaggagaauugcaauucauuuucagccaauuuggaacccggagugucguguauguuuuuagauuuacaaacuaauaugaacaauccaauuucccagucucccauuuacauuuuucugaccuaugcacagccuagguaugaggugauggaaaaggcugguuuagagaucaagaugcucaaacacaaaagucccccaaauccugguuuuuuuuuguuguuguuguuuaaaaaaaaucccuaaaacauuuaaggacacauaaaacucuucacccacucagugggugcaccaaauuuaccaauacuagaaggggaagaggguggcaacgacuggaaauauucccuuucaaguaauaaaggucauuuugaaccaaauugcuuuccaccucaaguucuccauggacaggggccugaaggaugcagugagggggguuuguggaauggaaaggagcgcggguaauugggguuugugaggauccgggccaggcagagggaacugggguuuuuuccaggaccaccggggaaaagagaggcugagaaggggcguaugagacggauucgaacuugggaggaccugggccucgccagguucuaagagucagggcucaucccccuagggcacugcggccacauguugucaugccugggggacugacgggccaggaccgauucugagaaaaugucaguggagaugucauucugagaaaaugucaguggagauggggauuccagguucucccgcgauuccggggcgagggaguucgggcuccggggaauccgaagagcuagacugggaaggugcuggugcccggggcuacgagaaaucgacuauccuggggugugaaaaagggccgggguccggcuaaggggagcgcgagucccaaagaguuaggguucccucgcggguccgagggucugacgaacgcucugggcaugcgggccacaccugaacagcaccggcugcugcgcggaccucggccgcggaaagcagaucugcggcugacccccuacgccgauuucugggcggcggccgagucuaucgcgcugguaguucgaacccgagguggcgcuggaacugguggucgccugggcggcggucccgccgaucguggaggaucccuggucacaggugaccgagggccuagucggcugugucauugcggcuucccuguuggagaaagaguuggaaacugguggcugguugccagcccaccuaggug

SEQ ID NO: 192206 - RNA, 5834 nt, Homo sapiens
acaugcgcacagagcccgggcggcuacggaagcggugagacugucucucggcugcagcccuggugcgacccggcccguugccguagagaugggcagggcuggauggaguggggugcggugagcugagcugacccugcuucgccacggggacugcagugaccccggcuugccggcagggcggguaacagguugagccaggguggggcugcucaggggcguggagccgaggccaggauuucucugaagacccggcacaggcuauuccuuucugcgacgagcccauugcuauggaaaccaaagcguuaggccagcggggauugaggcugcgggaucaugacgggucucucucccgaagaaccuugccuaaggcuuccccaagcggcuacuuccugagcgaacccgcccacccgccugaaggagagagguaaaacccuggggguccugacacuaagcaggcgaagaagccuauuccaaugccagcuccccuaggaaaccuacccggcccaccccuagaagugaugcuucgcucucguuaacucuuggacuuuguuccauguuuauaacuuaguauuucacgaacgccccgcgguguuuguucauuuuucccacacauaauggaccauaaaggucggcuucuuugcuuuaugacucguucugaacaaguccuuuuccgcgcugugucucacuuuccucuuuuguaaaauggaaauauuaacucuagacgccggucugauuagguugcuuugaagaucgaaccagaugagggaagccaaauacuucauaggcuguaaaguggugaagcugaacugcuaccgaguugcuauuuuuuucuccuccucccucucaagcuaaacguucuuuagaucuuuugugauuucuucagguggucuuugcgacucccuaggcuccgaccuggaagaaaucuuuuuuacacuucccuuucacagagcccugcauuuuaacuucccuaucagaagcgagaaaaauaguuaucauuuugagagggcuuacucuaugccaagcccugagaaaacucuuuacguggauuaucucguuuaauuucacaacauccuuuuaagguagguacuguuauccuauuuucaagcucugucugccuguaauugccuguuuacuaucuguuucucccacuagucuuugagcucccugagaaaaggggccaugccugucuuguacauuucaguaucuccaacaccuaauacagugccugauagagauugcuuuuuuuuuuuuuuuuuuuuuuuuugagauggagucucacgcugucucccaggcuggagugcaguggcacgaucuuggcucacugcagccuccgccucccggguucaagcaauucucccgucucagccuccugaguagcugggacuacaggcccaugccaccacgccuggcuaauuuuuguauuuuuaguagagacggggguuucaccauguuggucaggcuggucuugaacuccugaccucaggugaucugcccgccucggccuuccaaagugcugggauuauaggcuuaagccaccgugcccagcccugauagauauuucuuaacuagcaugaaaaugacuccucgcaucacuacccucaccugcaagagcauugucacuucugcagacuuuuaguggcuauaaugaacagcacauuccucuauucccguuacccacugggcacugguuuggggggacaucaguucacuucucuauggauuuucugaugacgaggauccagaacauuccuuagcauuuagacuuccaucuggguucaggaggcuuuuucuuugcccuucauaucaccucuguagcaagccagcccucucuguccuuccgggaaugagccugaugcauuugagucuggggcauuggcagguaggauuugccuauacaaccuuuggucuuucucuuuaguagccucagaaccacccccauccccacccagccccucccuggaauucuggagacacgcugccagagaacucauucuuuccagaaaaccucucagaaggcagagucauagcuguugggagucauuucuucauucaacaaauauuuaucaagcaccuacuuguggggacacagcgcuuggcacuaguuggugauagagugggagugaagacagacaccaucauaucccuaaagggcucacagucucuuggggagacagacauuaaucaaauaaucagacagaucggagcaaaacuacgucuucaguaaguguuaggaaggagagaacauagggcuaagaaagccuggagcagaguuggucaaacgugagggaggggugugaucuaaggagauuucccuuaaaacaguuaccuuuaaguugauaucuuaaggcuccucagacuucugcaguccucugcugaauggaccagaucaggaucugauggguucauaaggaaagagacugagagaucagcaggggcaaaggccacuggcuggagaggacagguugucccuaaggaacuguaaguggcucgguucaccugaggcccuucagagcauggagaagccuaauaagaggcuggagagacaggcaggagccaggucacaaauggccuugacagccaaacuaaguggcuccaucuuauccucacaguggauagccacugaaauauauuaagcagggaaacaaaacuuuggcuccucauuucucgugccuggugaagacugccacuuggccuugaaaggugugaucuaaauccaaaugucccuauuucagcggaauguauaaagauguccugguuuuugcagcuuuguuuaagacugagaaagugaggguccgagagucuaaugaaugcucugggcacccaggccgcaccugaggagcaccgacgacugcacggucugcggcgcgggaagcagaucugcggcugaaccucuaccccaauuacuuagcggcgacugagccuaucgagcaggugaagggaaggggucugccucucccugggguguguuucacagcucugcugcaggcagcaugaugcagguguggcaggucuuccuaaggcccugcugucucugugcuugucccugggguugcuguggugcccauuaugcuggcuuccaggaagcuuucagccacucccuuucccaggccuucuucagaggcaaggugcaggagcaugucuaacaauuuaggacuuuguauuugacaucagcuucgcaugggcauauccugucucuuuaaagagaugguucuuagagggggaaaaugggaacccucccuacucuuauaccagccuccucagugacugccagcacagugggcucugguuccaugccacuggcucaggaccuuaugauuugggcauaaagucagaagacugaggaggaagacuguacaaaugguucccacucagaggggcuggaaggaaggagagaauuuggaagagcagcaagaaaagggcucugugagcuuaaauggagaaucaggccaaggcacagcugagggacacaagucaucugcccaacuagagcugugggaccccucaagggaggccucaagugccagacuuggggacuugccauuuguccuauagggcagugcacauuagaccaccugagaagcaugcugaaaaugcagauucaugcucuucaccccgagagucugacuguggguuuggagagggaccuggguaucuguacuuuaaaugaguuugcuggguaguucugcugugauggucagaggacugccuuggggaaugcuauaagccuauccauccauuucccagggauccccuggaauuggcccucugggcaccugcccucuaaacauccucucccucucugcaguuuuccauggacacagccuagcagaaagacgcagccuucgugcuucgcugacugcugaccacugacccaccgccuugaugacagcacccucgugugccuucccaguucaguuccggcagcccucagucagcggccucucgcagauaaccaaaagccuguauaucagcaaugguguggccgccaacaacaagcucaugcugucuagcaaccagaucaccauggucaucaaugucucaguggagguagugaacaccuuguaugaggauauccaguacaugcagguaccuguggcugacuccccuaacucacgucucugugacuucuuugacccuauugcugaccauauccacagcguggagaugaagcagggccguacuuugcugcacugugcugcuggugugagccgcucagcugcccugugccucgccuaccucaugaaguaccacgccaugucccugcuggacgcccacacguggaccaagucaugccggcccaucauccgacccaacagcggcuuuugggagcagcucauccacuaugaguuccaauuguuuggcaagaacacugugcacauggucaguuccccagugggaaugaucccugacaucuaugagaaggaaguccguuugaugauuccacugugagccaucccacgagccccugcauuggagucagagguacagaucuauuguugaucuuacaccaagauccaaacuugaacauucuacuuuuguugauacagaaaaaaacagaugaugccuuuuaugagcacaaaaaagaguugcuguagcuuuuaacuuuauaauccauuuuuuuuaagauuaaacuaauugugagauggugaagauaaauuuucugcccugugagugacacuggccaggggauagguugaggcagauggugcccagaagaaagagggcagcacccauugcacauggcaggccuggaauccugcagcccuccccaaaaacagauugacccaggaaugaaucugcuacaauuccaccucauucuuucacacccagagccagagccuuaagcaucaugguaccucuugcgcuucuuacagugagugccaaucuacuagauaaauggccuucaggcagugcuccaggaauccuggggggucccaggccaccucugcuuccaccuucacuauaaguggcccaguucugguuuucuagauuguacuuaugcauaagauaguuuuuaaagaaagcauuccacuguguaaauuuuuuuuugucuuuuuuugaaacuguccugcucugucacccauccuagagugcaguagugugaucauggcucacuguagccacaaccucucaggcucaagugauccucuuaccuuagccuccugcguggcugggacuacagauguuugccaccaugcccgccucauuuuuuuucuuuuuuuauagagaugagauuuuacuaugucgcccagacuggucucaaacuccuggccucaagcaauccucacgccucagccucccaaaguguugaugagccacuguaccccgauaccacuguauaaaaaauuuaaaaaaaauugugagugcuauuguacauggcaaaguuucaaagagcucuuggccaucccucaccaaacuuuggcaaaagaugguguuaguccccuucuccagggcacaugagaaaaacaggccuaacaucaggucucagcgguuccucucacaggccuuggcuuggaaggcuggagcuucggaccaaggcccagcccugucaccuccucuucaugugauguggaccccugggagcaucaguguccucaucuguccaaugacagcccuuuucucacagaguuauugugaagauucaacaauuucuuggcauagugccuggcacauggugugugcuuagcgcaaauggcagcucucaucaugaaugauagacucuuucacccugcuggucccaggucggcacacacauccccauaauggcauuucuccuuucugugcacagcacuuuauuguuacaaaguacucuuccaaaaaguuacccugugugu

SEQ ID NO: 192207 - RNA, 96610 nt, Homo sapiens
ggugggagggaagcgucgacgagcugaggugagggcuguugagacgcgaggucucggcccagagagggcacucgggcguuguuaguucugucuuuaugucaaaaaacaauuuuuuuuucuuuucuuauuacuuaaggcuuuaaguuggauuugaaaguaucauauuucgugagggccuaaaguacugugaagagaaucgggagggcagggggcugaggaggaaggcaaaagggaggcgauuucccccagaacuggacagagagcacccagguaguuuugaaauucagauuuuucuggacaugaaaucaaacuugcugagcaagcagcagccauaaugagccaugaugaggcuggcagggcagacgaugucugugcccgacauuggagggggccgugugugguggagcuuuggggaaguuuaucuuaccugggucagauucuccccagccauugagguuuucugccaggaucgaugccugguacaggccaagaggugagagagguggggacaagacaccccgccccccuugaccucagcuccccuuucacuuuagugaggauuugccaauuaaucccuauggacuuuaguucccuaaacagagggagagagucuugaaccucaggauuagccaaucgccaaaauguguccgaguacgcagggcacuggacaggcugugcaguacaucguguacucagcugguagaaaugaggggugguucuggccccuaaagggguuuuuaaucucagcaggaucauaaucuaauuucuccuccauuggaccaucaaucuguugagguaggaacaguauuuuacaucucguaauccugcauguuguugccuggcacauuguaguugccucguagauguugaaugaaugaauaauugaaauagcaugaaaaagauauuaaaaagucaaaagagcaugaacaaauacucaauuaauauaguggaagccauuuucucugaaugagcacagguaggggaauuaccagggccaaauggaauuuguuaaaauggugaauaauuuauugaagcaagcucuguuggaaggucuaaguaauugggcgaacuuuggcaaaccaaguucccuugcuuagccucacuuuccuuuucuuuuuucuuuuuuuuuugugagauggagucgagcucugugccaggcuggagugcagugacgcaaucucagcucacugcaaccuccaccucucggguucaagcgauuccccugccucagccucccauguagcugggacuacaggugugcaccaccacgcccagcuaaauuuuuuuauuuuuuuuuauuuuuaguagagacaggguuucaccauguuggccaggauagucucgaucucuugaccucgugauccucccaccucggccucccagagugcugggauuacaggugugagccacugcaccuggccccuuuucuuuauaguuuuauguuuagguuuaaauccaugauccauuuugcauuaauauuuguauacagugugagauuuagguuaaguuucuuuuaauucucuguucuuccccccacccuccagauguccuuuuguuucagcaucauuugcugaaaaaaagauucuuccuccacagaauuggaucuucuuuaaaucaaagggguuggaagaugucugugcucccuuccagcuuuaggaaucuauugaacccauuuauguuaacguacacuucuuuugaguaaagccauucuuaacaacaugcauguguaaggaagguaauauaguuacauuucagaauccagcuauuggauaguguucaccugauagaaaagggauuuucuuguaaaaaacgguuuuugaagauugagaaagauggguagagagccuucauaaaucaacuaugauuauauuugggaaaauguaauaaaacuuuggcuuuugcuucacuuggaaugguuaaaaaagugguuuaggccuuaguaaacuaaacagcagcuggcuaaucuuuaugugaaucuuggacucacacauaguagggguaaaauaggaaguaauugugccaccauauaaaauagggcaauugaaggcgugguguggugucucauauguguaaucccaaaacuuugagaggccaagaguucgaggccagucugggcaacauagugagaccucccccuccacccgcccgcccaacucuacaaaaauaaaaaauuuuuaaaaauuagcagggcaugguggugcaugcauauagucucagcuacuuggaaggcugagauaggaggaucacuugagcccagaaguuugagguugcaaugagcugugauuaugccagccuaggugacagaucaugccaccgcacuuuacucugucucaaaaaaaaaaaaaagaaaagaaaagaaaagaaaaugaauacacaacaacaaaaaaaauagggcaauugagauauaggucaagagguaagccuagagugaaucuuuaccagaaagagcauagaaauauugccucuuucucaagaagaucauaauccuugucacaaaguagacauaucaaauguaagagugagggucaguugcaguggcucacacuuauaaucccagcacuuugggaggcuaagaaaggaguauugcuugagcccagaaguucaaaaccagccuggguaacauagugagaccucaucucuaccaaaaauaaaauuugcugagugugguggcacauggccucuaguacuagcuacuuaggaggcugaggugggaggaucacuugagcccaggaggucgagguugcagugagccaagauugcgccacugcauuccugccuggguaaacagaguaagaccuugucucaaaaacagaagagggaaugguauugaugaacugugaaguuucaaauauguguggaucuaauuugcaaacaaauauauaagagaaugacauugcaaaguuagcuuucaguucuuaaaauccauaguuaugaaaucucuucuagguuuuuagauaaugagccugaacaaagggauaacacauagaaaaaaucagaccuauucucugagaaugcaugcucucuagagucauaccuccugugaacuugugagcuuuuaaaauuaagcaggguuuguacuuaaauagaagaccuccacaaaacaccugcucaaagggaaaacaguagcaacagaauaauuagaggcugaaaggagucuggcuuuuuuuuugagacggaguuucacucuuguugcccaggcuggagugcaauggugcaaucucggcucacugcaaccuccaccucccggguucaagcaauucuccugccucagccucucaaguagcugggauuacaggcacccaccaccaugcccaguuuuaguagagacgaaguuucaccauguuuuuugaaaaaauaauuuagaucuuuuugccuuccugaagcaagcucaugcuagaacacuagaaagagacccucccauguuuagaaauaaguaggcaagccgaagaacuaaggaggcccugguaguacaucauauuagauagaaugaaagcaaaggagaauuucauuuuggagagucagucuggaaaaacuuuuaaauugugagccagacuuguugaguuuuagucucaguucuguuacugaguggcugacuaaucccggguaagucuagauuuugaauuccccaucuagaaaauuagauauuuggacuaaauuacugucuuaguccaguuuguacugcuguaacaauaccugaggcuggguaacuaaaaagagcagacauguauuggcuuaugauucuggaggcugggaaguccaagaacaaggauaugcaucuuguaaggaccuucuugcugugucauaacauggaggaaggcaucaccugguaagacagagagagcaaggagagagagagugagugugccaaacuugcuuuuauaacaaauccacucuccugauaaugaaccugcuccugggguaacaauauuaauccauucaugaaggcaccuaaucaccucuuaaaggccccaacucucaacacuugcauugaggauuaagcuuccaaaauaugaacuuugggauacacauucaaaccauagcaaugauauuuaaaguuucuucuaccuuuaaaauuuugugguauuuuucuagacucuuaauuauuccuuguuccuauaguucuucucuguugacucagcaaauauuuaguuaguuaaguuagguuuuuaauuuuuuuuauuuuuuacuuauuuauuuauuuuuaaaguagagacagggcuucaccauguuggccaggcuggucuugaacugcugaccucaagugauccaucccaccgugaccucccaaaauacugagauuacaggugugagccaccaugcccagccucagcaaauauuuauugaguaccuauuuaguuccaguacugugaugaugcugagaguucaagaaugagcuaaacggccaggcgugguggcucacgccuguaaucccagcaauuugggaggccgaggcgggcggaucaugaggucaggaguucgagaccaucgucgcuaacauggugaaaccccgucucuacuaaaaauacgaaaaaauuagccaagcaugguggcagucgccuguagucccagcuacucgggaggcugaggcaggaggguggcaugaacccgggaggugggucuugcagugagccgagauugcgccacugcacuccagccugggcaacagagccagacuccgucucaaaaaaaaaaaaaaugagcuaaacaagacacaaaagaucacauauuguaugguuucauuuauauguaauguucagaauaggcaauuucauaaagaugaaagguagguuagugguuuccagcggcuggggaaaggagagaauaggagugacugcuaauaggcaugggauuucuuuuaggggugaugaaaauguucuggaauugauaguguuugcauuauuuugugaauacacuaaauugaugguuuauacuauauuaaacagaugguugcagaauuuugugaauauacuaaaacccacugaauuauaccuauuaaaaaaacuuuaaaggcugggugcaguggcucaugccuguaaucccagcacuuugggaggccaaagugggcagaucacuugaggucagggguucuagaccagccuggccaacauggcuaaaccccaucucuacuaaaaauacaaaaauuagcuggaugugguggcacacaccuguaaucccagcuacucaggacgcugaggcaggagaauggcuugaacccuggaaacagagguugcaguaagcugauauuauaccacugcacuucaccugggugacacagugagaguccuuuucaauaaauaaauaaauaaaacuuuaaaauauaaagaaugagcuagacugacacaacagcuagacacaauuuugcucucauguuagcucacaguaggucaggggauacuuaaagacaacuaugguacaguauauauugcaaagggcacauaacccagacuucguaauagugguagugggaauuaggaagucaucccuuaaggaaauuuuacuaagccauaugauaugguuuggauuuaugucuccacccaaaucucaugucaaauuguaauccccaguguuggaggagggcccugguggggguugacuggaucauggggguagauuucccacuugcuguucuuguaauuaugaguucucaugagaucugguuguuuaaaaguguguagcaccuccccuuucccucucuuccuccuucucuggccguguaaaacaugccuccuucuccuuccccuucugccaugguuguaaguuuccugaggucuccccagcuaugcuuccuguguagccugcauaacuguaagucauuuaaaccccuuucuuuauaaauuacccagucuuagguaguucuuuauagcaaugcaagaauggacuaauacaccauaucuaugagaugaguaggaauugggaauggaggaggauguuucaggcagaaggaauauugcaaaauccugagagcuagaaggaauauaguccuuugggguaaagaagguaagaauagcugguaaauaaaaguauaagggaaaauagagcugaggcuagggaggcaugagucaaaucuugaagccaugguaagaguuuuagauuuuauccugagaguaguggggagccauugaaguauuucaaucugggaaaaugcauagucgaguuuguaauuuaaaaacucuggcugcaauauacagaacagacuggagaaggagaauaccagugacaggaaauuggugguugcagcaguacaggcaaaagaugagacugguugauuuaaaguagagaugacaacaaccuggcuaaagugaggaguuggacacauuugagauauauauauauauauguaugugcagggggacaggguuucacucuuguugcccaggcuggaaugcaauggcgugaucuuggcucacugcaaccuccaucuacuggguucaagcgauucuccugccucagccucccaaguagcugggauuacaggcaugugccacuacgcccagcuaauuuuguauuuuuaguagagaugggguuucuccauguuggucaagcaugugccaccacgcccagcuaauuuuguauuuucaguagagaugggguuucuccauguuggucaggcuggucuugaacuccugaccucaggugauccgcccaccucagccucccaaaguccugggauuacaggcgugagccacugcgccuggccuacauuugagaaauauuaaggugauggaacaugggaacgaggaagggauuaagguugagucacagauuuugugcuugagcaacuagguaugugaugaugucauucacugagcgagggaacagaaguaaguuuuuggggaaaauaauucacauucaaauguguugagaacaucaagguggaacagucuuaugaucaguuagaagaacaagucagcaacuucugagagagaccuggguuggggauauacacauaagaaucaauaagauagaaguuauacuugaaacaaugggaguguauuuguucauccagggagugugugguagaaguaaaaaagaagagcucuguuuuagucuguucuugcauugcuauaaagaaauuucugagacuggguaauuuauaaagaaaagagguuuaauuggcucacaguuccacaggcuguacagaaagcaugguagcaucugccugacuuuugaggaggccucaggaaacuuacaauuauggcagaagacaaaggagaagcaggcacaucuuacauggccaaagcaggagagagagagagaggaaaaaaaaaaagguucuacacaccuuuaaacaaccagaucuugcaauaacucacucacuuacuauugcaagaacugcacugaggguauagugcuaaaccauucaugagaaacugcccagaugauccaguuaucuccuacugugccuggccaugccagcugcuagguaacugagucagaauuugaacuuagguuccuuaacucuaaaggcucuuucuacuagauuauacugcugguuauuucucucucucucucuauauauauacauauauauauacacacacauacauauauacauauacagaucuguauauguguauacacacguacacacguauacauauacacacacguacacacguguacauauacacacacguacacacguguacauauacacacacguacacauguguacauauacacauauguauacacguauaccuauguauacauauauacauauauaccuauguauacauauauacauauauacacauauauacauauauacacacauauauacauauacacacauauauacauauauacacacauauauacauacauauauauacacauauauacauauauguauaaaauuuaauuuuacuuuuauaaaugucaauuccuaaggaauuuaccaaaugcuaauauuaaccugcuugaauccuuucucaauagcaaguguccugaaugccucagaguuuucaaugguaauauuaauuuaaucuaggccauccauacauugcaaaaauauggauguaguaaugccuuguguucuaauuggcugaugcuauuuucagagcuugauucccuagaaaugacaucagaaugucuaugaucauagagaaauuuuuaaaacccuacuaauuuagaaaacuauuuaguuuuauuaaguaaguuuuaauaaguaaguuuuauuaguuuuauuaauuuuauuaauuaaaaaaguuaauuuaaaaauuaauuuaaaaauuaaaaaguaaguuuuauuaaguuuuauuaguuuuauuaauauuaguauucuauacuaauauagaaaacuauucuagaaaaucaugauuucucuuauuuauugugucuaagacuaauaacuaccccaguaguggguaguguauuaugguuuaaugggcugggacuagaucuuaaacucuuagagcuacuuuguuucccauuuuauuuuuugaaauuuaagggggacaacugauguauuagauaugaagguuauagucucaaaucaaguaaagauagcuuggaaucuuuaaggguuaaagaacuauuggugguuuucagucucauauauaaaauauuguaaaagaguguccccuagugccccucugaagaaauaauuugaaagaaauuuaauauuaccaccuauuuauaaucucuaucaccaccuuguggcaguguucgcaaauaauucugcccucuugggaaaaaucuucaagaaucuugcauuaauggauacacaaaaaccggucacaggcuauccuuggugauccagaauggaauaucuuuaaagaaguuauuuuacaaguauuuuggucagaacuucauaaaaccuugaaaagaagccccaguugaaauuaaauuaagacuuuguaaagaaaagggaaaauuugcugcugcuucuuuuuuuuuuuuuuugagauggagucuggcucugucggccaggcuggagugcaguggcgcaaucuuggcucacugcaagcuccaccucccggguucacgccguucuccugccucagccuccugaguagcugggacuauaggcgccugccacuaugccugucuaauuuuuguauuuuuaguagagaugggauuucaccauguuggccaggauggucuugaucuccugaccucgugauccacccgccuuggccucccaaaguccugggauuacaggcaugagccaccaugcccggcugcuucuuuuuuauaucaacaaaacaauaagggugaaaacuagauguauuuuaaauauuaacuuuuuuauugugguaaacuguaauaugaaacucaacaccucagcuuuucuaaguguacaacucagugacacuaagcacauuugcaauguugugcaaccauuaucacuauccauuucuaaaaccuucucaucaucgugaacagaaacucuauaccuauuaaacucuuuauuccuucuaccccaccagcaccugguaaccucuauucuacuuucugucucugugaauuugccuacuguagguaccucauauaagugggaucauauaauauuuguccuuuuaugucuggcuuuucacuuagcauaauguuuucaagauuuauucacauuguugcauguaucagaacuucauuccuuuuuaagauugaauaggggucgggugugguggcucaugccuauaaucccagcacacugggaggaugaggcggguggauugccugaaccuaggaauucaagaccagccugggcaacaugacaaaaccccaucuccacaaaaaauacaaaaauuagcgaggugugguggcaaaugcuuguagucccagcuacucgagaggcugaggugggagaaucauuuaagccugggagcgggagguugcagugagccgagaucacgccauugcacucuacugugggugacagaaggagaccccgucucaaaaacaaaacaaaacaaacaaauaaaacaauugaguaauauuccauuguaaauaccacauuuuguuuauccauucaucuuuuaauagacauucgaacuguuuccaucuuuuggcuaauaugaauuauguggcuaugagcauugguguacaaguaucuguuugagucccugguuucaauucuuuugaauauauaccuagagauggaaaugcuagauaauaugguaauucuguuuaacuuuuugaggaaugccauugcuauuuuccacaauggcugcaccauuuucauucccaccagcaaugcauaaggguuuuaauuucuccacauccuuaccaacuuacuauuuuccauuuuugaauaaucauuuauaaaauuuuuaauugacacacaguaauuguacauauuuaugggguacagagugauauuuugauacauguauacaauauguaauggucaagucaaagcauauucaucaauucaaacauuuaucauucuuuguguugaacuauuuuaaaauauacaauaaaucauuguuaacuguggucacucuacagugcuauagaacaauauaauuuauucuccuaucuagcuguaauuuuauauccauuaacuaacuucucccuauccaaccuccucccugcugcccuuccuagcuuuuaauaacuacuucugagagcucaucuguuuuagcucccagaugagugagaacacaugguauuuaucuuucuguacuugacuuacuucacuuaaaauuauaucaucuagguuaaucucuguugcugugaaugacagauuucaugcuuuuuuaaauggcugaauaauauuccauuguguauauauauccuuuccuuccuuucuuucuuuuucucuuucucucucucucucuuucuuucucucuuucuuucuuuuuuuuuuuuuuuuuugacagagucuugcucuguugcccaggcuggagugcaguggugcaaucauggcucacugcacugcagccuugaacuccugggcucaaguaguccaccuuagcuucccaaguagcugggacuauaggugcgugccaccacacccagcuaauuuucguauuuuuuguacagauaggguuucaccauguugccuaggcuggucuugaacuccugggcucaagcaaccugccugccucaaccucccaaagugcugggauuacagacaugagcugccaccccggccuauauuuuauucaugcauucaucuguugauggacacuuagguugauuccauaucuuggcuauugugaauagugcugcaauaaacauggagguauagauaucucuuccauauacugauuucuuuucuuuuggauaaauacccaauaguaggauugcuggauuauaugguuucuauuuuaagauuuuugaggaccuuccauacuguuuuccauaaugcuuguacuaauuuacauucuuaccaacaguguauaagaauuuucuuuucuuugcauccuugccagcauucguuauuuuuuguuauuuuauuuuauuuuauuucauuucauuuuuugagauggagucuugcucuguugcccaggcuggagugcagugacaagaucuuggcuaacugcaaccuccaccuccccgguucaagugauucuccugccucagccucucaagaagcugggacuacaggugcaugccaccacaccuggcuaauuuuuuuuuuuuuuuuuuguauuuuuaguaaagacaggauuucaccagacuggucucaaacucuugaccucaggugauccacccaccuuggccucccaaagugcugggauuacaggugugagccaccucgccuggccauuuuuuguccuuuuaauaauagccauucuaacuguggggagaugauaucucauugugguuucaauuugcauuucccugaugauuaaucauguugagcauuuuuucauauacuuauuagccauuuguaugccuucuuuugagaaaugucuauucagauccuuugcuuuuuuuuuuuuuuuuuggcuuuugaguugcuugcacuucuuguauauucuggauauuaauucuuucuuggaugaauaguuuucaaauguuuucucccauucuauaggcugucucuucacucuguugguuauuuacuuagcuguguagaaacuuuuuaguuugauauaauaucauuuguguauuuuugguuuuguuaccugugcauuugaagucuuacccauaaaaucuuuacccagaccaauguccugaagcauuuuuccuguguuuuauaauuuugagccuuacauuuaagucuuuaacauauuuugaguuuauuuuuguauauggugagagacaggggucucucauucuucugcuguggauaugcaguuucuccagaaccauuuuuugacaaggguaucuuuuccccaauguauguucuuggugacuuugucaaaaauaagcugguuguaaauaggcagauuuauuucuggguucucuauucuguuccauuggucuauguaucucuuuuuauaccagugccaugcuguuuugguuacuauagcuuuguaguauauuuuaaagccagguaaugugaugccuccaacuuuguucuuuuugcucagaauuacuuuagcuguucagagucuuuugugguuccauaggaauuuuaggaguuuuuuuccguuucuaugaagaguguaauugguauuuugacagggauugcauuugaaucuguagauuguuuuggguaauuaauaugaucauuuuagcaauauuaauucuucuaaucaaugaauacgggaugccuuuccaucuuuuuguguucuguucaauuucuuucaucaguguucuguaguuucauuguagcaaucuuucacuuucuuaaauuuauuccuagcuaauuuuuuugguagguauuguaaaugagauuucucucuugauuucuuuuucagcuaguugaaugaauaacuauuuuaauggguaugaaguauaaacauuaacuucugaguugaauuugcaaauaaguuacaacugaaguuaguucaagaaauguuuuugagccuuugcuauauuguuacacucugagggaauaacaaggauuaauaauauauauugagucucuaggugauuuacaauguauuuucuccucugaauauauuuuugaacaaauaaauaaucuuauaauuuucauugaguggguggaaaaauucauccagagaccuuaugccaaaauuauagauaaaaauguuuauuaaacuuauuucccaaugaguauggucaaauuuuaauuauauaguucuccuuuggaaaauuaacaauagguacuuuuuucaacucaaauucauuuuaucguuuagauagagccugauagaauuaucuuagcauucauucuuccuuugcucuucaaaauguagcuugguaaauuucucucugaacugaacaaucuugaaaacaguuuauacuuaacugucuuugauuuuaauuuuuuguuugcuuuuagacuuuuucaguuucauuuuugggcagaguaagagaggaagcauuauauuuggcaaggucucuaauuaauuaauuauuuuuuaauagguuggacuuguugaaauaauccugauacauuccuacaauggccacugcucagcuuucucacugcaucacaauacacaaggcuucuaagguauuuguuaagaauuaaaagaaaaucaaugaccauuuagugaguuaguucagaauuaugauuuuaaucuuuuguguguguguuuuuaagcagcaguuuuaucaguuaauuggcacauaauauucugggagaguauguguacauuuuaacugccuaauagaccaaggaccagaaaauuaaaauaaauuucuacaaaguuacuuacugggugcuuguuucauguuuauguaauauauuuaggucuucuagaguaaaagaaaucagaaacaaaaagauguuuaaagagaaugguucuugguuagacauucacuuccuaaaguguuaggaaacuuguguugcacaccaugguguaauuauaagaacagaaggggagagcacugagagaaacuuggaugcuaggaggucuaggggagcaucccagggccaggcauauaguuuaguuugucucaugacauucauuaaugcauccuuuguuuauucauugagacuaaauauuauguaguauaauauucauuauacuguguaacucacugauaaaauacaaaaauaugaucuucaucuuccaaaaguuuauaaucugguuaggaguuaagucaauauacaaagcgauauaugauuuauauauaugugaaaaagaguaagacaaugcaaauuauagggauuuauuuagagauuucauguggacuggaaugguuuguauauuccucaugaaagagguaagacugaagguggacagaccuugaaugaugaagauaauuugcguagaggggagagaauucccugaggaaaacccagcauaugccuuggcucagaauaagaaauaagaugggcugauuacaaaauuggcugacugguuuuggacugccuugcagugaaaugcaugguaaaagcauugcacugucuuuuccuauaacaucucucucuuuuucuggggauccaggaucuaguauaaaaaugagacccuuaauuuuggggaucuguuuauaccuuccaucugugccuguuuauuaggcccuagaaacuacaugcuuuccugggccuguuuuuccaaggacuccacccugaagccaguaauccaauuaagaaacuuaaaaacuggcaaucgaaaaaucuuacaacuacugggucuucuucugucuguguauuuauauguguugcauguaugguguuuacauaaaagaguguuaauuaauuggcuuaaagaaaaauaaacacuuaaaucaaauauuuugucagaaaaauuaaaacuuuagugccuuuuaguuuacaugacuuuaauaaucuuuggaaaauacagauuauugguaaaaugaaaauaucuucaaaauuuaggcacuugauuuaggucagauauuagguuugcuaaaggcuuuaaugucauaaaaugcuucuuugauuuuuaaaaauuguucagcuuaccugcuuuggagccauuagagucuagguaaagccuagggacauguggaguuagccauguccccuggcuaugcugggaaaagucagacuuuaucugcacuccgccuucaaagauuauauuaacugguaauaaguauuauccuuguaguaugaauuaagagugauacagaauguaagccacacgagggagaggauuuuuauauguuuugcucacuacuaugucucagaaccuaaaacaguaccuagaauguaguaagauuaaaugcauauuuggauuaagauuuucauacuuuggaaaugggaaaaagagcaugccuggcugaaagaacugcauaagacaacauuuuccaaacuuauuugaccagcaaacacuuaacauuuuuacugggaguauauauucauauaaugcauagguguacaacuaaaugaauuuuuacgaacuuaacacauuguuauaagccagaagccagaucagaaaccagaacacuaccagcacucccucucaugcugucuucuaguuauuauuaccucuccccaccaagagaaaccaccaucuugacaucuaacagcauagauuaguuucaccugcuauuguacuuuauauaaaugaaaucauauacuaauacucauuuguaucugguuucuuuugcucagcauugugugugagagucaucuauauuacucaguauaguuacagaucauucauucucauugcuauauaguauuccauugggggcguauaccccaguuuuauuuauucuacuguugaugagcauuugggugguuuccagcaugggucuauuacaauaaugcuuuucugaauacucuaauucauguccuauagugaacauauaagcauauguguuggauguauaccuauaaguaaaauauaagucauaggauauguguauauuuagcuuuauuauauacugccaagcacuuuuccaaagagguugugcccauuuacccucccacaaccaguguuuaggaguuuuuauuauucuacauccuuuuuaaaacuuuuagccauuuugguggguguguaguauucucucauugugauuuuuuuuuuuuugacagucucacucugucacccaggcuggaguggugcaaccuuggcucacugugaucucugccuccaggguucaaguguuucuccugccucagccucccaaguagcugggauuaugggugccuuuuaccacaccuggcuaauuuuuguauuuuuaguagagacggggguuucaccauguuggccaggcuggucuugaacuccugaccucaagugauccgcccaccccagccucccaaagugcugggauugcaggugugagccaccaccccuggccuccuugugauuuuaaugcucacuucccugauaaaguuuaaacacuuuuucauuuguuuauuggucauuuggguaugcucuuuuauugucuauuuucacacaaguagacacuuuucuauuugauugucuuucuuaaagaauuuuaggaguucuuuauacauucuggauaugaguccuuuguaagaccuaugcucuuaauaguauauuaaugaaugaaguucuaaaguuuaauauagucuaauuuguuaauauuuagaaaaugcuuuaaaauuauaauguauugacacaacaccggcuggaauucaugagacauauuuugugcuuggcuuaaagaaaacagcaaaaagcagccucacagaauaauuaugacaaacagaucaaauuuuuauuuuuauguuaauacauaaacacaguaaacauuguguauacaauaaacauaguaugucaaacauauguugaaaugauaauuugagauaccggcacaacccauccaucagcaaauauucuacucuugguagacaccccuuacauacugaagcaaaagucacaaauucauauaucagucgcucucuuaucacauuccuuuuauggcacacuauuucuuaaggaagacuaucuaaucauuuaagaacaaugauuuaaguuuguuuacuauguuguauauauauacacacauaaaauuuagcaggaagcuauuccuaguauugauacuuuuuacagaacacuaugugacaucuuacagaagcuuuguguuccucagaccucuggcuuaagcaaagcacaaaaguauggaaaaacauggcaguagaauaguagaugaauagccacaauuccacauagcuagacagcagagugcaugggagagaauaagggagugugggcagggaggaaggggugcaagaugaggcaggagagcuaaacaagaauaagauuuugacaguucugaaaucccacucuaagguacuugaacucucuccuggaugaacacuggcaguaucaugauaagauuuguauccuugaaaauuaauucugauggcaauauggaagacagguugaaugaaagaaucguuagcaaagagauaaggggcuacugcaguaaucaaggagagaauugaguauguccucggucaagccaguggcagugagcagggaaaggagaaaauagauuugagaacucuuuuagagagaauuaauagaauuuagugggguaugaaggagagagaagacaaagaugaagcugcuucuagccuggaugacuggaguagugcugauucacuagucugagaaugagacuugggaucagguuuuagccagggguggcagagauaaacugaguuuaagggaucuacaaagugguuuaggugcagauguucaggaaauaaaaauauagaacugggacucagaacagaaauagggaccugaauuccuuuuuguauaggcuguagcugaagcuaugaaacuagaugagauuauucaagaagacagcuauaaaagagaaaaagccugaagacagaauccugggggauaaccaauauuuaaagaguagaacaacuggaaaaaauaaaagagacugagacagauauguacggauaggugaaaaaacaaaguaguguuguggcaccuuggagaggaaaagagaguauguggguaacagugucagauaauauaaagaaguuacauauuaugaggaaugagaagaggucaacuauaggauuguacuuggugacuuuggagagaauaguuuagaaaggaaaggaggaaaauccagauugcagcggggucugaggaguguaugagagggaagaagauuauauaaucauaguaaaacuccaguuucauggaucauugugaaauaaauuguuuuagucuugaauuacuuggguaauuguuucugccuucugcucugccuugccuaugaagaucuaauuuaauguaauauucaaagcgcuauuucuuuuugauuaccuucaaagauaucaaauuugaaguccugagaaaucuuuucaucauauaugugguaaugaugugcuaaacugaauauauuaaauaauacuaaucuuuuuucaccuccguuguuuuuccaggaaacaguuuucccaucccaaaucacuaaugagcaugagucauugaaaauggugaagaaacuuuuugcuacuuccaucucauguauaacauaccuaaggggccuguuuccagagagcucuuauggagaacgccauuuggaugguaaaguuaaacuaacuagucucuuuggcuguuguagccccuuucucuauuuagcaggaauaaaccuuucacgucucacaaagugugcuaauuccaacuuaagggccuguucuucaagaccaauuugcuaauccauuuuccauuuuaauuuuacuguguguagugauuuuacuuauaggaauuacuaguuccuagcuagacgccaggugacagauggaagaaaaaagaaauguuuggacaaguccaguauaaaagcaacagcuagaucaaaaucuauuugaaugcuguagauuugcgcuacguugugccucaauugaauuuauucuuuaagguacacuuuagcauugaggaaguucaaaggaaccaggugaaaaacuuuucucccuguuaacguauauaaaaauacuggggauaaaaaagccaaacucacuuguugauuaacauggauauuaaaauaauuauuauucuaaucaguucuggcuuuuuucucaauugccaggucuucuacuuucauuccuuuuguuucagugcucuuaaacuuaucaucuuauugucuuauacuacaagcuguuucuggccccuuuucuucucuuauuauaaaaacaaguaccagccaggcaugguggcucaugccuguaaucccaacacuuugggaggccgaggcgaguggaucaccugaguucaggaguucgagaccagccuggccaacauggugaaacacugucucuacuaaaaauacaaaaauuaguugggcauuaugcugggcaccuguaaucccagcuacuugggaggcugaggcaggagaaucacuugaacccaggagacagauauugcaaugagccaagaucgugccauugcacuccagccugggugacaagagcaaaacuucaucucagaaaaacaaacaaaaacaaaaacaaaaacaaaaaacccaaguaccuaggacucaacaaguuuucaaaaaucuuauuuguuuaaaaagcuggauuguguaucaugaaaauggccauacugcccaaaguaaauuauagauucaauguuauucccaucaagcuaccauugacuuucuucacagaauuagaagaaacuacuuuaaauuucauauggaaccaaaaaggagcccauauagccaagaaaauccuaagcaaaaagaacaaagcuggaggcaucaugcuaccugacuucaaauuaugcuacaaggcuacaguaaccaaaacagcaugguacugcuaccaaaauagauauauagaccaauggaacagaacagaggccucagaaauaacaccacacaucuacaaccaucugaucuuugacaaaccugacaaaaacaagcauugaguaaaggauucccuauuuaauaaauggugcugggaaaacuggcuagccauacgcagaaaaccgaaacuggaccccuuccuuacaccuuauacaaaaauuaauucaagauggauuaaagacuuaaauguaauaccuaaaaccauaaaaacccuagaagaaaaccuaggcaguaccauucaggccauaggcaugggcaaagacuucaugacuaaagcaccaaaagcaauugcaacaaaagccaaaauagacaaaugggaacuaauuaaaccaaagagcuucugcacagcaaaagaaauugucaucagagugaacaggaaacauacagaaugggagaaaauguuuccaaucuauccaucugacaaagguuuaauauccagaaucuacaaggaacuuaaaacaaauuuacaagaauaaaacaaccccaucaaaaagugggcaaaggauaugaacagacacuucucaaaagaagacauuuaugcagccaacaaacauaugaaaaaaagcucaucaucacuggucguuagagagaugcaaaucaaaaccacaaugagauaccaucucaugccaguuagaacggaaaucacuaaaaagucaggaaacaacagaugcuggagagaauguagagaaauaggaaugcuuuuacacuguuggugggaguguaaauuaguucaaccauuguggaagacaguguggcaauuccucaaggauauagaaccagaaauaccauuugaccaaguaaucccauuacuggguauauauccaaaguauuauaaaucauucuauuauaaagacacaugcacacauauguuuauugcagcacuauuuacaauagcaaagacuuggaaccaacccaaaugcccaucaaugauagacuggauaaagaaaauguggcacauauacaucauagaaaacuauguacccaugaaaaauaauuaguucauguccuuuguaggaacauggaugaugcuggaaaccaucauucucagcaaacuaacacaggaacagaaaaccuguguuauguauguucucacucauaagugggaguugaacaaugagaacacauggaaacaggaaggggaacaucacacacuggagccuguagggggguggggggcaagggaaggaauagcauuaggacaaauaccuaaugcauguggggcuuaaaaccuagaugauggguugaugguugcaacaaaccaccauggcacaugaacaaaccugcacuuucugcacauguauuccagaacuuaaaguauuaaaaaaaaaaaaagcuggauugugaaucuuguugacuugucacuaaaauaggaacugucauuuggaaaauaaacauagagagcuacaaguugccuuguaagauguuauuuuucaaaaucuaauuuuaaauuucuuacaucuguauuuaaugauauaccuuggccucauuucagucuaauucucuugguugggcaugguggcucaggcuuguaauccaaaguguaaccauaacacuuugaaaggcaaggugggcagacugcuugagccuaggaauccaagaccagccugaacaacacggugaaacccugucucuauaaaaaauacaaaaaauuagcuggccaugguggugagugccuguaauuccagcuacucuggaggcugaggugggaggaucaucugagccugggggguuaaggcuacagugagcugugauugcaccacugaauuccagcuugagugauacagugagacucugucucaaaaaaaaaaauuaucuuaaguaauguaagagcaucaauaaaaugcaugugugcuauaagcacauaaacaugauauuugcaaucaugacaaccucauuuguauuaugacaucuuuuggucuaugagauacaaacuuguaauagugaauguguuuauaucuaacauauauuuguaauuuucccucuugucuagaacauagaauugagaaagacauauuuuugauaauaagcacauauugugugccagucacuacccuaggcaacggcaaugauaccauucccuauagcuuuauuuuuugugacaguuauuguggaaguuuuaugucucccuuucaauguuuguucuuaaaguaauauacaucauaaaaaugcuuaauacuccugugucacucucuuguaauuucugaauguuauaucaacaugggauaauuuucauaucccucaauagagauacagguaacaucaauuuuaguauaggaaaacaauacgaaaaggugaaguugcuuaugcaaaaucacacauaaaucagugauugaucuuggacuacuuuaaaccaaaacucuauuuauuuauuuugagagggagucucauuucauuguccgggcuggaguguggcggcaugaucauuacaggauuacagcuucgaccuuccagccucaagugauccuccugccucagcuuccugaguaguugggaguauaggcaugugccacuaugcccagauaauuuuuuuaauuauuuuuuuuagaggugagguuucacuagguugcccaggcugguuucgacguccuaggcucaagcaauccuucugccucagccucccaaagugcugggauuacaggugugagccaccacacccggccuaaacccaaacucuuaauaugauauuccuauucuucuuaaguauaaaaagguagauuucggauaaaauaaauauuugagaauaauccgugugaaauuuuuuauuccuuccuuuucaaugagagggagagaaauaacagggaaaugacugauauuuagguguauauuuuaaguuggucaauggagauagucucaauacuaccucauaauuacuuagaauucuacagcggcaaagaaaggacacaaauugauuuuggagccaacucaguugugcuacauuguagaagggggaaaauccuuacuguaaucgaaauugagaccaagcuacuucuuaacauaggauuuauuuuuaaaguagauguuuagagauccaaaauguuuuuauaagcuauaaaacuaaauaaauuacauaaauaaaauaguuaaaggaaauacccuauuuagcauggacaauuucaguacagcagucauuuaguagauaaaaauagacuguguuucuguuuuuguagaccucaguuuaaaaauccuccgagaagauaaaaaaugucccgggucacugcauauuaucagaugguaaguaauagaaauucuauaaaaguugaacaacauuauuuuuaucauggcugaaauuacccauaagacuuuauuuaguaagaucauuuuuuaaaaaaccauuucuucuuuucuacuuucccucuuucuuuuucuuuuucuguuuuugauuuuuuuuuuuuuuuuuuuuuuuuuuuuuuugagauggagucucgcucugucccccaugcuggagugcaguggcgcaaucucggcucacugcaaccucugccucccagguucaagugauucuccgccucagccucccggguagcugggacuacaggugcaugccaccacgcucagcuaauuuuuguauuuuuaguagagacaggguuucaccaucuuggccaggauggucucgaucucuugaccucaugauccaaccaccuuggccccccaaagugcugggacuacaggugugagccacugcccugaccuacuuucccucuuucuuuuuaaaaauaauuuucuaggaauuuguaagaauuauucaauauaauuuuaagacacugauuuagcuuuuugaaagaaaauugacuuguauaaaaauaaaaacugugauaaaauauuaaauauauacaccuauuauguacccacacagauuuuaaaaauugauaauucaucauaugugugucaguguacuaaacaugggauccaaaaaaauuugguucacuaccacaaaauagcucacuauuacuuauaaaggucuaucaucauauuaaaaguugcuggaaguuuaaaaaaaugauuaaaugggaaagguaagaugguuaucaacuuaauguacaucaaagcaaaaagugcaaaugaauucuguacuuggaauuuuuuuggauuugcauaugguccaauugacaucaaacauuuauuucuugacaggauucaagguuguuuugaugcuuuggaaaagagauacguaagaauguuuuuacacuuacacuggaaucaaaggcuugucuuuuauucuuuaaaaaaagaaauuagacauuuauuuuguuuuuguguuuaacaguauaagugucuacguuugcauccauaaacuaauuucuuaucuuaugucuuuauuguccuguuguugucuccuuugcaucaauuagaaagaaaacucauuuuuucucuuuuacauacucacauuuuuugaccacagaguuuccucugaagucacuggaagagauccacaggaugugggacaggagagacaagaaucuggcauuuagugcauugaacaaauuuagaauaguggugauucaauuugcagauaugaaaggaaaaaauugacuugaauaauugguuuuuauucugucuuaguuauuuugguaacuauauuuuguucauaaguauaaucuauucccuuacaauagcuaguauuguaccucaaauuuuaaaaaaauacagcuuaaauuuuaagugcaucugaucuuucaugcugcccaagacagcuaugaaggguguacaaaauggaggcucuaguccuaguugaagagacaagauguauauaaaugaaauuucucuuuuucuuuuuuuuucugugaagcuuuuauuaugaacagagggcagggcaaggcagggggcucaguccuuggcagcggcuuuccucaugguggccaggacauugcgcagcuccuccuacuuccucuuggugcggauguguguucccaccuuuuucuugaugaacuugaaggcccuuuuguccuuggagaccuugagcuacuccaugggaugcugcccauacagggugaagccacacaccucucagaucauaucccgcaugaacuugguguguuuggucaggcaccugcgauggcagcugggccugggcuugcucacauucuuggucaccuuguggcccuuguugaggcccauggcuguaggauaaagcagaaccauggcugcugcucuccagugacagccaaggccuguaaguauuugaaauuuccgccacugcuuuuccccacuuucuccaucuaugucuucuuuuuacuccucaauuccuguuccuuuaagaaaucuugaggucaggaagccuuacacuggauuauuuagcaaauucauacauuucuauuuccacugcacauuuguuacuuaugauuuauucaacacugaccagagggaccuagggauacaaagauaaaacagaagugggaaagagcuuguaaccauggcagaagauaagugaauucauaugcagggcugaugaucagcuguuacauacugacucagcuguaucugcucuuaaaauauugaaauauuucuguauugaauggugaauagcuacuuuucugagaccucauguggcuccccaucaauauccuccccaucaccuuacagugucucuuuugggaucucuccagaacacuccaaaauccaguaaccaaaggguuaauaucuaguccgaacguugcuuccaggaggccagcucuagagccaaauuggcauccuuucugauuggccaguaucuaugucauauugggcuuuacauguuuauuuauuaauuuuuuugugaguguguggcagagucuuacucuguugcccaggcuggagugcaguggcgcaaacuuggcucacugcaaccuccgccucccagguucaagcgaugcugcugccucagccuccuaaguagcugagauuacagaaaugcaccaccacacucggcuaauuuuuguauuuuuaguagagaugggguuucaccauguuggcuaggcuucucucgaacuccugaccucaagugaucugcccaacucagccucccaacaugcugggauuacaggcaugaaccacuucacccagacuauauauugauuuuuuuauaucaauuugauauuuuuauguaaaaauaucagagauauuucaaucaccccuauaaugcucauuagaaagugaugcaugccaaaagacagauaaugaucauaugcaaugggaaguaugggaaaggaggcacuauacccugugagaaacaugagagaaaucuuuugagagaaaauagccucugagcuuuggaggcccugaauauuuggacagauugagagggggagacggccaucacuguuauacugaacagugcucacucauuccccuucauccauucauuuagcagcauuuccugacuguuccucauugaggggcaguacaauauaguuagaacuucaaguuuuggagucagauggucugaagaaucccaguucugucacuuaacaccugugugaccuuuggcacguaaccuaccuuuugguaccuuaguuucuuugcauauaagauggggauaauaauagaauccacuuguuaaggauauuugauaauuaaaugaguuaauaaucuaaagcagugguucucaaacuuuagcuugcaucagaaucaccuggaggacuuguuaaaacacauguugugaagccucaccucaaaauuucugauguaagaauuugcauuucagacaaauuauaagagaugcucuugacugcuggucuagggaccauaauuugaaaaccacugaucuaaaaugguuagaacaaugccuggcacauaacaaauacuauguauguguuaaacauucauucuuuauacauuggcuauuuaaucugugccagacacugugccuaagcauuggaugagauaauaaugagaguaaaaugugauuccacucccagggaggucauaauauaauagggucacuucuuaaauaaaaaauuauaaguauuacauguacuaaaauagcaguauaauguacaaagaguaucuagcuaguuugauaaauuuauuuuacuaaaugucuaccuguaugacugacucagucaaaauagcuuguuuuggagagaucaaaagacaaaauuuuagauagaugacuuagucucuuaaguaaauaguauuuauauuguuuuucaguuguuaaucuuuuauaacuuuccucaggugaucuuguagcugguaugauauguuuuaaaaguaguuugaggccgaacacaguggcucacaccuguaaucccagcacuuugggaggcugagacggguggaucucuugaacccaggaguuugagaccggccugggcaacauggugacacccugucucugcuauaaauacaaaaaauuagcugaguaugguggcuggugccuauaaucccugcuacucgagaggcugaggcaggagaauugcuugagccuaggaggcagagguugcagugagcugagaccaugccacugcacuccagccugggcgacagagcgaaacuucaucucaaauaaauaaauaaauaaauaaaugaaaauaguuugaguaaaaucagauuugaguaucuagagaucuugaaagguguuccccuguaagagcaugauuauuucuaguuaugaaauuuugugugauuuuuuuuuuuuuugagacggagucucgcucuauugcccaggcuggagugcaguggugugaucucggcucacugcaaccucugccucccgaguucaagcaauucuucugccucagccucccaaguagcugggacuacaggcacgugccaccaugccuugcuaauuuuuguauuuuuaaaguagagaugggguuucaauuuugggugauuuuuauacuuauuuuguacuuuauauuaugcuugaauucuucaaaauaaguacauaucaguguugcagauaauuauuguaaaaaaagagacuauauuguauauagcuaucuagcuuguuuccuuauucgcauucucaaucccucaccauuccaacccacuguccacacugcauacuuucagaaacccaagucugaucaugucauucuuuugccuaaaaauuuuccacagcuuuuaaaauaaaguucaggguccuucacauggucugcaaggccuguaugaucccuaucuuccuguccagggcaucacugucauucccauguucaagccacacaaagaaucuagaacaugccaagcuccuuuuaccuuugcauauauuguuccucuugccuggaaacuucucuccccugccccauacaccuugccuggcuaacuccaauuuaucugucaagucucagcuuaaauauuuacuucccuagggaaguaaauacuucccucccugacacccuccucccuagccuagauggucccuuuauuucauguucucauagcaucccaugcugcuucuucauagcaaugaacacaauguuaaugauguagcuaucuuugcuauuuuuuuguuguuuaacguuguucuccccugcuagucuaaauguucccugagauugggaccaugucuauuuuugaaugaaugcauaaauaaaugaacucaauuaaguaauguaugaguuuauaugcaguaaucaaaauggccacacaguggcaguaaaguuuuaguccuuugauaugaaauuaugguucugaaauuuuuuuucuuuucucuuucuuucucucgcucucucuuucucucccucccuccuucuuuccuuccuuccuuccuuucuucuuuuucuuccuuucucucuuuccuuccuuucuuuccuuuccuccuucccucccuccuuccuuccuuucuucuuuuuuuuuuuuggagucucucucuguugcccaggcuggagugcaguggcguggucuuggcucacugcaaccucugccucccggguucaagugauucuccugccucagccucccgaguagcugggauuacaggugccugccacuacaccuggcuaauuuuuuguauuuuuaguagagacgggguuucaccaugucggccaugcuggucucaaacuccugaccuugugauccuccggccucagacucccaaagugcugggauuacaggcgugagccaccaugcccggcccucucuuucuuucuuauaggguuucacucuguugcuuaggcuggagugcauuggcacaaucacagcucacugcagccucaacuuccaggccucaaacaauccuccugccucagccucccaaguagcuaggaccacaagugugcaccacuaugccuagcuaauuauuuacuuuuuguagagauggcaucuuaccauguuucccaggcuggcuuugaacuccuggguucaaaugaucugcccaccuugggcucccaaagugcugggauuacaggcaagaaccacugugacuggccugaaauuuucugauuuguauucuaguuuuuaaaaacaauuaucauuggcuugauuauauuucuaucucuauauguuacucuuucaagcagagauaaucuguucauaguaguguauauguagagaggacaaggacuuuauagacauauaagauguuuuuacuuuaguagauuaguuucaaaugggacacuuuuugagguacuuguugcauauuuaauuauuuaguaauaaugaauuauuuuguauaccuuuugccuccagaacuagaauauaacuuuuuaaggguagggauaguuaucuuuuuugugucccucucgucucuagcagagcccuguguacguaauggacucucacuugaaugagugaauaguuaguacaguuggcccuccauguaucagagcauucuacauccacagauucaaccaacuggaaaauauuuagaaaaaauaacaguacaacaauaaaaauaauacaaauaaaaaauacagugugacaaguauuuauauagcauuuacaugguauuaaguauuauaaguaaucuagaaaugauuuaaaauacaguugaacucauuacacauuauauacagguaucaaaauaucacauguacccccaaaauauguacaacuauuauauaucaauuaaaaaaugcuagucuuucagaaauggagagaaaaaaagaaaaaauuauaggaaagaaucaguuuucagauaucuaggaaauuccccuuuauaaugcaaaaaaauugcuaucgaauugugagcauauacuuuuuuuuuuuuuuuuuuuugagauggaaucucgcucugucgcccaggcuggagugcaauggcgugaucucagcucacugcaaccucugccucccagguucaagcaauucuccuguuucagccucccaaguagcugggauuacaggcacaagccgccaugccuggcuaauuuuuuguauuuuaguagagacagaguuucaccauguuucccaggcugaucccaaacuccugagcucaggcagucuacccaccuuggccucccaaagugcuaggauuacaggcgugaaccaccgcacccggccucauauaauauacuuuuagcauaaaauuaauuuugaccuuccuggaaaaaaguacaguugaccuuugaacaacauggguuugagcuucacagguccacuuauauauggauuauuuucaauaaauacaguuggcccucuguaucuguggcuuccacaucugcaaccaaagguggauugaaaauacaggacggggccagggcagugguucacgccuguaaucccaacacuuugggaggccgagguggguggaucacaaggucagaagaucgagaccauccuggccaacauggugaaacccugucucuacuaaaaauacaaaaauuagcugggcgugguggugcaugcguguaaucccagcuacucaggaggcugaggcaggagaaucgcuugaacccgggaggaggagguugcagugagccaagaucacgcuacuguacuccagccuggugacagagcaagacucugucaaaaaaaaaaaaaaaaagaaagaaagaaagaaagaaaaagaaaauacuacaggcugggcacaguggcucaugccuguaauuccagcacuuugggaggccaagaugggaggaucacuugaggucaggaguucacgaccagccuagccaacauggcaaaaccccaucucuacugaaaauacaaaaauuagccgggcauugaggcgggcaucuguaaucgcagcuacucaggaggcugaagcaggggaaucccuugaaccugggagacagauguugcagucagccgauaucaugccacaacacuccaaccugggugacagagugagacucugucucaaaaaaaaagaaaaaggaaaauacaguaucuguagaugugaaacccagauauggaaggcugacuuuucauauacucccugagguacuugaguacacauggauuuugguauucauagggaguccuggaacuaauuccuucucagauacugagggaugacuguauccuuuuucuucuggccuucuggauauuuuuuuccuacccaaaucuuucgaaccucucugaaauaauauuuuaauuagucuauugaaaagaaugauaauauaggugcaaguauguaauaauaauaguuuuuuuuucuuucucuugaagcuacguauggcaguacugacaguaaguacacacucauuuaaagaccaagccucugucucuauuucauugucuuuuggcaagugaaacauuaaaacaguacucucccucuuccucccugacuuuuuuuuuuuaaucugucuuggaauuaaaaacauaggaucuaucagaaguuuaauaaaagauuaugaauuguauauuucuuugguauaauacaugggaaaauguauaggcuauacuaucugcuucauuuauuggcucucaggauuuuauuuuuuuaguuacuuuacagacuccaaauuuuuuguuuuugaaguuugguagacucuuuugaaauuuuguauaccucugaguuuaacauguuauacauaguuaagaauagaaaaugagaagauaccacugagagucuuagaucuaugauuuauugaacaaauuuuaaaccauaauggauuauuuagaauuuauuuguagcuuagucaugguaauuaugaauccuucauuauuaauuuccuuuuauucaguguucacagaauauucuaaagacucuacauucacaaaauaagcauauccuaucucuagcuuaaaauauaugucuguacucaacuaauagaacacaaauugaacucuauauaaaaaagguauuugaugaggaguaaucuaguaaauuccagaaauuaaaugauguuuauuuucccuuauacagcuuuacacagaucccaugggaucugagguaagaacacacacaaacguauagguggguaguauauguauauuauauuuuaagauguuuuucugaguugaggcuauagauuuuguuacuagacuaccauaugagcagaggaacuaauagugggcucuuucaguauauuuuacucuaaacuugaccaaucucuuauuaugagauuuuucaaaaacuauguaaggguauuggggaaaaaaggcauugagaagaacugagcuuauucccuaaccuguuggcauuaagagucucuuaauguauaaauguauaaaaccacauuuuuuucuuaaaaauuuuuuaaauuuaauuuuuaugaacuuuuuuuccgagucauauaaaaccacauuuuauuauuuauuuaaacugauuaugaaucuuuucuguuuauggccuuuugggaaaauaaaugagauauggcauaacucuaauuuucauuuuugccaacuaaauucucccucuuuucguguuuuuauagauuuucagagcuuuaccucuuuacuucucucuuuagauuucuucccucuguuuagggaauccgacucaucuucaaggccaacuauguucauaucuuauauguaaaccucuuuggcuauuuggucuauacuaacuucuuucuuuaaauucuuuuuccagcagaaccccacaauuuaacacucucaauugauucauauugauuacuuaaucuccucaaccagauugugaauucuucuuuuuuuuucuuuuuucuuuuuuuagauggagucucgcucuguuacauaggcuggcucugccucccaggcuucuagcaauucuccugccucagccuccugaguagcugggacuacuggcaugcaccaccauggccggcuaauuuuuauauuuuuuauauuuuuaauuuuuauauuuuuaguagagaugggguuucaccguguuggccaggcuggucuugaacuccuaaccucagugaucuuccugccuccuccucccaaagugcugggauuacuggcaugacccagcaugucuggcccagauugugaauucuugaggacaagagucuugucucauagucuuggacacauaauaguuacuugugccacuuugaauguggcugugggacagaaauugagggagaaacuuucuguucucuucucacuuuacucucuuugucuuucuccuagcuuucuuuccuuuuucuuuacuuucaauuuuccuucucuaagccuacauauuuagccuaacuggugcuauucuagacuaaauuaugcauuuuuggcucuuaauauucuuucuuugcaagaugacauguagcuguuuaagcaagggguaagaaaacuuuuacauacgguagguagcaauuccucaaugcccaaacuaguucuaucuuuuauuucuuugucuauuguuucauuucaaaaugguuccccaccacacuguaaguuugaagggaaguuucccaaaauaaaaccuucugauaguuacuaaauugaucauuuucuuaguguaguauuuaucauguuuucuuaugcaugaaaacuuccuaguuugaaaccaguguuuuuuggggguagugaaaugcuaagcaaguugaguuuaauuacaaaaaaaguauuacagagugggaagaaaugcaggcauauauaauaaugaaguuaggaaacaaaagcugguuaugugguaaguuuugagcuaucauuuaugacccaggaaaaaauauuuugaauguuuacagaguguuccccuuauggguagauagugaugccuaaccucuacguguucaugguauacuuuuuauuacuaaaaaauucaguagcauauuggguaauacuaaaacacucaaaggagcccaaacaaaucaguaauaauuacaauguaacuacuacugugguauagcaauguucauagggccuaaaaagcauccacaaguuacauuauuuuaugauugcuauuuagcaucaagucacugauaaaacuauuuagcucccugaucucauucucuuauguacucaaaaacaacauucuaacauaaacaucgucuuuggcauucaucucauauugugccauguuucuugaguuauaugccuggaaguauauccuuuccuaaacaaaauugcacaaacaauaacaauguuuauauaugccugaagcaaaaauacacuagacaguuggauuaaaauuugcagcacucuugugaagaguaugucaugguauaacaauugagaaccucuggcuuaaaucaaacaagugugugucccuaguucagaaggccaacugaguuuucagcauucuacaaaguuaugguacuucugugcuauaaguuuuguucugguugcuccaucucaugaaagagaugaccaacgaaaguaacuaagcaucuaaguaaacuaaguacuaaaguagugaagagugauaguguagcuuuucuauaggaacacacuacaaaaugaguagcaaguauuaguaaaacauguaagccaaaauguaaauaagauuuacacagcuuaaugcauauaagaccauauagaauuauuauauaugaauauggugaaggcauaaaucuuaugguuucacuaucuauuccuuugugccuguuuaccauuggaggugaucaauacucuuuauuuuuuauuuuuuuaagagacaggcucucccuccaucacccaggcuggaguucaguggugugaucuuggcucauggcagccuugaccuucuaggcccaagcgauccuccaaccucagcuucccaaguagcugggacugcaguuguucgccacaaugcccaguuauuuuuuaaaauuuuugcaaaugugggguuauguugccccggcuggucucaaaggauccccuugccucagccucccaaaaugcugggauuacaggugugagccacugcacuuggccaacacucaccuuuaauagauugccucauaaacuuaacuauaaguaguguccauuucuagccacaauauacuuuuagauacuuuauuuuagaaaaaaaucguuguaggaugaaauccuaaguaagcaugaacucuaccuuggccaaauauuuauucauucagcaaauauuaauuggguuccuuuuaugugccuagcacuguucaagguauaaaaacacaggggugaaugggauaggcaagaucccugcucucuagaagccuacguucuuaugagguaggauaaacaauaaauaaauaaauaaaaauuaguacaaacaauuucagauagacauagugcuaugaagaaaauuuuuuaaacaggugauguacuagagagugcugaaguggagaaugaagaaggagggauuggauggcuguguuagauugggcaguuccuaggaggcaucccugagaggcuacuguuugagcugagaugaauaaccagaaggagucagcccaugcaagucugugaagggcaauggcaugugacaggccaaauaacaccacaguuaacaucacaggcauuggcgucaaaucgcaguucuaccacuuacuagcuacaucaauaaugagacuaaugucuacuucagaguguuggcuacacaaggagaugaacuugugaaauauuuagggcagugccugaauauuauuauuaucauuaaccggagaccacauguuccagaauauagcugugcaaaggcccuaagacaggaaggaaucuuggguguuugagcauagaaaaggugccaugagccuggagcuuagcugagugcaagggaaaguggccagagauaagguuagagaggcagacaggggacagauggguagggccuugcaaaucaagauaacuuuuggauuuuauuuuaaggguggugagaagcuaauggggguuuuuaagaaaaugagugacauggucugauuuguauuuucaaaaacuacuuuuggcugcagaacagagaaugagcaucagauggacuugcaauuugcuuuagagauagaccugaaaagucuugccaauggguuggaauguggagggagaaggagaggcugcauauguugcugcugcuuuggccuaugugacuauauuuaguaugauucauagaaaccacugaugagcaguucaaugguucaucuuuauuaggcaacacauuagucugaaaaguguuauaugagguguuaagaauagugccugcuguaaauauacuuuccuagauaagccagagucagacugaaguuaauuaaggauuagcaucuucuguaaaacaauuauaacuauaacucuuuuauuaguugcuucagggaucaaauaauaaaguguaaauaaaauuaucaacuacuaaaacaaccuacucuuguuacaauuuaaaaaaacaaaagaucacucagagcauuaaaaagcuagaguugauugagaaacaugggcaggcaggaagaaugagcauuguuugcuuggcagagcaauuacacccagcauuggcuaagagaggacucuguucaucucgccuaucuggagugaaccuguugcuauaggcuccucuaaucucaucugucucuccuauuguauuuacaaagcaguuuucugaacuugauuugauuucucaaguaggcugucuuauucagaaaauacuuuuaucuuuuaaaauuaacuccauuacaaaucaaucuccuuagaguuuaagcaucaugagccaauuuucccaagaucugaucaccuguaauuaaguuucauguuaagguuuaagaucagcagagcugggaggcuuaaaguaacagaaacacugagacuuuuucugaucagucugacauccucauuuucacauugucaaggaucaaauacugaaccagaugaauaaaggacauuuuuuguguucuguuuugagcuuauacuguuuacuugucauuaguacuucuccagcucuguggacauacuguaugacauaucugggccaaacauuugcuucaacuacuagauguuuauuuuauuuauuuauuuuuaaaauuuaauuuaguuauuuuauuuauuuauuuuuauauuucaguuuauuuuauuauuucuuuccuucuauucuauucuauuuuuugagauggagucucgcucugucacccaggcuggagugcagaggaacagucuaggcucacugcaaccucugcuuccuggguucaagcgauucuccugccucagccuccugaguagcugggauuacaggcgcacaccaccacgcccggcuaauuuuuguauuuuuaguagagacaggguuuucccacauuggccaggcuggucuugaacuccugaccucaggugaucugccaaaaugaccucggucucccaaaaugcugggauuaugggcgugagccaccaugcccagccagacauucauuuuauuuuaaauggaaucuaucucuuaugaggaaauuugucccucuuuauuucuaguuuucuuaacagugaggagagcagauagcaguaguagcaucuaguuuucagugcaggacugaaaaaacaagacuugauaucagagaucagggcuccuuuucuaauuuuuguaauuuuccuauugccauuauagucuucccugaauuacugcaguagacucuuaauugcucucaugguuuuuauuucuuccccucugcacuuuuaaaggagccaagaugauguuuaaaaaauacaaaucacucaccugcuuaaaacucuuccguagacuucuagcuuacuuagaaugaaauccaaaccccuuaccauagccaacaaggccccauagucuccuuuaucaccucauuuccuggguucucccccucgcucacugguuuccagccacugggccuccucucugacccuagaagaggcaucccuccccacuucagagccuuugcauugcuguucccucugccugaggcaccccacccccaagaucugcacauaacugacccuugaggcucaguucaaaccucaccucuucagcaaggccuuccuuggcccuuccaaaccaaagcagcacuuguccccuucauguaccucucuaucacagcaucugcuucuuguucacagcacuuacacuaucggaauuagcuuauuucauuuguuuacuuauuuacugacuauuuccccuacuggauuguauguauauuccagaaaaacagggaccuuuucugucuuguucaccgcugugacuccagugacuggcacaaaguagacauucaauacaauauuuguuacaugaaugaaugguuucucaacuguuuccacuguuguuuaccuaguuugguuagauauuugacucugugauuuuguuuuuccagcuuuaaaaugguaauaauaguaucuuucaucuaauuuauuuuuagcauggaggagaaaaacuagguugucuuuauauuuggaaauauuacucuugaauaaugugauacugugaaacaaacagcuauauaggaaguacaguagauauacagugaaaauguuccuuacuuaugaucagguaagauucuggauuucuuuucuaaauucuuuuuuuucuuuauuuccuuugguuuuuguagaaggugacugagauguaccaguucaaauucaaauacacgaaagaaggagccacuauggauuuugacagguagaaucuaacugcuuaaugaacaugagaaauaaauaggauugagguaaacauaagcuucuugaggccagagaaaggccuuauacuucuuuacacauuuccccacaaacccuacagaaaaccacuauuauaaaaaggggcugcaacaauuguuuacauuccugaaauccauggauuaagcuggugggaauagagaaaauggcaugcagcacaaagguagaaauuaugucaauaagguugccuacacgcuauugauugaauaacuccauaaggcucugucuagccauuaauucaaaguuucucaacugcuaugccuagauagcgauccuuuccaccucgauauagccagccugugccuaggguagauaauacccuuggacuauuugcccguaugcacaaauauucucauuugcuuaccccaguaugucauauaaauaucauuuccuuguguccuuguaugaaaagauuagaaagcacugcaguuuccuuaugaagucgaaaauuccaaguuuuagguuacuaauggguuaaauagcaaacacaaggacauugaagagcaacguuuauuuuucucccaguagcuuuuggauucagaccugccaggggggauggagagcuaaguauugcugaugagauggcacaguaguggaagguacagaugauggugaaaagcucuggauaguagaggaauccaaguaagggggauggaugcccuugaaaggaaagacugaugagagacauggccuaauuuucaauuuucccuacuauuagcucuggcucaucauuugccaugagcuugaggacuuuucuccaagauucacucccuugauuauccuuccauuuguaaaaccuacagacagcacuagaaugugaagagaaaaucaguuccaaaaaugagaauuaaaauauuaccuuuuauuagcuaacauuuguauaauacuuuacagcuuauacagcagcacuuuucauacacguuuucucacauaaaaaguuaccuuuacucuccaaaacucaaaaauauacacugauggccagauuaaacucuuuuguucugaaggcacauaugccaagagguaagcuguaaaacaaaaauggccaaaucuuucacaugcuaaggagagaaggugaugcauauuauuaauuuccuagagaagaaauauaggcauuuguuuaaaugggaguccugaauaugauuuuacugauguguccuggaggcucccaugagcuacauaucuauagcccuucauucugguuaccuacauuugaauugguuaaauccugguuggcagaauuuuaaguuguucaaaauuggaaaaggagcuaauguauucacuuaauaaauguuugcuucaugaauucacacugucuccaaagaucaguuagggaaaaauccaacauuucaauuacuuaggguuauuuuucauauuaagagcuaacuaugugcacagccauguguaaauauauuauagucauggucccuccuggaaacuacucaaaugugagacuaauuguggaaggaaacuuuggagauaaaugaacaaaguuuagaauuggaagguaauuuaguccaaauuguucauucauucauuaauucaacaaauguugauugaauagcugggcaccaaacucuguacuguggagaugaaagauauagccacucacagucuagagaaggacaaauaguuauccugaggaugagaugaggguauuaucagagaagacuucuuugaagagucugcgcaugagcuagguauuagaggauaaauuuaggacagucaggaagaaaaguggaaaagcacaguacaagcaaagugaacagcauaugcaaauacuuugagugagaggaaacugggcaauagcugcagaugaggauggaggugaggauaugacggguugugaaaggaauuguauacacacugucuuugaauuugauugaaaacugauggauauaauagaagaauucuaaguaagaaggugacaugaacagauuuuccuauuaguaauauuauuucagcggugauauggagaauauuuuguaguguggacaagaaggaaagcaggaaaaauaguuagauagccacuguaguaaucaaugcaagagugaggaagggauacuuuugcgagauaaucagacgguagaaagucccagagcuggugauugauuuuaugcuugagaguuguagaaaugucuuuacgcuuaucucacaaaugagcuaacugaccuagagugugucuaaaugacuugaccaaggucauucagcuaguuaucagcagagcugauauuagaugccaggucaccuaauuccaaauucguuguucuuacuguugugguauaugauuuuuuucaaaucaaauuuuuaaaaagaucguauuuuaaaugcuuuuagggaauuugcuacuuaagaaauucuuuguauauacauugcaaaaaguaccaucgcuccccuaauuuacauucuaaaaaagucucaaaauauacuaauguuuaauuuauauuuacucacauagucaaaaguuuuguuccuuuugggauagauugccacuauuguauaugaucaaaaaguaugcuuuuuuuucuguguagucauagcagcaguacaagcuuugaaaguggaacaaacaaugaagauauuaagaaagccaguguucuacugauccguaaauuguauauacugaugcaggaccuugagccacuuccuaauaauguuguacuuacuaugaaacuccacuacuauaaugcagguagguagagaacuuuaggcaaauuccuccuuaagugcugagcuaauauuuucuauaaguaaaaggauuuugcaggcaucugaaagagaagucuguugcuacacaugaaagauuaaucggauuuguuguauugaaacucaguuuucauggcuuuuugcccuuuucauuucgcagugaccccacaugauuaccaaccccucgguuuuaaagaagggguaaauucacacuuccugcuguuugacaaggagccuaucaacgugcaagugggauuugucuccacuggcuuucauagcaugaaaguaaaagucaugacagaggcuacaaaagugauugauuuggagaacaaucuguuucgggagaacagcacuacugagaucgcccaucagggucuagacugugaugaggaagaagaaugcaaugaccauguaaggcaaagcuuuagagauuuucuaucgugucaguuaaacacaauugauauuuuucaguuucuacccagggcaugcacguggagugugccagcuauaaaaacugaaacaaaacuagucucugacaucaaggaguuuuuaaucuaaaaaaguuuaaucuucuaaaaggaaauauacuuuaucagaugaaauuguccauaacuaggaggaaaaagauuuucuaauauauuuauuuuauuaaagauaucauaaauuuagaaaauuugagguuuucuuuccuuuauuuguaaaugacauaauuuuaggguugaaaaauauucuagguauuuauucauacucauuggaaguauaaaucaguucuugauacugagauaauuggaugggaggaguuggggaagauaaauuuuauggauaaacccgagucagcgugaaaacaaauaauaguuaacuucugguuauguggaggaagacaagcuuuggggcuaacucacuggggaaagucaggggguuggugggguuggagcuaguggagccaaacagucaggucucugaucccuuuauccucccauuuccaccaauagagacuuggaguuagauucuugcuagggucccauuaugcccuagguaacuccacacccuuaacuggugguugucuggauaauaauguuaacuguaugacaacauuguguuaaaaggguucugaguuagacaaaaaauuuucaguaggaagggaugcuauaagaucuuuucaggagauauuuuaagauuagaaugauaacuuguuugcuuaagauaauuugagucuuauuuaaagauaggugacuguacuagguaacuucugaagguuccuucuaguucuuuaacucuguauuauguuuaauacauugaaaagagguucuaguuguucuaguuuuaauucaauuaauguaaauaauauaaccaaacaaguaacagauuguuuuuaaauuuuuagugcuuucucgauguuagacauaaaaaugacuuuggauuuuggugcaauuuuccucuuccaauuucacccaaggaagauauagcuaacauagaaaggggaaaaaaaaugaagguuaagaaaagaauguuucagcuaguuuuuuuuguuguuguucuuguuguuuuugagacagggucucgcucuguugcccaggcugaaguacaguggugcaaccaugacucacuggugccucagcuugccaaggaauccuccuaccucagccucucgaguagcugggacuauaggcacaugccaccacaccuggcuaauuuuuuauuuuuuaauuuuuuguagagacaagggucucacuguuaccagggcuggucuuaaacuccugggcucaagcaauccuuucacuuugaccucccaaagugcugggauuacagguaugagacaccacacugggccucagcuagguauuuauuuauuuauuuauuuauuuauuuauuuauuuagggaaagagucuugcucuguuguccaggcuugagugcuggagugcaguaguugaucacagcucacugcagccuugaccuucugggcccaaguaauccuuucagcucagccuccaguguagcugaaaccauaggugugcgccaccacacccagcuuauuuuuuauuuuuuuuagagacagggucucccuauguuguccaggcugaucuugaacuccugggcuccagugauccuccugccuuggccucucaaagugcuaggauuacaccacaccugguuagauuuuuaccuuuuaauuaagaauuucuuucuuuuuuuuuuuuaaucaaaugaaagcaggacaaccuaagaacgcauaguucaacuaauagauuaaauaagaaaugugauaauccuucucaagcauacauuuaguugaaacuauauguauuauauggacuuugugguaaacuuaguugauugaaguuucucucucagccagccaaacauaugagagaauuuaguaagucuaguaaagugguuacugucacuuucccacuaaggauuccuuuuuguuuuccuucauggaauacauggaacacacacacacacacacacacacacacacacacacauacauacauguguauacauauguagaaucuuuauuucuuuuaaaaauuuuauuuugagauauacauauaauagacuacauaaaaauauguacaguuuaaagaauaaugagaacauccauauguccuccauuuaggcuaagauguagaacauugcuacucccuuagaagccaccacgugucccuuccucauugcacgcccucugaagguaaccacucuccugaccuucaugauaaccuuuccuugcucuucuuuauaguuuugccauggaugaguacaucuacucguuuuaaauuuguauaucaaaguaaucauacucugaguauucuccuuuaauuuucuuuugcuugaacuucaaaguugagauuuagccauuguguuauuguucuuucauuuucacugcuguagaguuuucuacucuugauagacauucuuuuuaauugcuauaaacauucauguacauaccuccugguacaccugucaaagagugucucuugggaauauaugaaacaguucuaggcuuguguauuuucaacuauauuagguaaagcaaaacuguuuuccaaaguggucguaccaacuuacucgcuacccccagugaaggagaguacccuacauucuugccaacacuuauugucaggguuuauguuuccugccagucugcuagauaugaaaugguaaugccucaugauguuaauuugaauuucucugauuauuuguguguuugugcaucuuuucuuuggccauccuauuuugcucauauuaaauagcuguucaugucuuucaugcauuugucucucagguuauuuaucuuuuccucaaugguuuaaaaaauaugugcuuaguaauaauucuuuuucacucauuuauguugcaauauuuuuuucauguuuguggcucaucuuuucacuuucuuuuucuuuucuuuuuuuuuuuuuuuuuuuuuuuuuugagacagaguuuccucuuguugcccagcaggccugagugcaauggcacaaucucagcucacgguaaccuucuuucuccuggguucaagugauucucccgccucagccuccugaguagcugggauuacaggcaugugccaccacacccagcuaauuuuguauuuuuaguagagacaggguuucuccauguuggucaggguggucuugaacucccgaccucaggugauccguccgccucagccucccaaagugcugggauuacaggcaugagccacugugccuggcucaucuuucacuuucuuuaagaggucuuuugagcaauguaaguuuuuaauuuuaauauagucuaaucuuuuccuuuaauaugugcuuuuggauauccuuaagaaauccucuaccuaaggucauuaauaauauucucauauuuuauucuaaaaguuuuaaugcuuuucuuuuuacauuuagguuuauaauccacuuaaaguuuauuuucauuuauggagugaaauagaccagacuuucuuaacacuuuuaaauucaagaauaauaaacauacaguaaaacauauguaucagugauacagcucaauaaauauucacaaacugaacacuagagcugggaugagggugaugcaagcaaggugccuagggagcauauuuuaaggaagaucucaggugccaagaguaaggaccuccuuacauuuugcccccuggacaucuugcuugcuuugucuuugucacaacccuacugaauaaauaugugaaaucagcacucagaucaagaaauagaauucuuccagacccugagaaacccccagucuuauuuuacagucacuauucugcucacaagaauauugcuauccugacuucuauucgcauagauuaguuucuccucuuuauuuuauagacauggaaucauagaguauggacuuuuuuuuuuugagacggagucucccacugucucccaggcuggagugcaguggugcgaucucugcuuugcucacugcaaguuccgccuccuggguucacgccauucuccugucucagccucucaaguagcugggacuacaggcgcccgccaccacaccgccuaauuuuuuguauuuuugguagagaugggguuucaccguguuagccaggauggucuugaucuccugaccucuugaucagcccgccucggccugccaaagugcugggauuacaggugugagccaccacgcagggccgaguauggaccauuuuuucaguuaacauuauguugugagauuuacccauauuuuuacauguuguuguagaccauccugacaauuuauucauucuauuguuaaugacaauuuauucauucuaauguuaauuuggauaauuuauaauuuuugucuaugauggauagaaaugcuuugaauauucuggaacauguuuuuuagggaaauaacuacacauuucuggugggaauagaauuacuaggaguagaauugcugggucaaaggguauguguauauuuaguuuuaacagauagugcaaaauaguuuccaaaguauuugugccaauuuacaaucccaccagcaauguaugagaguugugguugcuuuacauccucacuaacccuuggcguuuuccaucguuaagauuuuagccauucuggugggugugcugugguaugucauuguuguuuuaauuuauuuaauuuaauuuauuaaacuaauuuuaacuaaugaagaggagcaccuuuuuauauguuuauuggccauguugaauauuuucuuuugugaaguaucuguucaaauuguuugcuccuacccugccuuuuuuucucuuggauugucuuucaauccuacugauuuguaggagcucugcauauauauucugcauauaaguacuuuguuggauacauguauugugaauaucuucuucaaccuuacgaguuguuuucuuaaugagguguuuuauaaacagaaguucuuuuuuuuuuuuuuuuuuuuuuuuuuugagacggagucucgcucugucgcccaggcuggagugcaguggcccgaucucagcucacugcaaccucugcuucccugauucaagcgauucuccugccucagccuccugaguagcugggauuacaggcaugugccaccacacccaccuaguuuuuguauuuuuaguagagaugggguuucauaauguuggucaggcuggucucgaacuccugacuucgugauccgcccaccucggccucccaaagugcugggauuacaggugugaaccaccacgcccagccuaauuuuuguauuuguuuuagagauaggauuucuucauguugcccaggcuggucucaaauuccugaguucaagccaucugcuggccuuggccuccucaagugcugggauuauaggcgugagccaucacgccuggcacaucuuugucuuuuucuauuucucugguuugguuugucuuucugauuccaaauuguacuuccauaaauguauagacaugaauauccuacagguaccuuagauucaacaucuucaaauggaauuuuaacuucugaccaaacaugcacuuccucauccuagguuccuuaucuugguauugcaccaucacuuuucuaagcaacccaaccaggaauauguucaacuguuauuuucuccucacuuucuacauucuuuugguacaccauuuccauguguuuugccuuugaaguauuucucaaaucuagcgcuguuaccacugugcugauucaggaugucaucauugcuuucuuggugauaguugagucuucuaacugggucucuuugaugucaucauugccucuccaguuugucuuccagggugccagagagugaggcacucaaauauuucaaauauuuuaaguugauuuauuuuguguaauugcaaagggcagaaugagaaccaguagaugaaaauuauguugauuuuggcucaauagaaggaagaauuuucucuuuacaaauuuuaaagcaauguuauuauaacauuaaaguaauuuaaaaaccaauggaaaucuuccgccgucccaccauccuaucaauacuguuuuuauuuuuauaugucccauccucuccaguauuuuuucauugauuuauauauuuguauaugguuuuaaucaugguauaugugaauuuauuuuacuuuuauacuuaacauuauugauuuuguaaauauguuccacuuuaaucuuuauauuuuuaauuuuaaugacuucuuguuuuauuuaggcacucuaccauuucccuacuuugaaacauuuagguuaauucuugauuuugcuauuauaaaguauuauaauaaauaccuuugcacacaugaaagcauuuaaaaaauuuuucuacgaauauaguaucaggagugaaauuuacagagcuucaacauuuguauggcucucaaaugaguaguaccaaaucauuuuccagaagcugccagcuucuccaccuccucaggguggauuuucuaacaaugauaacuacuuaaaccugguugccuugugugggggugagcuccagugucaccagcugugcucaagugcagauauacacguguguucaagauagaguauaugauuaggguguugcaaaaguaaaaucaugauuuagagggaagguugaacuagauugaccucuaagauaucuuucaugcuaagauugucugggauauuuuuugaaucccuauuaagagaauaaugcccuggccgggcgcgguggcucacgccuguaaccccagcacuuugggaggcugaggcagguggaucacaaggucaggagaucgaggccguccguccuggcuaacacagugaaacccugucucuacuaaaaauacaaaaaauuagccaggcgugguggugggcaccuguagucccagcuacuugggaggcugaggcaggagaauggcaaaaacccgggagguggagcuggcagugagccgagaucgugccacuacacuccagccuggguggcagagugagacucuaucucaaaaaaaaaaaaaaaaaaaaaaaaaaaaaaaaaaaaaaagagagagagagaauaaauaaugcccugcuaagcacugugaggaaaauaaagacauauaagauauagccugugcccuuuagaauuguggcugaagagauaacaccuacauaauguaauaaaaagguaauacuagagaguauaugaaugauagaaauaauauuaacuaacaauuucgagcacucucagagcuuuacauauauuaucacuuucaaucuuccuagcuauuuuauaagguagauacuauuguuaucuucauuuuacaaauaggaaacugagccagagaaauuagcccaagacuccauacauagugaauuuguaacagggacagaauucaaacccaggcaauugaacuccaaaguacuaggauuacagaaaaaaggauaaauugguacugugugggaaaguuucauuaaguuggugauuuuuuuuuuuucuuugagaugcacucucacuacauugcccaggcuggucuugaacuccugggcucaagcaauccucccacuucagccuuccauguaccugagauuauaggcaugugucaccaugccuagcuugauuuggugauuuuguggaugaaucauauuuugauuggcagugaucauggcagaggacauuccaggcaaguuggaaaguccaguaugguagcaucagaaauucugucucugugacuuagaauuacaauacugaauguuccacgccuuuccuguauccuacauggcuuugcugaaauuucuuuacucuugguaaucucuaacucaaagauuuuuuaaaacuuuaaaaauaauuuguaauuuaaauuuuauuuaaaauuaaaauagaaaguuuauaaauuuuugaucaaacagcuuacacugcuuuucuaccaaugaucuauaguaaagaagggauuuaacacaaucaucuuguugugagaccguugaaaauagaaagauuuuaauacaauuuucuuuuucagguaauuccuuauuucagucacagaaaggcaaauauaacagaguuucuacuaaugguugaaauuauucaguaauugugcuauucacuuucuggugugauucuuaagauccaaggaauaaugugaaagugagauuauaauuuggcaauggauucagaauuguaaaagcacauaugcuugaaacuuaggaauucuuaaauuauaagaacucuaaaaaccuaacuccacuugaaaaauagaacguuggaauuguccaaggaaucccgggacaauacaggguucaguaagccugucugaaaaacgcuguccuaauuguguccuuaucauuuaaucugccccccacacacuuucaggacaggucuucauucuuuucuuuucuuuuuuuuuuuuuuuuuuuuuugagacagggucucacucugucacccaggcuggagggcagugacgcgaucucggcucacugcaaucucugccuccugggaucaagccauucuucuaccucagccacccgaguaacugggacuacaggggcgugucaccaugucuggcuaauuuuuauauguuuuauagagacaggguuucgccauguugcccaggcuggucuccaacuccugagcucaagcaacccacccgccucugccuccgccucccaaagugcugggauuacaggcaagagccaccaugccuggccaggucuuccuuccuaauagggguguuuuaggccuaagcuauagcuacuaagucuacacaaacacaaaagcacuucacauaacccugggaaguuguuuuuuuuucccugucauagacaacugggcagauagcaguagacauacacacugaagacaacuuccccuaaagauccuuagacagguuucuucaaagaacugaccuauauggugcuaaucaacauauguucuguaauuuguuguagaaucuuacuuaaauuuaugcuguuuaaaugcuaaggaaaaaguacuucuuucuaguagaaauaauuaacccaaucuccuuaaaaaauucuaguaauuacuuacacagacagugauaaaaagauggagggcuaauguuggcccaggucuauuuuggagauuaauuguuccaguuuauuaagucauuauaguucuuugagaauuaauauuuuaaccauauuuuuaggcaggggucuacuauaauuuucuaauuuucugaaauacuuaugugucuuuauaccuccaaauacaguugcuagacacucucuacaaggcuuuuuucuaggccuuucuuuuguaacuagaaaucuugauccagaauggcauuuuuuucaucuguaacauaucaauuucacugaagcauaaauaauucauacaaaugauuuuuuuugaggaugagcuaaaggcagagaauacuguuuucuuauaagagccacaaguauuuuuaaaguuuauucaauaguuuaucauuugauuuaguuacaaagaaugguuugcuuuuuaagcauaucccaaacauacacacucuauuacacuauuuucuaaguguaauaaaaaugguuugcauuuugccuggauuucugcaucuuauuucaauuuaaaaauaauguuuuaagauagcuuuuuucuuuuuuaugaauuccacaaaagaauccacaaauuauaacaauauguaguuuaccugauguauucuuucccuccaugaagcucauuucuuuugugccaacacacuuaauuaaaaaguaaaugauuuauuuguaagaaauuagaauguaaaguacauuguuuccacgguaaauagcagcauuuacguguggacuagaaagguauuuuucugaauuccuuagaauugcuuuguauuucagauaguagauuaaaacaagagccuuuucauucaaaaccuauugucucccacuaaacucugaacugaaguuuugcauuuuuugagguauagucugaugauuuucauagcaucacaucuccugaagcauauaugccuucuuugauacaacauaguguuggcaagaauaucucagauucuuggaagugggguagauuauugaaagcacuggaagaggcacauuauuugcagaaaauauccagccuuaaaaaaacacacacaucaggccaggugcaguggcugaugccuauaaucccagcacuuugggaggccaaggcgggaggaucaccugagaucaggaguacaagaccagccuggccaacauggugaaacccugucucuacuaaaaauacaagaauuagccagcacgagaaucguuugaaccugggaggcagagguugcagugagcugagaucacucaggcuacugcacuccagccugggagacagagggagacuccgucucaaaaaaaaaaaaacaaaaccaaaaaaccacacacacacacaucauucuuucuucaucaugagacucuaguccuuuucauuaaguuuccuuuugucaaacagaaaauuauuuccaauuaauuuuucuguuuugcaauccagaauguaauugcuauccucuguuaacugugcaaagaggaaugaaaguugguugacuuucccaucagucuuauaagucauuucuuuuuuuauaugaaucauucuauaacaucagagaauuacuucuuuccuuuugugaguaggaagagccacacugauuaucuguauauguuucacucacauuaaagaaguauacugauauguauuauagcagaaaaaaaagucaaacacagugaguaaucuuagguagaaaugcuuuggauguuacaauuaauaagcccuagcauuaaaauaaauaaauuuuguuuaaaaaagaguaagacagaauauucuguuugguuaaaaaagagaugccucuaauaauacaauguuaucauuacaccaaaaucaaugaaauauuagguuucauuuaaacucagauuuuuuucaaagugacuucauugagauuuuauucaauugcacauuggaaaaaaguauaaugauaauguuacccaauuuccuauaacuauauucaguuggcugauuuuccuaauaccauuauguguguuaaaguuuucuauuugaugcuaaauugucuguugguacacacaugagauuaugcuuguaacaaaucuaagcaucauaagaggaguaauaauucuuuuagcauuuauauuaggaucucaaaauugagaacuaagacuucagaagaccaguccuucugacaaugguaaagaaaaguuagaaacacaauuggccucauuuucuucuggauuuggcagaccuguuaguguuaauuguauauauauacauauauauauaauauauuuauuuaugauuauacuuuaaguucugggauacaugugcagaacaugcaggcuuguuacauagguauacacaugccauggugguuugcaauuggcccuuuguaucuguggguucugcauuaguggauucagccaacuguggguuuaaacuguuaaaaacaaaaaacaaaaaaaaggaugauuggguccguacugaacauguacagacuuuuuuucuugucccccaugguucccuaaacaauacaguauaacuacauagcauuuaugucguauuggguauuauaaauaaucuagagauaauuuaauauacaugggaauauguacauaggaugugcauauuauaugccaauacugugccauuuuuuauaagggauuugagcauccauagauuuccuaucuguagguguggagugugugugcccugaaaccaauuccucauggauacagagggaugacuguauacuuuaugagccacuaccuaggugugcuuuuuuucugcccaauggagggcucuuucugcuuugaugaccaaaguuggaacaaacaaacuuuaucacuaaagguaucauuuugacauuuaaacaaggcuacaugaagcucauugugaagaaaguuuaaaagaauguucuacuggggccaggugugguggcuaaugccuguaaucccagcacucugcgaggccaaggcgggugaucaccugaggucaggaguucgagacaagccuggccaacauggugaaacccugucuguaccaaaaauacaaaaaauuagccaggcauuguggcggaugcuuguaaucccaacuacucgguaggcugaggcaggaaaaucacuugaacccgggaggcgaagguugcagugagccgagaucacaccauugcacuccagcauauaauauauaugauuauauauauauaaucauaaauauauauauuuaugauuauacuuaaaguauaaucauaaauaaauauauuauauauauguauauauauacaauuaacacuaacaggucugccaaauccaggagaaaaugaggccaauuguguuucuaacuuuucuuuaccauugucagaaggacuggucuucugaagucuuagcucucaauuuugagauccuaauauaaaugcuaaaagaauuacuccucuuaugaugcuuagauuuguuacaagcauaaucucguguguguaccaacagagccuugcucugucaccaaaaaaagaaaaaaaaaguucuacuauauucuaaucaacaauagguuaucagcauuuauucagucaauaaauuuauauugaggccuacuaugcuugagucaucauaggaggguaguguacacaaagaagaaugggccaaaucccugauucaaaauugauuagaggaagagaaacaaacaaauagcuauuuauuauauaauaauaauagccaccauuuauuaagugcccacaaaaggcuguguauauuugugaacccaauuaaucccaacaacaacuuugcgugauauuuuauagcugaagaaacagaaguucaaagacauuaaguagcauguccaagguugcccaacuagagagcaucaaaaucaauauuucaaucuaggucugucuggcuccaaaacucauacucaaccuguuaaaucauauauucaccuauguaggggagagcguguaaaauuucagaagagagguaaaaacccuauauuagaaugaccaaauuccacuuucacucaugaaagaguaauguaagaguuacccucuugcuguaaacaacuagaaaacugggcaaaauauaugaagcaacuguuuuuggacauuagauaacaggcacacaggaaugggauccuugacagaagaaaagugagaccagucuuaaaauugcccuagcuuccugcuaggaggcaccuuccagaccacugguucagggagagagaacccaagcagagcauggcagucuugcugagucgaagaaagagacuggaguauggggaaucugaggcaguuggaaacagaauaucagagggcagggaacuauacagagaaggagauccagaaaucagcauagggguuccuugagucuuuuaauauucagcuuuucaggugugggucaaaacuccacaagccuggacaaagaaaacuggcaacuuaacaauucccagagcucucacagggaugggagauguucacauaauuaccagucaaauggagagcccuucucgaacacucagaacauucaauagagacuccagaaggguuacauguuagcaguagagcuaaaccaaacuuuuaguaaaacccuccagauuuaaucuaauaaaguuuuaaaauaugccucaaaaggaucaagcuuaucugccugccaaaacaauuuuuaagaaagauaacaaaauucaaacauucaacaauguaacauucuuauuguucagaaucuaauaaaaguuucuugauauguaaagcagcaggaaaacugauccauaaccugagggacaccagucaguagaggcaagcccagaaauuucagcaaugauaaaauuaguagauaaggacuuuaaaacagcuguuauaccaaguacaaugauagccuauguuuacacacaaaaauguaugcaaauguuuacagcaacucuauucauaaucuucaaaguauggaaacaauuagguguuucuuaauuagggaauggauaaacuuaagacaaaaaggaacaaacuacugaaacaugcaacaacaugggugaguugcaaaugcaugauaaguuaaagaagccagaaucaaaagacuacauacuauuugauucuauuuguacaacauuuuuucuguuuuuaauagcuugaaauguaauuuauuuaccaugcaauucacucauuuaaaauguacaacuuaaugguuuuuaguuauagucacagagauuugcaaccaucacuacagucaaaauuuuagaagauuuucaucaccugaaaaaaacccguauucuuuagcuuucaccuuccugucuuauuucuccucucccccaguccuaaauaaucauuaaucuauuuucugucuccagauucgccuauuaugauauauuucaaauaaaugaagucauauacuaugaugaauuuugugacugaccucuuucacuuaacauuguguuuucuuuucuucuucuuuuuuuuuuuccacaaauagggcuuuuaauuugacacuauuaaaagucugaauguuaaacagauucguggaccgaugguucauauccaucagcucauucaauuuuagcaccuuucucauccuugguagcuuuuucaaaacuacuaccuucaccaugaagcuacaugaguuuucccaauucaaacuugggcuucuuuauuuuuacuuuccuaaugaagacaccauggagaggauaaacagauaggcaagccuuuucuaugucuuuuccagugcugucuggaaucaauuuauugaccacuucuuucaagucauuugucugcaccucuugggucaugauuuccaucaucuucuucuggauuuggcagaccuguuagugucaauuguaagaagucuuccauguguaauuguugcauuuuuuaguaaaaucaacacaaaacagacaaaguaaauaaucauugauagucuugacaucaaugugaacuuaaaucauggucugcuauuuuuuagccauggaacacauuuugucacagauaagauccaugccauggaaauuaaucaggcauuuuugcccugaacaucuucaguaucagcuugaauuuucuaaaugcaacuucaucauucugcacaucagacaaacucacuucaaacacaugacccuugaggccaucagaugcaauuuugauuccuugaguccuggcgaugagugucuuucccauaguuauuauacugaacauagcaggugcuuucacaucauaccaaucuuucuuagaaaaugggucaagguauuugagcccaggaggucaaggcugcagugagcuguugaucacaccacugcacugcaaccagggcuacagagcaagacccuguuucaaaaaaggaaggaaggaagggagggagggagggagggggaauggaaagaaggaaaggaagagacagagagaaauaaaaaaugaaagaaagaaaagaaggagggagagaaagaaagaaauaaaauggaucaaccacuuucuucuuggcuugcuuuugccaccuuucauaaagugcuuguucuugccaacuaccaugugcuuuucagccaaaagggcagcaucauguuuucaaaguucauccauguauggcaugugucauuacuucaucccuuuuuauggcugaauaauacuccauuguacggauacaccacauuuugucuauccauguauuagugaugggcauuuggguucuuucaaccuuuuggcuauugugaauaaugcugcuauaaacauuuguauauaaguucuuuuugaguaucuauuuuuaauuuucuuggauauauaccuaggaauagaauugcugggucauauguguuuaaucauuuggagaacuccaaaauucuuccaaaguggcuguaccauuuuacauucccaacaucaguguaugaggguuccaauuucuccacauccuuaccagcacuugguauugucucacuuuuugauucuagccauccuagugggugcaaaguaagugguaccucauugugguuuuaauuuguauuucucuaaugacuaaugaugucaagcaucuuuucaugugcuucuuauccauuuauauauauuccuuggagacauguauauucggaucuuuugcccauuuuuuuuuuuuuugagacagagucuugcucuguugccuaggcaacagagaagcugggaccauaggugugcaccgccaugccuggguaauuuuuaaaauauuuuuguggagauggggucucgccauguuuccugggcuggucucgaacuccuggagucaagcauuccucucaccuuggcccccuaaaaugcaagaauuacagguaugagccucugcauccagcuuccuuugcccauuuuaaaaacggucauuuguccuuuuauuacugagguguaagaguucuuuauauauucuggguagauuccuuaccagauauacaauuuauaaauauugucuuccauuccauuuucauuuauuuggauuuucuuuaauuucuuucagccauguuuugugguuuuuagauuauaaauuuuguauuuauuuuguuaaauuuauucaugagcauucuuuucauacuguucauaauaguaugugaauaguaugugaacugcacaauagcaugaaaagaauaaaauacuugggaauaaauuuucaucuuuguauuauucauugcagguauauagaaauacuuuugaauuuuguauacugauuuuguauucuacaaccuugguaggauaguuaauuuuaugugucaacuuggagggugcuacuggaugaaauuaacauuuaaaucaguaaacuuuaaguuaagcagguugcuuugaguaaaguaaaacuaacacuccaugauguguguggaucucauugaauuuguugaaggccugaauagaacaaaaagacuggccucccugagcgggagggaaugcuccagcagauugccuuagacuucaucugcaccauugacucuccugggucucuagccuguuggccuucagacuggaaccgcaucaucaacuuuccugggucucaugccugcugguucacacuguagauauuggacuugccagccuccauaauuggauaagccaauucuuuauaauaaauguguuuauauauauauaugaacuguacuauauauauauauauauauauauauauauauauccucugucucucucucucuacauacauauauauauauaaauaaccugucucucucucuacauauauauauacuuauauauauauuuuuucauccuacuaguucuguuucucuagagaacccugacugauacgcuugcugaacucguugaauaguucuaauaguuuuuuuuagaagauuccugauuacuuucuauauccuaauuuuuuuagaggauuccugaggauuuucuauauacaaaagcaugccaucugcaaauagauauaguuucacuucuuccuuucuaaucuggaugccuuuuauuuccuuuucuuaucuaauugcccuggcuagaaccuccauuacaauguugaauagaagugaagagacguccuugucuuguuccuaaucuuagagaagcaucuaauuuuucaucauuagguauggguuuuuguuuuaggugcccuuuguuauguugaagaaguucccuucuuagucugcugaguguuuuuuuaaucauggaaggguguuggauuuugucaaaugcuuuuccugcaucucuugaaaugaucaugugauuuuugcuuuuuauucuuuugauauaauguauuacauuagcugauuuucagauauuaacccaagcuugcauuccugagauagaucccccuuuaucauuguguguacguguaucuguguguguguguguguguauuuauauugcuagauguuuuccuaguauuuuguugaggauuuuugugucuaaugcaugagagauauugaucuguaguuuucuuguguugccuuugguuuuggugucaggguaacacuggcuucauaaaaaugaguugaauuagcccugcauggugguacacaccuguaaucccagcuacuuggggggcugaggcacaagaauugcuugaaccugggaagcagagguugccgugagcugagauagcgccagugcacuccagccugggcaacaaagugagccucugucaaaaaaauaaaaaagaaaaagugugcaugagagagagaaaugaauugaaaaguuuuuacuuaucuucuacuuuuuggaagaguuugugaagaguuaguauuaauucuucuuuaaauguuugguagaguuuaguggugaagcuaucugugacugggcuuuucuuuuuguggauaguuuuaaaaauuguuaauucaaggucuucacuuguuauagauauauucauauuuucaauuucuucuugagucaguuuugguauuuuguguaauuuaggcaauuuccauuucaucuaaguuaucuaauuuauugacauauuauuguucauaguauucuguuauaaugcuuuuuauuuuuguaaggucagcaguaauaucuggucuuuuauuuccaauucugguaauuuuagucuuuuauuuacuuggucaagcuggcuaaagguuugucaauuuuguugaucuuucaaagaaucaggcuuuggauucacugauugucacuauuuuuuaauucuccauaucauaaaugucuacacuaaucuguauuauuuccuuccugugcuugcuuuagguuuaguuugcacuuuuuccagugucuuaagguggaaaguuagguuauuugagaucuccuuucuuaauauaggcauuuacaguuguaaauuuuccucuaagcaaugcuuuagcaguguuauguuuuguuauguuguaucuucauuuucauuuaucuugaaguauuuucugauuuccccuuuauuuuuuugacacaguaucucucucucucugucacccaggcuggagugcaguggaaugaccucggcucacugcaaccucugccuccuggguucaagcaauucuccugccuuagccuccugaguagcugggauuacaggcaugcaccaccauguccagcuaauuuuuguauuuuuaguaaagacgggguuucaccauguuggccaggcuugucucaaacuccugacuucaagugauccacccaccucggccucccaaagugcugggauuacaggcaugagccaccucugauuucccuuuugauuuauucuuugauccauugguuauuaggaguauguuguuuaauuuccacauacuuuuuuauuuaauuuuuuuauuuccauagguuaucagggaacaggugguguuugguuacaugaguaaguucuuuaguugugauuugugagauuuuggugcacccaucaccugagcaguauacacuguacucaauuuguagucuuuuaucccucaagcccuuccacauacauuugaguuuuccaaaucuuauucuguuauuagcuucuuauuucauuccagugaggucagagaacauacuuuuuuuuuuuuuuuuugagacggagucuugcucugucacccaggcuggagugcaguggcacaaucucggcuuacugcaaccuccgccuccugaguucaagugauucuccugccucagccucccaaguagcugggauuacaggcaugugccaccacccccggcuaauuuuuuuguauuuuuaauagagaugggguuuaaccauauuggccaagcuggucuugaacuccugauccugugaucugcccgccuuggacucccaaagugcugagauuacaagugugagccacugcgcccagccgaacauacuuuuuauuauuucuauccuuuuacauuuguugagguuuguuuugugccuuaacauacgguuuacgggcugggugcgauagcucuuaccuguaauccuagcacuuugagaggcugaggcaagagaauggcuugaggugaggaguuugagacuagccugagcaacauagugagacccagucucuacaaaaaaacaacaaaaaaccaaccaaccaaccaacaaacaaaaaccacccaggcgugguggcaugcgccugugguccuaccuacuugaaaggcugagcugggagaauugcuugagccugggagguaaagguuguagugagcugugaucacuccacugcacuccagccugagcagcagagugagacccugucuccuugacucaaaaaaaaguaaauauaugguuuaugcuggagaauauuccaugugcacuugagaagacuguauauucugcuguuacuggguauaguguucuauauauauauaucuguuaggucuaguuaguuuagacuguuguucagauauucugccuaauuguccuauucauuacugaaguucagguauugaagucugacgcuauuauuguugaauugucuguuucuuucuugaucaguuuuucuucauauuuuuuguguucuaacauuaggugcauauauuuauauuuauuuuauuuuauugacagguugauccuuuuauuauccccaaaugccccuuauuaucuccaguuacaaccucugccuuuugauggguuugcuuaauccauucauguuuaauguuacuauugauauauuugguuuaugacagucauuuuacuuuuuauuucuauguguuuuauauguguuuauuguaccucuauuccuccuugacuuguuuuccuugcacugagugaaugaagcauuuuaauuucuuuaauuuuuuucacuauuuuuuugaauuucuuuaguaguugcacuagggcuuaucaugcacauccuaacuuaucagaaucaguuucagguuuaugcuagcuuaauuccagugagacauggcaauguuauccuuauguagucucuuuugucccuuuuugguauuuuuuuuauguauuacaucuauuaaugguacaagaucaacaauuauuguuuaauugguacuuuaucaucuguagcuauuuccuugcccaaacagcuuuucuccuacucagcuucuuugugcuauuauuggcaaauauacuacauuuguugaaguuuuaggucaaacaauauaccauaugcauauuauuuuacacaacuuacuauauaaaauuuaguuuauuuaagagaagaaaggagaaaaaugugcauuuacauugccuuuuauaauugcauuauaagagcaucuuuacugaugcucuuuguuuucucaagucgguuugaauuauugugugugauaauuuucagccugaauaauuuucuuuaguauuuccuguaagaugaaucugcuagcaaaauucucucaguuuuuguuuaucuggaaguguuuuuaucuuaccuuuguuuuuuaaagauaucuuugcugaauaaagaauucuuggcugacaguuuuuuuuuccuuugagcacuuugaauauguugucuuacuaccucacuggcccccauuguuccugcugagagaucagcuguuuucguuauagggguuccuuuguuagcaaugagucauuuuucucuuguuguuuuuaagauuuucuccaugucuuugguuuucagcauuuuuacuaugauaugucuauuuguggaucuuuuucuuacucagaagugcagccuuagguaugccccacagucacccugggauaaugaugguugauaugccuuggauauuuguccugcccaauccucauguugaaauguaacuggagguggggccugaugggagguguuugggucaugggugcagaucccucauggcuuugugcugcccuuguaauggugaguucuugcaagaucugguuguuuaaaaguguguggcacuucugugcucucuguugcucccacucuugccaugugagacaccugcucccccuuugccuucugccaugauuguaaacuuccugaggcccucaccagaagcugaugccagugcuaugcuuucuguacagccuacagaaccaugagccaauuaaaccucuuuucuuauaaauuaccaagccucagauauuucuuuguaccaacacaagaacagccuaauacagcgguuucaucugggcuuucuuuggccaauucuuucccugcccaguuauuaaacacaacuaauugcuggugauugcuccauuauuuucaucagugucccaggcauauauuacucuacaguuuaaucaaaucaaauuuggacuucuuuaaagggauaguuacugagguuccaguguuugaaauuuguucugaccacaggaggacuucucucaguuaucuauuuccugauucucuccugaaaacuggccagccuacaguuuagcaaauaccuguaaugaaucuaccaaucuccuuccaauugccuuuugauacaaccuccauuguauuugagcauguccuuauccuugaacuucuucaugcucuguugcaauaaagucacugucuuuggaaagagauuaggagcuauuuuaugcacugcuucuccccuuggaaaaauaucugagccacagcucuggagcuagguacggggacaacggugugcuuaucucucagugacaugcagcuuuaggagcugauggccgaguggaggggggacaguagacucagaucuucucagcuugccucucccagcauagaaccacgaccuuacaagccagggcaagggugauugagaccucagcauucucggugguacaguacccuaggcagaacuuccauuucaccagugaggcuggaaguauagugguacuguauccuacacaaaacuuccaucucaccaugagcccccaccucauggccauacucaacauagaauuuagcaauagcuggaggcaagaagaaaaauacuaacguucuuuuccucccaugaagauagcccucagauugggagcuugggagagagggaggcuuguguucuuggcuaucccaaucuauaauggaauggaguggaauguaacugagcugggaggguggaggaaauggucuugguucaaauaccaccaacuuuuguuguucuuggcaaauuuuagaagauauucuugaacggaggcuucuucaauuacuguaugccuuuagguauaacagagacuucaauuuuuaaaaauaguuuuuagcaguuuugcuggagagcuggucuguggagcuccucacacugacaugugggaaauugaucucuuacacaauauucuggcaaaggcaaaacuauaggcacagaaaaaaaucaguaguugccagggcugagugugagguuuaacuacaaagggacauggaggaauuuuggggcugaugaaacugguuguguauacauuugucaaaauucacagaacuguacauuauaaagaacaauuuuacugcauguaaauuguaccucaauaaaauaaaaggggaaaagcuauuauaaauaugcucaaauauuuaaaggaaaacaucaauauaaugaagagaaaaauggaaggaguuuuugaaaagguccaaauagacccuagagcugaaaaauaccauaucugaaauuuuaaaauaucacuggauggguuuaacagcagauuagaagcuauaaaaaaauaggucagugaacuugaaguagaauauagaagucacucaaauugaaacauaaugaaaaaacaaaaugaaaagaauagggccucagugacuuaugugacaacaucaaacagucuaagcuguguguaauugaaauuccagaaauuuggugggauuuuaaaugauaaugucuguaaauguuacaaacugaugaauuauaucaaauaaucaaggaagaaauaauacuaauuuugaacaaauucuuuaagaauauagaggagaaggcuucacaacucauuuuaugaggccagaauuacccugauacuaaaacugaagacacuccaagaaaacaaaacuauggaccacaauaucucucaugacuauggcugcaaauguccuuaacaaaauaguagaaaauugaauccagcaauauauggaaaggauaaugugucaugacuaauguggucuaucccaggaaugcaugguugguuuaaaaagugaaaauuaguccauguaauuccccauguuacagaaugaaggagaagaaccacaugaucaucucuauagaugcagaaaaaaaguauucaauaaaauucaacauccauuugugacuugaaaauaugaaagcuuuggccaggcgcaguggcucaugccuguaauccuaacacuuggggaggcugaggccaguggaucacgaggucaggagauugagaccauccuguccaacauggugaaaccccaucucugcuaaaauagaaaaaaaaaauuagccaugccugggggcgcgugccuauagucccagcugcuugggaggcugaggccggggaaucacuugaacccaggaggcagagguugcagugagccgagaucaugccacugcacuccagccuggcgacagagcaagacucugucucaaaaaaagaaaagaaaagaaaaaaugaaaacuucaggaaaacaaggaguauaaaggaacuuccuugacuguauaaaagacauuuacaaagaaccuaaaggugacauuauacuuaauggugaaagauuaaacacuuugcaccuaagacagggaauaagacucuuaccacuuauagucaacaucauacuagaggucccaccagcuaauuaagguaggaauaagaaauaaagguauauagauuggaaaggaagaaguaaaacuuaaacuuuuuugagaaugacaugacuguauaauagaaaauccuaagaaaucuacaagaaagacaccaccagaacuaauauauaauacaugaauuuaucaaggucacagauuaauacauagaaauuuauuguauuucucuauauuauaaaugaaaaacuggaaaugaaauuucuaaauaccauuuacaauacuauaaaaauuuaugaaauacuuagggcuaaauuaauaagacauaugccaagauguguacaaugaaaacuacaaaauguugcugagagaaauuaacgaagacuuaaauaaaugcagauauguaccauauucauggauuggaagacucaagugagauguuaauuuuccccaaauugaucuauacauucaaugcaaucccaaucaaaacuuuacagccuuuacaaguugauucuaaaauuuaaguggaaauggaaugaaacuagaaaagucauaaaauuuuugaaaaagaacaaggagaacuuuaucagauuucaagacauugugcuaaggauagacauauagaucaguggaacagaauggagaguucagaaguagacccacacguauguagucaauaauuuuuuauaaagguaucaagguaaaaggugggguuuuuuuuuaacuaguaguacuggaacaacuggauagucauauggaaaaaaaaaugaaccucaauccuuaccucacauuguacacaagauugacuauaaauagauuaaagaccuacacauaagagcuaaaauuauaaaacuucuggacggaaacaugggauaaaacuuucaggaaaaacuucuuaggcgguucccuaaaaguacuaaccauaaaagaaaaaaauacugauaagcaggacuucaucauaauaaaaaaacuucucucccaaagacauuauuaagaaaaugaaaaggcaagccaaaaacugggaaaaaauauucuuaauaccuauaucugacaaagaacuuguauuuagacuacauuuaaaaaaaucuacaacauaauaauaagacaacuccauuuuuaaaaauaucaagaauuugaagacauaucacaggaaaauauguauuaaugggcugggcgugguggcucacaucuguaauuccagcacuuugggaggcccugguggaaggauuacuugagcccaguaguucaagaccagugcauuggaaaauauuuuaucaaauuccuauaaacauauacuuacuauaugaugcagaaauuuucacuccuagguauuuacccaagggaaauaaagguguacagucacaaaaagaccuguacauuaauguucauagcagcuuuauucauaauaguuccaaacuggaauuaacccgcguguccaucaauaggugaaaggaucagcaaauugugguaucuuuguacagugaauuauuacuagcaauaaaaaagaacaaacaaaugauacaugcaaaacuguuaaugaauauuuaaaagucaaaaaauucagacacaucaacaccugugaaaagaaagggaaagaaaaagaaaaaaacuuagaugcaaaagacuaaauaccguauaauuucauuuacaugaaaaucuggaggaagcaaacuaacuuuauaaugaauggaaacaaauaaguguuugccugguguggggguggaauuuagugcaaagaggcauagaggaacuuuuuuuagggugaugagauguuuuauaucuugauuguggugguuguuucaaggauauauacauuuaucaaaaugcaaagaaaacauccaaaaauaggugcauuuuuuacauucuguuucauguaaaguuugccuuauuacaguugaauuuuaaaaaguagugauccauaguguuaaucagcaaaguccuauugauaauugucucaaauuggaaacaaccuacaugucccucagugaaguauuaguucaguaaauuuuggaagaacaauaaaaugaaguacuguguauuccuuaaaaacauauuagacaggcgccaggcacgguggcucacaccuguaaucccagcacuuugggaggccgagacgggcagaucacgaggucaggagaucaagaccauccuggcuaacacggugaaaccccgucucuacuaaaaauacaaaaaaguuagccgggcguggugacgggugccuguagucccaacuacuugggaggcugaggcagagcuugcagugagcugagauagugccacugcacuccagccugggugacagagcgagacuccgucucgaaaaaaaaaauuagacaaaauaauugacccagagaaaauauuuguacuauuuugcuaugugaaggaaaaaauaaaauaagacaccuaacaacuuuuccguguauaauauaauuuggguuaagucaguaacugaugcuuauguuauuauaacuacauaauuuuauacagaguugaguugucauaagccaugauugcuuuuccuuucuuguacaaauuuuuguuuuccuuacagcuaauaauuguuuuucauuggcucaguuuucucuuuacuuauuccuaaaucaauuccaaacuuuaugcugauuaucugcacugcccaaaaugguagccacuaaccacauggcuacuagaauuuaaauuuaaauuaauuuugacuaaauaaaacaauaaguucaguucuucagucacacuaauaaacauuucaaguguucuagcuaguggcuacuguauuggacagcacagauauagaacauucccaucaucacagaaaguucuaauggacaauacuggucuagauugccucucaaauauucagaaacaacaauuuugucuucacugagaaauuucucuggagcuuuucaccuuugaccaaaucuggauguuugcucucucugccugguauugggcucucauccuggaauuuccuuucgccaacuuccagggaauucuuugccccuccccuguguuaaauuucuuguuuccuauucuugguuuccucccucauuuuaguggagcacauccuuugguaacuuccuuagagaggacugcaugggagauaagguuuugaaauauuucaugcccuaaaaauaucauccaucuauucuuauaugagauuaagaaucucacuggaaauuaaaucuaagaagacaauuauuuuucaugauaauuuuugaggcauugcuccucuuucuucuagcuuucaguguugcuguugagaauuuccaagccauucugauucucagucuuuguguauuauuugcuuuuuccucaggguucugaaauuucauaauggugucccuugauguaggucuauuuuuauccuuuuuuuuugcgguaggcacucagugucuuuuaaucugguaacucaggugcuccuucaguucugggaaacuuucuucaauuauuuccuugaugaaaauuauguaccaucagauuucucuguucuuucuuucugggcccaccaguauuuagauacuggauucccuguucagguauucgauuuuuaaaaaaauaauuuucccuccaauuuuccauauguuuaugccuuuguuguguucuuggggagaacuccuugacauaguccuacucuucuauugguuuuucauuugugcuauuguguuuucauuuccaagcgcuuguuguuguucucugaacuucccuuuuuauggcauccuguucuugcucaugguuacagaauugucucuuaugucagaggauauuaauuaucucuauauagagucuuucucucugugugucuguguuuguuucuuuuguuuauuguuuccuccucuucccccacccaccuccucuaccucucucuccuuagaaguccucagaugacuggcagaccuugguugucugcucacauuaaagagugggggaacuaugaaucucugagcuuguggaugaggcuugcugauuguggccuucauuauuuuaauagaagaccuguacaagccuuugggagaagucccaaaaucuguauuuuaaaaucuuuccucuugaucaguuuccccagcaugcaggcuagccaacaguguuuuggggcccaaauagagauagaggacugagggucucugcauucaggcauucaguauacaugcuuucacuuaauuccuugauuccaguaccauaauccugccucaacugcacuuuguauuccauuauccaaagacuuucuauuacccucuauagagaauaaaccucugauuuuauccuaggguggaagaggaacaacuguuuggcccugcaaaacuggggagggaaucugaagauuccaacuguuucauaaauguguuucaguuggucuuucuuauuuuagcuccucuaccuacccucucuaucuccucuuccaaaaguaucugaugcuggaaauuauuuagaaugacgugcauuugacugguccucgguuugguccacugcugguuuagguuucuugggucugcuauuuuaguuauuuaucuugcaucugcuuccuggcuuccaaaauuucauugucacugucuuuucgcuuguucuuucuuucuguuuguuuguuuguuugcauuucugccuuuuaaagaaaugucuuuuccugucauucuagagggguuuuuggaggaaacaaaauaaaugugugugucaaucugccaucuuuauccagaagucgguaaacauauuuauaaaaacauaaauaugucaagaguuaguuuauaggacaagcaaugcaguuuucuuuaaacauuuuggucugaaguauaaauauaauacuacuuuaauucauacaggauuucugagaauugguaaaguauugcuuaagaauuucaacaugaaaaauacuuccuaauacuauaaaaauacuauaaaacuauauuugaagaauuuaaguauaaauggccucaguaaggaauauuagcucauaguccuccacuuggaaauaaaccccucagcuguguugaagaccauuggagauaauaaaugacauuaucugaaaauauuugcauguuuuaaaauuucuuacucauauuauaucuuuuuagagguugccagaacaucacuagucucaguuuaggaaaaaaaauauuaauaaaagauaguuugaaagaugacauagauacuuucauaggaauugauaagaacacacagagagaucaaauucuuccacuugguuuuggaugcuuugugucauuauccugacuuuguucaaaaguaagacuuugaaauugucagaguaagaaaggagaaaaauuugaaugaagcuggucuaaacauuagguagaaauaaaagccuucagauaauccugaugaugcuucuaguuaccuguuugcuuccuuuccuuaccaaauuucucacaagaugcuuucuauuugcuguaccccccuuaccaguuuuuccaugcagaaagcuggcuucuucccccaccuucacuuccccaacuacucucuucaaaauaaacaaugacuuccuaauuaauagaacuuagagucucuguuccuuuuucauucuucuuggucuauuuuuauuuuauuuuauuuuuuagaaacagucucgcucuguugcccaggcuggagugcagugguacaaucauagcucacugcagcuuugaacuccugggcucaaacaauccuccugccccagccucccaaguagcuggaacccagguuugugccaccaugccuggcuaaugauuuuuuguagaaauagcaucuugcuuuauugcuuaggcuggacuuggacuccugggcccaagcaguccuccugacucagccucccaagaagcugggacuacauuuguguaccaccacgcaugacuaauuauguuuaaaaauuuuuguagagacuaggccuuguuauguugcccaggcuggucuugaacuccugggcucaagcaauccucccaccucacccucucaaaguguugggauuacaagugugaaccaucacacccaaccuugaucuuuuuuauauugaugauauacucauuuuaaaacaguccuucuuauuucuaugauauacuucucauucuuuuuccaucuguucucaucuuuuuuccauccacuucccucuuuugcuuuuguucuuucuuccaccucuaauugugggcauccccaaacaucccccaaaaucuuugaucauaugcucuucuagcucuaugugcuuuccuuuggaagauucauccauucucaggguuucaagcaucacguguaugcugucgacuuccauauguguuaucuugagcccugaucauccccaagagcuccaguucuauaucuuuaaccuucuuucgggcauuugugcuuugaguuaacacugucaugucaaauccaguaugcucgucuuuuuauucaccacugccuucccuuuuccacacauagaacaaguuucucuacccaguuuccccccaucucagcaccaccuuuaucucagugucuuaaguucagaaucuugaaaucauucuccugcauuauccucauuuagucaaguaucagaauuccccuaagccuucccuuuccagccuguucuuacugccaaaacucaaguccagaccuucauccucuccuaucugaauuacuaccacagccuugaggcucucccacagccuccuggauccuagauaccacugccaucuacuguuauuuaaauaugacuuuuauucuaucgcuucccuaaucaaaaauaucucaugagucuuauuuccagcaucaagucuaaacaccuuuucuuggcuuucgggcugcuuguagccuggcuccaccuuaucugucuuauuacccaacaucuuccccuuccuugaguuaggucaguuuucucacugucacaagaacuggccaaguucauuucuucccccauaucuuaacaaguguauuuucucuuguccagaaugccuuucuuuccauuggcccaaaucauauccauuuugcaagagaauugucuaugcuuccuguguccaauucccugcuuucuguucucuuuaacccacuuuaaucaagcuuuuaucaccaccacuuuacuauucaagccauaauucuuaucacuuuccuaucauuagucacuuucucagucuuucccaucucaguaaacgacacuaucauuuacuuaguugcuucaaaccuaaaagccaucuuuaguucuucucccucaaaaccuauauccaguccaucagugagucuagugagcuuuccauucaaaauauauuucaaaucuggccacuucucacuaucucacugcuaccacucuggcccaagcaaacaguaccucuccaguggucuccuugcuuucauuuuugcccuugcacaguuuauuucaccaaagcaucucuaaagaugucaaucuauucaugucacuucacuguuuauggcuuuuaaggccauaccugaucugcucuagcccaaggcucugaccuuaccuucuuucaauuuccccuuacuuccucgucucuauuuucucuggccuucuuucuguuucuacaaaaagcuaagcuuuuugacaccucacuuacacauggacacauuucagaauagucacuagauagguuagaaaagaauaaguguuuucaguuuccacaauauuugucacuaaaauauguauuguauuaacaggaaaaacuuauuucuaaaaucuacauuuuuguauaaguuuauuuuuauuuugaaauaaucucaagcuuacagaaaaccugcaaguacacacaaaucauguuuuauuuucugagccauuugcuuuaucacuccuguauacuguacuauguaauuccuauaggcaaggauauucuccuauauauucacaauauaaccaucaaaacugaggaaucagcuuugauucauuacugucaucuaacccucagauuccuuucaaguuuuuccaguugucccaguaauauccauuauggcaaaaggauccagguuagaaucauguguuguauuuaguuaaauuucuuuagcuucccuuagcuuggaacagguccucaguccuuccuugacuuucaugaccuugacauguuuuaauagaacaggccacuuauuuuuuagaauguccuucaauuugcauuugucugauguuuccucaagauuagauucaggguaugcaucuuuuuaaagaauaacauagggcugggcaugguggauuaugcuuguuaucccagcacuuuuggaaacugaggcagaaggaucaccugaggccaggaguucaagaccagcccgggucacacagcaagaccugcaucuccuaaaacuuuuuaaaaaguuagcugggugugguggcacgugucuguaguccuaguuacuccagaggcugaggcaagaggaucacuugaacccaacaguuuuaagguugcagugagagcuauguucacaccacuacacuccagccugggugacaaagugagaccuugcuuuuuuuaaaaaaaaaaaaaaaagaaagaaagaaagaaggaauaucacagaauuggugcugaguaaucuuuacuuccuucagguggcacaugauuuugauuugucccauuucaauuauguuuuauuuggucacuugauuaagguggugucugccagccuucuccacuguaaaguuauuuuccccuuuguaauuaauaaguaguuuauagaagaguacuuagcaacuauguaaguuauccugauccucaucaaacuucccauuuauucacuuauuuauaucaguauggacucaugggucuuuauuuuaucuguuacuaucauuauuuauuuugaugcucauauucucuaagauguugccagugggagccucuucaaguuggcucuuguauucuuugacaugucccucuaauuaagcacuuccuuacauccuguuacaagcuguuccagacucgucuuguguuuucccuguuccaguccuggaaucagccauuucuucaaggaucccugguuuuucagugguuccuucuaauagccacaaugugguuucucucaguggacagaacuagagaauauauguauguacacaacacacacacacacacacaucuauauuuauguaucuauaugaaaacccaugauuucacaccuauaccaucaaugccaauccaaugcuguagaauucauucuagcuuuaucacuuucuauauuuguaauuuuucuccaucagugagagaacuggcugccauuaucauuagcuuauuaauuuauuugaucaguucccuuaaauguaaccaaacucccaucuuugccaccuuccuuguacacauauagacacccauaucacaccucuaggacucuugacucuacuccccagacugccuccucacccugcucaagcuuugacacucugccuugggccuuuuccccauguagaugacccugcuuacccugcucaggcuccaacucuggcauucccacugugggucacccacacuugugaugcccucguuacuccauuuggcacugacuccccaagccaugcucgcccuccacaugguugcccuccucacacugcacaggcucugauacagaugcuuagcuugcucugccccaccugacauuggcuuuaggauugagcuguuucucaagaauugggaaaaggaagaaguaagaccauauuuuauuuagaaaaugcuuccuaccuaguguagcuuucacuaugaguugagaaggcuguaacauuucuguucccuuugaccuaaaaaagcauauauuauuaguauucaucugccuuaaauacuguagcaaucaguggaccaagagccaaaucauuuuugaaagaacaccuaaccuaaaugaauguagaaacaaaacaaccagauaaaaaaagaaagauuucuucacauuuuuucaucuuuuguucaaaugcuuugguauuauggacacagucucggaaucacuguuaagugcuaaugauuaauaaguucaugaaccuuacauuuugaacaggguaguuucugaugccugacgcccuuggaucaaaauuaauuguaucuuuuaaaacugagaaaugaaaauauuuagucacaauaacauuacugucauucagucauaccacaagauuuugcaaggcaauaucuacauugaauugauugucccuugaaacuuuagaacuaaaaccucugcaagauuguccuugauaaucuuuucacagcaauaaaagcacugacgaagagucagggcguugucaucaaagagacuaaacugcugcagacuacaacuuucccaggacaaaaauauucaaguuugccuccaaaccucuucaagauauaaacuaaccauuccaagaaguagcuuuuucauuccuacuguuacucuaaauugucugagaggcaaauuuagccuuuuuucuaaauuaagauauguuauuauugggcuuuuguuuaauucuaagccaaaauauacccaaacucccacuacauuccuuggaagcuguagaugcuguugaagugcucucuuggccacaucucacuccuuuaggagucagcacucuccaucuguauccucuuggagaccaugaaagggaaaacagccucugugacuucuccaaccaggugggucagauuagcuuuacaguccacuuacaaggagacuaacaaagcuccucuguggguguuugagcacauuuuacaaaacugcugaugaccucaugagccaaagaaaccaggucucacauuguggacuaagccuaaauauuaauacuacuuuauauuuauguagugucuuuuuuccaaggaacuccagccucuuuacagacauuaugucacuaauccucaaagcaucccuguuugguacauggcaaauauuaucccccucccuuuuuuuuuuuuuaacagugauggaaacuugcaaguuggugauggaacccagcccccugguucuuagucuaugcacuauaccauaaaaaaagucagacgaauacuuuuucaagcuauucauugcuucuugggugggauuuaagaggaugucuuggcuuguaugcauuucaguuuucagugucucuagcuucugugauccucuuuuucuucuucauuguaagucaagcauguucaagcauauuucucuuccacuguugcauuuaugggaacacuagaaguuuguaacugagauuugaagugaaagacuucgguauugaauauguaauuucacuugucacucagagaucccuuauacuucucauaaccuaaaagaaauuagauuuuuuaaaaaaauucaccaugccagcuuagagcacauuucauuuauagcaaucacauuuucaccaaaauuagguaauguucaacuaaauacaaccaauuuguguugaauuauuaacauguaccagauauuauaucaaacauuuucaaauauaugaucuuguuuuacauauauuaacacauauguaauauuccaugugaaccuguuagauuuaauucuuaaguguauaaacacucuccuagaguagggcaaagaaaaaaaaagaggcauuaauagaaauauggccucaguuguuauauccaauaaaaauaaaaauaaaagagcucccucaauucucucaguggaaauccccaguguaaauauuuccacaaaagaggaaaauguggguaacuucuaaaaaucaccaggaguuagcuucauauccacaaaguaaaaaaaaaacaaaaacaaaacuuaaaaguuugguuccuacauaaucaacaacuauacaaagcauaaggaagagaauaaaacacagccauaucuaaggaugacaaauauuucuugauuucacuugguuagacccuuccuaaucaggauuauuaaaaccaggaauuaugaacuguagugguauagcuugcucacucuuucuuuccuuucuuucuuucuuuucuuuucuuuuuucuuuucuuucuuuccuucuuucuuuuucuuucucuccuuuuccuuuuccuuccuuccuuccucccuccccuccccucccuuccccuuccccuucuccuuccuuccuucccucccucccuccgucccucccucccucccuuccucccuuccucccuuccugucucucucuaucucuuucccccuccccuucucucuuucucuuucuuucuuucuuuccagggucuugcucugucacccaggcuggaaugcagugacaugauccacagcucacugcagcuuugacuuccugggcucccgcgauccucccaccccaggcuuccaaggagcuggaaccacaagcgcacgccaccgcucuuggcugauuuuuguauuuuugguagagaugggguuucaccauguugcccagguugaucucaaacuccugagcucaagcaaucugcacaccucggccuccaaaaguucugguauuacaggcaugagccacugcgccugccccuguagugguaaaacuuuagucacaaaaaaucaauuucacaucucauuuuaaaauucuuuuauaugaacuacugucauguuuuucaaauugguggacaucuguagcuucacugaauuagaaugaugccagugaaaugagagacaaugcggaaaaauuagaaaaguucuccuaaaauaaggcggagaguuucaacucuuaaucauugaauuuugaaagcccucagaauaaaaauguaccauaugcccugccauaauacuguuucacucugcucucuggcccagcuagauucgaacuagcccuacauuucuaaguaaauagugcuuaauuugaaacugagaagcccuaccacaucacggaaaaucuuuauagguuggaaaauauguauauuaugucaugcuuuagguauauaaucuagccauauucuguaauagauuugcugcaguuuauacucaacaaccuugaguuuuuaagaaaacauauuuguauauuccaaauguuugguuuaucuuucauaggaaauauuagccaaaagggauacccuguauuucagguaaaaacuuagugauagggaaauuuaaaaaguguuagucaaaaaucgaauguuugcccuaucaggguugccaugcaugacugugcugauuguguacugcauaauuccagggauaccuaaaacacagacagaaaugugaaugacaccccugggguugagcaacgccuggcagcccugauuuuaaguaaauaguaaagcuuuugaaaaugcucauuuuuuuuuucugauucacuacugaagaccaguugugagcugcaggagggcuuuuauuauuuuuccuauuuuuuuguguauaugcaagguccuuaguuuuuuccucuccauguuguuuccaaaagacuuccuuacugacugagcuucagcacacugcucuggcauucucccagcucuaaguuuucaugagucagggaaaaugugugcacucugaaaagaagcuugucagacaugcucagccagcugacaugaagucccucucuccauucuucuuuuccauccacauucuuacagccuacugcuuguaccuuuauuuagcccugacuucauccuaccuguguuggauguuaguuagaguuuguuguuuacauaucuguguuccuuacuaccuugaacucuacugcccaucccugcuguccugcugccacugugcccugcccuuaucaccaccauagcacuuagcauggugccuugaaucuucugcuugucugacccuccucuuuuaccuuuccauucuuugguuuucuuucauuuucuuuagucaggaggaaaauauguauucucuagauggggagaauaacuggaggaaugggaagaaagcucaccuccguaaaagaccaagaguggcccugcaguuaguucuguuacuuggucacaacccuccauuuccucauuuacucuuacuguggccaggccuggcccagauuuaauaaaacaacuugaagagggugauaucaugaauuuuauuccaguuuuaaguuuuuagugaugcaguugauuuugaaaugacaacaguacagaugguuuuugcaaggauguaaaagaaacuaguaacagugauugucuuuuagaaggggacuugaaugguucugggauagcagggaaaguuucacuauauaccuuuauauuaccuuuugaauugcauauuauguaaauguauuagcuauugaaauagauacauaaaacuaacaaaaauggaagcaauuaaauaacuauaguugaacuaaauugaugcuguagaaaauucuguuaauuacaacaaaguguuugaauauauuuuuucaaagcuagaucaggaagaggagagguaugauuauucucauuuuguguuagaaauuuugaaaauguuucaucauuuccugcauaaauaauaugaaaauuaaguuuaggugcaugcuccuuauauaaaacuuauccucacucugaacacucaacuacuucacuuuagggguuuucuauuucucuucaauugaauuuagggccaauuuaaagugaaaaucugacuucuuagugacuguaucuugcaacucugccucugccuuguguggaggaacuuuacuggggaggccagaguuccuaaguguuaucuacuuuggucucuccuuccugccagcaagaguaggcaguuaugaccugagguuuagauauugcaccaauagagaucuuccaucuuagacaauuuucauaccaaaguggucuuuuucugauauuuuauaggaccuaucucuauagucauuucuguacuuacaguuaugcuauguuccucucaacaccugcuaaagcacuuauagaggcucauguucaagcaaaugaccuacauagcaagucugugagaagcaggguauugcauuuccaauucuguaucuauuaucuguucaucucuuuuuugaagaaucagcaaauguaugucaaacuuuaguacaucuaaugacaccaucaugucauugccuguaaauuuccucuauucaugccacaaaccaagaaacaacuuuuucauuuuuauaauuacuucaaguaugugcuugagcguguuuauguauuuaauguauccaccuuuaacuaccacggaauucauaauuauuuacucaggcauuugaaaguaagaaaguaacugacauuuuucuauugaaaaguauuuaauaauauuuuagaauauuuuauaauuuuuaaaagccuaauaaacauuauuuuuuuaaauguucuuuuuuaccuuugcaaauaaagcaagauugcaaauaaaaagauuuuuacacuaacauuuuuuaucacuuugaaauaaaggggauaaaagagauuaaaguaauaaaaauguugauuauuauaaccgugucaaguaauagaaaacacaauuuaaacaauaaacacacugauaugaaacuucauauuuuuaaguuuaauuauauuuaauacaauuuacacaugaauacauucucauagauaguucaaaaacugccaauaaggauauuccaugccuuuuccuuugcauuuaaaauacacacacagggugggcaugguggcucacaucuguagucccagcacuuugggaggcuggggugggccgauaacuuuagcccagcaguuugagaccagcgugggcaacauggugaaaacccgucucuaccaaaaauacaaaaauuagcugggcguggugaugugugccuguagucccagguacucaggaggcugaggugggaggauuaccugagauggggaggucaagguugcaguaagccauggauggcaccacugcaccccagccuaggugacagagugagaccccgucucaaaauacacacacacacacacacacacacacacacacgauauguuguuuaauacagcagccacuagccacauguggcuauugaguacuugaaauguggcuaguuugaauugaaauguagguauaaaauauacgcuggauugugaggacguacuacaaaaaaagaacguaaaauaucuccaucauuuuaauauucacauauuaaaaugauaguuuuuaauauauuggguuaaauuaaauguuaaauuuuaauuucaucguuucuucuuacuuuuuaaaauaugguucaaauuuaaaauuauuugguguguaauugugucuugcauucuauuucuauuaggcaguacuguauauagguauauacaugcaaacauuugauuuguggacaucuuuuuuuuuuuuuuuuuuugagacagagucuugcucugucgcccaggcuggagugcaguggcgcaaucucggcucacugcaaccucugccucccagguucaagcaauucuccugccucagccucuagaguagcugggauuacaggcacccaccaucaugccuggcuaauuuugguauuuuuguagagacaggguuuuaccuuguuggccaggcuggucuugaacuccugaccucaagugauccacccgccucagccucccaaaguguugggauuacaggcgugagccaccacgccuggcgauuuguggacaucuuaaaaucacaaaugcaauaauauuguccuuuuuuuaaacuuacuuuuuucacuuaacauacgucuuacagauuuuucccuauuaguauacuuaaaugaaccucauucuuuuuaacuguggcauaguaauccuuaguauuaaaguguucuagguuuauuucaaguuuuuuauauugaugaacauuuaaguuuuuacuuuuucuuaggaacauugcuucaggaauguccuugaacaugacucuuugugcauauaugggagcauuucucuaggauagacaccuagggggccagaagauauuugaaguuuuugauuaucuggauauaguccuguucaaagauuguauuaccucagaaaagaugcuuauuuuuuaugguuuugucauuuuuauaaaucaugugcugauuuucuuuucuuuuuuuguuuuuuugagacagggucucacucuguugcccaggccacagugcaguggcacaaucuuggcucaccucaaccucugccuccugggcacaagcaaucuucugccacaucagccuucugaguagcugggauuacaggcauguaccaccacgcccagcuaauuuuuuguauuuuuuguagagaugaaguuucuccauguugcccaggcuguucucaaaccacugagcucaaguaauccaccugccucagccucccaaaauucugggauuacaggcaugaaccaccacgcccggccaugugcugacuuuuauuuuuauuuuuauuuuuauuuuuguguugguuuguuauugugguaaaauauacauaauauauaauuugccauuuuaacgauuuuuaaggauacaguucaguggcauuaaguguauucacauuguugugcaacugucaccguuauccauuuccagaaguuucuucaucuucccaaacugaaacucuauacccauuaaacaauaauuccucaucucccucuccccauagucccuggcaaucaucauucuauuuucugucucuauuaauuugacuacucuauauaccuuacacaaguggaauuauauaauauuuguucuuuuuugacuggcuuauuucacuuagcauaauguccucaagguucauccauguuugagcauguaucagaauaucuuuccuuuuaaagcugaauaauauuccauuguauguauauaccauauuuuguuuauccauucaucuauugauggacagguggguugcuucuaccuuuugguuauugugaauaacgcugcuaugaacauggguguacaaauauuuguucaaguuccugcuuucaguccuuuuggauauguacccagcaguggaauugcuggauaauaugguaauucuauuuuuaauuuuuugaagaacugcccuacuauuuuccauagcagcugcaccauuuaacauuucuaccagcaaugcacaaggguuccaguuucuucacagcauccccaacuuguuauuuucuguuuuauuuuuuacuaauaacuauuauaaugaguaugaagugguauaucuuuguggcuuuaauuugcaucucugaugauagugauauugagcaucuuuucaugugcuuauuggcuaauugcauaucuuauuuagagaaaugucucuucaaguccuuugcccaucuuaaacucaggauuuuguuuguuuuuuugcugguuuguauuuuaagagacagcgucucacuauguugcccaggcuggucccaaacuccugggcucaggcgauccuccugccucagccuccugaguagcugggauuacaagugugagccaccauacccacuaaaaucagguuguuuuguuguuguugaguuguaggaaugcuucauacauuuuggacauuaacccauuauuagauaaaugauuugcaaauauuuucucucauuccauggguugccuucuugauaauagcauccuuugaugcacaaaaguuuuaaauuuugaaguccaauuuaccuauuuuuucuuuugccuuuguuuuuugugucauaucuaagaaauccuuguuaauuccaauguuaugaugauuuucccuauguuuucuuguuuuggcucuuagguuuaggucuuugauccuuucugaguuaacuuuuguguaugaucuaagauaaaggucuaacuucauucuuuugcauauggauauuccauuuucuuaacagcguuuguugaaaagacuaucuuuccucauugaaaaucauuugaccauauacaugaggguuuauuucugggcucuuuacucuacuccauuggucuauaugccugucuuuaugccaguaccacacuguuuugauuacuguagguuuguaguaagcuuugaaaucaggaaaugugagaccuccaacuuuguuuuucuuauucaagauuguuuuggucauuuggagauccuugagaucccauauaaauuuuagaauggguuuuucuaucucugcaaaaaauuuuauugggauuuugagaaagguuguguugagucuguagauugcuuuggguaguauugacaucuuaaccauauugucuuucaaucuaugaaugcagaugucuuuccauggucucaucauuuuauacauuuuauauguugcuuaagagggucuucccaaugcuaaaguuauaaauaauuuuuuucuauauuuuguuuuaauagauuuguaguuuggguuuacauauuuguuuccuuaaguuagcugggauauuucccccaguaugauaacuuuuucccauuuuauugguaccaccugaauagucugccaauucccugguaauugaaaugccaccuuuuucauaaaccauagcauagguuuguuuuuagauuuuucucuucuauuucacugauccauauaucuacucuugugauauaauuuuuaauuaccuuuauuuuauaguagcuuuugauaucugguaggguaacuguuuccccucauucuucuucuuuuuguuuauucccuuuauuuuuauuauuauuauucuuuuucuuuauucuucauucuucuucuuuuuuuauucucuuuauuauuauuauuccccucauuauucuucuuuuucauuauucuuuuuaagguuuucccauauauuuucucuuucagaugacuauuagaaucagccuaacaaguuccaacagacauauuauuggaauuuugauugagauuacauuuauuugaugaauuaaucuugggaaacuuauuuuuauaauaauaugccuuuguguuuugaggaaacauuauuucuaguaucuauauuccuauuaucaccauaaucccuaagaaauuuucuauuuacuuguauaauauucaagauugccauguagaauagcucuguccaauagaacuuuccaugauaauaaaaauguucuguaucugugaugucaaauagguagccacuuaccacauguggcuauugagcaccagaaauguggcuaaugcaacugaggaaguaaauuuuaaguuuuauuucauuuugauuaaauguaaauggccacauguagcuaauagcuaucauauuagacaguacggcuuuugaauguaugaauaaauguguaacugaacacuuuuguaaguaguagagguaguguagcaaagaauuauugauaccuacugugugaaagacauuguguaaagcauugcagagaggcaaaaggccauaaaauuaauacacauuaauuccuaaauaaaaauccaauccaaguauaagacaauuuguuuacaaauauuucuguugucagaaacguucaauuacaaaaauguaguguggauauucauuagaaagaaaguucaugucaaauuaaaggagcaagagaggcuuuguggaugaaguacuacuagaaauuggccuugaaggaauuauucaaaauuuaaaagaaagaaaguaauggaagauuucuguuuucuuaaaucuagaggaaauagagaagagggaaaagaaugugguauguuuggaggauuagcucccuugguugcuguaacaaauuacaaguuugguggcuaaaacaacaaaaauguauucucucacaauucuggaugccagaaguccaaaagcaauaugaguggucugaaaucaagaugucagcagagccacacucccucugggggcucuaagagaaguucuauucuuugccucguccagcuucuaguagcugcuggcauuccuggucacagcagucucugacccuauugucacauugucuucucuucugucuguguucacaucucccauugccucugucuuacaaggauacaucugauuacauuuaggguccaccugcauaauuaagaagaacucuccauuucaagauccuuuauuacaucuguagagacgccccccuuuuauauuuuugccauguaaggucacauucacaggcugcagaauuuaggacaugaacaucuuugggggcucauuuuuuaguguaccacaaauauccaauuugccuggaguuagggauuccuguggcaguaggaauuaugauaacugucagucacugaaugacuugcacaugugagagguuauaccaagugcucuaucugugcuauuccauuuacucauuacaagaacauuguguaggcauuaggagacgagggaugaaucuaaggugacuguuuuccaccuuugaugacuaggaaaugaugauuuacagaaauuguagagucaugaggaaaaauugguuacaaaggaaaaacaauaaauuugacuuuggcuguguuuaguuugaagucccaauaggcugugcccaaggaaagaucaaccccaaauagaaacuuaagggccccacgaagaauucuuauagucucuucuauaauuuuuuaccuuguuuuccccuuuggguugaagaaacaaauuauaaggagcacuaaacuugaaaucagaagacuuggguucaaaacuugcacuuacuaaaugugugaacuagauaagucauuucacuucucugagcuucaguuucuacaucuguacaagaggaauaaccacucccccucccaucacacacaguuauugugaggaauaaaugacauaacauaugugauuuuuuaguauauagucuguuguaagcauucaaauguuucauuugaagguaauaugucuuaaagcuaucuggauccuaaguaaaacucuacauuauuuuuacaaaucuaugaucaacugcuuuucccauuguccaaaugaccauucuauacuuuuaccacuuaaguguuuuaagugccacccaagaccaauuuacucccuuucuaagcagaugaccuaaacucuacuucauagaaauaauuaaggccaucaaacauaaaucauucaacuuucugcucucauauuuaaauguuuaccuauaucuguauccauuuuaccucauuccuucggaccucagaagaaguaauauccuuucuuuugucccaagugaauacuucuuuagauaugugcccuugaugcaauuuccuucauccuuagcuccaggucacauagucaaugccugguggacaucuucauuuggauaccucauuccaauucagaauauugaaaacagagucaguuguuucuucauccauccucccuaccauguuccuaccuccuacucccucaacuucuauuucccaucuuggucaccggcauuaccagaaacuuggguaauuuuugucauguuuuacuccuuucuuuccuuuacuauaccugugcuuauuccaauuaaugaucaagucaugguagggcucagguucaggcacucauucugucucuccugagcccucuauccuuuuaauguuuucccucuaacuucacugcggcuuuuggucuugcucagaucauucauuuucugaaguagccucauugcuucucgucuuacuccucuccaauccacccuucacacugcugccauagggaucuuucuaaaacagaccuacucuuggaacccuucagggcucuccauuacagacucucauuacaaaguccaaacuuuaaagaaugacauugucugacccagcccaccacucccacacccuuccuguuagccccauugagcuauacccaauuccccagagguauccugcuuuauaucccuguaccugugcuccuucugucuaaaauguguuaucugcaaccccauuuccuaaugcuguuugccuggugaaugucugcucaucuugcauuacuuaguucaagcuucauaucccuuuugaagccuugccaggccuccccagaaagaacugauaagaucuuuuuggaaccccugcuguacccuauauaugacucugucauuuccucuguaaccuguuuguuuccccguaccaggccuucuuugaggacaugaagugucuugaucagcuuuguaucuuuaguguuuaacacaaugucuggcacagagaaggugcccaaaaaaaauuuaucaaauaaaugaauuaauuauaaaacuuuuaaaguuauaugaugccuuagagaagggaguaaggaagaacuuauguaacaacuuuuggagauaaauggaaauaucugauuaugagccuaagaagaauacacauuuaccuccuaaguagagauagucaugguccagaacucuggucacaaacuacagaagauaaagaaauuaauugaaugggcaaaccccucauaagucccaguaaaacaugagacacuucccaaugcgcucuugaugugauuuccuccauccuuagauccaguucacauagucaacaccuggugaacaucuucauuuggauaucucacaucuaauucggaaucuuaaaaacagagucaauuauuucuccaucuaucuuccccaccauuuucccaccucucacucccucaacuucuucuauuuccaaucuuggucaauggcauuaccacaaacuuggauaauuuuugucauguuuuacuccuuucuuuccuuuacuguaccaacauaucaagaaagcuuacagcuccacugguguuggacauaaguauucucucaaagcauuugcuuucuuacugcuuauucaucacaauguuaacauaaacuucauuuacguuaauagcauuuauuuuauaauuacuguugaucuaccuuucauugugccaaaaauauaaauguuaagggaaucaaaacuaacaucagugguauaacuuacuuuuagggacauagauccuuugaaccauggaaaucuuugaucuggaaacugccaaauccaaagauucuagacauaaacuuaacuacaaauuuauacuggugaggacugguuuucucaagagaaaacauuuugccagaucugacuugaaaaauaauuuugaagugagcaaaauucacuacacucaccccaggcacacaacucacuguauuuccuggcugccuggggcugcccucucccgugguuccccaugcaggucuaccuccucaugcaaaacaaguaccgugcccugaacugccuuuccugugucacaacauaucugucuuuuuuccaaagccugugaggcucugcuuuuaguaggcugacacuuggagaccacuugguaaauucacuuacacuaacauaauauuaaguaaaaauuccaggggaauuuacauuuuuaacaggaguauguuggaugcauaauaccuaaccauaagagcuaaucuaauaaagggacauuuccuaccaucucauauauuuuccaugucuuuucauguuucauugucuuuaaacauauugaacuuucugccuagaauaaccucccccugcucccaccaccauuuccagucuggugaacugcugcucuuccuucaauacccagcucaaugucucucuucuaaggagccuucucuaaauuccccagccugaguuggucccucccucuggacuucuauaaaacuuuguguacuugucucaauuucuuuagucuuuuauucacucuucaaaugacuucaaggugacuucuacccucaccaauccaaugcacuaaguaaaccccauguggugaaaucaaguggacauauuugaguccucaucuuccuugcccucucagcaacaccugacacuauugaccaccaccuuuuaauuucuccacucccucuucuuaaaacccccuuccccugacuuucucaacaugacagucugcuagucuucuuuuaucucucucuuucucagucuacuuuguuggcucauccucuaacuaaucucuaaauguuagauuucuuuaggcuauguccugauccuuuucccuucccacacucugaucuuucaauaagcaaacucuuccacacccauggcauuaguuauccuccguaugcuuaugacuuucaaauuuacaucuccaacccagaccucuuuccugaauuucagacuuccacagauagccacugauucagcauguccacacgaagguuuuguaggcacuccaaauucagcagguucaaaacucccauuguucucgaccugagagaacagcaacuccauccaugcaguuagccaaacuagaaacugggaaguuauuauugacccaucuaucucucucuuaccaugguauccaauuggccauccuccugacucuaccugccaaauauaucucucaauuuuaacuucucuccaucuccacugccaugcaaguuaucaccugucuaccacuauaacagacucaucacuuguaucugcuugaugucuccaauacauuucuacacugcaggcagagugcucuuugaaaauucauucaucaaaaaguauuuauugaaccuuuacuaugucaaggcacuugcuagauagugauacaaauguaaccaagacauguauguuccuaaucuccuagaacucuauacaguucugugauugggagaccuaacuuaugugggauggagagaauuucucugaggaaauaauuuuuuuaaucugggaucugaagaaugaguaggaaucaacuaggcaaaaagggaaggcaauggaggggaaagaacauuuuaggcagaaggaacaucaugugcaaagguuuagaaucaagaggaagcaagguaugagaagcaagauaugaggcuaggcacagccagggccugaggagucauaacucuaacugggaaauacucaggaggucuaguagcuccucaaacagccugccaaauuagauuagugaguggaggugugagcauuuuucugaggagagagugcauagcuuucaucagggucugugacacuuucccuccccugaaaauguaaagaacuaugucugggguaugaaagaccauuuuuggacuuuguccuaaaaacaauggaugacauuggaaaguaugaagccaaaaaguaacauggccagauuguaaaauucauggggcaggaauuuuuaucucuuuuguucacugauaggucccaaacaccuagaagagugccaugcacauagcugacacucaauaaauaacugcugaaugaauugccgaaugucuauuuuggcauuacauuguauugcauuauacuguaauuguguacuuaaugucucuccuuuacaaggcucaauucugggaaaccaacuaugucuccuugaucuuuguauuacuagagauauguuuuuagugcccagcucauggccuggcuuaaaaucaguuucauuuguguguucauucauucagccaauaauuaaagagcaucuaccagauggcaggaacugagaauacaaagaugaugaaaauauuggggcugggcacaguggcucaugccuguaaucccagcacuuugggaggccaacgcaugcggaucaccugaggucaggaguuugagacuagccuggccaauaugguaaaacccugucucuacuaaaaauacaaaaauuagcugggcgugguggcggguaccuguaaucccagcuacuugggaggcugaggcaugagaauugcuugaaccugggagauggagguugcagugagccgagguugcaccacuguacucuagccugggcgacagaaugagacuccguuucaaaaaaaaaaaaaauggcccaaaccucaaggaguuuacacuguggaugggaagacuaguaaguaggccugauaauacugcauaguaaauccuacaaaagggguaagaacagaacacagcugugggggugucagggaagcccagcaggcagaagaaacuauggaacugccccugaaccaaaugaagaagagaggagcaaagcgugggagugggcauugaagguaaaguccagaguagggcaagcagggcccauuagaacugcaagugguuaagugugggggaagauggagcugcagaaauaggccaaggccauaaagcaccuagacuuuauucugagguccaugggaaguuauuaauggaugacugaugaagcagaagagcgaugugucagaucugcauaugagacuacuugugcuccagaguggacaauggauuggagaggcagucauaguggcaguagggaccagugauugggagagaugauguuugccugcacuaaagaaguaaugggaauagaggacaauggauggauuugagagcuauuaaggagguaggaucaaaaggaauuagugauuaauuagaugcuagcaugagaaugauggaguagucauggaugauucucugauuuuuaacuuggacaccuugggugagugagaacgaagauugggaacaggcuuagagaagcagaugaugaauuccaauuugggcagacugcacuugaguuuucuuuggaauacccauguggagacuuuuagucggcaguuggauacacacauggaucugaaguucagaaggaagaucuaggcuguaaacauaaaugugggggucuuugcuuaugaaugguaauugauuccuagaaguggaugagaucacucagggaggguguggagaauaaggagaaagacagccaaagacagaacuuuaggagaacauucaaguaacaagcauuuuuaaagggagcgaauaaaggaauaagugauuaaaaagagucauuuagaagaagggaucccuucuaaagcuucccaaauacugcuaccaaaucagcuggcuauccuauuugugcuuaaggcaaagccuacuuuuuggcuccccaaauggagaauguguuacuaaaccaaagauggaaaguagggcaacaucauauacagaaagcauaucuucagggcuuuuuucagauacauauguggauacucuacuccugaggcucuauugguaaacagaucauaguagcgucuuguuagucugcaucaagaaacacuuaauaauuaaaaagaaacacuuuaaaaagcuguauguuuaaaauauaauaugaaaaguauuagaagucauuugaugaucaucugauguucagaucaaccagauaaucuuucuagccugccugaugaguggccuuuugcuuggcuuguuggcuuuggcgucaaguguacaaacucagccaguuggaauacaccugaaaaauguuucucaaauguuccuuuguguggauaaauuuguugguuuauauaguguguauauguuauuugucuauguuaagaaguguccccuggcugauaacauacuuguuuuucagcccacaaauuuucuaugaaccauugagaguucccaggccucacuauuaccuugagauauugaagauauuuugacuuacugcaauaaaauuacaguucugcaacuuguaauuaaacuuuggauuuauuugaacaaugaaagaaaaaagagaacaaaacuauuaaaccaucaggucaacuggucaguugagaauucguacacucaucuucucuucuuucauguguacccagauuugauagaagugaggauaguuugguuugaauggaaagcauggccaagcaacaagcuaacuuuuaccagauacuuuuuuccuacagucaaaccauaacaaauucaucuccuagauaacaacuugguuuuugugcuuugacuuuuuauguugcuauuuccuuuccuuuagagcagcccauuucaaauuuuuacauguaaguaaacgaguuauuugaggggcugcucuauaucuuuucucagaguuuuguauagcuacugucuuaguauaagccaaagggaauuugugguuccugagaucagaaauucaacugcuuucuaaaacugaaggaugaauuaguacuuaaguuagccauuuugauacacaaucuuuguuccuaaaugacacuuaaauguuuuauuugcacuuccacuauuuuguuauaguaacauaucaauaauaauaacaugccucuccuacgaaggacaaaaaggauaauuuuagaaacucuacuauauauucucacaagucuugcuuuaaauauauauauuauauauuauauuauagaauauauuauauauaauauaauauagaauauauauaauaauauauauaauauaauauagaauauauauaauaauauauauaauauaauauauauauauauauaucuuauuccauuuuccuuccaaagaaaaaacauaggacauggaaaaaccuuuccucccaucuaguggcuggaaaauauauaaauguccucuaucuguuuuuuggaauuccaggcauuagggauuguuuggcagauuauaauauaucuaauuguucacccaguuaagcaaaaauaaguucuaaaaucuucaccaaagccaaacucaauggcaaaauauauaucuauaaugauucacuaaccaacuucccuuucaucaauaacauacuccucaguagaaagguuaugguucuucuuaauucauuauucugaacacacgauagaaaacacaaggcaguaugucucugcuaccugaaauugggacuuaaauuacauuugccucuaaagcagucagugccccagaucucuccuaaaccuuaauugcuucuuguuggccccacaacuuaacaaccuucucucaagaguuggauguguugaauucacuagagagagccaagaaacugucucagaaacuggcugccuccaagggaccucagcuccugaaacuuggaauaccagacucugauacuggcagcagggccucugugcagggccaaaccagcccacaggaaagcagguuuggauccguuaugcagcuugagggauuaaugcuuggucuaccugucuuauauaugucuugugcagaugucaaaaucucugcugaauugugccucucucuggugauucucacagauucaaagaaugaauuuugugugcagucagcaaaguucugagugcuccaggaagaagaggaaggucagugaaccagugaaggucuucaucccuaacagaaaaugaaagcuaaauauuccuucuacauuuauuuuaaaauaaguuuauuuuguaaaaacaugcauaaacugucuuagcaggaaaguacauuccuguuaccaaaaccuuuuucuaaauuuuuugcucaauuuuuuuugucaguugcuaagugcuaaauuacuggccagguaggacgcgaguccacuuugccauaaggaaagcgggucaauagggcugccucuggauagcauuacuucaaagcuggguuagagaugaggcaccuuuuauauuauauuuguaaaagaaccacagcagcuauuuuggaaagaagcuguuguucucaaaggaaagaaggauuuuuuugcauaauuaaacucuucagcuauuuagacuacugugaaauguuuugacuuguuguaaccuguauacuggaaucccucucuagcuguauuaaaaauucccacagaguugcauaggauguguggaggugcuuauccaggugugauuuauguguuaaccucagucacgagguugaucagcuaauugugggaccaaaaugugcccugccucaacucuggccccaggcccuguucuguuauccaauccgaaacacggaacaugcugcaauucaggagucuggcucucuucuuaagaccuauauuaaauauuucccaagaagcacuucaguuuaucagucuguaaccugcaaaugaugcuauuaguucccuccuuauucuggaagaauuuggauagacuuaauugaugauuaguaugagaugaacaauagaugacuuaaaguguuauuucuauuauuuauauaacaugagauuuaguaacuuauaaaaugagguuuaguaauuuaauuuaaauggauaggaccaauaaguuaaauauuaagugugugacuuaugguuaaauaaaaugaaaauacaa

SEQ ID NO: 192208 - RNA, 26288 nt, Homo sapiens
uuugcggcuccaacauggcuccgcggcugugcagcaucucugugacggcgcggcggcugcuggggggcccggggccucgcgcuggggacguugcgucugcagcugcggcgcggugagagcccggccaggcagggauagacgcgcgcgggguggggugcaggcgcgggggccagggacugggucgugggggaggggcugagacuccucgcuuggaaucuggggguuagaggcggggcaggaucaaggccuagggaggggucugggcaaagaaugggggaggugagaaagggauggguagggucuuuguccugguugggaccgggcugugauggggaccugaugaaagauggugagaagggcagguacugggcccuggagagugggagagggcagaagacaggaggaguggcccauucccaggcguagcuugugauuuaacacccacugggggcuucugguagucagcuccuccgucgggaaguucugugggaaagagaugauggcaggggagcagugggggauccccaggggccauggcugcacagacccuuuguuccuccaccucgaacuguacagguggggaaacggaccugagagggaaugggaguuguccaaggucacccucccugcugugccguggcagcaccaggucugggacccaggccugccaaugcgccaugcacuuugcacccaacugguggccuccugggagugggagucuggcugggccaugugcucucagccugggcuuuuguuugggcccugcucugggcugagcuagggcuuggccucccugacuggcccugggcagccccucacuccuugguccccacagcccuguacuucccccaucucugcauauaugacccugcacaguuaugacuuggugcuugucugucucucucacuagaccaugaucucauuuuucucuguuuccccagccucccacccucagagggcucaggacuguguauggucaaggaauauuuaccaaagaagugaggccaccuguucccccucccccaaccugugaaaaggaagcaaccaucccuccugcccugcagcccaggaaugaagcugcaaaguucugauagugccugccaugagauguuacagcacagagcaguggggcuuuuggacagcugggaaagaggaguggcauaagcgccccaccuagacugcccaauaauuagggauaaagcugacaccgugggaaaagccuagaguuugccuggcacuaacagaucuaacucagacuuuguagguggggugaccucaggacucuuuaagccucggguuccucaucuguaaaaugggaguaaucaggauguaucucauaggguuguugaggauuaaagaugcugugguuggucggguaugguggcucaugccuguaaucccagcacuuugggaggccgaggcaggcagaucacuugaggucagcaguucaagaccagcuuggcaacacggcgagauccugucucuauaaaaaguacaaaaauggccgggcgcgguggcucacgccuguaaucccagcacuuugggaggccgaggcgguggaucacgaggucaggagaucgagaccauccuggcuaacacggugaaaccccaucucuacuaaaaauacaaaaaauuagcugggcgcgguggcaggcgccuguagucccagcuacucaggaggcugaggcaggagaauggcgugaacccaggaggcggagcuugcagugagccgagauccugccacugcacuccagccugggcgacaagagugagacucugucucaaaaaaaaaaaaaaaaaaaaaaaaguacaaaaauuucaccauguuggugaaaacgugucucuacuaaaaauacaauuagcugggugugauggcucaccccuguaaucccagcuacuaggaagcugaggcaggagaaucaauugaacccgggagacagagguugcagugagccgagaucacgcuacugcacuccaacccgggugacagagcgagacuccgucuacaaaaaaaaaagauuccgugguugugaagugucuagcacuugacgaacaugcaguaaguguugcuccuuaaccccuagccuauguuucaagcaauuucugcaugugacccacauaauguugaggcucaaagggcucugggaagaucaucuuuuaugagcccuuuguuuuccagauaaaaauaucaagauuggggaagggacagaauggauuggugguaaaaccauuuguguggcaaacacccagaggcuguaaaaggagcaugggucucagagucagccugcugccccucacucagugacccuggaugaguugcugaaccuccgucagccucaguuuccuuuucuguaaaguggggauguugguguuuucggcaggauugcuaugaagccacuugaauuaauguuuaucaagucccucaaggacugucuugcaguuacuuauaccuuaauuccacauuggauaccugagaacacucuguccugcugccccucaggcugccccauaucucuccagagucacuaguagggccagcagcagcccuucuggccugugagguuugggggcaaugaggcugcugggguggggauggagugugggcuuugaaaucagauggaccugggccaggcaccauugcucacgccuguaaucccaacacuucgguaggccaaggugggaggauugcuugaacccaggaguuugagaccagccugggcaacauggcgagauccugucucuauaaaaaauacaaaaauuuggccaggcacagugggucaugccuguaaucccagcacuuuaggaggcugaggcggguggaucaccugaggccaggaguucaagaccagcuuggccaacauggugaaaccccaucucuacuaaaaacacaaaaauuagccaggccaggccuggugacucccaccuguaauccuagcacuuugggaggcccaggcaggcggaucaugaggucagguauucaagaccagccuggccaacauggugaaaccccgucuuuauuaaaaauacaaaaauuagcugggcauggugugugcgccuguaaucccagcuacucuggaggcugaggcaggagaaucgcuuaaaccagggagguggagguugcagugagcugagaucgcaccagugcacuccagccugggugauagagcaagacucugucucaaaaaaaaaaaaaaaaaaaaauuaggcauggugguguguuccuguauucccagcuauucuggaggcugaggcaggagaaucgcuugaacuggggagcuggagguugcagugagccaagaucgcgccacugcacuccagccugggcaacagagggagacuccguaucaaaaaaacaaaacaaaacaaaacaaaacaaaaaaacaugccgggugcguuggcucacaccuguaaucccagcacuuugggaggccgaggcgggcagaucaccugaggucaggaguucgaccuggccaacguggugaaacccugucucuacuaaaaauacaaaaauuaguugggcgugguggcagaugccuguaaucccagcuacuugggagacugagacaggagaaucacuugaacccagggggcggagguugcagugagcugagaucguaccauugcacuccagccuggggaacaagagcgagacuucgucucaagaaaaaaaaaaaaaauuagccaggcauggugacacaugucuauagucccaacuacuccggaggcugaggcaggagaaucccuugaaccugggagguggaaguugcagugagccgagaucgugccauugcacuccagccugggcaacagaguaagacuccaucucaaacaacaacaaaaauuagccagacgugguggugcucaccuguggucucagcuacuugggaggcugaagugggaggaucauuugagucugggagauagaggaugcagugagccaugauugugucacugcacuccagccugggugacagagugagacccugucucgaaaaaagaaaaaaaaaauagaagaaaaaagaaagaugaagcugagcuaggaucaaaaccuggauuuguccagagcuugugcucauaagcacuaguucugcuguugguguuaaggauggaaaggaccccugaucccugagugaagucacucugggucaaggucuaccuuuuuuuuuuuuuuugagacggagucucauucugucagccaggcuggagugcaguggcgcgauuucggcucacugcaaccucugcccucugaguucaagcgauucuccugccucagccucccaaguagcugggauuacaggcgccugccaccgcacccagcuaauuuuuuguauuuuuaguacagacgggguuucaccaucuuggccaggcuggucuugaacuccugaccuugugauccacccgccucggcuucccaaagugcugggauuacaggcgugagccaccacgcccagccuaaggucuaccauuucuuuuguuucauacuuuucagcuuucaucauuuucaugcaagaaugucuuagcuccucuuucauucauuucucaaacuuggacugcauucucaccaugugcccagcacugcuccaagcauaggggauacagcagggauacaacagaacagacaaggauucugccccgcuagggcugccuccaguuuagagacugacaauaaacaaagcacauaauaagccaaaaaguauaguguuuuuuuuuguuuuuaauuuuuaguagagaugaggucuugcuauguuucccaggcuggucucaaacuccuggguucggccgggcaugguggaucaugccuguaaucccaucacuuugggaggccaagucaggcagaucacuugaggucaggaguucgagaccagccugaccaacauggugaaaccccgucucuacuaaaacauacaaaaauuagccgggugugguagcacgcaccuguagucccagcuacucgggaggcugaggcaagagaaucgcuugaacccaggagguggagguugcagugagcugagauuacgccacugcacuccagccugggcaacagagugaaacuccaucucaaaaaaauacaaaaaaaaaaaaaggccaagugugguagcucaugucuguaaucccagcacuuugggaggcugaggcaggaggaucaccugaggucaagaguucgagaccagccuggcuaacauggugaaaacccaucucuacuaaaaauaaaaaauuagcuggaugugguggcacaugccuguagucccagcuacuugagaggcugaggcuggagaauugcuugaaccugggaggcggagguugcagugagcccagaucacgccacugcacuacagccuggacgacagacugagacuccaucucaaacaaaacaaaaaaaaaaaaacaacuccuggguucaagcaauccuucccucuugcgucagccucccaaagugcugggauuauaggcaugagccacugggcuaauccuaguauagcguuuuagaacgugcucuggaacaagauagagagcaggaagagagggcuuggggaggucaaggguaggagaacauuguaauuucacugagaaagugacauuuguacucuugcagauguacccuuggggaugcuggcuuggaguucaaacccuccucugagaucuuugacaagcuccuucuuggauuuuaccuguagaaaacagcuuuagggaugggcuccaccacccugcucauuugacagauggggaaacugaggcccacaggcaggaaggauuagaguagugggaagagacgggagcccaucagagcuccugaaguuuccaguguuccagccccuaaucucuuucuucagggcuggcuauuugacugauauuuaucuuggucagugcugauguuaauaaauuacucugucuaguccuuucuagagcaaaggucuugguugauaaauaguaggagcugcucuccucacugcccaucucccuccaggggaagcagccccucuacauuaaaaccaaaggucaggucccucagugcccaaccugagguggggauuggcuuucaaggaaagagcgcuggguucuuaacucugcccucugauuuucugugcggccuugggcaagucccuuaaacucucugggcuucuuuccauuuuauccucgcgagaaugggaauacuaauaguaccaauacuauaagaucauugcauagaaucagugagauccugcaacugaaaaguacaucacagaucccuggcuuagagccucccuuauucugguccaaaaacuucacagaccgcacuacccaucuaaugauaauugucuuuuuuuuuuuuuuuuuuugagacagaguuucgcucuuguagcccagucuggagugcaauggcacgaucucagcucacugcaaccuccgccucccggguucaagugauucuccugccucagccucccgaguagcugggauuacaggauugcaccaccaugcccagcuaauuuuuguauuuuuaguagagacugaguuucaccauguuggccaggcuagccucaaacuccugaccucaggcaauccgcccgccucggccucccaaagugcugggauuacaggcaugagccaccgcaccaggcugauaauugucuuuuugcuaaugaagcagaugcauguacaaugaucgagagaguucaugaauucagaaaugcuuaacacacuuuaaaaucuuuauaaaaaauuacaaugaauaaagaaaaauuuagccaucuccuauuccucuuucccagguaagcaguauuaacaguuugggacaaguaauuuauuuucuuuucuuuuucuuucuuuuuuuuuuuuuuuuuuuuuuuuuuuuuuugugaagauggagucucacucugucauccaggcuggcgugcaguggcgugaucuuggcucacugcagccuccgccuccuggauucaagcaguucugccucagucucucgaguagcugggacuacaggcacacaucaccacuccuggcuaauauuuuguaucuuuuuuuaaguggaaaugggguuuugccauguugcccaggcuagucgugaacuccugagcuccagcaaucugcccgccucagccucccaaaaugcuaggauuacaggcaugagccaccaugcccagccucuuuuuuuguuuuguuuuguuuuguuuuguuuuuugagacagggucugcucuguugcccaggcuggagugcaguggcccgaucucagcuugcugcaaccuacgccuccuggguucaagcgaucuucccaccucagccuccugaguagcugggacuacaggcgcacuugacacucgaccacaccuggcuaauuuuuuuuuuuuuugagacagaguuucacucuuguugcccaggcuggagugcaauggccugaucucggcuuacuacaaccuccaccuccuggguucaagcaauucuccugccccagccuccugaguagcugggauuacaggcaugcaccaccacgccuggcuaauuuuguauuuuuaguagagaugggguuucuccauguuggucaggcuggucucaaacucccgaccucagguaauccacccgccuuggccuccuaaaguguugggauuacaggcgugagccaccguacccagcaauuuuuuuauuuauugcagagacagggcuucagacuccugagcucaagugauccgccugccucggccucccagagugcuggaauuauaggcgugagccaccaugcccggcccauuucucauuuuuaugcuuauacaaacauaucaccacuuuggcccagcgcaguggcucaugcuuguaauccuagcacuuugagaggccgaggcagguggaucaugaggucgagagaucgagaccauccuggccaacauaguaaaaccccgucucuacuaaaaauacaaaaauuagcugggcgugguggcacacgucuguagucccagcuacuugggaggcugaggcaggagaaucacuugaacccgggagguggagguugcagugaguggagaucauaccacuuuacuccagccuggcgacagagcaagacuccaucucaaauacaaacaaaugaacaaaacaaaacaaacauaucaccacuuuaagauuauuuuuaaaaagaaauuuuuuuuuuuuuugagacauggucucugucacccaggcuggagugcaguggccugaucauaguucauuguagccuugauuuccugggcuucaugcgauccuccuaagucucucaaguggcugagacuacaggcaugugucaccacacccggcuaauuauuguauuuuauuuuauuuuauuuuauuuuuuugagauagagucucacucuguugcccaagcuggaguacaguggcaagaucuuggcucacugcagccucaaccucccaggcucaagugauccuaccaccucagccucccaaguagugggacuacaggcacauaccgucaugcccagcuaauuuuauuuuuuguagagacacggucucacaaguuuccccaggcuugucucauggccucaagcaauccuccugccucagccucccaaagugcugggauuacaggcauaagccagucauauuuauuauuuuuuuuguagagauggagucucauuuuguugcccaggcugaucuugaacuccugggcucaagugauccucugaccucagccucccaaaguacugggauuacaggcauuuagccaucgugcccagcugauuuuauccgucccaauggcugcuccauauuuuggaaaaaauugauugauuuuuuauuugcaagacauuuguccuuuuuuuuuuuuuuuuuuuugagauggauucucgcucuguugcccaggcgggagugugauggugcgaucuuggcucacugcaaccucugccucucagguucaagcaauucuccugccucaugcuccugaguagcugggauuacaggugcacaccaccacgccuggcugauuuuuguauuuuuaguagagacaggguuucgccaugcugggcaggcuggucucgaacuccugaccucaggugaucugccugccuuggccucccaaagugcugggauugcaggcgugagccaucacacccagccuaagacauuugucuaaccacauaaaagucuuaaaaagggauagggcagccgaguauuuguauuguaaaaauacgaaaauuaccuggauguggugguacgcgccuguaaucucagcuacucaggaggcugaggcaggaaaauugcuugaacccgggaggccgagguugcagugagccgagaucgcaccacugcacuccagccugagcaacaagagcaagacucugucucaaaaaaaaagaaaagaaaaaaagaaaagaaaggauagggcuuccugugaccucacuuggaaaaaacaaaagagaaaaaagaaaaaagggauaaggcuugcugccacucagggaucccucuugccaggcucccuggcuaggaauugucuccauugggagacuuccuuuucaggccuggcugcaagcugcaccaaggcuguggagcgggaagauugguagucucaaaauaagcaccccugccuccugcugggaccuuggguauguguuuaggaugggagugcaguucugguccaguaggagcuggcagcagacccuccacugcccuuaaccacagugcucaugggcaaagcacauaaucauauucauugaucauucauucauucauucucaguauccuauggagaugggcagagcagguguuggcuggaugagugaaugcaucuugcuuugcagugccuuuuacucccucuaucugccaaaccaguccuggggacugaccagcucaucuccuccucuguagagagucugcccagguugccagaagcagaguuaaggcuaguucaccugggcucuuccagagaccccuccuauaauugugucccaaggcccauuucuccuaguggacuaugagcuccucaaggacaaagcuuauuuguauuuggcuuuccauguguggggucaggguggggacaugggccaagugcacugugagagugcuggggaggacggugagagcagucuucucguuagaggggacagaacuuguacagaaagcacagaguagcagauccugguguguucagggaagagcacaccuggagagugagguguacaggugagggggcaggaggggaggcugacaaguuagguuggguugucaagggcuuugggcaugaugcaagguggauuugggguugauccucuuggcgagaggcuggaguuauaugacccaaguagaggaccucuuggaagggggaugaaguggaggcagggaggcuagagagagaagugggagguggggcugccucuccuggcguccugaggcucugcaaagcuucaagaagccaacugggcagcuggaauaucuguagaaaggagcuggcuccaauagcauuucacagucuggagcugccacaggacuccguggcccuguucccagaaaugugggucacuggucuaggggagcaggacauccaaguggauggaauugcuggggcucccccaaccuccgcgcgucccccucaacuccucuguccugcaguuucuauuccaaggacaaugaaggcagcugguuccgcucccucuuuguucacaaaguggauccccggaaggaugcccacuccacccugcuguccaagaaggaaaccagcaaccucuauaagauccagugugaguggcugcugagcugaccaauuucugcccuuucaggggcucugggggccugugaggcuccaggaaggagaugggagggucuggaauguccucagcuguccugggaccccuggccuugaugggcuccccucaccccaaguucuucccuguguacacacccuaccucacuucuuguucucuguccucuguugcaguucacaauguaaagccugaauaccuggaugccuacaacagccucacgugagcacccugcauccauacaucccauccccugcuuggguggggaacacacuuucagcaaauuugcggaacauccuccacccuguucuuuucuguagaaauccaggagauguagauuucuuuuauuucugccuuuuucuuucuuucuuucuuucucucuuucuuuuuuuuugagauggaguuuugcucucguugcccaggcuggagugcaauggcgcgaucucggcucacugcaaccucugccucccagguacaagcgauucuccuguuccagccucccaaguagcucggauuacaggcaugcgccgcuaagcauggcuaauuuuuuuguauuuaguagagacaggguuucaccauguuaguccggcuggucgcaaacuccugaccucaggugauccaccugccucggccuccgagugcugggauuacaggcaugugccacugcguuuggccccauuuucuuucuuucuuuuuuuuuuuuuuaagagauggucuccaggaggcggagguuccagugagccgagauugcgccauugcacuccagccugggcaacaagagcaaaacucugucucacacacaaaaaagagagaugggaucucacuuugcuucccaggcuggucucaaacuacugggcucaagcaauccuccugccucagccucccaguguugggauuacaggugugagccacugugcccagccaggauguaaauuucagugucggaaguccugagggccucuugccuagcuucugcauuuuagagauggagagucugaggcccagccccagggucuguuugaacugaguuugaacccuuaucucagaggcccugguggcuaugugaacccugccccucucugcaccucccccacagggaggcugugcugcccaagcuucaccuggaugaggacuacccaugcucacucgugggcaacuggaacacgugguauggggagcaggaccaggcagguaaggcgcucaccucccuagugccauugccacugcccagcccuggccuccagcaccuuucacaccuggcuguucuccacucccucuccacaacagcaccugguggggcucuuacuaaaaccucaucaccucacuccccugcucaaauaccuguccuggcuccccugugcccucaaggugacccgugaagccugugacuccuucccggcccugcccccagccucauggcaccaaauccuccaugccucgcugugcugucccacccaggacucaguuccucagauugacaguuucacucuuuaguuccagacuacugcucauucucuuucuucugccuuaagcauuauuucuuguuugccugcuuuaccuggaucacugucuuuuauucuuuuuuuuuccgagacugaguuucacucuuguugccccaggcuggagugcaguagugcaaucucggcucacugcaaccuccgccuccccaguuuaagcaauucucuugucucagccuccugaguagcugggauuacaggcaugugccaccacgcccagcuaauuuuguauuuuuaguagagacgggauuucaccauguuggucaggcuggucuugaacuccugaucucaggugauccaccugccucagccucccaaagugcugggauuacaggugugagccaccgcacccggccuuuuuuuuuuuuuucuuuuuucuuuuuugagacagggucucgcucugucacccaggcuggcagauaguggcacagucuuggcugacugcaaccuccaccuccugaguugaagauauucuccugccucagcuucccgaguagcugggauuacuggccugugccaccaggccuggcuaauuuuguaucuuuaguagagaugggguuucacauguuggucaggcuggucucgaacuucugaccucaggugauccaccugccucggccucccaaagugcugggauuacaggagugagccaccacucccggccuuuuuuuuuuuuuuuuuuuuuuuugagacagggucuugcucugucacacaggcuggagugcaguggcauaaucuuggcucacucgagccucaauuucccaggcucaagcaguacucccaccucagcuuccugaguagcugggacuauaggugcgcuccaccaugcucggcuaauuuuuguguuuuuugguagagacgggguuucuccauguugcccaggcuggucuugaauuccugaacucaaaugauccuaccuccucggccucccaaagugcuaggauuguagacaugagccaccgugccuggccuuucaguuuuauucauuuuuaaauuuucauuuauuuauuuauuuuugaaaccaggucuuguuacccaguggggagugcaguggugugaucacagcucacacagccuuaaccuccugagcuuaagcaauccuccuaccucagccuccugaguagcugggaccacaggugcaugccacaaugcccaacuaauuuauuuuaaauuuuuuguagagacgggaucucccuauguuacccaggguggucucaaacucccgggcucaagcgauccuuccacuuuggccucccaaagugcugggaguacaggcaugagccacagugccuggacuauucacuuuucuauuuuggcauagaugucaccuccuccuggaaggcugccgagauuuccuccacgcgggcugggucaggcaccuuccuuagcucuccaggccucaguaauuaccuccucacgcccugaucauguaccccuauagcugccuguuuaguugucugucuccauauaugggugaauccccaauaugcagcacauauuuguggaauaaauaggaguucuucuugucugagcuggugucuuacagucccaggggcaccccuagcaugccccaucccagccuaauagacacaucaaaguuggcaccagcuauaagaacccacacaugaauuuggcugacucacagcaucucagccacucaaagggaccucaaauucagacccacacuguccaaaaugauagccacuaaccacauguaguuauuuauuuauuuauuuuuuugagauggagccucgcucuguacugucacccaggcugggguacaguggugcaaucuuggcucacugcaaccucugccuccuggguucaagugauucuccugccucagccuccugaguagcugagguuacaggcgugugccaccacacuuggcuaauuuuuguauuuuuaguagaaacaggguuucaccauguuggucaggcuggucuugaacuccugaccucaugauccucccgccugagccucccaaaguguugggauuacaggcaucagccacugcgccuggccuauuuauuuauuuuuuugagacagcgucucacucugguuucccaggcuggacugcaguggugcaaucacagcucacugcacccuugaccucccgggcucagaugauucucucaccucagccucccaaguagcuggaacuacaggugugcaccaccacagccagcuaauuuuuuauauuuuuaguagagacaggguuucgcuauguugcccaggcuggucuugaacuccuggacucaagcaauccgucagccuuggccuccuggacuacugagauuacaggugugagccacugcgcccuggccucacauguagcuauugaaauuuauauuaguuaaaauuacauaaaauuuaaaguucaagcugugugccaaggugcucaccuguaguccuagcuacuugggaggcugaguugggaggacugcuugagcccaggaguucgaggccgugauugaauaccaucacaccuaugaauagccacugcacuccagccugggcaacacagugaggacccugucucuaaaaaagaaaaaauucaggacugaauaugguggcuuaugcuuauaaucccagcagauuaggaggcugaggugggaggaacacuugaggccaggaguuugaaaccagccugggcaacauagugagacuuugcuucuauaaagaaaauacauauuaaaaaaaaaagaagaaaagauuuuaaaaagaaaaaauucaguuucuuagucauacuagcuacauuucaaaugcucacucauauacacacaggcucaugcagaaaguacuuuuggacaguacugguuuagagugucugcauagcacagccauaacagaugguccucuaaacuucccuugaacacuccuagccaugaagaguucacuuguaagccaaucuauuucauccuuugacagcccugauaaucgugucuuugaaaauaaucugugaccugcagauagauagguguaucuccuuaaucaauuauuugguuuccguaacagacauuaacauauuauuuauguuuuauuuuuauuauuuccauuuagaaacagggucucacuauauugcccaggcuggaguugaauuucugggcucgggcaauccuccugaguagcugggacuacaggcgugugccaucauaccuggcuagacacugauauguggcuaagggaauaagagaaaagcaaauugccuucaguuucagccacuacagcuuucccauuuuaagcuugacuugaucagcuccagcaguauuccuugaauucucuuaagcauuugcuaguugugaaaugaacucugagggaugggauccugacuuuuucuuuuuuuucuuuuucgagaccgagucucacucuguugcccaggcuggagugcaguggcgugaucucagcucacugcaaccucugccucccggauucaagcaaguucucuugccucaggcucccgaguagcugggacuacaaguaugaaccaccaugccuggcuaauuuuuguauuuuuaguagagauggaguuucaccaucuuggccaggcuggucucgaacuccugaccacaguugauccaccugccucggccucccaaagugcugggauuaaaggcgugagccacugccccuggccuuuuucuucuuuuuauuuuucuguuugggacagggucucgcucugucacccaguuuggagugcaguggcaugaucauaguucacuguaaccuugaacuccuaggcucaggcgauccucucaccucaacuucucgaguagcugggaccacagacaugcaccaccaugccugggcuaguuguuuuguuuuguuuguuuguuuguuuuguagagaugaggucuugcuauguugcccaggcugaucucagacuccugagcucaagugcuccucuccugccucagccucccagaguguugggauuacaggccugagccacugcgccuggcugauccugacuuuuuaaagcauacccuacauuuuuuguaccuugaaguucagucccucacauagucagcugaaucauguugagcuguacgcugggaguaggguucaagaaucuacauuuuaauaaacuuguaagaaccauugauccaucuccuauggagagcaccacaguuguuagacaauuccuucuucuuggcugggcgcgguggcucaugccuguaucccagcacuuugggaggcugaggcaggugcaucaccugaggucaggaguucaagaccagccuggcuaacaaggugaaacccugucucuacuaaaaauacaaaaauuagcugggcgugguggcaugcgccuguaaucccagcuacuugggaggcauaggcaggacagucucuuaaauccaggagguggauguugcagugagcugagaucacgccaccgcacuccagccugggugacagaaaaauaaagaaaauuccuuccucuugccaaugaugcuguccuuguaacuuuucuccguuaauccguuuuccacaggucauuccugguuuugguagauuucuauccauacaguacuuuugccauuuccuuugggaaaaagaccuuuaaaccauagggucaggccauuuugcagaugggaaaaucaaggcacagauggagucaaaaaacaggugaaggucaggcuggggauggggaugggaaguuacagagucugaguuucuagacugcuggcagccagcugcccuuagcucuagcuugccugugugauccccuggggaccuuccuccgcugaugggcccagccaugcucccaggauggcaaaacuguuccuuucuucuccuccacaauuaauuagguuucuuuguuacuaggaauuagauuaguuuccugggguggccagcauaccgcaaacuggguggcuuaaaauaacagagguuuauccugucacaguucuggaggcuggaagucacaaaucaagguguugacagggcuguccuuccuccuaaggccuuaggggagaacccuuccuugccucuuccaguuucuggggauugcuggaaacucuuaguguuccuuggcuuguagacuugucauucuaaucucugccucccucgucacaugcuguucucucugugugucucugucuucacauaguguucuccuguguccagaucucccacuucugauaaggacacuagucacuggacucagggcucaccuaguauaaucucaucuuaggucgauuauacccacagagaccuauuuccaaauaaggucacauucugagguucugggugggcauaaauuuugaggggacauuguucaacucagugcagauaauaugauuuuuauuuauuuuuauuuuuauuuauuuauuuuuugagacggagucuugcucuuuugcccaggcuggagugcaguggugcgaucucagcucaccacaaccuuugcaucccagguugaagcgauucucuugccucagccuccugaguagcuaggauuacagaugugcaucaccacgcccagcuaauuuuuguuuuaguagagaugggguuucgccaaguuggugaggcuggucucaaauuuccgacuucagaugauccaccugccucagccucccaaaguugauuauuuauuuacuugagacggagucucacccugccacccaggcuggaguacacuggcacaaucuugacucacugcaaccucuaccuccuggguucaagcgauucuccugccucagccucccgaguaacugggauuauaggcaugugccaccacacccaacuaauuuuuuuuuuuuuuuuuuaagauggagucucgcucuguuguccaggcuggagugcaguggcaugaucucggcucacugcaagcucugccuccuggguucaugccauucuccugcuucagccucccgaguagcugggacuauaggugcccgccaccacgccuggcuaauuuuuuguauuuuuaguagagacgggguuucacuguguuagccaggauggucucgaucuccugaccucgugauccaccuuccucagccucccaaagugcugggauuacaggcgugagccaccgugcccggcccaggauuuuuauaaauucuaacaguacaaagaguuuuccaugcaaaguaagcuucccuccugcccgaggccccacaggccuccauucugugucccaggggcaucuacugucaaucucuuuuuuuuugagacggaguuucgcucuuguugcccagguuggagugcgauggcacaaucuuggcucaccgccaccucugccucccagguucaagugauucuccugccucagccucccaaguagcugggauuacaggcaugcgccaccacaccuggcuaauuuuguauuuuuaguagagaugggguuuuuccauguuggucaggcuggucuccacccaccucagccccgcaaaaugcugggauuacaggugugagccacugcgccuggucuacugucaaucucuuaagucgccauuaagaggugaugcauaaauuagcaucucuggauguccuugccaccucaacacaugagguagcauaccacacauccucuucuguuccuugguuccuuuuuucaauucacugucuuggaauguuccauaucagcccaucaguucuccccuguucuuuuguucagcugccccucuaaggccugguggucuuccuuaugcaugccacugcuuccaggguacaggacacaucugaucuucuuguugcuauuuaaggaagguggggugggaacauuauucccauuuucaagaugagaacauugaggccuagagcaguccaaggcugcugggcagagcuggagcucaaauccaggucuccuagacuugugucuagggucauccccuccccagcauggucuuccaccaaggcagagggaacucagggagucuugcugcuacagggaaccaggccaccccgccucccccguccccaccacuuagccaaccuugaggaggucaucugcugggggucccagcagcucacugaccuauaccucucacccccaacagugcaccuguggcgauucucagguggcuacccagcccucauggacugcaugaacaagcucaaaaacaauaagguauguuaguguccacucagcacaccucucuggaugugggaugcagcccagcccuguucuggggacuacucugcuaccccaugaggcacacugucaggauggagcgcacuuccugguagccaugccuuuaccaccaugcccacaggaguaccuggaguuccgaagggagcggagccagaugcugcuguccaggagaaaccagcugcuccucgaguucagcuucuggaaugagccacagcccagaaugggucccaacaucuaugagcugaggacauacaagcucaaggugccucccuccgacagacccccuccugccccccaauuucccugcugcaaugcugcuuugcagcugccccaacaccuagacuggggcuucuggcuucucccucccuaugggcucagagcagaguuguauacacaugugugcaaacaugcacaccaggugugugucagggccugcgaaugaggccaaauggccgcugcagcuugggagguggggagacagggcaguuucccuuccuugccaagcugugaugcuaugaaucugaggugggggcucauucccaucaucccuuugguucucuuucagccaggaaccaugaucgagugggggaacaacugguaaguggcagcaccaagacugggguugggggaggcguacccugcucaccugccccaccaaggccccuggugggccaccuuuuccagggccauaucacagggaacucuuuaccuucugccccucauggaucugggagaaggauccagccaggaggugaggaucuccuagaagguugugaccccuccguugguagaacaccccgccaucaguccuuucucucagcaucccggaggaccguggguuccaccuaggccccuccugugaaguguggccaaggaaucagccucaguacccucugcaccagcccuggcuucugccccauauuauugugccuucuccagggcucgggccaucaaguaccggcaggagaaccaggaggcagugggcggcuucuucucacagauaggagagcucuacguggugcaccaucucugggguagguugaggaccuuccaggagccuuuuguuaguucucuuucucugucaucacucucuguagccaaugggguuguauuaguguccucauagaacuuaauguucuagcaggagacacuaucuuagauguaaagucacaaaaagaucaauuucagauuacaaauaauauuuauagaaaauaggcaaggagucugggagcgguggcucaaguguauaaucacgacacuuugggaggccgaggugggcaaaucacaaggucaagagaucgagaccauccuggccaauauggugaaaccccaucucuacuaaaaauacaaaaauuagcugggcgugguggcgcaugccuguagucccagauacucgggaggaugaggcaggagaaucaguugaacccgggagguggagguugcagugagcugagaucacgccauugcacuccagccuggcaacagagcgagacuccgucucaaaaaaaaagaagaaaaaaaaaaaaggcagggagagaugauggugaaaaacauaggggaucuacauuggucuagguagacaaauaaugccucucugaggaaguaaaauguaagcugagagcuaaaggaugagaaggagccagcugugaauugcuaggcaaaagcauuccaaguagacagagcagcacaugcaaaggcccugugguggggaaaggccuucgggguuuugagguguggcaaggaggccaguguggagugaguagggaagaauguggggagauggaacaggagagggggaaugaguugggauuuauuguaaaugcaaugagagacuauuuguuucaaauagcagugacacgaccugauuuuuguucuaguaugauuucucuggcugcugucugcuuuguuaagagugcuugguaggcgagcaagagagaaagcagggcuucaggaagccauuacucuaguucaggcaggaggggauggggcagugggaugcugagaaguccacagaagauuuguuagucuagagguggaaccaacaggacuuguggaugaauugucuguguggggcaagagaaggagaagggcauuccagaagagcucccaggcucgugcuugagcugcugugugucaucuccugagucugggaggucuagggaaggagcaagucaguggggucaggagcguaauuuuggcccuuggaauuguuacuuuuuuuuuuuuucuuugagacacagucuugcucugucaccuaggcuggagugcaguagugugaucucagcucacugcaaccuccgcuucccaaguucaagugauucucgugccucacgcuccugaguagcugggauuacaggcaugcaguaccaugcccaacuaauuuuucuauuuuuaguacagaguuucgcuauguuggccagacuggccucgaacuccuggccucaagcaguccaccagccucggccucccaaagugcugggauuauaggcaugagccaccgcaccuagccggaaguguuaacacuaaaaaugcugacacaccaaaguagagaugucaaguaggcaguagauggauauaggagucuggagcccuugggaguguuugcgacuagaaauauaaauguaggcaauauuaacauauguacugauuggauggaugauuaaagcagacaguguuugcuaauagucugagggaggcaucuagggaggaggagacagcagugcaggguuuaggggacagugggaagagggcccugugcuggguaagggauccaguccucugugccugaggaaugagccugugccuuucucacagccuauaaagaccugcagucucgggaggagacucgaaacgcugccuggaggaagagaggcugggaugaaaaugucuacuauacaggugagugaagccuuuggaggucuucugcugagaacccugucugaggauggaauccucucugcaaggagaucuagucuuucuugauuaccuccagugauggggaacucacuuuuaagacaaugaguuaauggguuucuauccaaguggcacacuccauaggauaccagcaggccuaggugaguacucuaggggaugauaacauagccagggccacgccucugccuaggagauguggauuagcaaacgcccauugugaccuugggcacgguucuuuaccucgcugaggcuguucccucgucuguaagauagugauggugauagugcuucugucagagggcuauaacggaagauucuacaaacuauuuuauuauuuuauauuuuauuuuauuuuauuuauuuuugagacacagucucacucugucacccaggguggagugcaguggcaugaucuuggcucacuguagccuccgccucccagguucaagccauucuccugccucagccucccgaguagcugggauuacaggcgugugucaccauguccagcuaauuuuguauuuuuaguagagacgggguuuuaucauguuggccaagcuggucucgaacuccugaccucaggugauccgccugccucggccucccaaagugcugugauuacaggcaugagccaccacaucuggcccacaaacucauuuaugaaaagugcuuucuccagugucugucacaaaggaagcaugcaggaaauguuuuugaauaagguuuuuguuuuuguagagaugcagucuuacuaugucacccaggcaggucucaaacuccugggcucaagcaguccucccaccucagccuuccaaagugcugggaucauaggcaugagcuacugugcccagccuugaacaaguuuuuugcucaagguguuugccacuuugcuaggaaccugaaaccaccuagagucaguggguguuaauuaagcccucacugugugccgggaacugugguagguaggugguugaggggcacauaaaugaacaagagccuguccuugccauugagaaguuuacagugaucacuuaccaggugguaugagggagaaugugucugcugaaggaguuagcaggagccuugcuauucaguguggucccagcuggguaugguggcucacaacugaaauccuaguacuuugggaggccaaggcaagaggaucacuugaggucaguaguuuaagaccagccugggcaacauagggagaccccaucucuacaaaacauuuuuuaaaaauuagcaggacgugguguuucccaucuguagucccagcuacuuggaaggcugaggugggaggaucacuugaucccaggaguuugaggcugcagggagccaugauugugccauugcacuccagccugggcaacagugagacccuaucucaaaaauaaaaaauaaaaauaauaaaaaacaagacaagcacaguggcuuacaccuguaaucccagcacuaugaaguugagguauguggaucaauugaggccaggaguuggagaccagucucggcaacauggugaaaccucgucucuacuaaaaauaaaaaaaauuagccaggcaugguaacucaagccuguaaucccagcuacucgggaggcugaggcacaagaaucacuugaacccaggaggcggagguugcauugagccgagaaccugccacugcacuccagccuggaagacagagugagacccugucucaaaaaaaacaaaaaacaaaaaaaaucaaguguggucccaacugacaguauuggcauccccugggagcuuguuaagaaugacaaaucucggcugggcgcaguggcucacgccugucaucccagcacuuugggaggcugaggugggcagaucaccugaggucaggaguucaagaccagccugaccaacauggagaaacccugucucuacuaaaaauacaaaauuagccaggcauaguggcacaugccuguaaucccagcuacucgggaggcugaggcaggagaaucgcuugaaaccggaaggcagagguugcagugagccgagauagugccauugcacuccagccugggcaacaagagugaaauuccaucucaaacaaagaaacaaacaagaauaacaaaucgcaggcuuccugcaaccuaccaaaucagaaucugcacauuaacaagaacugccaagugauuuguaugcacauuaaaguuugaaaagcucugagcuggaggaaagagucuaaccuccuggaugaccuggagcugaccuucucuaggcugcacccucucuaucuguaaaacgaggcaguuggucuaaaucaguguuuuucuuuucuuuuuuuuugagacggaguuuugcucuuguugcccaggcuggagugcaauggccugaucucggcucacagcaaccucugacucccggguucaagcgauucuccugccucagccucccgaguagcuaggauuacaagcaugugccacuacgcccggcuaauuuuguauuuuuaguagagagaggguuucuccauguuggucaggcuagucucgaacuccugaccucaggugauccgccugucuuggccucucuaagugcugggauuauaggcacaagccaccaugccuggccaacagauaacuauuaaaauuuaagaaaauguuauucucaucaccaccaaaguccugucuuaucccauaauuugagggaucuggugcucuucaugggcccuuccacgagggcaaugggacauuccugucgcagcaucuggggccuccuccugcccacucaaaggccagcauguguggguggggccaggggagguuguuggcuugcuugagcccccugugugaccucugccuucucucuccgcagucccccuggugcgacacauggagucuaggaucaugauccccuugaagaucucgccucugcagugaugcugccuacaccuccaccuccuuccccuucucccucaggcaaccccgacagacaguggcacuccugguccugcugucuugguuuugucuuggcucugggaggacucugaggggcagugcucaguucagacaagggggaacugaaggcugacaaguucugaggauuacagcucugcccaggcccuuucuacuuucccugccugccucccucccccugcuagaaguaguuucugauuucccugaaugaaagauagugaucuuuuaggccuucauuuaucuucuaaaauuccucaucucaaggccaccaguccccaguuaucacccuuggaaauccucuguuuagcuuaguugcacaaaagguaguauguccaguggcuagagguggggugggaagagaggaggccaggccaggcccucaggaauucccugguuuccacugggccacccacuugcuggacagucugagccaagucccuccugcuggagaaaagccuggaacugccaaaacaaaaaaacaaauacaaacaaaccucgucaccacggucaggaggagguucagacauucugcccagaggggcuggggaaagggaugggagccaggaaagauuuaggggcaggagacagacacguaacaggaacucggaagguagaacuuagaauucagaacuuggguuucaauuguagaauuuggaaucuggaauacagaauugggaagaagaacagagaugacaaaagaccacuugaagagagguuccuaauacuagacagauggagaguggcuuggcuguuucccccugcauauugggguugaaaacuuaaauguguaguuccaguccuucuaugcagagucucuccugcccucccuccuuccugcaggcaaauauacaagcuagacccuguucccucacccuguauccugucuccccuaauugacauucuaucagcccaacccucauucugcagggccaccugguguguggagguggcgggaggggucagugacucugggggucuccucagugacccccauaccucaucaugaacccuuggguagcuugauucugccuaccauccaggaaaacuugugcuggaauugcugauggaaacaauuaaauauuuacuauaa

SEQ ID NO: 192209 - RNA, 45581 nt, Homo sapiens
cucuauggugcgcgggcaagcuuugcuccgccuccggcaguggcuuacucccggugccagguucuuggagcugugaggugaggaggggacaagggcaguggggcugggagauggggcggggcugggcgcuccgggacugaggugcugaucgcccaaagggcgccccugggcuggggucugacccggcuucuccucccucacuacccgcgguccccggccucucggcgcugcgcuguuaccucauccgaaaaguguucgcugcagcauccucaggcuucacguuggagccucuugauugugguaauguagccugaugggggugggggugguggugaugguaacagcucacauauaucgugcucuucggugugccaggcacucuacuguguugccaaagucaggauuucccacacuuaagccuuucagguccggucuuuguaggcuuugccagaucaacuuaccaccucuacuaccguuuauuaaaaauuuguuuguuuguuuguuuuaguauuuauugauaauucuuggguguuucucgcagaggggauuuggcagggucauaggacaauaguggagggaaggucagcagauaaacaagugaacaaaggucucugguuuuccuaggcagaggacccugcagccuuccgcaguguuugugucccuggguacuugagauuagggaguggugaugacucuuaaggagcaugcugccuucaagcuucuguuuaacaaagcacaucuugccccgcccuuaauccauuuaacccugaguggacacagcacauguuucagagagcacgggguuggggguaaggcuauagaccaacagcaucccaaggcagaagaauuucucucaguacagaacaaaauggagucucccuuguccaccucucuccacacagacacagcaacaauccgauuucucuaucuuuuccccacauuuccccccucucuacuagacaaaaccgccaucgucaucauggcccguucucaaugagcuguuggguacaccucccagacgggguggcggccaggcagaggggcuccucaccucccagaaggggcggccgggcagaggcgccccccaccucccggacgggguggcggccaggcggaggcgccccccuacccccgacccgacggggcggcuggccgggcuggggcuggcccccaccucccccccggacggggcggcuggccgggcgggggcugccccccaccucccggacggggcggcugcuggguggaggggcuccucaccucucagacggggcagccgggcagagacgcuccucaccucccagacggggucgcagccgggcagaggugcuccucacaucccagacggggcggcggggcagaggugcuccccacaucugagaugaugggcggccgggcagagacacuccucacuuccuagacgggaugggguccgggaagaggugcuccucacuucccagacugggcagccgggcagaggggcuccucacaucccagaugaugggcagccgggcagagacgcuccucacuucccagacgggguggcggccgggcagaggcugcaaucuuggcacuuugggaggccaaggcaggcggcugggagguggagguuguagcgagccgagaucacgccacugcacuccagccugggcaccauugagcacugagugaacgagacuccgucugcaauccuggcaccucgggaggccgaggcuggccgaucacucgcggucaggagcuggagaccagccuggccaacacagcgaaaccccgucuccaccaaaaaauacgaaaaccagucaggcguggcggcgcgcgccugcaauugcaggcacucggcaggcugaggcaggagaaucaggcagagagguuccagugagccgagauggccgcaguacaguccagcuucggcucggcaucagagggagaccguggagagagggggaggggggagggggagggguuuacuaaaaauuuuuaauccaguccaaauuuuuuuuuugcaacgggaucucuguugucaagacugagugcaguggcgcgaucauagcucacugcagccuggaacuucugggcucaagccauccucccacccuagccuccagaguagcuugggaccacaggugugcaccgccauacuaggcuaauuuuaaaauguuuucuaaagauggggucucgcucuguugcccacucuggucuugaacgccugggcucaagcgauucucucaccucugcuugccuugguuucccaaaguguugggauuacaggugugagccaugguguugggcccagucacuuuuuuuguuguuguugagacugaaucucgcucuguugcccaggcuggagugaaguggcugcgaucucggcucauugcaaccucugcucccuggguucaagugauucuccuaccucagccuccugaguagcugagauuacaggcgcccgccuccacucccggcuaauuuuuguauuugugguacugacgggguuucaccauguuggccaggcuggucucaaacuccugaccucaggugauccacccgccucagccucccaaagugcugggauuacaggccugagccacugcgcccagccaagucacuuuuuaaacucaaauuuacuuugagagaaaacuugaaaucucuccaccagaaauggaaagcugcuuucacuuguuuuauguagaagguaaaaauuaauauaguuaauauaaugcaacuagaucauuguuaacaaacucuggcuagauuuuguuguuuaaggcugugggauagaguucuuuuguuacaaaggaacauuggcauucauagauguuaaagacaaacuagggaacugagauguucuccuugaagcaaucagaaguuucaaaauaagaauugaaaagggauuaacuuucuccuuagguguucagcauuauuuaagaucaccuaugcaucaucugaagccacagucccaggucaucuucaucaccuuccccaguggaaugccuccuguguuaaagcccacaacaaccccugugguagggacuguuauucucauuugauuugugaggaaucagacccagagaaaagugaagugacucguccggggacucauagccaugaaagaguagaauggagauuccaguucagggcucucugacuuuuaccgugacaaacuauuggcucccucaagucggggauguggaagcuucagugagugaugauugugccacugcacuccagcuugggugacagagcaagagggauuaggguaaaggggacagugcugcccaccucaggaggcuguggugaggcaacaagggaggaugcuuugugacuguagagccccaugaaauguagguucuauacuuuaaauucuaggaucaaccugggagucaauggcaucacuagaugagaggcuggcaggacuaggaggcauaaaaguguaguuaagagcaccaguauggcauugauuggauagauccggauuuuggccuacuagucaugugacucgcaauuacuugcaaguaauuccccuugcgagccucaguuuugucaucugugaaauggugguaguucuuagcugaaaaguuuguuauaaggagcaaaugagaacauacccauaaaguaguuagaucaaggcccagcacacagugaucacaguaguauugggagugucuuuaaaugccagaccgaggaguuuggauacuaauuuauggagcacucugccaggcucagggggaagaggguagagcucacaaucuaggugggaagacagguaaaugauucauagagauaaauucccuaauaguguacccaaaguagccaaaagagggcuuuggggagaccugacaggcuuccuagagcagaugagcauugcuuagucuugaaggauauagggaggaaaaggaagaucuuugcaagcaggggaaaagacauggaguguuuggggaacugggauugcagggugcaguugcagcuaggagcagagguuggggacagugggaaggucgguaggaauaggaaugcaagaaaugaaguugggaagguagguuggggacaaaccaucaagggucuuuaugacaagucagggaauauggauauucagugcauuaugaagagccagcaaagguuuugaaacaggagaggcauuaauuaggucggucuuuuuuaagaaagagaauuuagacaguauuguugggcaagacuguuagaguaguccuggagaggaauguggagggccuggccuaggguguugagauggagacacacauggugccuggauagcugggugaacacuugaaugcaggucuccucuauggagaguguggagcaggauguggguggaggcagggcagggagagguugaaguagaugauuccgaggucagugggaguggguggugaugccuuuuuaaaagagaagguggaguuuguuuuggacaggcugagagaugcuucccuguuguauuacagaggguuaaauugaggcuuugagggguuaaaugacuuuccuugaguuaccaagucuguaaguggccagaacugcuaguuugacuucaguguuaugacuccagaagaaucucaaaaacuuucuccucuuaacaggaggaacaaccaugucaucagaaucgagcaaaaaacggaagcccaaagugauccgaagcgauggagccccagcugaaggaaagcggaaucgaucugacaccgagcaggugagaucagucaggguugccaugcugcugagaaauuacaucucauggccaagcaccuggcuguguguuugcagcagcucggggucgcaucuaccagguacaacuuuuugguggcuuccacuugaccaggugacugggauuccuguuucuucacuaaagcugaguguccacaucugguuuagcugcagcaucuccaaaaccaacaagccuguauuagacaugauuauaccuacccagagaauguauuccaguaugauaugugucuccaguuuuccugauggucagaagaagguaguccaucugcagcauggcacuggagcuucaggaaucccucggugugcugcugagacaauaccagaaccaugugcccacagaaccucuuuuguggccugagagcucauguggucgucagguucuuuucuucuuuuugucuguuucucuguccuugaaucugucaacuucauuugugacuuagcuauuuaaaaaaaauuuuuuuugagacagggucucacugugucgcucacgucggaguacaguggcacgauuucugcucacugcagacugcauuuccugggcucaagcgauccucccaccucagucucccaaguagcugggaccacagcugcacgccaccaugcccagcuaauuuuguauuuuuuguagauaugagguuuugccacguuacccagguuggucucaaacuccugagcuuaagugaucuaccugccuuggccucccaagguauugggauuauaggugugagccaccccgcacccagcuggaauuccucucuauaggagacugucaugcagccauuuugauugagaucuguauuuacugggauggucauaugguuuggccguguccccacccaaaucucaacuugaauuguaucucccagaauugccauguguugugggagggaccuacgaggagguaauugaaucaugggggccggucuuucccaugcuguucuuauuauagugaauaagccucaugagaucugaugcgcucaucagggguuucugcuuuugcuuccuccucauuuuucuuuugcugccgccauguaaaaagugccuuucaccuccugccauguuccugaggccucaccagccauguggaacuguuaaguccaauuaaaccucuuuuuguucccaauuucagguaugucuuuaucagcagcgugaaaauaaacuaauccaguaaauucauaccaguagaguggggguuugcugaaaagauaccugaaaauguggaagcgacuuuggcacuggguaacaggcagagguuggaacaguuuggagggcuuggaagaagacaggaaaaugugggaaaguuuggaaccuccuagagacuuguugaauggcuuugacaaaaaugcugauaaugggccggacaugguggcucacgccuguaaucccagcacuuugggagucugaggcagguggaucacgaggucaggaguuaaagaccagccuggcuaagauggugaaacccugucucuacuaaacauacgaacaaauuagccaggcgugguggcgguagccuguaaucccagcuacucgggaggcugaggcagagaauugcuugaacccaggaggcagagguugcagugagccaagaucaugccacugcacuccagccugggugacagagugagacuccaucucaaagaaaaaaaaaaaaguugauaaugauaugaacaauaagguccagccugagguggucucagauggagaugaggaacuuauuggaaacugcagcaaaggugacucuuguguuuuagcaaagagacugaaaacauuugccccugccuuagagauuuguggaacuuugaacuugagagagaggauuuaggguaucugguggaggaaauuucuaaguagcaaaccauucaaaaggugacagggccaugugcaguggcucacgccuauaauccuagcacuuugggaggccgaggcaggugaaccacuugaggucaggaguuugagaccagccuggccaacauggcaaaacccuaucucuacuaaaaauacaauaaaaauuagccagacaugguggugggccccuguaaucccagcuacuugggaggcugaggcaggagaaucgcuugaacccgggaggcagaaguugcagugagcugagauugcgccauugcacuccagccugagcaacaagagcaagaccuugucucaaaaaaaaaaaaaagaagugacuuggguacuguuaaaagcauuccauuuuaaaaggaaaacagagcauaaaaguuuggaaaauuuguagccugaugacacaguagaaaagaaaaacccggcugggcacgguggcucacgcuuguaaucccagcacuuugggaggccgagcuggguggaucacuugaggucagaaguucgagaccagccugggcaacauggugaaaccccaucucuacuaaaaauacagaaauuagccgggccugguggcaggugccuguaaucccagcuacccacuguaaucuccaagccugaggcaggagaauugccugaaccugggaggcagagguugcagugaacugagaucaugccacugcacuccagccugggcgacaagaccgagacucugucucaaaaaauaaaaauaaaaaauaaaaaaaggaaagaaaaacccauuuuuugcggagaaauucaaguugguugcagaaauuugcauaaguagcaaggagccuaauguuaauccccgugggggauuaacaccauggggaaagcgucuccaggccaugucagagaccucacggcagccccuucccucacaggcccagaggcccaggaggaaaaagugguuuucugggccaggcccagggucccugugcuauaugcagccuagggacuuggugcccugugucccagccaguccaggcauggcugaaaggggccaaucuagagcuuggccuguggcucagaggguggaagccccaagcuuuggcagcuuccaagugguguuaagccugugggugcacagaagucaagaauugagguuugggaaccuccgccuggauuucagaagauguacggaaacaccuggaugcccaggcaaaaguuugcugcuggcgcgcucauggagaaccccugcuagggcaguguggaagggaaauguggggucagagcccccacacagucccuacugaggcacugccuaguagagcugugagaagagggccaccgucccuucagacccuagaaugguagauccacgaacggcuugcaccaugcaccugaaaaagcugcagacacucaaugccagcccaugaaagcagccaggagggagggagacuguacccugcaaagccacagggguggagcugcccaagaccaugggaagccaccuuuugcaucagcuugaccuggaugugagaccuggagucaaaggagauaauuuuggagcuuuaaaauuucacugcccuacuggauuuuggucuugcaugggcccuguaacgccuuuguuuuggccaauuucucccauuuggaauggcuauauuuacccccacuguaucuacgaaguaacuagcuugcuuuugauuuuacaggcucauaggcggaaggggcuugccuugucucagaugagauuuuggacuauggacuuuuggguuaaugcugaaaugaguuaagacuuugggcgacuguugggaaggcaugauugguuuugaaaugugaggacaugagauucggaggggccaggggcggaaugauaugguuugggauuuaaaucucaacuugaauuguauuucccagaauugccacauguugugggagggacccagagggagguaauugcaucaugggggccagucuuucccgugcuauucucaugauagugaauaagucucacgacaucugauggguuuauaagggguuucugcuuuugcuuccuccucauuuuucucuugccgccgccacauaagaagugccuuucaccucucgccaugauucugaggccuccccagcuaugugggacuguaaguccaauuaaaccucuuuuuguucccaguuucaggugugucuuuauuggcagcgugaaaauggacuaaugcagaugggaaguugcacuuaacagcacggacaguaugaucccguuuuguuuacaaauaaaauguuuauuuauccacaaucuucacucaguuucggacugagaggcgaaauuauaggcaauuuuuccauuuucuuuuugauacuccucuguauauucugaaucuuugauaccaggcaugcauuacucugcaaucagaaagcaaaagagguuucuauuuugaagagaagaaaagcauuuaauuuaaggaccagaucuuuuagagaccugacugaggcuucauuguuacuguuuuuaucuaaaaggagaugucagccaagugucccugaucccagcagggagacuuuuaccccaugcacacagagccuuuauccuuaccucuacaggaagguaaauacuacagugaggaggccgagguggaucugcgggacccuggcagagacuaugaguuauacaaguacaccugccaggagcuacagaggcugauggcugagauccaagaccugaagagcagggguggcaaggaugugguaaggagugggaccagguggccgugaaccugguggguuuacauagaugaggcuguuuuugcaccuaccagggcccuuccugaucuugaucuucuguccuagccaugaucaggugauuggagccugagggcucccaaaaccugugaauuuauuggaacuucuuaucaccauucagucaccaauuacaggaaugaaaguacaggauaauuaauuuuuucccuacuaauuugaucauucauccaauuaauauuuauuaagugccaggcauuuugcuagguguugagaaaugaugguacuuauacauuugcuugauacaaagauggauguguacaaguaaauuguagauaccaaaaaugaaauuaucauuaauaguaaaugaauaaaugagguuuuaggggcagagaaauuaaacaaugugacuaaaaacucgauagauaaguuuuuuaaaauccauuuuuucccccaggaaucucacguauuugugcuuaugcugacaaguuuuguuagaauuauugcauucaaucuauucuagccaagcuuuauggcuauaauucuguuauuuuccauuuaaguuauccuguaauguuauuuauagaggucaaauuuuaugacaagauguuacuauugcugggaucucuguguaggaucuguagagauagauugugccuuugcugcccuuauuccaucuucaauuccuguuacucuaguccaagcagaaauuacuuuuuuuugcccgagauucuuaaucauuuuccuuauacaaucauccucuuauuuucuucaugacccuucucaugguucugagcucccuccggugccguuuuuggccccagaugaggaugggucaguggugaaggacugaaggaagcugagcuagcccugucgucagugggcuuuacuguuuucuuugcccacaggcaauagaaauagaagaacggaggauccagagcugugugcauuucaugacucuaaagaagcuuaaccgauuagcccacaucagguugaagaaaggaagagaucagacccacgagguaguaguuaaaagguuuaauuuuaaccuuccuccuuccuccuccccauccccuucuuuuuuuuuuuuuuuuuuuuuuuuugagacagagucucguucugucccccaggcuagagugcaguggcacgaucucagcucaccacauccucugccucccagcuucaagcgauucuccugccucagccuccuaaguagcugggauuacaggcaccucccaccaccaugccuggcuaauuuuuguauuuuuuaguagagaugggguuucaccuuguuggccaggcuugucuugaacuccugagcucaggugauccacucgccucggccucccaaagugcugggauuacaggcgugagccacugcacccagccccauccccuucuuuauucccuuuacaccuucucuuaguuugcugacccucuccucugcuccauccugacuugcccugcucacuucugaucguauuuuccuuucaggcuaagcagaaaguagaugccuaucaucugcagcuccagaaccuguuguaugaggugaugcaccuacagaaggagaucaccaaauguuuggaguuuaagugaguuugggaggacagggcuuuggcacauguggucuuucgguaacugcuuuuucccauguagcucacuguaagucuguuucuuuuuuuuuuuugagacggagucuugcccugucacccaggcuggagugcaguggcgcaaucucagcucacugcaaccuccaccucccggguucaagcaauucuccugccucagccuucugaguagcugggauugcaggcgcccaccuccacauccagcuaauuuuuguauuuuuaguagagacgggguuuugccauguuggccaggcuguucucgaacuccugaccucaggugguccucccgccucggccucccaaagugcugggauuacaggcgugagccaccgcucccagccuaagucucucuuuaaaaagaaaucugaugagcuuagaaaacuguaggaucugggagaagggcaaauugcaagggugaaugugggagaauugcaagccgugauuucaggcugcauaaagaaccucagaagucucucugaccuuuuugaguuuugagcucugcacuugguaaaaagcaggucucucucccuaucaggggucuuuacauuaccaguuugauuucugggcauguuguaugggagcaacucacuuccagucacauucuuuuaaccuuuuggcccaguuuuccuuucuguagucccagcaguucauuucugcaaauggauuuuauucuuuggaaccugaauuucuugcugcuuagcugccuucaggugaagaaacuacaguuugucaguguccuuccucaaaaccaagcugagagaugagaaggaggaaggaguaaacgggaagagaaggggaaguguucucacuugaucagaccuguuuaugcaaacugaaagcagcuuuuaucuguaacaaacuugacauaugcaggggcccuauuagacauuggguccaggauauauauauauauauauauauauauauauuuuuuuuuuuuuuuuuuuuuuuuuuuuuuuuuggagauggagucuugcucugucgcccaggcuggagugcaguggcgugaucucggcucacugcaagcuccgccucccggguucacgccauucuccugccucagccucccgaguagcugggacuacaggcgcuugccaccacgcccggcuaauauuucguguuuuuaguagagacaggguuucaccguguuagccaggauggucucgaucuccugaucuuaugauccgccugccucagccucccaaagugcugggauuacaggcgugagccaccacacccgguggguccggaauauuuuuaauaaucaugauacugauugauuguuuuguuuuuugucuuuuuuuuuuuuuuuuuuugagacagggucucacuccugucacccaggcuggugugguggcacaauccuggcucacugcagccuugacuugacuuggcucagaugauccucccauuucagccuccugaguagcugggacuauuggcaugcaccaccaugccuggcuaauuuuuuguauuuuuaguagugauaggguuuugccaugcugggcuagucucaaacuccugguugcaaaugauccaccugccuuggccucccaaaaggguaagauuaaagguguaagccaccaagccuggccugaugcugauuuuuuucuuuucuuuucuuuucuuuuuuuuuuaaagauaaagucucgcucuguugcccaggcuggagugugguggcgugaucuuggcucauugcaaccucugccuccuggguucaagcgauugcaugcaugagccaccacacccagcuaauuuucguauuuuuaguaaagacaggguuucaccauguuggccaggcuggucucaaacuccugacuucagaugaugcacccauuucgaccucccaaagugcuagaauuacaggcaugagccacugugcccagcccugaugcugauuuuugagaggcaucuuuaucuguuccacaaaaucgucacauaacaauaguuaaauaugaauagaggugaaaucugcaucaggucuguacuugaguuaauaauauuguaccagugucaguuccugguuuugacaauguauaaugugguuagauaagauaguaucauugggugaaggguacauggaggaaauacauucuaaguauuauuuuugaaacuucuuggagucuuaaacuauuuccaaauuaaaaagguaucaaaaacaaaauaaugugaugcacuggucuguaaucaucacccaaauggaaacugacaaacccagaauacaguggaacuugcgccuguugggaggcagacggccacauggaaggagcauaggccuugaaguuacacagccuggguucaaaucccagcuuggccacucccuagcuguggaccuugggcaagcugcuuacugauagaagccuccaucucagucaaaaaauggagauuaaaacuccccaccucuuagaguuguugugaggcuuaaaugaggugaggaugacauauagugggugcuuauuaauauaugauagcugccguuaucauuacugucaucugaccauaaccugagcagucaacuauguuaauacagcaaagaggguuggauuuuuuugagauggagucucgcucugucucccaggcuggagugcaauggcgcaauccuggcucaccgcaaccucugccuccuggguucgagcgauucuccugccucagccuccuaaguagcugggauuacaggcaugcgucaccacgcccagcuaauuuuuaguagagacgggguuucaccuuguugaucaggcuggucucgaacuccugaccucagguaauccaccugccuuggccucccaaggugcugggauuacaggggugagccaccgcgccuggcagaauuucuuuucuuuuauacauauaaaucacuaugcaugcaacgguuuaagccucuagaucuuuuuccauccaguucucccaugcuggaucuuccucauucuguucuuacgcggcuaaugucuugaacuuaagugcagacccuuguauuuauuccuguuaaauuaugucuugcuuucaacccuacagccuaggcccaggcuguaguguuuuuacuugacuuuuuagcuaguaguucuccugcucagcuuggagacauuuguaaauuugauaagaaucccuuccgagucuuuaauucauggguaaaaagguuggacagcauggauaaggauccuauggcaugucaccaacuaccuuucuucacacugaaauaucugcuaaugagcauuuguggagaagacuggauuccaggauccuguagaccaggacuaagcaggcauauguuggggauaacuuugggccugcuuaaacuacaguuuaguuuccugagaacagcagcuugaugucauguuuuugucuguaggucaaagcaugaagaaauugaucuggucaguuuagaggaguuuuauaaggaggcuccaccagauaucagcaaggccgaagucaccaugggagacccucaccagcaaacacuggcacgucuggacugggagcuggagcagcggaaaagguagcauuuccuccuuccugaccuuuuaaccacaaagugucagugcuuugucaugacccaggauaaggcagcaaaacacugugcaacucucagaauaguuucuaagaccaaaucccauuuuaugauuaaaucacacuggauaguuuaaacuucaccaaccucaucauggaugggguugggguuauaauugcuuaaggguuuuuuuuuuuuuuuuuuuuuugagauggagucucacucugucucccaggcuggagugcgguggugugaucucaguucacugcaaccucugccucccagguucaagugauucucaguccucagccucccgaguagcugggugguaggugugcaccaccacgcccaucuauuauuuguauuuuuuguagagaugggguuucaccauguuggcuaggcugaucucaaacuccugaccucaagugaucugccugccuuggcuucccaaagugcugggauuacagacgugagccacugugccuggcccuuuuuuuuuuuuuuuuuuuuuuuuuuccaaagagauggcguuucacucuauugcucaggauggagugcuguggcacuaucacgacucacuucagccuugaccuccugggcucaagcgauccuucugccucagccucccaaguagccaggacuaugggugccugccaccaugccuggcuaauauuuuuauuuuuguagagcaggguucucacucuguuacccaggcuggucuugaauuccuggcuucaagugauccucccaccuuggccucccaaagugcugggauuacaggugugaguuaccaugccuggucucuccuugaaauuuuaaugccgaagaccuuaucuuuuguaccauaaaucuaauuuuguauuugccuuuccccuuaucuguaaguguaugccuauggcagaaagcuuuguaaacacuauuucaggagguugugcaacauucuaguguauauucugguguauagaaaaaugcacaaaauuauuccccuguuggauuuuagguuguuuccauuuuuugcugucauaaauaaugcuucagccaggcgagguggcucacgucuguaaucccagcacuuugggaggccaaggcaggcggaucacaaggucaggagaucgagaccauccuggcuaacauggugaaaccccgucucuacuaaaaauauaaaaaauuagccgggcaugguggcgggugccuguagucccagcuacucaggaggcugaggcaggagaauggcgugaagccgggaggcagagguugcagugagccgagauugcgccacugcacucuagccugggcgacagaaugagacuccgucucaaaaaauaaauaaauaaauaaugcuucaagucacacuuuagguauaaacuuuucuauaugaauaaagagguuuauuuauuuauuuaucuauuuauuuauuuauuuuuuugacacagaguuucacucuugucgcccaggcuggaaugcaauggugugaucucggcuugcugcaaccuccaccucccugguucaaccaauucuccugccucagccuccugagaagcugggacuacaaggcgugugccaccacgcccagcuaauuuuuguauuuuuaguagaagcgggguuucaccauguuggccaggauggucucuaccucuugaccucgugauucaccugccucggcuucccaaaguguugggauuacaggcgugagccacugugcccggccaauuuuuguauuuuuaauagaguuggggguuucaccuccgccuccccaguuuaagcgauucuccugucucagccuccugaguagcugggauuacaggcgcaugucacugugcccagcuaauuuuuguauuuuaguagagacggguuucaccauguuggccaggcuggucucgaacucuugaccucaggugauccgccugccugggccucccaaagugcuggaauuacaggcaugagccaccauucccggccgagucugguucuuaggaaauuugugucagugucuuagcagauggggcugaccugucacuccgcuguccaguccacugauugugcugggcacugacucagccaucagugcugcauucuuguggcacugguccagaaucuguucccacccugugcuaaccaggccaguccaugggccucuuuuggguuauauagcugcuaaguccauguuugugaaaguuuuaggucuuaccucucaagcaagaaauggagcagaagauggcauguguauucccuagugguuacagagcagacagagccucuggagagcaagagacauggauccaaagccuagcgcaguguuuguucuuagcuggaugcccuugggcaaguuaucuacuugccugagccuugguuuccuccuuuggggauaagcaaagucccugucuuccagggucuuuauaaguauuaaauguaauuaugcuuuuaaagagcucaccaaaguaccuggcacacauugagugcuggauaaacauuggcaguuaaucauggcugcuacuauuagguggagucugacagugaacaggcauguugagguaucacugggggauaucaggugacaaugcucuuuccucccccaacaggcuggcagagaaguaccgagagugccuaucuaacaaggagaagauucucaaggagauugaggugaagaaggaguaccugagcagccuccagccccgccucaacagcaucaugcagguggggcccucuggccuuuugcuuugccuucaccacugaccaggcgcugccagaagucaugucacccuuugggcuuugccaggucuauuacccuaaauuagaguauaguauaaggauggccuugucugcaucccuacccaguuggugugauaagcuugugucugggaggaagaagugcuggccucaggaauauauacacacauugaccuggguguuuucauccagaggccuucucuggguaacguacuuucucagacuguguaaauuuaguuuacccccugcauggcccccaccggccucacaaucuccaggcaucuaaacuugcuuccuguggaugucuguuugaucccccgaccaugcuucagggucagacugcucagcagaucuucucacucugaaaaaaacuuuacucaugaggaagagucaacacuucgccuguaaaacauaaugucuuucuguauaggugauccacuuuuuauuugcuuugcgaagccagauuuggucuaaauccuuauaauuuuaugaagcaagauggcuaauaugaaagaacuuuguaaaaggauccuagagauaaauuugcuuuucuucuuaggauuuggcaagaucuauauuuccuuucuucaacuguaagcguagaaggagaguuguugacugcuuguggugccucaugccuguaauccuagcacuucggguggcugaggggggaggaucacuugagcccaggaguuugagaccagccugggcaauaucgggagaccccgccucuacaaaaaaaaauuaacugggcaugguggccugugccugucgucccagcuacuuggaaggcugaggcaggaggaucgcuccagccugggugauagagcagaaauuaaaaguuuugguuguacuuaaccaaagccucugcaugguuaaauuuucucuuguuaccuggaaauuuucuaaauguccuuaaauaggguacagguuaaauaaauucuuguaugguacagccuuagagcugugaugaaaguauggaaucaaaccacugauauuugaaccacugacagaauaacugaaauaugaaagaagaucugucauauuaaauaagaaaugcaaguuguagaacauauaguauggacucauuucuauaccuugguuuacaaaguaucuguagggauauauacaaguaggaguuggguauaugcgguauaugcuuggaaaagucuauauucauagcagaccauuagcagcuacuuugaggacugggaacugggagcuuuuguuuuacaaacuugaauaccacuuuuuuuuuuuuuccuuuuccuuacccaccuuugccaccgccccccaugacuuuaaaaugcuuuuuuuuuuuuuuuuuuuggagacagaguugcucugucgcacaggcuggaguggaguggcgccaucucggcucacugcaaccucugccucccagguucaagugauucuccugcucugccuccugaguagcuggguuuacaggcacccaccaccacaccuggcuaauuuuuguauuuuuaguagagaugggguuucaucauguuggccaggcuagucuugaacuccuaaccucaggugaucugccugccucggcaaaguacugggauuauaggcaugagcccccacacccggccuaaaaugcuuuuuuuuuuuuuuuuuuuugagacagagucucgcucuaucacccaggcuggagugcaguggcgcaaucuuggcucacugcaagcucugccuccuggguucacgccauucuccugccucagccuccugaguagcuagaacuacaagcgccugccaccaugcccagcuaauuuuuuguuuuguauuuuuaguagagacgggguuucaccauguuagccaggauggucucgaucuccugaccuugugaucugcccgccucggccucccaaagugcugggauuacaggcgugagccaccacacccagccuaaaaugcuuuuuauuuuacuuuauauauuguacaauugguccucaugcacugugcagaaucugcaaacuugaaacucaaggcgaucuaguucagucuuucccgagucaagaaaaaaaagaaaaaaaaaaacagaagaaaagcacacaaauaaaaucucugaaacaaaaccugaauucauugccuaaggucuugaauacaacuuuuaaaaacaguguaccauauauuacuuuaaaacagaguuuuuuauacagaaaagcauguaacucgcaaguguauggcucaaugaauauucacuaagcaaacacaucuguauaaccagcacccaaaaucccagagaaagaacauuaacaauuuccuggaagcuccuuuauucccccucgcagucccuaucuucccucacaccccaguaaccauaaucuugacaucuuaacaucauagguuaguuuugccuauuuuugaacucuauacaaagagaaucauaguauauacuccuaugucuggcuucuuuuguucagcaguauguuucuaagauucaucugugcuauugugaguacaagaguuuguuuucauugauguuuaguaauugguuguuuccgguuuagggccauuucaauaaugcugcuaugagcauucuuauacauguguuuuggcauacauguguacaucugucuguugaauauauacccaggaaugaaauucuaggucauacaguauguuauacauauauuuagcuuuuguagacacugaaacaguuuucuaaacugguuguaccgauuuacagaaauucccaccagcaccauaugcaaguucuaauuguuuuacauccuugucaacacuuuauacugucagucuccuuaauuuuggcuacucuggaggguaucucauuauaguuuuaauuuuuauuucccugaggacuagugauguugaacacagcacauuuugccuuuuggauaaccucuugugaugggucuaggcaagucuuuugccuguuuucuguuggguugccuggagaugaguuuuuucccaggucuuccccauucuguaaccuccugccuuuucacuuugcuaaugguaucuuuuaaugagugcauguuccuaauuuuacuaauuauucuuuuccuuuaugguuaguacuuuuuuugugucuuguuuaagaaaucuuucuauuuaaaucuguugucauccuggaagugauuuuguuaguuaaggguaaagauucauuuuuucuuuccacauagguauuuagcugaccauuuauugaagacauucucuuuccacugcucuguagugccacuuuuguuacaaaucaaaugucuuuguacauguggauauguguauaaucucuguguccauccuugcacaguaucacacugucuuauuuacuguggcuuuaucagaagucucgaugcacaguuccaaccuauuucuucaggauugucuugguuauucuuggcccuuugcauuuacauacaaguuucagaaucagguugucuguuuucaccugcugggauuuugacagggauugcauugaaucugcagaccacuuuagaauaaauuguuaccuggacaauauuugagucuuccaggccauugacauucacauguauccacuuauuuuagacuuuucauuucucagguuuuuguguagaggcuuauaugccuuucauuuguuuauuuuauuuuguuuuauuuugaggcagggucuugcucucuugcccaggcuggagugcagugguacaaucuuggcucacugcaaccuccgucucccagguucaaguaauucuucugccucagccucuggaguagcugggauuacaggugcgugcccccacacuuggccaauuuuuguauuuauagcagagauuggguuucaccauguuggccaggcuggucucaaacuccugaccucaggugauccaccugccucggccucccaaagugcugggauuacaggcaugagccacugcacccagccugcuuguuuauuauuuuuuguuuguuuuuugagacagaguuuugcucuuguugcccaggcuggagugcaauggcaugaucucggcucaccgcaaccuccacuuccuggauucaagugaugcuccugccucagccucccgaguagcugggauuacaggcauaugccaccacgcccagcuaauuuuguauuuuuuuuaguagagacgggguucucuguguccgucaggcuggucuugaucucccgaccucaggugauccaucugccucagccucccaaagugcugagauuacaggcgugagccacuaugcccggccuguuuauucuuauuugauguuuuauugaugguauugaaauggcaucuuuuuauaauuucuuuuuuuaaauugauuuuuauuuuuuguggaaauggcaucucgcuaaguuacccaggcugcucuugaacuccuggccucaagugauccuccugccucagccucccaaagugcugggacuaugggcaugagccagggugcccugacaguagguaaaauaaaacaauuuuauuuccuuacuguuuguugcuaguauaaagaaauauaauuuuguuuacguugagcuuuuauccaccuauuaguucuauuaguuuaucauguaucacuuuuauaaauaaugauuuacggucacuaaguagccacuuuuuccuguguggacuggcuaaaaaaggaagaacaaaaaucugucucuugugugcaggcuucccuuccggugcaggaguaccuguuuaugccauucgaccaggcucacaagcaguaugagacagccagacaccugccgccuccccucuauguccucuuuguucaggccacugcguaugggcaggccuguggugaguauggggccugggugaggacaaggggcuaugggagcagcagcuguggccgagugaaucaguuggaagcaguaccugcucaggaaauuucucaguccugcccgaagcccucaggugacagaagcuuucuucccucugcauugcccagcauggcugcucugaccagcuggccuaaggcuggauuaaccugauggguauuucacaauggguggcuuugagucauucgugagccuggcuggacagcucuugggugcagaacccaggcagccugucugggcucccaggugcucaccccaucaaggcacgcuuggcaguuagaucagugccucuugcucugcuucagggugggggugccuggugaauacaggucucagccagcucucccaggcuuucaccaugccuugaaucaggcugcaugucuuuguugugaauuuccagguuagaugauauguccucauuaagcuugagggcagccugugacucugcuaggguuuugagaaaauuuuggagacucugccuuuugcccuaaugcagcuuucacccagcaccuacauuuucucccccaccccaccccaccucaucagacagacauacaccgcaccagugcuugcuucuccucccaccuugggcaccaacacauuacugucucuucuugugucuuccucguccuucugguccuccccuccccuuuguucucccuccuguuuccaucaucagcucauaugaaauccucccagcccccuagacagggugaguaauuuucuuuucuuuuauguuuaaaaucggccuguuccauucugauguucuuguagaaugcuaauauuaaauggcugaaaaaaauagucuguuguuugccagugcuugaugggagcaacuaguugcuuggggugaaggguggugauucacauaggguugccauagauaaggcaguggucagccacuugggggaaguuugccaucccuccuuaguguggcuaggcaaaccguuucaggcucuugggaccauauguacccuuaagaauggaguuggacggugguggccugucugaccucacaacgcuagacccucagagggggucucaagacaucacucaaugaggugucauaccugguguaugcaacaggcuguuagcucaugugcuggagaggccaagcuuaaguugaacagaccuggucuugaauccugguuuaucagccuuauagcugugaugucuagcuucucugagccuuaaguuucucaucuauaaauggcuauaauguauuacuccuguaggguuguugugaguauuaaaaaaaauuuuuuuuuuugagauggagucuggcucuguugcccaggcuggagugcaguggcaugaucuuggcucacugcaaccucugcuucccagguucaagcaauucucccugccucagccucccaaguagcugggauuacaggcacccaccaccgugccuggcuaauuuuuauauauuuaguagagacagaguuucaccauguuggccaggcuggucucgaacuccugaucucaggugauccacucaccuuggccucccaaccagacaugagccaccacacccagccuaaaaauuaauuuuuaauaauuuuauaauuaaaauuacaagcaucagcucauucaguccccaccacuaauggggcagcuacuguuuuucuuuuuucuuuuuuuuuugagacagagucucacucuguugcccaggcugcagugcaguagcaugaucuugguucacaguaaccuccaccuccuggauucaagcaauucuccugucucagccucccaaguagaugggguuacaggcacaugccaccacacacagcuaauuuuuguauuuuuaguacagacgggauuuugccauguuggccaggcuggucucugaacuccugaccucaggugauccaccugccucggccucccaaagugcugagauuacaggugugagccacugcacccggcagcuacuauuuuucaaguccccuuuucauagauacagaaacugaggcucagacagugacauaacuuuccaggucauguguuugagaauugguuaggcagggacucaggucuggaacuggacugcaagauccaaguuccuauucacuguccuacugccucccaguuaagugagacaauggcagccaugugcuugguauaguguagaauagagaauaagcacuuaggugagagucauuguuucugggauguggacagguguggauuucugggugagaaccucuaagacaacuggcagaggaguuccauguggcuuuaggcccucaguuugaauuucugugcuuuggugugcaccaaaaaagagaggcauucacugcuaguuucaggugaugcugguuuaggaauuuguacuuaaguucucuguucucaguaaaugacggaaaaaaaagcuuaagugucccaccuuguuucccuucaucuggagcaaggacuuuugcccuuccacccuuagucagcaaggagcugggcagaggugggagaaaugcagccccagagcuggccuacucacacugcuuagcagcuuuccucagcagcuuuccuaacagacuucuucuugccccccagauaagacguuaucuguggcaaucgaaggcaguguggaugaagccaaggcucuguucaaaccuccagaggacucccaagguaauguggugguugggauucgucccccagggacaccaggucaccauccaagggcaguccuggucuuuggagaacuagcuggacuaguucuguguagcaggaagcuugacuugaaugucuuagcacccuggaguagacaggaaagagagcucacuucccggagucacaaggugcggcccguggauuucagcccugccacucacuagcugacugaccccgaggaagguauuuaauauuucagagccucaguuuauuccuuugugaaaacagauaguaacaccucauguaggauuguuauguggauuaaauaagguaaugcacauacagccuuuagcauaauucucagcacauaguacccccucaaguuaugcaugcuucuacuacuauuauuauuauuuguguuacuauuauuaccacagccaccaccaccaucacaaggaggggcuuguguuccaucuaaaugacaucaaaaagcccuuugaaaaaaaugaguuauacgucauucuucuuuuuucuuuuuucaucaccauguuuuguauacugaauaagaagcagcaaguuaauuuauuauuuauuacagagaaacuuauuuacaaaagacagagucagggccccuuuaugccauguggguuggagugcuuuagggagcauuuggagcccccucaccucuagcugccuucucucuguggcugcagaugacgagagugacucagaugccgaggaggagcagacuacggugagaaccauuuccucuugugggggcaucaagcagcugcaugcacuggggcaugcuuguucgcaggugccguccucccuagaagcagaagaggugugaaagaaggugcugcugggaggggagucugacaacccagcuagcugaagcagcaggugccaggcaguagggcugaggccuggcugguugggagagggaaggggagauugcuaugacugaugcucaucagcuuggcacuuuccuuuguccagaagcgccggagacccacacuggggguucaguuggacgacaaacgcaaggagaugcugaagaggcacccacugucugucaugcucgaccugaagugcaaaggucugguugcacucaccuuguuuaagggaucuguagcaccuaagaguucacccagcugcaggugcagaggguccgggagccaaacacccauuugcccaacaaaggauucccauuucauauugcuuuguuuuuccuuauuguuuugcauggacuuuguuucuuuuuguuaaaucauaaccguaacaacauagcaacaaaacuccagucacauaaggcagaagcuugagaaaacuauaccucuuucugaaucuagcaagucaaauaucuagaacaaguugcaaaaguauacagguuuuuaguaagaccaacauguuuaauaaauguaaguagaacuuuguauucugcagaguauauguuuugaaguugguuuguaugaaaaaguaccauauaauaaaauguucuagcaguagaagagcuaacaguaaaauuuaaguuucccucucaccacagguuccuauauaccaguccuaggucucaccuccaagggcaaccauuauuacagacuucuuauguauuuuuuagaaagauucuuugcaccuggaagcuuuuauacaaauguauauuuaucugcuucccacuuuauuuuuuacacaaauggaaauaggcucuacgcacugguuuucuuuuugcugguuguuuguuuguuuguuuguuuuuagagauagggucucacucucgucauccaggcuggaguacaguggcaugaucacggcucacugcaacuucaaccuccugggcucaaucgaucuucccacaucagccucccaaguagcgggggcuacaggcaugugccaucaugccaguuaauuuuuguauuuuuuguagagaugggguuuugucauguugcccaggcuggucuugaaccccugggcucaaacgauccuccugccucagccuccuaaguagcuaggacuggaagcgugcaccaccauggcuggcuuugagauaauuuuaggcucauagaagacuugccaaaauaacaugaguuccuauauacucuucauucagcuucccuaaaguuacaucuuaauuaaagaugguaugauuaacagcgauccacaccacucuuaauuucauuggcccaauacuguuaacaaaaugacagaauuuuuuuaguuucuuccuuuuuuaauuaauguccuuuuucugucccaagauccaagccagggucucaaagugcauuuaguugccaugcuccuuagucugcucuaggcagugagugucucagucuuuccuuguguuucaugaccuugauuagacugagauuauggauuugggggagagaauagcauagaugaggucgucgcuaucaugucauaucaggaguaccugaugccacuguauuauuucugcugauauugaccuugaucgcuugguucccuuuccaucuuguauuuguuagaagcagagucacuaaguccagcccacucucaagggcagagaaauuaagcccuaccucuuggugggaagcguagcaaagaauuuguagaugcucuccuugcuucuuuuuguucauuauauuacuguugugauuuuuuuuuuucuugagacagagucucgcucuguugcccaggcuggagugcaguggcgugaucucugcucacugcaagcuccaccuccuggguucacaccauucuccugccucagccucccaaguagcugggacuacaggugcccgccaccacgcccgacugauuuuuuguauuuuuaguagagacgggguuucacuguguuagccaggauggucucgaucuccugacuucaugaucugcccaccuuggccucccagagugcugggauuacaggugugagccaccgcgccuggccgauuuuguuuuuauaguaaaugauuguaaaagucucugaauuuuucuauaauucuguuuuucuuuuuuuguuauaauuucaacuuuuauuuucgauucuggggauacaugugccgauuuguuacacuauuuugcgugguccugagguuugggguaugaaugaucccgucaccuagguagugggcauaauaccuaguaguuaguuuuucaacacuugacccccccaccuuacuacccccuaugacucuguucacucugcucugaguguuuugacucauaaauucucucaucuuccuccccuccagaugacagugugcuucaccugacuuucuacuaccucaugaaccucaacaucaugacaguaaaagccaaagugacaacugccauggagcugaucacccccaucagugcaggguauugagcaggcgcucugggcaaugacgugcgggauggggaggugaugagagccucauuguggggcugcucucgguuccucccucuggcucuggagagggcuacggcuguguugacuugucuuguauccagauggaccagaaguccuggcacaucgcugguauuuagaaagcacucucugacuuuaauuugugaaguccucuuacuacacagcagaugauaaaagugacaacagcauauuugcaaauugaguagguggggcagagcaccagcuuuuugcuaccaguggaaagugugugaauauaaaaugagauuuggcagacauuauuagguugccaaauucaggccacucuuucccuuuucucuuucuaucccaaggugcugggauuuuugcuccccagcucagcccaagcccauguccuuaucuggguggugggaggacuguggugggucccugugaaaguuuugagaagagugagcagaggcacaguaaugacagccaucaucgcauccccaggaaggcccugacuacaguguucuuuuuuuaauuucuauuuuuguugauacacagucucacuauguugcccagacuggaggaccauggcauaaucauagcucacuguggccucaaacuucugggcuguagugauccuccuaccucagccuccugaguaacuaggacuacaggugcaugccaccaugccuggcugacuuucuauuuuuauuuuauagaaacggggucuugcuguguugcccaggguggucuugaacuccuggccucaagcacuccucccgucucugccucucacagugcuggaauuccaggcaugagucaccauaccuggcccaaucauggcauucuucuucugcaaacaugggcgggaagaagggucaugcggggcugagggugaaauagcuuccauucacaagagcacugcccugaccuagucccacugucagcugcagaaagaccacugaggcuuagggagguacagcucuggugccugguagagcagggcucuuuccaccccugccaguucuccaugaugcuggugucucuuggguuuuagacugcccuuagaguccacauccccuucaggccauagcagcuuuggcugcugugccugagaguguuguuggacacccccaggggugcucuggaugaaauugccccuguucccaucugaccccagcagagggagcccagggcuugcuucugagcacccaguuacacuguccagggcucucaguucauugaggaguuccagggcccccagaucgugguagagcucaucaugaacauucugcuuguucauuucucaggugcccuacaugcuaauaacagggcugcagccuggcuuuauugcaugcucaacuccagcucuucacuaagcuguauaccuggccucagaaucuguuuccucgcugugugguuguuaauuguaauauccccucccagggugcuugugaagagucaggucaagugcuuagcauagaggaagcacuugguaaaggacagcugauuuauaaucauugacucuuguaacuuucacaauagcucuaugaggugaguuaacugaggcucuggacaguuaagggguagccucaaggucacagguagagaguggagaauuaugauucgaagucagcaagaccuguauaccacugcugucauagccaggugggcccugacccccaaacagggaggagacauaaaaggagaugccacugugaaacugggauuaggucuuuuaggccuucagguguugucuagcucauccuccuuuuacaaauagagaaacugagguccagggagcauacaaccaauuaucgcagcacuggaccuaaagcccgagacucugggcucccagcccagaagccuuugcucaaauacaggcugccuuuggccacaugaagacagcaaccuggcauacaguuuuauugauuuaucuauuaaaacauaaaggguauauucucacacuaauucuugaaucucauacuaucauucuaauuucccugauuuuuuucauauauuuuuugggggagggaguuuucagacaaacaauuuuuuuuaauaguuuuguguuuugagucuggaucacuauaaggcccauacauugccaaugagcaaagcuucuuucaaguaucuuaucagaggguccugccaucucuuuuguuuucuccuaagauucauugucuugggcuuuccaccgucuuuguauuuguuggagaaaaugggucguuugcucuguagguucuaccuagucuggauuuugaggacugcgucccugugguaucguuaaacguguucgucuuucuaccuguguguucuugugaacagggaguuggcuuagagacuugaucagauuagguuuucgaaauuuuuuugugguggugggguggguagagggcaggacuguaucauggcuguuguugaauacuuccaucaagaggcacaggcucucuuuauuuuugugauguuacugucuugacaacuguugccuagauccauuaauucauuagagaauuuuuaaaaauccucccugacagaguuaauguuuuuauuuuauuauuuauuuauuuauuuauuuauuuugagaaggagucucugugugucgcccaggccggagugcaguggugagaucuugacucacugcaaccuccaccucccugguucaagugauucuccugccucagccucucgaguagcugggauuacaggcaugcgccaccacgccuggcugauuuuuguauuuuuaguggagaugggguuuugccauguuggccaggccagucuuaagaguuaaugguuugguuuuuuguuuucuuuuuuucuugagacagagucucgcucugucgcccaggcuggagugcagugguacgaucucagcucacugcaaccuccgccuccuggguucaugcaguucuccugccucagccucccaaguagcugggacuacaggcgcgugccaccaugcugggcuaauuuuuguauuuucaguagagacgggguuucaccauuucggccaggauggucucgaucucuugaccucaugaucugcccgccucggccucccaaagugcugggauuacaggcgugagccaccacgcccggccacuaagguuuuuuuaaucccuuacuuuuuaucaaaauuuuauaacaaagauuugacugguugagaaguuuuuuuguuuugguguuauauuuuuaugacuauaaauagccuuuccuuuuauguucaucauuuuuaccaaguucaguugucuuagccauauguugcagauauaaauuuugccaagaaggugauuccuucaucagguuuugucaauuaauaaccuucaucgugggcaguuuuaguucuguuuuauuuauuuacuaauagauugaaucaaucuauuaguaauagucccuaaacacuugcuaaaagacugaaaaguuuuauuuuauuuuauuuuauuuuauuuuauuuauuuuuuugagacagagucucgcucugucacccaggcuagagugcaguggugcaaucuuggcuuauugccagcuccgucucccggguucacaccauucuccugccucagccucccaaguagcugggacuauaggcgcccgccaccaugcccagcuaauuuuuuuuuuuuuuuuguauuuuuagcagagacgggguuucaccguguuagccaggauggucucgaucuccugaccucaugauccgcccgucucggccucucaaagugcugggauuacaggcgugagccacugugccuggccugaaauguuuuauuuguuugguagucaguucuccauuugagguggugaagggggcaaagaccuuggggaacagggauacucagugagacacaguagggaagagcuggaagccuccacuguccuagcauggaguuccugaaggcaugcuggggccaaaacgcaggaccggcacgugcugcccaaguugcuccugacguuauccauggaaagaugaaggagaacccccuuugguucagggaaagaaugggccuugucauccuuugugauaaaauuacuacauuacccucccacauuaucucuuuuuugcuugucacauuuaaugacaaacugugcccgaaccaucccagguggguggcaguggcgucacuauuucucuccgcuuguagcugugggucuccaguguaugugauuguaucuuuuucugggaacauacagggggccuuuuccugugaugagcauaagauuuggucaaagugagauagacauagcaccaaagcuauacacuuguucucucuguagcagaaaggagucuguucugcuuuuaugaaaauugaaauuauuucuacugauggugucaugggacuuugcuccccugagguaaggccuuaggcaccauauaaaucuugaagggaugaguuuuuuaaaaauuaaugauuaagaguacuagucuguuugaucagacaauauaaagccaccucuagcacuuacuagcagugugaucuugaauaagccauaucuuuuaaagccuugaguuuuuccucuauaaaauggaaaugauaauccucccucauaggguuguaaggaugcaaugaccucaagcauauaaacggucuggcccacagaaagccuucaauaaaugguggcauuggucaucagugagacguggcauuaccauccccaaaugcccaagccuauguugaagaaagauguuggcugcauucucacugcuuacuguuuuuccuuuucuagugacuugcugucuccugacucaguccugaguugcuuguauccuggggaucauggaaagaaaacuccgaauccagccaaucaguaucaguuugauaaaguugggugagucagcaguuuccuccucuccgagcucucuacuucugaguuucucugguggcucaagcuaaaugcuggagaccuguuagggccagaggugacccagaggauaggaaagaccacaggguagaaggaaauguuuguucuuucuugcuuacaaggcaaagggagaucacaaaaaggguggaaggaucaaaacucggaaacaugcugggugugguggcucacgccuguaaucccagcacuuuggaaggccaaagcagguggauuccuugagcucaggaguucgauaccagccugggcaacauggcaaaacccugucucuacaagaaauacaaaaauuagccaggcaugguggugggcauuuguagucccagcuacuggggagguugaggugggagaauugcaugagcccaggagguugaggcugcagugagccauggucaugucgcuguacuccagccugggggcaacagagccagacccugucucaaaacaaaaacaaaaagaaaaacaaaaaaaacccucuggaagcauaauaauacgugauacaauaaaaauguuugacauuuuaauuauccgaggauuaauuuuuaaaagauuuucuaaauugguagaccaauaaagacauuaguacacugccuuuguauuugauauuugcuuauaaguugaaggcugcaagaagaaaaggaaaaagaggaaagugaaugugagagagaugaaauucacaguagggaacugacaaaguugaagggcuuugccagcagccuggcugugaacauggccaaaccugcaggacuggaugguuuguggggcaugggagggugggaggaggcuguauccugggaccacagcagaaaugacuuacagcacaauuuuauuuaucuucuuuucugcagcauccugacuuugagcgacuauguacuugagcuaggucaccccuauuugugggugcagaagcuggguggccuccacuuccccaaagagcagccccaggucuguacacugaucucaucuaguuggcugaggagcuuaccucuucucuuccuguauagacucuagaaaggccaggccaggugcgguggcucaugccuauaauccuuguacuuugggaggcugaggcagguggaucaccugaggucaggaguuugagaccagccuggccaacaugaugaaaccccaucucuacuaaaaauacaaaaaauuagcugggugugguggcacguuccuauaaucccagcuauucaggaggcugaggcaggagaaucacuugaaccagggaggcagagguugcggugagcugagaucaugccacugcacuccagccugggcaacaagagcaaaacuccgucucaaaaaaaaaaaaaaaggccugucauggccuuuggaguuuugaacuggcagaauguguccccucagggcugugaccugucuucuauccacucaggacacuaaaaugucuuagacuuacaagaguuuacguaccuuuugcauuuucucugagccuaguagccuuuuagacccaggcaacuugaguccuugcucugggacucaugucugcaggcucugcugcccuuguucuugugugcaaguaccaaauaugaggcaugagcagaaauccagggggccuggccccuuagcagaagccugccuuuccucaggaguuggacacagcuucucaagaacgcagcauauuguguuguuucugccaggacucagcgucuggccugucauagcagauaaaccuugccaugucuaaaggguacccaucuuggggcauggauaauccagggugccgcagacaggcaggucccaggagagagauggugcccggaggaagggaugggggagcacacguguaugugucucauugucacucacagcaaacagugauugcugaccacucgcugagcgccagccacauggagaccaccaugaaacuucugaagaccagggugcagucccgccuggcccuccacaaacaguuugcaucccuagguaagcugaugauggggcagugguuuaagagucacucagacaacacacggacaacaacaacuuagccuuucacucaaaacuugaauccugaugacaaauacaagaccuggauuccuggcuuuacggagugggcaucuuggcagagccacuggggagagcuccaggccuguccaggcagaggaccgagcucccccuuagagccaucagugcuguccugccucacagaggaggcccagagccauuggguggcacaaguuuguggacuggucggggcaguucauccuaggucaugcauugcagauuuugaugugcauucgacacauauuuagugagauccugauucaugccaggcacugagcauagugcugggggaagaacugagcacagugaaccccugccccuggcucuguggcucacagucagcuuuuugaauauagcuauccagggagcaacucgcauaucccuuccccaaggccuacugaccucguguuccccagggugaggcugagccuauguuuucuucuaagcucccaagugauaaugaugagccacugacuuaggugguggcauuugggggcuucuuuuaguuuauucacucaguaagugguugucaaaugcuuaccauguggcagggggauggggucaagauuuuucugaccuaaaagagucucugggacaggcgcaguggcucuugccuguaaucacagcacuuugggaggccaaggcagacagaucacuugaggucaggaguucaagaccagccugccaacauggugaaacuccgucucuacuaaaaauacaaaaauuagcugggcaugguggugugcacuuguauucccagcuacucaggaggcugaagcaggagaauugcuugaaccugagaggcggaaguugcagugagcugagaucgcaucacuguauuccagccugggcaacaaagcgagacuccaucucaaaauaaaaaguaaaaaauaaaaaagagucucugucaggaaaggcauuggguuuccaggacacaucuggagaccacuccccaccaguucuuagacuccacauggcugccgaucucuccagagcacugauguuuguccaucgggccgugcuccccaucagcacugcugaguuuguuuugucccaagguagggaacuugucauucuggacaguacuuacuguguuggcauauuugcuuauuuaaaugccagcaggaauuuacccuggagcaguuaucuggcucuucucccugacacacaacacuucaguuguuuccuccaucaaggucagcuaugaaaacacaggccucuaugcuauuugaucuaauuaacagucacugcugcaggggcacccucccuaguucugacuguaaggguuuuucuuuggcaggcuaucauuugcauuaaagagaaagcaccauaagugcuggcacuggaucuggccacaagcacauagcacugggugaaggucagguugacaugcuugcauuccuggcacguguugaccuggguacuuccugaguaccagguauaccaggauagcuggccgggccaucugagcccuucagagagccccaggaggaugcuaguuacccaucuguggcaccugauuucuaccugugacgucaucugucuuguucucuuuuagaacauggcauugugccaguuaccagugauugccaguaccucuucccugccaagguugucucucgccuggugaaaugggugacaguugcccaugaggauuacaugguaggugaaggagugacaaguuacccuuacuguccugaggauugcaggaccaugucaccuuucagcuccugccaccucacuggaagagcaggggguuuaaccagaggagccagcaguucaccucuugucugugguaccucuucuaggagcugcacuucaccaaagacauuguggaugcgggacuggcuggggacaccaaucucuacuacauggcgcucaucgaaaggggcacagguaauugcucugcugauuacagggguucuagacaaagggcgcugccaagaaucaaacacucuccggggcugcccaaagcagaagauccuggaguccugcaaggacuuaacagauaauaaugaucgugagagccuguucagcaaggacucauucugcaacacagucacacacacgcuguguaucacugaacccucacugcaguccuagggguggugcuuucauuucuauuuuacaugggaggaaauucaggcuuaguugcaagcccagucugagcgcugagccugagcucuuugcuccuuccuucaccgcuuucuaguaccggacaucuccuccuucucccucuucauaacagggcugaggugucacccucagguuguaaagggcagggccacagggccucgcucccucuucugcagucccugcacucacuuuagaggcauugaaagcucugauucuucauaccucuucuggcaucugacucugccagggcucccugcugaaguccugggauguuguguuugggccguugugcuguugucccacccaagccgcagcaagccuggcacugcccgugggaucugacacccucaagacuuggugcugagcugaggaaguugucuguaguucuaagacaguuccagaacuguaaggaaaggcugaacucuuugguaucagaguuucuguccucacuaccccacuuucuucucuuucuauucuucaugucuuuuaaaaaaaaaauucugaagaaacugaauauuucagauacaguugaggccucccuaucccacuuuauucccuuucuccuaauaagugaccacuauuuggauuuuaugcauuugcuuuccauccuuuccccgcuacacccuuuuuuuuuuuuuuuucaguagagauaaggucuugcuuugucgcccaggcuggagugcaguggcacgaucauagcucacugcaaucuugaacuccuggacucaagcaauccuucuuccaccuuagcucccugaguagcugcgacuacagguaugcuaccaugcucagcuaagauuuuuuguuuuuguuuuuguuuuuuuguagaggcauguucuuacuauguugccaagccuggucucaaacuccuggccuuucuuccaaagugcugggauuguaggcaucagccaucaugccuggccucuccccuuucaaaauuuaauuuaacuuauuuuuugagacagggucuugcucuguugccuagacuggaguacaguggcucagucauggcucacugcagccucaacugccugggcucaagucauuucccuaccucagccucuugaguagcuggggcuacaaaugugcaccaccaugcuuggcuaauuuuuuuuuuuuuuuuuuguagagauaaggucuugcuuuguugcccaggccagucucgaacuccuagguuuaagugauccucccaacucggccucccaaagugcugggauugcaggcaugaaccaccacacccggucuuccuuuuaucucaucccuaaacaacauaaaguacaggcauaccucagagauauugcagguucaguugcagacuaccacaauaaagcaaacuuugcaauaaaguaggugacacaaauuuuuugguuucccaguacguauaaaaguuauguuugcacuauagucuaaguguacaauagcaucauguuuuuaaaaaacaauauacagccgggcgcaguggcucaugccuauaaucccagcauucugggaggcugaggugggcagaucaccugaggucaggaguucgagaccagccuggccaacauagugaaacccugucucuacuaaaaauacaaaaauuggcugggcaugguggcaugcaccuguagucccagcuacucaggaggcugaggcaggagaaucgcuugaacccaggagguggagguuacaaugagccgagaucaugccacugcacuccagccugggcgacagagcaagacucucuuucaaaaaaaacaacaacaaaaaacaauauauauaccuuaauuuaaaaguacuuuaugggcugggcaugguggcccaugccuguaaucccagcacuuugggaggcugaggugggaggaucacuugaggucaggaguucaagaccagccuggccaacauagcaaacccugucucuacuaaaaauauaaaaguuagccgggguugguggugggcaccuguaaucucagcuacuugggagucugaggcaggagaauugcucgaacccggaagguucgagcuugcagugagccaagaucgagccacugcacuccagccugggugacagagcaagacuccgucucaaaaaauauauauauauauauuuuuucauuugagugcauugugaaauugaaaagcaaaauuuagacgaauaagugggcaacaauugcaaauauaauucuucagucauggccgggugcgguggcucagguguguaaucccagcacuuugggaagccgaggcgggcggaucacgaggucaggagauggagaccauccuggcuaacauggugaaaccccaucucuacuaaaaauacaaaaaauuagccgggccugguggcgggcgccuguagucccagcuacucgggagggugaggcaggagaauggcgugaacccgggaggcggagcuugcagugagcugagauggcgccacugcacuccagccugggugacagugcgagacuccaucucaaaaaaaaaaaaaaaaaaauucuucagucauucuacaacagauccauuuggaaacuuucuguagugugaauuuaaaaauuggugaacagccugggcgugguggcucacgccuguaaucccagcacuuuuagguggaggcggguggaucacgaggucaggaguucaagaccagccuggccaagauggugaaaacccgucucuacuaaaaauacaaaaauuagcugggcgcgguggcgcaugccuguaauuccagcuacuugggaggcugaggcaggagaaucgcuugaacuugggaggcggagguugcagugagcugagauugggccauugcacucuagccuugguaacaagagcgagacucugucucaaaaaaaaaaaaaaaauugaugaacagagauaaauccagaaauguaugcugauuauuaggacagaagcaauacagcagcagagaaagaaaauacuuuuuauuuuauuuuuauuuuuuauuuauuuaauucuuuauagggaugaggacuugcuauguugaccaggcuggucuuaaacuucuggcuucaaaccauccuucugccucagccugccauugugcugggauuacaggcgugagccacgacgccuggccagaaagcacuuuuuauuuauuuauuuugagacggagucuugcuuuguugcguaggcuggaguacaguggcaugaucucagcucacugcaaccuccaccuuaccagguucaagugacccucccgucuuggccuccuaagcagcugggauuacaagcaugucccacuaggccuggcuaauuuuuguauuuuuacuagagaugagauuucacuauguuggcugggcugguccugaccucaagugauccacccacuucugccucccaaagugcugggauuauaggcgugaccccccaugcccaguccagaacacucuuuuuuggggacagggggagguaaagcaacuuuuuuuuuuuuuuuuugagacggagucuugcucugucacccaggcuggagugcaguggcacgaucucugcucacugcaagcuccaccuccuggauucaagcgauucuccugccucaaccuccugaguagcugguagcugggacuacagucgcccaccaccacgcccagcuaauuuuuuguauuuuuaguagagacgggguuucaccauguuagccaggauggucucgaucuccugaucucgugauccgcccaccucggccucccaaagugcugggauuacaggcgugagccaccgcgccagccacaacuuuuuaauuaauguucugacuguuagggaagaauuguguuaaccucuccucuccucuguuauuugaauaacuaguggucagagagugaaagucuccccccuaaaaauaacuaaaaaggaauggcauaccuaucccacuugagaagauaaaugucuuccuguugaaaaaggcaaaggcuuucaccagagaauaaaugaguauguucaaaaacacaaauauuuuguuuaaugauuaugaacacagcuuugauaucagccaguucugguuaaacucagcacugcuaccuuccaacuauuugaugguagggaaguuucugucagagccuguuucuuuauguguaaaaugaggaugaggauaauaguaccuaacucauagaauuauuguuaggaugaaauaaaaugugucuagaggguuuagcacagugccugggauacaguaaggacucucuacauguuggcuaguauacagaauuuuauguaacaaaguauguaaaaaucaaaugaagaaaauagagaaaauauauuugaugugauaguugauacacaguauuguugaaaaauuaguaagcuuucacauggagaaaaccuuagcuugcuggcaaauaaagaaaugacaauuacacuucuaucaaaguagcaaauagaacucauggagagagccaagguggaccagacucuggggaguccgcagcuuuguggcacaguaaauaugucaaaguccuuggagagaccaauuauaggaccucacauucugcaagcuggcaauuccacuuaggacauucuggaacaguugguaccagaauauacucugcagcauucagauuaauaggagacaucugagcuagccucaggggugcaguggggaggcugccauggcuggcaagcugagucuuagaacugcgcauuuccccucucuccucucuucccagccaaacugcaggccgcugugguguugaacccuggcuacuccuccaucccaccuguuuuccagcucuguuugaacuggaaaggggagaaaaccaacagcaacgaugacaacauucggguaagacccagcuggggaugacaggaggagcaggcagagcucccgggggagguggccguggcagaacccacugcagcugaggacuugggcacugccuuaauucccaaaacagaagguugugccaggauuugcagaauuugcuggagcuugugugguguacuagaggaaagagcccagaccuacuugccuaccuugggguccacagguuuccccacuuagagaguaaggagaaauaccuaccuugaaagguuauuggcuugggcuccuauaaaaaaugugaauaagcucugaagcauuauagaagcacuggaaugacaugaggaaugacaucacugcaguuguuaaucagcauugcagcuguuaaucagcauugcaguuguuaaucagcauugcugcuacuaagucaaacaugccauggaacacguuuuuaaccaacaucuucugacuuaggucuuauuuugagacugcuucccugcacaccucuguuuuccuggcugugggcauaugaggcagggaaagcuaugggucagaaucaggaagaccucauugucuugaugagggggccugaggacaagccagucuagcuugaucugauggccuagccccuggcccagccccugcagaggcaucagcgcucgggcccauccagggacggaagccuggccaguguggucccccacaugcaggaagguagugcugagaugcuggcuuuccuaucacacaggccauggagggcgaagucaaugugugcuacaaggagcuguguggcccuuggcccagccaccagcuguugaccaaccagcugcagcggcugugugugcugcuggauguuuaccuggagaccgagagccaugacgacaguguggaggggcccaaggaauuuccccaggagaagaugugucugcggcucuucaggugaggagaggguuggggcucuggugacuucucauggugaugugggacagagaucagagccagauuuucuggggagagcuugcuucuuccuuccugaaacuuccccugcagccgaugccuaucacucugguccaccuguuuuucacuaacaccuccugaagguguuagugccaggucugagccaagaggauuuggcugaacuuuauuuucuauacuuucuguggaaaacaauagaguuuguuugcuuuuuaguguccaaauaagcuuuuuaaacugugugcauccucgccuguccccagggagucugcuguggucuuucuaggguacuguccugucagugagaaucacagcuuaggcagucagguggcacagaaggaaccagcuucaaaguaaaacagauaggagugcagaucucuguuuugcugcugaccuuagaagagucaguucugcuuagcucugagcccuccuccagcuuuuuguuuguuuguuuccuuuucuuugagacacggucuuacucucuugcccagacuggagugcagcagcaugaucauagcccacuguagccuugcagucuugaccucuggagcucaaacgauccuuccgccucagccucccuaguagcugggaccacagacaugcaccgccacacgcaacuaauuuuuaaauuuuuuuguagagaugggguuucaccauauuagccaggcuggucucaaacuccuaggcucaagugaucagcuugucucagccucccaaagugcugggauuacaggcaugagccauugugccugaccccuauuuucuaaagacagaaauggugaaaguaauaccuucuagcucaugaugaagcagaaguaauucauauaaaguccuggcacaggacugggacucggaaaaugccagcaguuccugacagcuugguacucaagagugucugggcucauggcacuuccagcuacuuuuccuuucucuuucauuuuggguccuuuauuucccuuucagccucuaacucauguucuuuuaagagucaguuucaaaacugcagauuucacugcucaggcaucccuucccuucugcaugagguuggcggggagcaguguuugggaaggaagaagagugauaaucuguuucuaaucagaacauccccccuuguucccugucagucuacacagugccuuaucucucccucaccuuguucucuguucccugucagucuaagcagugccuuaccucucccucaccuuguucucuguucccugucagucuaagcagugccuuaccucucccucaccuuguucucuguucccugucagucuaagcagugccuuaccucucccucaccuuguucucuguucccugucagucuaagcagugccuuaccucucccuuaccuuguucucuguucccugucagucuaagcagugccuuaccucucccucaccuuguucucuguucccugucagucuaaacagugccuuaccucucccucaccuuguucucagacagccaguucuagccccuagaagcagucccagcauccuuucaccucaucugacaccuccacuggccugguucauuauguuaucucauaauaaccaguuccagcucugaguggcugcugggagguggagcugguggccagaugcuggcaccuucuaggacuugcucucucccuagagggcuugugugagaccucugcucuucucaccugcccagcccauucuagcacauugccagggugggaauucucacauggccagcauugauuuccucuucuccagugguucccaaaggacccauuucuuuuucuuuuuucuuuuuuuuuuuuuuuuugagacagagucucacucugucgcccaggcuggaguguaguagcaugaucucggcucacugcaaccuccaccucccggccaaaggaccccauucuugaagggcuuuguugugucuccaggcugagcuccucugucagcauucugggaaggugcuccuucagugacucagauccaguuaacucuauggccgguagaugugagaggcaaggcucuccggccaggaugcagagugcuggcaugggcagcaagagaccugaggccaggaguuccaccagccuggccaacauggcaaaaccuaaacuaaaccucaaccuaaacccgggcgugguggugcaugccuguaaucccagcuacuugggaggcugagguacaaaaauccuuugaacccgggaagcagggguugcagugagccgagaucacgccacugcacuccagccugggcgacacagagacuccgucucaaaaaauaaaaaaaggaacaauccuaaaaagugagggugccuaaagcuauguccccgaagugccacugucagugagggccuuuccaaguuuguguucacucauuugcaagcacaaaaagacauuuuuacaaaaauaguaucgcaccuuauauguuguucugccguaugcuuuucucaacaacauucugugucauguaacucugccucuucuuuuucccuugugugaaugaaccauaauuuauuuuaucagccuagaagguguguuauuaacaacuccguucuccuauuucucuagggguccuagcaggaugaagccauuuaaauacaaccauccucagggauucuucagccaucgcugaucucccgcgcagaccguuguuucccccaaggccucacccugagcacugggcuucugcuuucugcucuggcccacaugugacucuugauauucuccaaagacaccagccaauuaaaaagcgucaccugaccaguggccuuugucugugguuccuggcaagguggcuuugcagucuggaagggcaggugggagcugugacacagugugaaaaagcauuuguagagagacuuuuucucagcagccaauaaaagcagaguggaaaaagauuccaauucugcagagagaugcuca

SEQ ID NO: 192210 - RNA, 10283 nt, Homo sapiens
uuacugcauguuuucaaaauauuuuuuaaugugaugaguggucugggaaauccucgccuaacaaaguggcuuuugauucaaggccugaagaaggggagggcccacuccagguagaugacauggccagggcaaaaccugaggccagagugugccuggggauaugagggacguggagggcacccauguccagcccaccucagugcuucugccucagugagaaggggagggaguuggccacaagggggccugggugcaucaaauaggaagccggugagucaagcagcucggggccaguggggcuggagagaugccagagccaggggcuauguguggacuuaggguuuggaaccauuaaagggcucugcgacgggaguggcaggauaugaccuauuuuugagacauugugcugagaacaggccuuaaaggcagaagcacagagccuggcucggggcgcugcaguacugaagccccauaguugaaaauuaucuuccucccagcuccuacccaggcccucucccucuccagaugccuacagcacaccagacaguaggcuccuugcuggcacgaaccacagccuccagcucauggcucucaaaugcagugcagguaugcaugguucucuucugggcauucugggcagggugcccugcaggagccacaguuaacugcagugcaacuaaugagacacugcacaucagggaccacuugccauucaugacugcaggccccaccacagcuccacgaugugggccccacucacaucccauccagggcaggaacgugagccauggggaggcuaagagcagacccagggucacacagugaugaggcuggcacugagggcucccaccucaucacacccugcagcacaccagcaggggcucaacugauccugcaggcacaauugaccuccggaagagccaggccuuggcggggaggggugaaggugggggucagggggcagcauaucugccuggagacauucaguggccagguugggggcagcccaauuuccugaguggaagugggggacacaggcaggcucaggcguuucucugcucuggaggaagguacucaaggcccaggugucugaagaugucuuccucugaagccgcuuggaaaaaugucuucugcaacagaagcaggacuuccgugaccuaggagucuugccacugcugcuucccugcaggaagacugaggguggggaagagcccagcgccgagguggggugugcucuugagggccaggaacuguguguggagacccagauucggguccuauggguuucaggcuggaggggucuggggccauuucagauugugggucagggagcggacuaugggugcuguuugcuguccccaguccccaacaauguaccugcuccgggucaaacagcccauggcuguucagccacaggcccuucuccuuccggcugaagcggcgcagcucccgcuggaaaagcuguagggaagggauuguccucagcagggcuggcccagccccacccccaggcggcccagcggcacacugccuaccuuggagccaguccaaccgagcagggcgaaagggaacuggcugacgggugcaacuaccaaguccacucucacggccuuccaggaugggcagggccucguggauccccccacagcagccccuggagguugugguaggcggaaaaugcagaaacuucucucaaaagcguccauguggcucuguugggccaggcggguaggggacucacagcagcugugcuggugcuggugguacaggaugaggcccuguggggagaggcgggcguggcugagaccauccggugguguggagagagcaggaggcaguggcauuggccagcgguggcucuuggggagcagggaggcccucaccugguccugcaggcggcacaucacucuaggcagcagccccgccuccugacccuccuuggggugggugaugaggaaguccacgucauggcccugcaacuucccccugagggcgucagucugacucugacucagggacacggccugcucacuccagccccaggccacaucccuuccaacgagugggcccgcuucaggguccccgacucaggucccuucacuggggaggggucugaagccaagccagaggggcacgucgggccuucuuaccugcggaagccgccggucagcgugacgguggccccaggcagggccugccccacagcuuccuccaccaccugcugcagggcaucuacaucggaccgcaggacuggggugcucagguccugguggugcuggagcccugggggcaacaccggcccuccugacucacccagccugcccaccacaccgagcccccaucccucaccagcaugaggugaucaaccuggggccccgucauugcaggaccaggagaggccuccgaggaaggugaggcuagggcagggagcagagugagaucccaaucuaagccugacacuaucuucucucccccuuuaaauuuuaaacuuuuauuuugagacaguuguagauucacucgcaguuaaaagaaauagcacagagggagaucccaugugccuuuuacccagcucccccaaaagguuaaccccuuacaaaacuauaauuuugcaaccaaauauaaggauacugauguugauacagucaugccacaggcuaucucuuuugauggcuguuuuuccuuaugcauaaagugggaccaagaggugguaaaaggauggaagauggcuuugccaugacgaacaccucacucuggccuacuucuguuuccucaccuaucagccucccacacgcaguuaaggagagguuuauuuauuuauuugagauggagucucgcucuuguugcccagguuggagggcaguggcgcaaucugagcuuacugcaaccuccaccucccagguucaagugauucuccugccucagccucccgaguagcugagauuacgggugucugccaccacacccagcuaauuuuuuauuuuuaguagagacaggguuucgccacguuggccaggcuggucuugaacuccuaaccucaggugauccacccgccucggccucucaaagugcugggacuacauaaagaugugagucauggcacccagcuaaggagagguuuaaaugugaggaacagcagcaccuggcacagugagcucucaguaaacgcugcuaaccauuccugacuacucuugccauggggagaggcgaucaagaggaaccagcucugcgggucucaccuccugucagcugaacugggcaguggcccgggggaagaugugcgaagaggcaguggagcuggcagugccugcugggcuguggggauugcuucagcagagcccucaacccaagggaggucccagaugguguggccagaguagccaggcaggccaugcagagagaacagaguaucugcucaacaccugccacuugccggcucucacaggggagccuacgaauucauuccuucccaccuuuuuuuuuuuuuuuuuuugagauagggucuugcucugucacucaggcuggagugcaguggcucaaucucagcucauugcaacuuccaccuuggccucaaggcuugaccucccgggcucgagcgauccuuguaccucggccucaugaguagcugguacuacgggcauccaccaucacgccuggcuaacucuuguauuucucguagagacaggguuucacccuguugcccagacuggucuugaacugcugagcucaagcgaucuacccaccuugaccucccaaagugcugggauuacaggugugagucaccaugcccagccuuccuucuccauuuuacagaaaauguaacagacucagagagguuauuucuugggcaauggucaccuaccuggcaaaugguagauaagacucaaacccaggccuaacaaacuugaaagcugauguucuuucugcugcucagugccaccucugcaggccuccauguaccaagcaccacacugggcagugugcccaaggcccaggcugucccuggucacuggucaaagucuaaccaguaggcagacacaagccccuggcauaucauggaaguugcuguggucagcaucguccacugagaaaaggcuuugauagauccugacugcacuggguggagaccccaggaagcccaccacacaaagcugccaccaaacccucugcaccagacugcucccuucccucuagggaguugaugcugagggauccagggugcaguuuagggaagcccagggcccagccucucuggagggcucacccgcuuucugcuguuggguuaguuucuggggcugcucucggaggucaucuaagguucgcaguccuucccgguaccaccggucagcagucuucacaccgaccccgaagaucugggugaagagcuguggggaaggagcguagcccgguugggcagagcucucauggcuagacucggaugaucacccgcuccgggacgguguggcccauggagcaccaugcaccaggcaggcgccguccccacucgcaaccugccguagaccacagggcaaggauucaaaccuggagccugacuacccagccugccgucucugggaacaaacccacgcacaccccucuccucuccucuaugaaagggacuuacacagcucuagccugugauuccaacauaaucaaaacagucacccuaacacaucagcacgaggggcuccuaagucacuggaaaaaccaugccucucccaccuaacagaagguggaacaaauuucugugguucuccuccuuagccaacagcaaaaaacaaugaggaguuaacaaucaaaaggguggauuuaggagcagaguuggcagggcuggcuggggugcucacauaucuucccacagagggugggccccagcccaagcaagucaccugcuucaggucagccacuagagucccucccuaggaauucuggaucugagacugagggcaggcccacacaguggcagaagcuguagccuguggcagccgagcaccuuuuguggccacauuuccaaccgauggaagaagcuggugcgucgcaagagagggcgaagccaccgugcagaggggcagaggggaggaggaguggccuggugauacccaggucgcugagcccaguuguccugcagaccggccacagcccuccccauccugggcucugcuggcccuccuuuccuuuauuuugugaaccaacgguguggggugggucacugucacuugcaacccaaagaauccugacuaaaaaugaugagauuaacccaauuauauuguuaauaaacuucucauuacuaauguaauuuucugccagccuagaugccuucagggcuggggcugaggcugacagugaaaguacucacuaaccucacaccacuucaaggggauuucaucaucuucaggccccucacucccacacucaccacgguggccccacucaucugguccccugucccugccagugccccuugcccccuucccugcauauuugagcccauuugcccugcacacacugcucaagucucuccucuucgaagcccucccugucaauccugacaacauucugugugaccucccaaggccccauccacccaggaagccacacuucacugacaguuauccauguggccaccgcugugacaccuccagccacaaagccaguuggcagaagggugucaaagcaggcacacccgaggcauccaaaagaacucagacggcauuucccuaucagaccaggagugagcagaaacagagggaagguggccauggaaacaggcaggcugacaacacugagaaaauaacacauaagguccugcagaaggcgggcaagggcaagcccagcaugcucaguggcagcacccaaggguacauuugguucacagugcucuguuuaagaugccacagcauguaaucuacuugagaauauuccaucaaaaacagucaaggcagagcgaaguggcucaugccuauaaucccagcauuuuggggaccaaggcaggagaaucauuugagcauagggguuugagaccagcuuaggcaacauuaccaagaccccaucuuuacgagaaagauuuaaaaauuaaccuggugugguggcacaugccuguagucccagcuacuccagagacugaggugggaggaugguuugagcccaggaagucaaggcugccgugagcugugaucgcaccacuguacuccagccugggcgacagagcgagacccugucucaaaaacaaaauaaaacaaaaagccccaaaagccagauggugcugagugaucuagaaaauucuguccucaaaacaagcuucuuccuugccugucuccacuuggcugccuugugcauaucagguaucagcuuagcugccacuuccucggcaagaccuucucugaccccugggcugggucagcugccccuguuugccuccccgugcaugguguggacuguguugucauucccagggcaggacauuccugggguagguccgagcccugcccugcgcaccuucauggucugguaccucucugagcgccgaacucucuccaccuccucacacacuccaugcuccagcagcuccugggggagggaacaaagcagaacucuaagccugagggcgugggaagaaagagaagggcggggaguuagggucagggcugggggcccaaggacugaggcaguccccuccaacacccggcagagacaacuuugugaggucaggguccaguaggaccuggaaauggagacugugcccagggaggugaccaaaguugcugccacacagcugggaggucagggcuccagccucaaagcuccuucgggccuggaguuacagcagcugagaugccagguaacguggaucaucucucagucaaauaagucccaagauacauaaacaauugcuuuucagaacaugugaacucaauacuacuucauuuaaaagcaucuucugucacuguguauucuugcaaugaaagugcacuaaaggacaacuaaacacacuggggcacugaaaagagaugcucacacucagggugcucucuuucauuccacuguggagggcaguuugggacuaaugacaaugacaacagugucaccccuagcccugccaggccccucacagcgccauucacuggguccucuaggccacccaggaguaaauggcuagugugcacaggaggaaucugagcgcagaggguggcuuguugaggccuuggagcagugucagcacccacgacugucuguccucacccacccccacagcacccucugcugucucaccaggccccaaggccuccccacccacccacucacccugcuaggaugguaagcaccuaccuggacaacccuagaggaguguucuccaaaguggggaagccccugcagcuggcucaggguugugacagggcugggaagggccuugagcaccgaggcugcucugcagaaggugaggaggcggcccucacugccuucaaagccugcugccucggccaguaucuccagagccuccugcagggaggggcccuagguaaggggcagggugggcagcuccaaucccccaccuaccacccaucuguacccuuguccccaacccccagggcuggccaaggcucauagaagcggcuuacggagaggccaguguuguggugugugaggggcguagggcgcuggcaggcauaggcaggcauccaugcugggcucagaggccccuuccuuggcccagccaccuggggaugggcaauaaacaggucacugugaggcugcagggcuggcaggagagccaggccguacucaggcuuuguuucuccugggguguccaacucgggcccucuggagcucaugggacagaggugggcaacaaaacaccagcggcaugaggcugagggaggcaccgcccugcagaacaggcugugcauggggcuccucaugccaggguagcagcaaucacaucugccagcccugugggcacuucuccugcugcugcacaugaugcauguacuccaucaccccaauccucacaaccaagcgggcuggggaugcugaggccuuggaggcuaggggcuugccccacaaccauggcucacaggcugggccaggauuugaaggcaggcaaccuggccccaagcccacaccugucagaggccgggagccuuauagcauccagaggacaggcuccugcuaacccaugggucaucccgcucggaguugcugugucaucuacuuggugaggaagaaaggccugaagaagguaaaaauaagcagaccccagaauuugcaucaguggugagaacagaagcugagauggccuggcccccucagccccuucugugguuccucuacugguuuauagggggccccuggugaucuggguagagucuucacugcccaccuccucugaaggacauugaggcauugcugccaugucaccugucccagcugagcaauggccuacacuggggcuuucacuguagcccccacuuuagucuuccacccagcucaccuccaggcggugccggcacuccacagguacaggcugcccagcucccaggcucucuguuaaccagcuuauguccagcagagcugggggggugcaacccgggggagcagcugccauccugcgcuccugccagcugacggccuccucugcugaggucucuuccaucacaacaugugucgcuucggagcugguggagggaguugggagagaaggaggagggugaggcccagagcccguccugguuggcuccaagccuucacucuugccgucccuucugcaugguaagugaccauucauccugcaaacgucaccuccuccagaaagccuucccagccccuccuccugguagaugaacaccuccaccacucagcccucagaaccguaguucucugcccuggcuauguucacaagcacagcccagucuugugcucucucccucccucuucaccucaaagaaaggaauuccuuagggucaggaccagguggucuucaucuaagagcaaggguuucagcagagauggaggagccuguuugggucugaaccccagcucugccugccacauacuuguuuggcucuugggcaagccacgugucuauacuuugauuuccucuucuguaaagcagagauaacauauccacccugugggguuguuguacaaagauagugccuuguacacucuaagcugcuaucauccucuccugagugggucuggcgcacuacugaucccugguaauguuaaaaaaucaaacacaacugugggggaauacuagccccagguucguuugcucucucaaccuccaaacuagggggcacccccagcucccuuacucuggguguugucucuguagccgccauuuuuucuucucuugguucccuuccuacaagagcuucucagucguguuauuuacucaggccugaggacagaggagccugcgggcuccgggccucuugagaagucagucucgcucacaggugggacauagcccaggcagaagggcuguuagcaaauacgacuuuuuuuuuuuuuuuuuuugagacagagucucacucugucgcccaggcuggagugcaguggcgcgaucucggcucacugcaagcuccgccucccagguucaugccauucuccugccucagccucccgaguagcugggacuacaggugcccgccaccaccuccgguuaauuuuuuguauuuuuaguagagacgggguuucaccguguuagccaggauggucucgaucuccugaccucgugaucugcccgccucggccucccaaagugcugggauuacaggcgugagccaccgcgcccggccuacugcuuauuaauuaccccugaccucugguuuugauucucgcagugauccuuuaaaacacgccucgcccuaauuaauagcacccuuuacagaagaggagauggaggcucagggaaaggucacaagaccacgaagugccacugcaaacuuagaauccaaaaccagaagugccauggaagcccucgccgcgccgcgccgccccgcaccugcaggcgucaaggacgcggaagccuuuggagcgcgccaggccugugaggaaggcccggcggcugcgacccaugcgaggcucgaccagguagauggcgacucccgggaagcgcgucgagggcggcguggaggaagcggcaucgccgcuaggggacccgacccgcgcucgccgccguuuggggagcauugggacgacagccuccagcagcgcggagcgaacgcagagggaaacuccgagcgagacggaaggaagccccagugaggcugacggaagcgggu

SEQ ID NO: 192211 - RNA, 108421 nt, Homo sapiens
caaagcccguggggcagcugggucuggggaaaacagcccggggccgcgggggccgaacgagcacggaccggaaguuccgcagccgcgccguccggcggagccguuggcugcggacgccggaaguggccagucggcaggucugaggcggcgcugugugugugaagcguaccuagggcgggaggcgacauggagacaggggcggccgagcuguaugaccaggcccuuuugggcauccugcagcacgugggcaacguccaggauuuccugcgcguucucuuuggcuuccucuaccgcaagacagacuucuaucgcuugcugcgccacccaucggaccgcaugggcuucccgcccggggccgcgcaggccuuggugcugcaggugaggcgggcgggccugcggucuggggagccgccgcccccggccugcccugacuccuggcgcccgcuccuccaagcucucccagccuguuuccuccuuuuccugguguccugggguugagcuugugagaauggcuucaguaauuugaagcgcggauuggaugucagcuuauuccgcugagguguucgcuccggacguccugagguuucagaaguaguaagccgacuguuaagagcccuacucagcacccgccagcgcguaccccucacggugcugggggccgcuagucagggagcgaaauccaugcaggccagacagaaggaaggacauuuacagcaacagaaacgugcaugccccagaacuaccaaagacuugagcuggcggggaugacggaggcauuguguugaucaauggguguggucgcuuguuugaaaugugacuucccaggucaaagacugucaauguagugcuuauuaaaauuucuauuugagcuuaauuccguacccuccagguuaaguuuauuguauguuggaaacgcugucaauacucauucagugaaguugacugggcacuuuugaauguagugguaagcaaccuuuugcugaauguaguuuacacucuuaguugccgcaggugagggugauacggguguuuaaguaaugguuucucucuccuugugacacaguuaaagagagaaaacccagaaaguaauagaaaacuuuuuaagggcaauuauuugauggagcccauuguaaagaaaggaaauagaaaugaugguugagaagugaaguuuuuauaagagaggugggacuucugaugagauuaaaagaaacuauucagccaaguauuaagccuauuuguagaaacccaagaagauagaaaugcugaugauaccucccucaguucucuagauguuacaguuuauaaaaugcuucagauguuuccuccugaagucuuaaugcaugcugcagguugguaagauguuacuuuccucagcagaagccaaagcuuugaaugucuugguagcuaccaggguaauagggccaaacgaggaaugggguuccauuaggauucaauuucagaacuuaaggcuauuccucguccuugucaguggcauaagugccaucuuagugaugagagagcuguuggagguggccuuuagcaggaucuuauggcagguuaaugaagucuugccauuugaucuucagugucucugugaaacagauaaguuucaaguuuacguaccaauucagcaagguuaagugauuugaccaagaacacacagccaguucaccguagagcugaaacuaaaaauuucauuuuguggauuccaaaucuuccuguucuguuguuuaaccauuccauaguaggaugagaacacuuuugucuagauugauuguaguuugcagaaagauguggaggagaaaggaguauauacugaguaauauguauaguaucagauguuuuauauucuggggucguuaucuuauuuaacccuuaauauaaccugagagguuggucuuuguuucacagaugaacugacagagcacucauuaaccugguaacucauuuaccugguaacaccucuuacaagacacuuccauagguuaggauuuggugaccagucuaaugaaguaguggagauggggagcagggauggaggaaggggagggaugggucaaagaugauccaagguuucaacuugggugacuggaauagugauaaugcguuaacugaacugucaccuggguuuaggggaaaaaguucaguuuuagacagguugaacuugaaguugcagguaggagucccugcccauaggcuauuggaauuacuggacuagaucuuuugggagcuagagcaacuggagugguccgagggagagagaagagccaaaggugaagaacaggccuuggggaauaaucuugguggagagcaauaaguuucacagaaaccaaggggacaacagucuccagcagaugcuuaagagaggugucauguuuucuggaagugguucucaaccaucagcaucgcuuaaggaacuuuuuucuuucuuuuuuuuuuuuuuuuuuuccuggagauggagucucacucugucgcccaggcuggagugcaguggcaugaucucagcucacugcaaccuccgccuccuggguucaagcaauucuccugccucagccucucgaguagcugggacugcaggugugcgccaccacgcccggcugauuuuuguauuuuuaguagagaugggguuucaucauguuggcgagacuggucucaaacuccugaccuuguguucugccugccucggccuccuaaagugcuaggauuacaggugugagccacugcgccuggccaaggaacuuuuaaaagcacauauuccuggauauuuugguuggguagaucagggugaauccugggaaccuguucuuuuuuuuauuuuuuuauuuuuuauuuuugagauggagucucauucuguuguccaggcuggagugcaguggcgcaaucuuggcucacugcaccuccuccucccagguucaagugauucuccugccucagccucccgaguagcuggguuuacaggcauguaccaccaugccuagagaauuuuuguauuuuuaguaguagaaaugggguuucaccguguuggccaggcuggucuugaacuccugaccucaggugaucacccgccucagccucccaaagugcugggauuacagacaugagcuacugcaccuggcuggaaccuguucuuuuauccacaaaagcucauuugacaggagguuuguaaaggugauuucaguauugacaaggguuuuauuguggggugggacaacacugaaugagacugagugacuugguaccagcauaacauuauuucuucgugguaguaggugaucuccugaccuccccacuccuacucaucugccucuuaggguuuuuuuuuuuuucugucccuaacuugauggcauaagacuccuuccuggggucugccucuccacccccaccagaugugggaugcuuggugucucugcugaauauaggcagagaagaauuuggaugggagugcugggcugcaucauuguggaacuucaaagcguucccuuaauauuuuggggaguacaguguugguguagaguuaggcagcucauacguuuccuuuuaaaaguuugcauagccuggauacacagcuugaagaaccucagcaggaaugauguaugugaaaauugcauuccauuuuauaauacauuaguauguuuuaagacaaaaaucguuuagacugacaagccauucauuauaaucgauaaugcuguuuuuuuuggaguccacuuugagaagugcuccuuuguagaaguccuugaaacuagaaucaggaaagcuagcuacauccuguuccuuacauaaauuguugagaaaucuugggagagucacuucaccucuugucagcugagaagauugauuggagguuacagauuagaguucucuuccagcccuauguucugugacucuagaaugaguacugagaacaugugauaguugggagguuggcagugguagcacuuccugguggugugaauggguaggucagagaaggcuggauguacugagugagcagaggcagcugcauggugaggacuaucaagucuggggguucuguguucgaagucucagguguuaggagagagagaucuuguugcuuugcuuuuguggaguuaagaugaagaucuggaguaucagcaggaugagcaacucugaaagcauggacucaaagcgguagagacccuaauguuagaaugaagucagggcuucagguuaucugcagaaguaaaaaugguucugguguuguuuccaguuuuuaaccuuuuaggauuuuauugauuuuuuuuuuuccccucugccuacaucaucaucuccccacacuguuuggugugugcugcguaguuuuuuacuucuuuugccagcaggagcuggggcaaguuacguaaccuuuccaagccuuauuuuuuucucauuuuugaaauguugaugcugucuucuucacaguauuuuugugaggguuuugagagaauguuuguaaaauaauuugacacaguuagucuguuagcacccuuuugacugcccgcgcagugcacagaacauuguuauuuaauaccuguccgcauucuagcccuuuggaaucugacucccacccaugucccagguugcugucucagccuuuccuuccuccaguuauugcaagagcuuuugcccuuccuugacaagccuauucuuagagcuguggcauuuccuccagugguucccuguggaagaugugccucucauucagggucuaacugggauccuccuuguuccaagaagucucccuagauuucuuucgccagacaugcucauucccacccauacccugacagggaauugagggccuugucaugcccccucuuguaucagaguuuucauguguggguaugucuugacuguacuuuuuugguagagaggucccagcaccuucaugggugugacuguuucccagaaaauguuaagaacuuguuuacacaccagaauuuugaguucuuaggaggcagcagaaaucauuuugauguuuuuugugcgugcguguuucuugcacacuguaggcgcauaguagauguuuguugaauugaauguccaugcaguguggugaaaaacagcagcaguccuguaaaccugguuccauuuugggaauugaaguucagccauauuuucauguuucauuugugagucugaauuuuggugccuuuauaacccacaguuguaccaggaccguguauucuuugcauugugaacaagacuggggucuguaaaauaaugacaacaaagaccaucuaacuguacaucuuuuagguauguaaauauuguuagccuuggcuuauaaguuucugauuuuguugauuuuggaauccuccuguuaaacacuguuuaccugucagcuuuuggugaaguggcagugcauuuccauuuugccagugggaaaacuugucaguuucugacuuuuaguucucuccuucacagauuuuacgacauuucuacaagauaugugguacaguauugggcagaugaacugauugcuggauugguguuugauuuuagguauucaaaaccuuugaccacauggcccgucaggaugaugagaagagaaggcaggaacuugaagagaaaaucagaagaaaggaagaggaagaggccaagacugugucagcugcugcagcugagaaggagccagucccaguuccaguccaggaaauagagauugacuccaccacagaauuggaugggcaucaggaaguagagaaagugcagccuccaggcccugugaaggaaauggcccaugguucacaggaggcagaagcuccaggagcaguugcuggugcugcugaagucccuagggaaccaccaauucuucccaggugggaauuucuacuuugcagcuuccuucuuucuugcguaacaucugguguuuggguuucuccauaauuuauucuuacuuuguaacacauuaauucuugaucucaguauuuauuuagcucuucauguuuguaaacugcugcauuacagucuuucaguuauguaggaugggaggucaguuggcuuaaggucaguucccucauuugguaaggucaguagucauacaaccauuugagauccagagccaaaauuagagcacuugacuccucucacaaagaccuaacuuuaucuguguuuagaggcuuagccucagcagcucgauuguuuguguuuuucucucugcaggagcacugcuaggauuugcucaugaugccugagguauaauggacaccugaaaugacagucuguuuuaggugacuggauucacauccucgcuaugccgcuuccugaauguauuaccuugaacaagcaguauaaccuuucugugucucaguuuucuucucuauaaaauguaggugauaauaauaguaccugucucauagagcuguugugaauuuuaaaugagccgauagucaagcagcuaaugagcaguagagcuugaauaugacaugagguuucccugaaucaagccucuugcuuuauguacuuguacucacuuuuuaggaguuauguuuugugggugcucuaaacuuaguuauacaguccuuccuuacagucugagugagaggagcugaucccuucuugugugggaguuguaguagugucugcaagacagccacgagccuccuggccugcuuuguuuuuuuggaaaauucacucucuucccuccuugauaggaugggucaccugugugcccccaaaucccugccaccuugaguucucuucuguuuuucucacuccuuuacucucuuucugacguguuuugggggagauugugugugugcgugcacacuuuuuaauagagaccggaucuuacucuguuggccaggcuggagugcaguggugugaucauagcgcaauauaugaauugaacucuugggcuccagcaauccucucgccucagccuccugaguagcugggaccauaggcaugcaccaccacaucugguuaauuuuguaauuuuuuguagagaugucugccacuauaccuggcuaaauuuuaaaaauauuuucuugcuguauugccuaggcugugggggaguuuuuguuuuuuuuucuaguuaaugaagcaaagugaacaacuuggaauggcuuauaaaauauggaguaagagaaaauaaguuuuguaaagacaggaggggcaagauugcagagucuuaaaguccaggcuaacuaauggaguucgaagaaaacaauuguuugauggcagaaccaagcugauggagaaggggagcagcucuugaauauggagcucuggaugagaaggggugaaauaaggauuuagagauuggaaguggggaguauaggguggaaggcagacaucugauauuuccuugcagaucuuuuuaaaauauuuuuuauagugcagaucugcugauagugaauucuuucagcuuuuuugucugaaaaugccuuuauuucaucuuccauuucugaggauauuuuugcuggauauagaauugcagguugacacuuuuuuuuuguuuuuguuuuucuucaaacauuuuaaagacuaucauuccauugucuucuagcuugcacugucucugaugagaagugaguagacauucuuuguuccccugugugugaaauauccccauucucuuguuauaucaguuccuugaaguuauuaucauuaguuugagcaauuugauuaagauuuacucaugcaugauaguccuuguguuuauacuauugggagacuuuugagcacacacacacauacacacacacacacacacacuuaggaggucuguuuucucuuuguccuuccuuuggaauauuuucuguugaccugucuucaacuuuacugucuuuucuccuuuggugucuaaucuguaguuaaacucaucuaguaacuucuuaauuucagauaguuuauuuuuuagcccugcagguuccccuugauuguuuuuuauggcuucaauuucuaccuugguuuuccuuuaaauccuucaauauacuuacaauaguuuaaagucuuuaucugcuaauuccauuaucucugugauuucuugguuuguuucuagggauugaguuuucuccugauuuuggguuacauuuucuuuuucuuucaaaugucugauaauuuuuuauuggaugcuagacauuaauggauguuaugcugucgagucucuggguuuugauuucuucuguugaguguugaguuuuguucuugcaggcaauuaauuuauuugcugaucagaaugaucuuuuugaagcuuguuuuuuauuuguauugauugaucaauugauuguagagauggagucuuaauauguuacccaggcuaaucucgaacuccuggucccaaaugaucuucccaccuuugcuuaccaaagugcugggauuauaggugugcaccaaugugucuggccuuguuuuucagcuuuguuaagcuguaucuaggguacuuuuauuuuaaagcuagcuuagucuucuaagacaugccuuuuuggggcuucugagugcuccagcuguuagugaggucuuuccauucugacugguugaggcuugaacgucucccagcucuagggauuguccaugucaguuacccagguuuccuacuugucucauggaguugcacuuuacacaugugcaguuuuguauucagccaaagacucaaggggauccuaugagguuuuuuggaguucuuucuaugcgcagccuccuuacuaguagucuuucuguaaaauaaucagauguaagaaugaagauuuaauauacaaaguuguuugucauaguccacuuaggcugcuauaacaaaauaauauagccuggguggcuuauagacuacauaaauuuauugcucacaguucuggauacuggaagucuaaggucaagguacuggcagauucagugucuggugagggcccacauucugauucguaguuaccuugcuguguccucaaaugguggaagaggugagagaacucucucaaaucuuuuaugagggcacuaauuccagucaugaaggcagagcccugaucaccucccaaaguacucaucccaauaucuugggauuaagauuuaccguaggaauuuugggacacaaacauucagucuauagcauuguucacuucaguucuauuuauuccaacauuacuuauauuagcaaaauuuuggaagaaugcugaauuucuguaguaagggaauggagaaauacauuuauaaaaugcuuuuaaagacuacugacaugguuauugugauggucaguuucauuugucaguuuggcuaaguuacaguccugguuauucagucaaacacucaucuuggcauggcugucaagguauuuuguggaugugaugcaaguuaauaauugguugacuuuaaguaagggugauuguccuaggugaucugagugggccugaucuaucagcugaaagccugaagagcgcagcagagcuccccugaaguagaagaaauuucuccgauggacagcagcugcacucaguuucuggagaguuccacauuggccugcuauguggauuucagacuggccuagccagcccccacaaucauguaagccaauuucuugcaguaacucucuuaauaaauacacuuaucccuugguaucugcaggggauugguuccuggucccucguggauaccaaaauucauggaugucuaggucucuuauauaaaacaguauaauauuuguguauaaccuaugcacauucucccauagacuuuaaauuaugucuagauuacuuacaaucccuaauacaauguaaaugcuauguaaauaguuguuacacuguauuauuuggggaauaaugacaagaaguuuguacauguucagcacagacaaaacaauccauuuuuuuuuuuuuucaaauuuuuggauuuuuuuuuuuuuuuuuuuuuuuuuugauacugggucuugcucuguugcccauacuggaaugcagugacaugaucuuggcucacugcagccucugccuucugagcucaagcgagccucccaccucagccucccaaguagcugggacuacaggcgugcaccaccuugcccagcugauuuuuguauuuuuuguagagauagggucuuaccauguugcccaggcuggugucgaacuggugagcucaagugauccacucgccucagccucguaaagugcugggauuauaggugugaggcaccaugccuggccauuuuuugggaauauuuuugauccucagcaaauauuuugguaaauauuuuuugggaauauuuugauuugggcuauggaacccauggauagcgagggcugacuauaucugcugcuucuguuucuuugguggaaccuugacuuauacagauauuuucaugauauaauguuaagugagaaggggagaauucaaacuauauagucuaauaucaaauuugaaaacuuuaaaaauuauguauguagaaaaaaagcuggaagaaaauaguaguaguaaucacagagugguggaauugugaguguucuucauuuuuaucuuugucccuuacuauauuuucuaauuuuucuguaaugaccauuuauuuuguuuuauuaauuuuuuuguauuccuuuuaugaucucuaaaaaaugaaaggaggguauugguuuugauuucugaguaauagacuagaauagcuacuuuguuguuuuguagagacccuauuuuaaaauucuugaaccagugaauuuuguucuggguuagaauuagaguuaguuuugugaguucuaccuuaaaaauaaguauagagugaagacuuggauauguuucaggaaagcuaaccuuucuacuugguagcucuuuguucagaauagacugguaccgcaagaauccuaaucaaaccuuuccaaggacuggaacauucucagcuucaguuacuuguuuuccuugaacaaaacaggaaguuguggcaccgaucucuaguuauaccugaaauguaguguuuuagcagauuugaaaauagaaugugaaagaccauccuuuuccuuguucuaccuuuagcugcaccccaaguccucccaccaguguucaggaugguuuauccuauaaauuauagaucugcaguucuuuuaauugaguaauuuaagguaguuauucuguagaagaccacacagaagcaccaucuuuugugagcacucugucuaaaaucugagaaucuaagucuuagauugcugauaucugaugacucuuacuugacauguuuuucgguucuaaccaguauuaggcaaaaacucccuuuuuguauacuacaguaaagucacaucacaugcuuauuuaauuuaaauaaauucaguguaagugcugggaaagaaagaaacaagauuaaaaauaauguauuuauauuuuguauauauguauuuugaauuuuauuuuuuuagagacaggaucuugcuguguuuuucaggcugaacucgaacuucugggcucaaguacuccuccugccucuauauaugcauuuuuguuguaagguguucauuacuguauacagacaauuguuuuguguuuuaguaaaguauaauuuauguaacaauacaauucauuccuuuuagaauacaguuuaugacuuuggacaaauguagucuuguaaccaccacagucaagauagaugaccaguaugguuuggcuguguccccacccaaaucucaucuugaauugcaguucccauaauccucacaugucaugggagggacccggugggaggcagugaaucaugggggcaguuauauccaugugguucucgugauagugaguucucauagacgguuuuauaagggacuuuucccgcuuugcuuggcacgucuuccugcugguaugugaagaaggauguguuuacuuccccuucugucaugauuguaaguuuucugaggccuccccagccaugcugaacugcgagucaauuaaaccucuuuucuuuauaaauuaccccaucuuggguauguccuuauagcagcaugagaauggacuaauacaaugacauuuccauuggugccagacucccagauccuggcaaccuugugccuguguucugcccuaaagcuguugcagcauacauuguuauuuauacauaauaauguacagguuucauuuauaguauuuuuggggugauuugggggaaauuuuauuuugaccuaauuuuaccaucacucugauuuuagcaucucccugacuaauaaccuacaauuggucugaauuucauucuuguuucugcccuacuguugcugccagggcaugucaaaugaagaucagaaaugcccccaccccagggcuuaaaggaaccuaucuuuuucuuuuuuuagacggaguuuugcucuuguugcccaggcuggagugcaauggcaugaucucggcuuacugcaacuuccaccucccagguucaagcgauucuccugccuuagccuugcaaguagcugggagugcaggugccugccaccaugccuggcuaauuuuuguauuuuuuuaguagagacaggguuucaccauguuggccauacuggucugaaacuccugaccuugggugauccacccaucucggucucccaaagugcuggaauuacaggcgugagccaccgcgcccggcccaaaguaaauaacccaucuuauuccucagagaagagagagaauuugcacacagauauuucccuauuugcacaagauagcaucagagaaugugcuuauauucuguaaggaugcuuuacaauuuuaauaguuguucaggcugggugugguggcucaugccuguaaucucagcacuguuagaggccgaggccggcugaucauuugaagucaggaguuugagacaagccucaccaacauggugaaacucugucucuauaaaaauacaaaaaauuaaccaggugugguggugcgugccuguaaucucagcuacacaggaggcugaggcagcagaauugcaugaacccgggagguggagguugcagugaguugagauugugccacugcacuccagccugggcgacagagcagagcgagacuccaucuaaaaaaaaaaaaaaaaaaaaaaaaagaauuguucauaguaaagacuuuguaaaaagugaaaaagugccauuugagccucaguguuuauguaauacuagacugggugaccagugccugcagacaugauuagcacuguggaagagaggggcgcaaagucugcagcaucuuaugacguagucacuaaucaggcauuucucaagagcugccuguuaggguuugccucuuggaugaccucacgguaggguuugguguugguuuccugggcaugggccgucagugucaacuuucauagcaccugcaguucaggcucuugaccugcagguguugcuguagacagugggauggugacuuugccuuugcuugugcugggaugcugacaaaaaucucugaaaggcugugucaguccugggcuuuuccuuuuaaaaaucacgagcagaauucuuuaacagagaagaaggaaaauaugguagcacuaagaaugucaguuacugccuagaaacuguugucuuuguccuuugugcuuggacugguuaucuuuuuguccuuuggaugaggaacagagugcuccaacacuguuggugugcauugggcagugacagggcccuggguccaacuaggccauuccuccugcccugggcagggaagcagaguagugacaguguacaaagagggugucauggaacaaucuaacauauuaaccccuucuaggacaagcccguuagaacauaauaccugagaaaacuguucaguacuuucucuugcuuuggguaguguggccuuugugcgcaguuacagggaccucggugcuucuugggaagggaauggcaucauuuggaagauaaauuucagguuuccuaauaguguccuuggcagauacuucaucaucaucaucaggcugcucccuccugacuuggucuccguagguaugggcacucuucacuuuucucaucagcaaagucuuuuccaguaguucaucccuccgcuuuccccagcagguaaccaugccuccuuggaguuugcacuucauuuuacguuauuccuuuauggcuggcugugcccacauuuucagugauuaggggcagagacuuacucagccuuucucacuuccuggugcugugugagaugacccccccagugcaugccgaauuccauuucuuaguaccucuucuuugguuuugcuuacuguuuucgcucagucuguuauaacaaaaauacuguagccuggguggcuuauaaacaacagacauuuauugcugacagccucuauaggaggcuagaaguccaagaucaaggugccagcagguucaguggugagggcccacuuccugguucauagaccucugucuucucaucgagcugucacauggugaaaggggcaaaugaacucccuuaggccuguuuuauaaggccacuacucauauucacgagggaucugcccuuaugaccuaaucgucucccaaaggccccaccuccaaauaacauuacuuuggagguuaggucuuuaacaugaauuuuggagggacacaaacauuccuucuauagcacucacacaccuaucaugacaucuguggcucuugaugucccucgggugggcugucaggagaauagaaaggugccugugcuucaggccugagacuucuuuccguguguaggcucacacugccugagaaauuuggguuccuuguuucgucuuuaaacagcuucuuccuuuacuagucgaggcuuuuucaggugcccauugcaggagaccccuuuguagagucacgggggcuuaaucagaauccccuucucuccauauacccaaccccguagacuguggugaggauugaaugagaccuacuuagcaugauuccugacagagugugcacucaaguagauacuagcuauuaucguuacuauuauuucucuuaaaaaagaaaaagcuuuucauuuuucuuucugauuauacucaauguacaauauuuggaaaauacagaugaguauauaaagaaaaucccuucacuuccuauuaacuuuuugggauauuuucuauggcuuuucuuuucuuuccuucuuucuuuuccucuucccuuuucuuuuuugagacauagucuuacucuguugcccaggcuggaauauaguggagcacggugcaauuguagcucagugcaaccucgacuuccugggcucaagcugucuuccuaccucagccuccugaguagcugagaucacggauguguaccaccaugccuggcuaauuuuuaaaaaauuuuuuguagagacgagacucccuguguugcccaggcuggucucaaacuccugggcuuaagagauccuccugccucagccucucaaagugcuggaauuacaggcaugagugucuguauccagccuguuuuuuucuuaugcauguaaacauauacauaaauacauguauguauauuuauaaaauuuuauuacacuuuaucuucuuuuaugcugaacagaguauccuuagcauuuccugcaugccuuuugcugauuuugaauuugugauguagaccagccuggccaguauggugacagccugucucuacuaaaaauacaaaaauuagcugagugugguggugcaugccuguagucccagcuacucgggaagcugaggcagaagaauugcuugaaccuaggaggcggggguugcagugagcugagaucaugccacugcacuccagcuggagugacagagcgagacuucgucucaaaaaaaaaaaaaaaaagaaaugaauuugugauguacacuguugaguguugucuaccugaaguggcucuuguccuuggaugagggcauaugcugcauaguaugcacugagagagaauaaugaauagaaagccagggguugagggaugucugucuguuuccccucagauucagcuaucuguggaccccaccuggggauugagccuuaggccaccuggcucagugucaucuugugucauagcugcuauuucaccuuuccagugauucacccugaaacugcaccuucuuuaagaaagcucaggcauaagaagccuccaagcgauuugacuuaaaucacaagucaggaaaaccugauuuaaguuguuaggaggacuuuuaaaaaauucucacaagaaacauugcauuuuuauuuuuuauuuugcaguuuauuuuuauuuugcagugaagguuauaugcuucauuuuuagaaagcaguguugaguuugcuggauauugaaguuauaucagaaaauaaccugguaucuuaacguuuucagaguuggauggguucagggagcauguggucagggaggaggaagaggaguguuagaaucaucuguggaguuuuuccccuggaaaaauguguauuuccaaaaauugagaaccagugaucugcuuccuuuuuacaggugaagaaauugagauguacaauggucaagugcuuugcuuaaaaucauacauuuagaagguagggccagagaguuauugggaauugaagcagaacuaccucguggacuaacugaggauuuauuugcauugauguguuagaaaaaagcaacuaauuacccuacuaucugagagauacuuuuuaaaaacuagccaauuucuuuuaaaauaaccaacuucuauuugaauauuuuucuauaauaauaguucuucuuuuuaugcuagcuugguuuuuuuuuuuuuugauguuggaaagguaauauauguacuucacaaaauguuuauuagguagaauuugaaauacaaaagacaguagacagaagaacaugacuccucaugugcucauugcccaguuccaacagcagccugcuuuucucccuccugguuuauuuugaaacaaauucugccuuguaucauuucaucuguaaauauuuucagccacuguuuaaacuuccaguuuucuuauaguguccuaauuaaaagaaaguuuuguuugaaucaggcuacuaauaaggcuccaaacaccaaugccucauagucaacccuccauuuuucucucuuuuuuuucccucaaaauuuauuugguaaaguaaaucaaguuguuuguuuguauuucccacuagcuggauuuugcugauuauuacccacaugugguuuagcauguccuuuguccuauuuccuauaaguuggaguuggauuuaggguaacauuuuugaaaguuaggagaguauguaauagaagcagguucuuccuaaagaugacuguuguucaauaucaucuuuugcaaaauuuuaauauuuuauauguauguauauauuuucccuacuauauauaguacacaugcacagacaaaagcacaucagugaauguugccuuugucauaucccuggaaugugcugugaacccuugcacuagauaagcagcugacacugacugaauacuuccuguugccagguagcuucuccuuaguguacacauagguuuuucacuguccucacaacucuuugaggccguucuguugccuucccauuuuguaguuuaggaaacugacccaggcucauguuguugagcaguggaaccuaguuugccuuugggugguuugcccugagauucuccgcuacguuaaaaugcugauguucauauuguuugguccauaaaacauaaaauaaaauaaaaugcuuggguccuugcucuagagaucugauuuaauuggucugaguguggccucuucugugucaugucuggauuuucagaaacuuuccaggugacucugauguguggccaagauguuuacuaacugccauguaguauucugcuguguagaucuuauuauuuaaugaguccccaagggguguguacuuaaguuguuucccgugugccagcaucacaaaugauguugcagugaauaugcguuuaagugucucuuggaacauguguaugaauaucagcuaaaugaauucccagaacaggaauuacugggucaaaggguauggcguuuguaauuuugauggauguugcuaaauuggccucagggaguuugugucuguucucucacugcuagguugcuagguugucucagaguacccgaccccauccuagguguuagccagagucccuaacuccuuucugggcuacuguuaccuuuucuucuuugguuuucuuugaaaugucguucacuuuugaaauaucuuggauuuaacuuuguauauguuucuguauuuuuuuccauucuuuguaucuacaaauacuaaaccauuuguucauuuuguuuguuagcacaacgcuauuuuguuucauagcuuuauaauacauuuuagcacuugguagaacuaguguuuaaucuuuuuacccccagacuuuucucaaauauucccguaaauuaauuuuuguguaugaaaauucuguugaaauauucauugagaauacauuaaauuuauguuuuggauuagggagaauugacaucuuuacauuauugagucuuuuggucuaagaaaagguuaugucuuauuuacucaagucuugcuuuauguucuuuuguagaauuuuaaucuuuuuauucaguaaguccuauacaccaauaucgaauucucuuacugguuucuaauaguuucucaguugauuuucuuggauuuucuaggagugcagacuauuucuuauuuauaguaguauuuuaguaacaacuauauuuaguaauacaucauuuauguauuugucacauuuagaauucuaaauguaauuguauuuuuuuccuccuccucaaaauuuguugcugagcaacuggaaggauggaacuggcagccacuaaagcacuggaggggaaguuucucaggguugauugggguuggucacggcuuccaucaaucugagaagcugaccagugguugagguggcauuacuaauuaggcaauagacacacgagucuggaguucugagaagaguagggacugggaugggcauuuggaaaacauuagcauuuagaugcauuuaaccauagacuggguaagaucaccaaggcagugaggguggauggaggagacaaaccugagagcauuccaggagcccuugugaccggugcaguaaccccucgauuagaccuguugcuucaucucugguuuguucauggaguccggaugagcaccuaaaauccugugucauuuugugagucuuugucaccccuugcuucuaagagguauaucuaaggucugugugucacuucuacucuguaguggccucagugugucccugaguaggugauucuguguucucuauccuaugagugguggcuguaaacacuucuauguguuuacacacuccuauguguuuacaaaaaaccucuaugugccuuuccugugcaaacuguccuuugugugucuuuucuuguggccacucaugcuugcccugcucauucugucagcagagaagucaggaggaggggagugggacugaccuagaucaccuagcccugagcugguuguuaccauguacaguuggcccucuguauccuucgguuccacaucugcagauccaaccaaccuuggauugaaaauacuaaaaaagccaaaaccauaaaaaauaacaauacaacaauaaagauaauacaaauaaaaaauauuuaacaacuauuuacauagcauuuucauuguauuaacuauuauaaagcuaaagaugauuuaaaguauacaugaggacgugcauaugcaaauacuauaccauuugauaucaggauaucagggacuugagcaucguuggauuuugguauccuuaggguucuuggaaccagcacucugugaauaccaagggacaacugcauaucuacuuguuggguaccauuugucgucaccaugcaaggcaggaacuuuguucauuguggauucuacugccuggcacguaguugguacucaguaaacagcugaacaaauaaugauugaaguuaaaagucacauugaagaugaucaaccuuugaauuuuaacauaucucaugaaugccacucuucaguaacauuuaguuuuucucauauuuucacauuuguguauguucucugucuucuuagggcaacucagaguuguacuuugaacuugguaguaguuugaacucuuguuuugguuuggucaaaguaaagauaaauaaaaauaguuaaaaguuaaacuugcuaguagaguccugaggccacuucucugucuuccagacauugugcugagccgucaggcugucagcugccccuucugguuuuguuguuugugcucuugcccuucuuucccuucccucauggguugcuucccuugcagccccugaguuacagaugcccaggacuaugcagagcccgguccacgcaggccuugugcucucugagccacgcugugagguaguuggagugaccugaguuuuuguaucuccuuuaauuaagccaaggaauuugcuguggaagcagcaucugagugagaggcuaacauuggggggaccuuaaaccgagccugggcguguaggcagcucuguccuauaggauuugcuuugagacccucuggaauaagucaucucaaaugacuuggcugugaguucugugagcugagaaaucagauuuggagccuguuaucuggucuuuaaaauagcagcugugggauucugaagagugagggucagaucuguggucuggcugcuggcugcugugguauggagucaguguucuuagcuaaccaaagacuagcauauucucucucucauauaacuguuaaugucuguuuauuuuuuggucuuuuaaaaaaaucuuugaauuuuagauaauucauaucuaccaaaaaaaauugcagaagucaugcgaagaauucucacauaugcucuucacccagcuucaccaaauguuagagucuuuuauaaugagggauuaccauuagcucaucuguagaccuuguuuaaauucugccuguugaaucauguccuuuauccuuggcucaggguucaauuuguuauugucauuguauucgugguugugucucucuucagucuccuuuaucugggacagugacaguuucuuagucuuuucaugaccuugacaguuaaagagaacugguccuuuuuuuuuuccuucauugccauuuuuuuuuuucguggaaugucccucauuauaguuuugucugaugcuuccuuaugacuguauucguguuauauguuuuuggcaagaaugccacagaagaauaccauggugggcccuuagugugucaugccaggauuugucccauuccuucugauguuaauugugaucauaacugugaucauuuggcugaauggauggcugcacauuucuuccacuguggaguuacuguguuccuuuuuguaauuaauaaguaucuuguggggagauaacuuugagacuagauaaauaucuuguuucucagcauaccuuuaccauuaaucuuagcaaccacugauuauucuugccugaaacaauuauuacuguacuguuugcuaaaugauuuucuauuuuuaucauucucucuccauuuauuauuuagaauuauacuugucaaaagacaaaauuauaacaaauuuaguuuaaagaucuaguuggcauuuguguuucuagaauugggcaacaucucauucuguaaaauagaaugaguauucccaugagcugaccaaaggagguagguuuuauaggcagaaaagggcugagaaaagcagacacagagaacaaaaagcagaugggucguuucaaagucacuuccucauaggguugaaacagguaaggggucuuccuuaccugcugacucaaguugacugaaaucuccuguuuuuuuuuuuuuuuuuuuuuuuuuugguuuguuuguuugaaaacuggcccuuuuuaaaguucauuuugauugucucuauucugguuuggucuggugugcuggggccuuaugcaggagcucaguccaaaacaaauggacuguaaggacuguaaguuucacaugcuguaaggaagagcuuuucuuucuccucuacuuauuuauuaguucuugguguaugucaguguguauucauggauaguuauuccauagguuaugguccauuacuauuguuuaauugcucaaguggccucuugcaguugacuuuuccuguuaacauguuugcaucauuuuucgagcacuucuuuauuuucuuguacacuacaggaaguuccagguuugaauucuucuccugcccuggcuguggaauggacccuuucuccaagaaguccuuggguuuugauaagagauugagauuacaagccaagagcugggccugcuguguuaguuggugcuguggugucaggcuucuagacucucccaguggaugagcaaggaggauaccugucucuugccuugugguuugcuccuuuaaucucugaaacuguuacauuuaucuuuuuacuuccugauucuagucuuuuucccccuuuuaaaaaaauuauguuauggaauaagaguaugaaucuuggagucuagagaccgggcauucaguugcuagcucugacacugauaagcugucuggcauugaacaaacaaauucuuucgucucccugggccuuaguuuucuuuucuuuuuuuuuuuuuuuuuuuuugcaguuuuuacauuuauuuaaacagaaaacgugcacacgagcugucuacucauuuucuucgcugcgcagccuggcauugggguuggugacucugauggccaguugggcagcuguuuccacgauggcuuugcgguucuuggaggaaacauugugagcgaucucggcacaguaagauuuguugcacaucagcagcacuuccagcuccuugauguuguggaccaggaacuuccggaagccacugggcagcaugugcuuuguuuuuuuguugcucccauaaccaauguugggcaucaagaucuggcccuugaaucuucuacgaacccuguugucagugccucuggguuuccgccaguuacgcuuaauuuugacauauuggucugacuggugcuggaugaacuucuugguucucuuuuugacgaucuugggcuucacaaggggucugagggcggccaugaugccgaggaggagauggcugccaccuccguaggcagcgccgaggaagagagccuuuucuuuucuuuuuuuuuuuuuuacugaggucuuaguuuuuuucuuauauacaauagggugauaacaauuaaagggcuguuguaaggauuaaaugagauaguauaauuaaagcuuucaguauaagcuaaguacuagguuugguucuuggauucagcaaguauuuauggaauacuuuuuuuuuuuaggggcuuggggcaaaugggguuuaagauugccagccugccccagucuuuugccucgucccugccgggccucaauggggaccuugaucucugaccugccccuugaucaaagagcuccaccucugacuugucccuugaucugggagcuuggguucuaacuuggcagccuggaucagggugauuggccucuggcugaugcagaggaaccucuggcuucuuuuucuuccuuugagcaguuguacaauuugagucaggaagggagagaggauggcuucuuucuggccacccacuagcagaagucuuggagugggcgcuucgccguucccauguuaaaugagcaguucugauucugucugggcacauucuacuucugaaagcaaaauuucacaccgaucucugugggugguauuauugugaggaccauuggaagggacucuccuuccuucccuccuuuucugucauaacuuuucuaucuuuauugacccauucuucaguaggggugagaugcugguucagcaggcccuguaauagcagcacacucugcccugcagagguuggaggaagugacacccaaccuucuucaccacggggggcuggugagggugaauguggggaaagaaaccagucagugccccucaaucuucacugcugauagcugagccacaccauagauuuggaccagaaucuucucccaaggagggccagugcucucuucccaugacccucauagcagagucugaaacagcagucugagugggucacacguucccucacccgguggggcuuugugaccuagugauucaugggaagcggggguguuugcacacuuucucccuccugcccacuagcaugccuccugcuuugcaggcucacccagagcuuucuauucugcugcugcuagagcuucccaauaaguggguagguaggacuagcugugaccuagaaaacacuuagcauuauccaagugucccuagugaaaagcugaauaaagcaggagaaaugucacuuuggaugcucaaguucuccuaggagaacaaacuuccagaccuuuuguuuccccuaauuuuugaaggcagcauggcugagcccagaaccacauggcugagccugguaccagaguggcuggcaggaugagcacuucacagauugguguggugacuagcagccuccuuccugaggccuuuggggcccugcugacuguacugggucuuaaguaagaaaaacagaaaacuguuucucucuccaaggaaaacaagcaauaaaccccauguacauaccucccugaguucugaguaagaaaggaaaccaggcaugguggccccagaaguguucagggcauauggguaugaucccuugcccgaguggguuggcaguguccucuugagaggcuuuuugugucugcugaguauuuuccaauuuaggguggcucaggggaugggaugaggauucuucaacuuuuuccuuguuuuuuagcuuuuuuccuucucaaguuggcccuggguggcugucccugcuucuaggggccauugugagcuuuacauuggugcagugcuggcuccuggcagcaagcaucuggcuuauaccacugagaugucucauguuggguggcugugccacccaggcuuccaugguccuggguucacuggucauuucuuucccaaaaguaugcauucacgaggucagcuuuguaucuuuggggccaagcaucugugauuuugcugcucuagcuuuuauuuagauuugacucucuugcaccccuuuuacccuggaacuuccuauuuuuccguaaaaguuuuucuuuauuuuuuuuaacugguguuuugaaaaaugcuguaugcauauaucaaaaacaauuugagaaguacggugggguguauaguagaacuuugguggucuucucacucacggcccugucuguggcucuguucugcucuacacagugaggugacuguguuuauccacucuacccuaaguggcugcuguuaccagugucugguguaccggucaggagauagucuaugaaaauacaagcauacuuaucuaugccugucuucuuacuuuuuucuuuuuugguuaauacaguuuauuuuuagacugacuuuagguucacagcaaaauugagcaggaagugcagagaguucucccugugcccauggccuccacgauuaaugucccacauucucuacuuuuucaguuuuaaccuuuccacagaugauaguggcuguauacacugcucauccacaucagucucagugggugucugcuguguucucuaacggcuguucagaaguuucccacuucauguggacaggccuuaagguguugauguuuuacugugugaacugugcuguggcugucuguauucucucagccucauuucugguggaauuacgggagaaugaugugagaugacugugagauuuuuaaaaucacuaaaaguuucuuuauaguaauauagaggaaaauuagaaaauacauguaaaaaacauuaagauuaaggaaauuuaaaaugcucucuggaaauguccuggggaugucccaugcucguguggggucuagggcacagggcggagagcaaagcauagguguuugaacuggugcugcugagguggagcagagcacaugugucagcuucuguuuacaccuucguuugggcccuucugcuccccugccacuucccugagcccugcccucggcucggccccugggauggauguggguuauuguuuuuggcacuguaagaggagggaauuuagaauaaggaaaagaggguugagauucuguacuaaaugccaguauuguugggugucuuaaucuaaaagcuggaauggggauaacgcuccuucuaaaaggguauugguccauagaauaagaaaaaauugaagcuuauguaaagauuuggugggccgggcauggugucucacaccuguaauccuagcccuuugggaggccaaggcgggcagauuacuugaggccaagagcucgagaccagccuggccaauguggugaaacccugucucuacuaaaaauacaaaaauuagcuggguuuggugguacaugccuguaaucccaguuacucaggaggcugaggugggaggauugcuugagucugagagguggagguugcaaugagccgagauugugccauugcacugggugacacagcaagacuccaccaaaaaaaaaaaauuguugaucuagucaagguacauuucucugccugauguuuucugagacauggguguaugauuugucugugcuauauuguguucuaacccagaggccgugaaaugaaaaaaacguaauuuaacucaaauuaaugggacuguggcgcucuuuuucuuucuaguuggccugcugucacuuugagggacuguuauuuggaggaaguuaauuugggaaacgauucuugcuucguuuucuuuuucuuuuuuuuuuuuuuuugagauggggucuugcucuuuaacccaggcuggagugcaguggcaugaucuuggcucacugcaaccucuuccucucggguucaagcaauucuccugucucagccucccaaguagcugggacuacaggcgugcaccaccacgccuggcuaauuuuuguauuuuuaguagagacgggguuucaccauauuggucaggcuggucucgaacuccuaaccucagaugauccaccugccgcagccucccaaagugcugggaucacaggcgugagccacugugcccggccaggaaaugauucuuuuggucccucauacugcuugugaaguuguagaaguacuaaauucccauuucauccagaaaauauauuucuuugaaaauguccguugauuuuuuuuuuauuuaguaaaaauacauuccuuuuguaaauagauaaaacucaagaccccuuugaucaucccucaagcccaguauucucccagagauaacaauuguucuugggcucaccuuuuauuuauuuauuuuaauuuagugauuccaguuuuuaauguuuaagauugcugguugauucuuaugaguguaauauccucucacaccacuuggaggcuguugauugugccuguuuuuaagucuugugucuuuacuaacucuguguucugcagcaucacuucuuuagguguagaauuuguugcccuuuucucaggguuuggggauacucagcuguguauuaacuuuuaaauuugagguuccuguuagccugucuggaugcugcaucaguuuuccaaaguuggucucuagacauuguugguggcuuggcugggcauggacuaugucagcugcuaguucucagggauggcaggcuccgugcccucugugggugucaccagcuuguccucccaaaccaaguguccaacucuccuucucucuggguucaaugccacuuagguucaagugaguggaguuacauauguguuuuuggggaggggcaggaggucauuccauuguuauacccuaaccacauugucccuugauacucacaaagacaaacuagagcgggcuaggguuucugggcaucucugccuccugacccuaucggggucaagacacacccaggcugcauguguagccuucgcuuagugucauauauucagugccagcagcuaucucaugagggccaugggcacucauacaaugcaaaagauacuauaaaucuuuuguaucuuuguguauacacacacacacacacacacacacacacacacacacacacacacagccugguugugucuugauugguaacccagaauacacaggcaguguugcuuuggugaugaguauuuucaaaaaggcaauuacauuuuaguaaaggccagaaucagacauguuguauuccuggaaaauucaugauauaauaaaagcaugcaaaaaauuauuuggguuuuuaucuaaaauugaguuagguuacaggcucagaagaauguuaaacagcuucugucuaccugcaugucuaaugggaugugugaagguaaugcagggcaggggacagugcccauugacugccccaaggacaccuaacgcugcccacacacucccaaacucccaggaggcagggccuacccucccuuugagagcugcugaucaaguaggaguuuucuguuuucauucauauuugaaaaguuggaauaaucugcuuuaugaugucuuuauucccugaaaaguuaagcuaauaauauuggucaguguuuuccuauuuaggaacauuuucugaacauguggucauuaggggauuuuagaguauaaguuauguaucuguuaauuuuuucuggguaauuaugugguugagaugcuaguggcacacauuaugguuacauuuguucaguaacuguaacucgagcccuggaaauuaggcuucuauaaaauuucauagcaauucaugaaauguuguuuguaagcaaaauguacccagcuccuugacuaaaguuaccuuaaauauucuuaaagauagagagguaauacgcauuucuuuuucucuuucuguauguguguauauaugagagagagagagagaguguguguguacaugucccugauaauuccuaucucagagcaguggaaguccucugaguuugauaauaugcuuugcaugugcuauauuuguggacugccucagaacaucucuuggggagacuaccuggguucagggaccaccugccuaugcaccugaaucaugugagcccugauuuuauuuaccacggagccaggcacuugaacacugucccaucccaacuguguccaucccaacuguggacagcuuuuacacgguccaccuccuugccuuccaggaccccuuccucccuucuccuuggcuucuguggcccugcacccaugaaggccagcacaggcaccaccuucucuaggaagcauuucuggcauuugagaaaaugagcuuucacacagucuggguuagggcccggaucccaaacuuucuguuucuuuguuuccucccccuuucaaccauuauggcugagguguggccauucugcaugucacauggcuggugaaagacuccuuucucucucucuuuggugcuucuucaaaggcuccuucacuuucaaugguauaggucagauuguaccaugugucugcggcugacucaaucaugguagcuuuucuguccuucccauagcaucccuaacaggcaggaaaugauuuagucuuuaugagugugccuccccccacagggagacagccuuuuccuguugcagaucacacugauuuuaagagaagacuucucuucauaugcagcuugcccuucuauccucccaucccauguauauguggcauaccuucuaugauguuucaggcucuguucuagcagucagacauauagagugggagaugcucaaggggcucacaguuuagggggagcuuggacaaacuguugcaaucccaugugaugaaugcagaggaaggguccagacccauuuucuggaaugucagaaauacuuccuggagaaggugaugccugugcuggccuucaugggugcagggccgaagaagccaggagaagggaggaagggauuccuggaaggcaaggagauagaagaaagcauuugaguuguguccagagaauccccuugggagggguauagucuugaaggagcguuuugagauaagcagaguugaacccgucggguuuuuaggccuguugucuaggacuaccuaggauaugugguaggagaaaagaauuaucacaccguucaaauacauuuuuaaaaauaaugaaagauuuuccaauggaggaaaacuaaaauccuuuaaugcagauuuugcaaaaaagcguuuuugccaaguguugacuaguguagaguuaauucauuuggaguaauguuuuauaguauuugugaaauuuaguauagguuagaguuaguacuggauccaggguuuaaacuuuuguuuucucuuucuuuccccccaaauuaaagcauccuauccuuuucaucuuaauuucauucauaucuucauauuacguuuuugagauagcuguuuauuuuuuugagggggaaauagugacauaaauagguuuagaaccucagguggcuuaaaaccccagauguagucagugguaaauuuuuuuuuucuugguuagucuaguuuugguguugguaaguauuauauaugcugguggguuuuuaaaaagggcacgugguagagucuggcauacuauuuggagucuugugguagcugcccacuuccugcuaaugcaguagagcauguucauaauggccuuauaugcuuuccuuccuagggcaggccguacuuagucauaccagguaagaaauauguuuuaaaauuuuaguuaaacaguuaugaugauagcuuauaguuuacuuugcauuucuuuauuuauagaaagauuacauuuucuacacagugauuuacuguuguuauuuccuacuuuguuaacucauuaacuccacuuacucauugaugggagucuggauauuauccuucuguaguuuuacaaauccucacauuuucuuauucacugcuuuucuucuaucaguugauucacugaauuuaguguggggauuuuaccacaucgauacugccuucagugauuuucuuuauguuagauuuuagaaauuucucucugcuuuaauguuguaggcuaaauauaccauuccauugucuacuaaagggcucaagacuguucuuuaauauuguuugauuucuuuaaaaugaauuccacugugacuugaucaaguuuuguauuauaccacuuggggacuuuaauugauauuauguuaaaacuccauauuaacuugaagaguaugaucaguuuuguucucguuaaauuuuccuguuaaaaggaagcauaucauucuauuguugguggcuuccuuuuuucugucauuaaauucaguuacagaaaguugcccucaagaauuauauacaaaucucauguguccucagauccauuaguagccauacaguuaauguuuguguugcuuuuagcaaugguaucuucuucuccaccauauguuauagaugugugacaguuaggaaagcaguuguuuaauuaauuacaaaaguaauuuggaaaauuuggaaaauagaauuauccaguucuaucacuauuauuaccuuguucaauuuucuucugauuaaaacaauuauauuugcuaguucuuuauuagacaauuauaauauuagaaaauacaugaccacaggucuaggcaugguggcuuauuccuguaaucccaacacuucaagaggccgaggcagaaggauugcaugagcccaggaguuccagaccagccugggcaacauagugagaucccgucuugaaaaauuagccaggcaugguggugcaugccuauagucccagcuauucagggggccgagaugggagaauugcuugagcccuguaggucaaggcuacagugggccaugaucgugccacugcacucagccugggcaaccaagugaggcccugucucaaaaaaaaaaaaaagaaaaaauuaagaaaaauccaucuacaauagaauauauauaaaaaaauacuuaggaauaaauuuuuaaaacuccaaaacuaauaauacucccaaaacaacacaacauuguugaaaggaauuucuucuuuauaauccugcagccauugucaauauacugugagauguccuugcacaccuuucuccaggcucauacacaugcuuguauguaugcauacacaucaccacacacacacacacacacacacacacacacacacacacacacagcacuccccgucuaauccugcagccagugucaguauacugagauguguccuugcacaccuuucuccaggcucauacacaugcuuguaugcaugcacacacaucacaccaagugcacauggcacaccauaccagacacauguacgguuuuaaaaacuugagauauaguucacguaucuuaaaauuuguacuuuaacauguacaauucagugcuuuucacauauuuacaagguuguauaacuaccacuauuaucuaauuccagaacuuuuuuuuucccccgagacagaguuucgcucuuguugcgcaggcuggagugcaauuucacaaucucagcucacugcaaccuccgccucccagguucaagugauucuccugccucagccucccaaguagcuggaauuacaggcaugcucaccaugccuggcuaauuuuuuguauuuaauagagacgggguuucaccauguuggucaggcuagucacaaacuucugaccucaggugauccaccugccucagccucccaaagugcugaguuuacaggugugagccaccaugucuggccccagaacauuuuuauuaccugaaaaagaacuuuguaugcauuagcauucacuccucauuuucucucaaaccucccagcccuaggcaauuaccagucuacuuugccuuuguagauuugccaauucugacauuucauauaaauggaauaauacauuauguggccuuugugucuggcuuuucucacuuaauggaguguuuucaggauucauccauguuguagcauuuaucaguacuucauuccuuuuacugacagaauaauauuuuauuguauggacauacuucauuuuguuuauucaucgguugguggacaguuggauugcuauuaugaggaauagugcuaugaacauuuguauacaagcuuuuguguagacauauauguucauuugucuuagguauauaccuaggaguauaaaugcuggguccuguuaaacuguauguuuaaccuuuugaggaagugccaggcuguuuuccaaagcaguuccaccauuguacaccagcaaucuauggggauuccaauuccuucacauccuugccaaaacuuaucuauuuuuuuugauuguggcuauucuagugggcaugaagugggaucucauuguaguuuccaugugcauuuucuaguaacuaaaaauguguauuuuuucaugugcguuauuggcuauuuguauaucuuuggagaaauaacuauucaaacucuuuaaccaucuuuauguagucuacauacaaguccuguauuacauauauaauuuacaaauauguuuucccauuaguuucguaguuuaaaacauguauuccuaaguauuuuauucuuuuuugagucuauuguagauggaauauuucuuaauuucauuuucagauuguucauugcuaguuuauaggaauacaauagauuuuuguauagugaucuuguaaccugcagcuuugcuaaauuuguuuauuaaugcauaguuuuuaguggauuccuuaggauuuucuauauacaagaucuuuucauuugcaaacagauaauuuuacuuuuuucuucucaucuggauacuauuuauuuucuugcuuaacuccccuggcuagaacuucuaguacaaaguugaauagaaauagugagaguaggcacccuugucuuauuccauucaucggggaaaaugucuaguguuucaccauugaggaugaugugagcuacaguccuuacuuuuuguuaaaucucaugauucaguugacagaauccucuaguaaccucgcuagaaagugaccaugacacagaaaguuuuugagaccucaucaggggucaccaacuuccuugauuugccugggauugagagauuauugggacaugugaauuuuagguuuuuuuuuuuuuaaccagguuauaucuggguaaauaguuuaccuaggacugagggaauucccaggaugugagacuaaugcugcugaagccaggaaaauccuggacaaaccaggaugagcuuguuacccugccacaugccugaaaaugcuuuuuuucuaucuuuauguuugaucgauaguuugaaucuguagaacuuaagguuggaaauauucccugcauuccuccauuuucuucuagcuuacaguuugacccuuaggaaguugauguaaauuuuuuuuuuuuuuuaagauuggucuugcucuaucacgcaggcuguauugcaguggugcaaucauggcucacuguagccucgaccuccugggcucaagcaauccucucaccucaguccccugaggagcugggaccauaggcaugugccaccaugccuagcuaaaguagagaugaggccuugauauguugccuaggcuggucuugaacuccuggguucaagccguccucccaucuuggccucuuaaaguguucagauuauagaugugggcaccaugccugacccugauugugcuuuugauaugacaagucgagugcaauagugagaaguggggaaagaguagaacaaggaguuugcucgaguuuaaccuugugcugguacuugcucggccuuuaaagcugaagauucaugucuuucauaucagaauuuaagaaauuuccuuaaauucuuucugguuaucugcuuuccuuuauuuucuuuguucucuaguucuucaguuauucagauauuugaucacuaguuucauuuuucuaauuuuuuuuuuccuauauccugugucucugacuuuuuauucuuuuuguggggaaaacccacacaugacuuccucggcuauguucucuaauccuaguguugagguuuuuuuucuuugcuaucauuauuaguuucuaaaagcucuuuucuuguuuucuggaagugauuguuauuguuguuuguuuuuuuguuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcuguauuguuguuuuuuaagcaauauucuuuacuuguuucaaggcugcaaaguugugucauuguucugagcagguagacacaugcucuuaugugcucuuacacguguucuuacacucacauuuaccugcacuaaugcacacucacaugcacucacacacacacuugcgcugucaugcacacucccaaugcauacucacaugagcugucacacauauguacacacacaauuucucacacacaugccugaaggauugggcuuggagggaaagagggaaagguuuugugugaggagcuuguggaagagguagcaguccugggccagacuggcugggaggaugcagugagcugggagaugugcagugaugggaagaagugaggacuacaggccuugcaggaaaacaagccugauccccaauaagacauggugacagaugagugugugaacuguggaugagaaaggaccccgugcagugccauacacacgccaaguauuguugcucuuuaugcacauaagaagcaugugauugacuucagcuacgagauaacugagauguaagugcaagugaccagcagacaguuggaaauguagucugaaauuuggggaagagaagcagaaguuggaacuugauuugggagucagcaucuuacaagugguaguuacugucucugaagggagaaggauagaagucaaugcucagaugggagagguccauaauuauggggcaauuaagaagaggagcuuguaaagaaggacaagauaaagaagaaagcaagucugaguauuccaaaucaaagauuuaaaagaaaggguguguguguguguguguguguguguguguguuuugagacaggguccuguucugucacccaggcuagagugcaauggcaugaucuuggcucacugcagccucgaccuccugggcuuaagcaauccuccuacccauagccucuggaguaguugggaucacaggugcaugccagugugccuggcuaauuaaaaaaaaauuuuuuuugguagagauagggucucauuauguugcccaggcugguuuugaacuccugggcucaagugauccucccgccuuggccucccaaagugcugggauuauaggcaugagccacugugcccagccuaaaagaaaguuuugagaaggacucagucuaaccugagcugaaaaacaguugaaaggaucaguuugccaguucacaguugccaggucacagaggcagcuggcauagcucacggaggugguugagguuagccucagugguuauaugcuaugaaugaagagcagaugaaaggauuuuaauucagucauuuaacaauaauuugaccaaacuugauacugguaggaagguagaccaggagaucauucuauucuugugcucuuugccaacuauuuugacaugggaguuuuuauuuuuuuauuuuuauuuuugagacagagucucacuccgucacccaggcuggagugcaguggcucgaucucagcucacugcaagcuccgccucacggguucaugccauucuccugccucagccuccccaguagcugggacuacaggugcccgccaccaugcccagcuaauuuuuuguauuuuuaguagagacagcguuucaccguguuagccaggauggucuugaucuccugaccucgugaucugccugccucggccucccaaaguucugggauuacaggcgugagccaccaugcccggccuuuauuauuuuuuuugaaacaaggccuugcucugucgcccagguuggagcgcaauggcacaaccacagcucacugcagccuugacuucccaggcucaagccguccucccaucuuagccucccaaguagcuggaagcacagacaugcaccaccacccucagcuaauguuuuuauuuuugucgagauggggccucccuauguugcucaggcuggucuugaacuccugggcucaagcaauccuacucccuuggccucccaaaguacugggauuacaggugugagccaccacgccuggccaagcuuuuauuauuuacauuuaaagauguuuuaaaaucccagcauuuuggcuugugacguucaccuuuccugugugccuaccuuuccugcagcuuacuguguuguuugugucagauauuaccuggaucugugauugcugaguagaagugcugcuauucaaagccauggagguccugccaagucuuaacaccguuuuaaccuucaucuugggguuagauguacagaguuauaggagcaggaaauuaaaguccagaaaaaaauucuuaaaaaugauuuagugcuuucuccuuuggguuggaauccuguuucuagcaauagugagcuuaucuuccaaagaaaccacuaugggauucuauggacauuguuuauuuauuauuauuuauuuauuuauuuauuuauuuauuuuuuugagaugaagucucacucugucgccuaggcuggagugcaguggcacaaucuuggcucacugcaaccucugcuucccgaguucaagugauucuccugccucagccuccugaguagccgggauuacaggcgcacgccaccaugccccgcuaauuuuuguauuuuuaguagagaugggguuucaccauguuggccaggcucgucucaaacuccugaccucaggugauccgccccccucagcuucccaaagugcugggauuacaggcgugagccaccgcacccggccaacauuguuuauuuuuaaagucacuucuucccagccgucugagcuguuauguggaacuguccugugccuccauaacaguaauuggguuuuugggcugggaacagaaugucccugaaauccaaugcugacuuuuccucagaauugcccagaacagcaaagauggaggaagucaaugugcaaaggacuuuuaaagcauaauagcaaaggagcuacaguuuagugaauuuacauuuauggcccaagugauaucaaccuuuugugugugugaguucugucuuaauugagucacagagcagccacauggcugguucuugucaccuggcgaggccagucccucacuccgauggccuuuccuggcuucugacuugauuauauuuuaaaucaaaccacucaucacaaaugagugaucuuaugaccauuuuuuccucucccaaaaacauuuagaaggagguacggagucagaauccugagccccuguuugccugcagccagcuccugugcuuugucggcuuccugggauucaugcccaucccaggaagaagcuccugugagauaguccugguggagggccugugucuucagcguguccacacccuggccuugccugcuuaaaugaguaaaggagucccuucucuuuugucucugagacucuugggcucuguugccaggcuggagugcaauggcacgaucucagcucacugaagccugcuggccucaagcaguccucuuaccucagccucccaaguagcugggggcgugcgcccccauccccagcuaacuuuuauauuuuuguagagguggguuuucgccauguuggcuagacugguuuugaacuucugagcucaagcgaucauccugccuuggccucccaaagugcugggauuacaggugugagccacugugucuggccaucccugggacucuaacuccuguuggcuugucccugggacuugggaugggcugucucccuccugggcugcccuugacucugguuuguauuuaguuuugaaucaaggcagccaccauccucguagcacagggaggacauuuuugcccucaucagugguacuuucucuugacugugcuuuuuuuuccuucucuauagaugacuuuucuccacaaauggccuuugauuuuauucaugagaucauucccaacauagugaauacuuuguuuuguuuuuucucucaggugacucugucaaccaccaaauacuaacucuggcuuccuuuccucuuuuuauccuuccucuuugcccaccuucuuuucaacuuaguccauuuuguuuucuuguguacuaaacugcauguauuuaaaguacacaguuuaauaaguuuugauguauguacaccccuaugaaaccaucaccacaaucaagcuaaugaacagucaucacccccagaaguuucuucggacccccuccugcugcccauccuuccaccuccauucccauccuuaggcaaccacggcucuguuuucugucacgauagauuauauuuccuagaauuguauaaauggaaucauauaguauguacauuaaaaauuuauuuaguuucugaaaauugcaguacaauacauauaaaauuuaccaucguaaccauuuucaagcgugcagcuaugugacauuaaguacguucacauugucaugcaaccaucaucgccauugagaucgaggacuuuuaaaagucuguucucaaacugaaacucuguacccaugaaacagugacuccccuuccccgugcucccagucuuuggaaaccaccauucuacuuucugucucuaugaaucugacucucuggguaccucauguaaauggaaucauauaguaauuuuuguuugugugccuggcuuauuucacuuagcauaaugccuucaagguucauccauguuguagcauguguagaauguccuuccuuuuuaagucugaauaauccaucguauggauauacuacauuuuguuuauccauucauccauugauggacauuugaguuccuuccaccuuucagcuauuguaaacagugcugcugugaacaugaauguacaaauauucagaguauauacucuuuuuagucugauuucuuucaggauaauuauuuuuagguucaaccguguuauguauaugaauaaucaauuucuuuuuuauuuuuugucuauucaucuauugauuaauauuggguugugucugccuuuuggcagaacacaaauggucaacaaauaugaccauuugugcuaugaccauuuguguacaagucuuuguguggauggacacuucauuucucugggugaauaaccuaggaguagaauagcuauuccauaugucaggugccagauuguuuuccagaguacuguaugcuuuacauccccacuagcaugugucaguuccaguugaucuucauccuaacauuuaguguuuuauuuuuuuuuuuaauuaacauuuuuguuuuaagauggggucuugcuauuuugcccaggcuggucucaaacuccugggcucaagugauccuccugccucagccucccagagugcuaggauuacaggugugagccaguaugcauggccagcauuugguguuuuaaauuuagacauuucuuggccgggcgcaguggcucacaccugucaucccagcacuuugggaggccgaguuagguggaucaugugaggucaggaguuugagaccagucuugccaacauggugaaaccccaccucuacuaaacauacaaaaauuagcugggugugguagcacauugccuaugagccugcuacuggggaggcugaggcacgagaaucucuugaccccaggagguagagguugcagugagcugagaucgcaucacugcacuccagccugggcgauaaagcgagacucugugucaaaaaaaaaaaaaaaauuagacauucuuauagguucagugugguauuucacugugguuugaauuugcaguucccuaauaagcaauaauguugcccuuuauauuuucuuugaugaagugucaguggaaauauuuuguccauuuaaaaaaauuggguuguuuucuuauuauugaauuuugagagcuuucugcauauucuggaucugaguacuuuaucagauauauaauuugcaaauauuuucucccagucuuuggauugucuucauuuucuucacauugcauuuugaguagcagaaguucuuuauuuugaugaagugcaguguaucaguuuuuuuuuuuuuuuuuauggaucauguuuuuggugucauaucuaggaaaucuuggccuaacucaaagucacaaagauuuucucauauguuuucuauuaaaaguuauauaguuuuagguuuuauauuuaggucugugauucauuuuaaguuauuuuuaguauaugaugcaagauacggcuugaaguuccuuuuuuguguguguauggaugucugguuacaccagcaucauuuguugaaaguacuauacuuucuucacuaaacuuuuauauguuucugccccuuuccuucugcuucuuugcauaguaagccuccuguauccaauaaucuucuccugcuuuguuaccugucaagcacauuauucccuuuuauuuugcccugugccuuccuucuuugucuucaguuccacccaguccuugucuucuacucuugagcugacaucagcaguuugauuucugccuuuaugaauacaguggcuuucucacaagcuauggacaacuuccuugggguuagagugagugguuugucuuuagguuucccuuuauugaucuccucugauauuugaugccaucaacugucccuuuucguugaaacacauguguuuggcuucuguacuuuccugauucucuuccuccccaacgauuagucuuucagccucuuucuuaggcucgucuuguuuccaccccuuaaacguggguguucucaagauuauaucuauaaucagcccuuucuucuuucugcaguuuucucccuuggagagcucauccauucccagagccugaagccauacaucugugauucacucugaccucuguuccaugcucucuaccacucccuguguuugguccuaguuuaauuuggaguuuaguuguccuaauguucuguagaucuaccagcuuccugaccuccuuucucuaggaagaguucuaccauuuuccucauugcccaagcucagggcaccuucuucccuucuugcuuguccaacaugcucuaaaucaugcuaucacugugauuucccuugauauucugaacaaaaugagcacauccuuaggaagcaagaccuaugaaguaguuuuuuuuucucucucucucuuucuguauucuuuuggagugggagugggagaguggaggcggcaggugguccauguccaacuuccugccugagcuggagcaggggucuggagguagguucuuguggcuacugaugcagaacagcgacucaggaaggugucacucagcuuagacuaaaucauucuuuggagacaguucccacaucuaaguggaguuuuauuucacccugauguuaacauuaacuguggcucugggugaugaucaggaaagcugaagaagcuucugucagugccagcaacauugagaaguauaccaucaucauuugugaauuaaguguaagacagaauuacaucacaguuacuaucucuccggcgccucgggcagguguucugggggcucuguggaaagccucuaguugggucaguagucacucuccacaucuccucugugguccucaggagugaccacagacagacugaugaaaaggcugcccuggcucuuagaggacuugccacuguucguguucacugugugcugcacagaccaggaauuaauuucaccuucugccuccuagacuguugaaauugggacaggcaggcagccgugcagcaaaggaaaugagagaagccuauuaaggccaaggagaguggaggcugaaggcacaugggaguagacuacagucaugccagugaguaucaggaagcugaguacucuguggggaagccuauguucagcuaccaaguguggugggugcaggcggcggccugacaggugcauuacagccugaagaacuggggugaggccagaauuuggcucagccacuuaggguaugugacuauagaccauuccuuuagccucugggagccuccauuucccagagaugacaauuuccaaggguguggucaauucugugugcaauccuguguggccagacagaggugccccuugcugauggccugucccuuuuucuuauucccuucuaauugaugucauaugucucuugucuucaugugaacuugauaucaccuaagauccauggcuuugaggaaggcuaaugcaaggaugguguuucaguucauuugggcugcuguaacagaauacuugagagcagguguuuauacaaaauuuuauuuuccuacaguucuggaggcuggaaaauccaagaucaaggcucuggcagguucaguugucaagugagggcucucugcuucuaagaugggccugaugcuguguccuuuggagggguggaaugcuguguccucacguggugacagggacagaaggggaagagagcuggaugcugcgugaagccuguuuaauaaaugccuuaaucuagucauaggggaggagcccucauaaccuaaucacuucuuaauaccgucacauuggccauuaaguuuccacaccugaauuuuggaggagacacauucaaaccauaguagaugggaaacauacggaaacuuucuacagaagaccuucguuacaguguuuguuggccuggggcaggcuacucaggcucgucacuuaaagaauuauuuuuauugucuuccucuggagacuuuugguuuugucaggugaacguuguggcugucaaacuugcacggaccaucccaugcugagaugggacuucaauaagugcguuaacagauagguaucaggucuucuucuccuaccaggccugccccuagggaaugaaauggccucauggcgaagcaucucuugguuaaggcucuucuaaggcaagaacuaauugcuuuuccuuggcagcccaaguaaauguucucugugagaaaugacuuucugacauuuguuucauuguggcuguacuuaccaaaaaacuuuuauauaauucacuacagagaauucucaaaugaauguaaugaacauugccagaaacugggcuggauuucugaggcauuguuuuacuuacuuauuuuuuggauuuucagucaaaucauauaaucauguuugauggaguaucuaguucugccaguuaaaaggguaauaguauggggauugcuaauuuacacauuagucaaaaauacuccuuugaaacacuuuuuaagggaggcaauaagaagugacuauuauggcuugaagugagauacgcagacagcccccuacccaaaugucagauguaaacuaacaaagcauggucacacccugggcauuggaaggaccugguuggccagccuggggccuagguuuuggggcaucccugccagccauccagccacccucagagcaggcgugccuggaggaucuuggcccauuuauaugcagaagaggaucaaauuggcuaacaccaaggcuuuauaaauaguaggacuguuucuccagccugucuucauucuguucacagcuaaaauuuccuggcagcuuguaacuaaugagaacggaaaaguacuguuugcagagauuucagcuagcugacuugaaugcucccaugaugcuuugucacugauuguuguacuuacugcucucugggguggccauucccuuccaaguugagcugggucucagguaaugaaaacagcaacucuuugaccaagacccuaagauggucacaaggaaagcccauuuuguccucaugagaguaugacuacacacaggcucucuggcugagaacugugacacccagaggucacaggcuuggcuaaggaugucuauaggacuugaauaguccagccucaugugucaauuggggauaauguuuggacuggcauagacccauagguaagugugcaguaaugucagcuacagcuaauagguugucuuaccugagcucugcacuacuucugcaauggaaguguuguuucccugacuuuacugaugagcaaagcggaggcuuagagacacaagguuguaucaccaacuaguggcugggcagggauuuuugacuccagagucuguguccuuaaguacugguuucgguucuccuuuaucuggaauucuugaaagauguaccuugcauuaaucaaaucagacacguaaaaccucuuugccuugguuuuucacuuucucauuagagaacucauugcuucauagagcuuuacaucagcugaaaguugucguaacggauuuccaugcagugugugugacuguuuguguuguguucauuucugucuagauacaccuuccacugugcacaccugugugcacacacacaacccaccccuccuccccuccaaaaacaaaacaaacaggaaaaagaccaaaaacagucauugcggauguggagcaaccugcagagaccuugugaggcagaugacauuggaggucagcaguugagaaggggcaagcaccuggucagagggaggaaccugugcaaagaaaugauaccauuaaagggaugcugauauuccuguguuccuaggggaagggagugaacagggauggggcuggcagggaccacacugugcaugucucugcccugccaagacccugauucaugcuaaagaauuggggcuuaucuuuagaaacuggggcaacuuaucuaacucaagaguguuugcucagauuugucagaaaguuaauaggcagcagucagucaggguggacaagguaggggauguagaaaggauacauaccaggcagcuguugcaguucaggggugcaugugcggaagauauagagauagcacuguguucuuuggaguguaaggggcaggcagcaggaagggucagccaaaggaaaccagugaguuggaggagagggagaacagguggagguggagcagagggagagccuggguaguccaagggugggacauucaugucagauguuguggagguaucagauggacagaaauucagaaaggcaaguuugguuaugauacuuggaagucauuugugauuggcagagauuucacaguggggcauauuggaagguaaggugggaagaaacugacucaagauguuucgcugggaauaaaaggaagaaggcagcagccugaacagaaggcugguugaaagaagaguugugaguccuuguguuugacugauuuuaaggaagagugaggcaugaggcaagguaucaguggguaagaagggcuuggggauccaagagaccaagugauacuuacggcacagggucucacagaggggagugggagcuucucccaggccuacaggacucagcauuacugauagugggugcgugcuaauuaacguuaaaguugggguguuauguaaguauucaauuuguagaggaguuuugcucugucaaaguaauucuuugcuuuaccaaaaggacuuaguguaagauucuauuaaauagcaaacucgaguuuguugagguuuucucuuugugaauguauauaaaugcugcacuugugugaggcuucucagggauugggcccugucucccagccagaaaagcuuucuguucuuuacauccaccuuccccuguccccaggccugggacaccucggacaggucuuggagggagcaaaccuuugugauuaucuggaugcuuucucagaaagaagaggggcagaggggcugcuuuacuuuuucuggcuuucucuuuuuagauuuacaggccaaggaacaggugauaggaugccuccuauccuaucaucuguugauaaccugugagaugagaagguuaaaguggcgggcagggacccugagucuguagcccuccuugcacuggccugagccuucucauuccagaaauucuguucucaauacagcaaaccuucgguuuugcucauagaaaaagcucuagccuuuucacaugauagcgucuuuugaagcugagagguauccaaaugcauuagucuuagaugaacacaccuggaaucucacuuuuaugagaauuucauagacuauacucuugaauuccaguuguacauuuuugcuugcaaacacaggcauuucagaguauaaugagaggaggcuggugcucauaaagaagacugacuuuacaguaaaccaccucccaggagaacugaagauggggcuugagcugagguggggucucuucuccacuaucccgagcagcaccugggccccaggucuucaccuagacagucaaggaccucagccuaaacagcauccagcucuuagaaguccugugaaauugggccaggcacugugggucacgccuguaaucccagcauuuagaaggaggcugcggcagguggaucacuugaggccaggaguucgagaccagccuggccaacauggcgaaaccccgucucuacuaaaaauacaaaaauuagcugggugugauggugcaugcccguaaucccagcuauugaggagacugaggcaggagaauugcuugaacccgggagguggagguagcagugagccaagauggcgccacugcacuccagccugggcgacagagcgagaccccaucucaaaaaaagaaaagaaaaaagaaaagaaaaaaaaagauuucuuguaaaauugaaaacaaaauucagacuuuggcuacuugaaucuuguuuaauguaauaggaaagcugauaauuuaaagguaacaaguuguggaaugucuucuuuaagauuagcaugcagucucauuguaccuguuaccuguucuuuuuuuuuuuauauugaauguguucaaagcucaucccaccuguaugcagaguguguuagaaacugugcuggaugugguuguucucuuucuagaagguagggcucccaugacagccauauagguucucuugguugcauaaguaaacauaaauaaaccaguaaacaaaaugccugcuuucugugugaauacguugucauuugaugucaugguguuaaguaugaaggugcuauaaagaaaaggggaggccaggugcgguggcucaccccuguaaucccagcacuuugggaggccaagguggguggaucacgaggucaggagaucgagaccauccuggcuaauacggugaaaccccuucucuacuaaaaauagaaagaaaaaaaauuuagccaggcgcaguggugggcgccuguagucccagcuacucgggaggcugaggcaggagaauggcgugaacccgggaggcggagcuugcagugagccgcgauagcgccacugcaguccggccugggccaaagagugagacucugucucaaaaaaaaaaaaaaaaaaaagaaaaggggagaguccgccccucuuguaguuagggaggaaguucaauuuuguuaaagacuugaggguaagaggaaaguaauucaaugagugagcugagacagaagaugaaugaggcgaggugagccuccaucuugucacuuguccccucccaucuucagcccucguggggcugaagugauucagccugaguguccuuggcccugcccugggucccccaggugcauacucuccugcaugugcuuacacccucaggcuugccugcagucuccaugcuggugcccccaaacagccccuggaacuacuucuuuuggcauucugcagucuacucuccauguggcagcugugcauugaccuuuuaaaacaaccaaauaacauuguucccugucccaaccuugcagugauuugcaaucacuuuuuaauuaaauucugaacucuguuuuaaaaagcccuaugcugaucuuggcuaguaagauagcuucuccucuuugaugauaacaauauuauuuguauuaauaaucuacaucaguaaaaauauuaaugauggugacagugaugacugcagcuaacacuuacucugagucguacacuguucugagcauuguaucuauucacucauuaaccccaggaacaucuuugaggaagguacucaugugcucccauuuuguaaguuuuauaaaugugaaaauggagauaugaacccaagggcacagugaguuggaggcaaagaugagcccugagccagugcuguggcuguggaucaaggaguuugugugggacacugucuaggcugcucaucucuguggucuucauagcuggcccugucuugccauuuaucagaguucugugugaauguccagcuccucccaggggccuucucuguugaccagaggcucugagagccacuuaaucacuuuugauuaacuccaaguuuguaagucccacguuguucccaucuguguccugggaccuacaacaguaagguuaccugggccaguacucuuugaguggcagguggggccggcucugaugugugggcuagcuauggagcccugaccugaagccugggauccaaguguggguaguccuagcugcgaggguggcacagagaguccagagacugaacagaggcugggcagggcggguagacauggcgagucuuugacugggcuguauguaggguuucugaugcuuccauacuccaggcagaauaaauuggugcuauuguuggcgggagcaaaauuggacaauguggaauucauuucucccuggaagacugggugguucuugguacugaaaguccucccaggauauaauaucuucaagaaaacaaaagauaaccucacuagucauaucaaaguaguuuagucuaagaaucccuaaaaauccaguguugucaugcuaugaguaaagcuaagaaaccaacaugacagugcccuccacauacugacuguugugaaaacacgucuuguuauuuuuggaaaguccucuugguagaccacuaacauuuucgcccccaaaacagcaggagcaguaaauaacaaccuucuagauaaaucaaaugggaaagcauugccagaauuugcuauaucaagugcugugaauaguggcacccagcagggaaauuauggagagaaaagugcuuuuauuugcuuuucaaaguuggugggacugugggaauaugggagaugggaagaaaaggaggaaaaagagaaaaauacugucaucuugaguugaaaaugggugcuaaaccuuuuugcuuaggacugugauucaguaucaagggaaggaaacuguuaacucagguauuacuaauagccucauguuggugagagagagagcucacaugcaagaagacuagguaagagcuuaugagucucacaacaggcuaagaauugggaucauuauuguucccauuuuauagaugaggaaauugaggcuuuaaugagauagaggaauuugcucagauaacacaccuaguaugagcugaagcccaggauucaaacuaugggcuggcuucaaccccauggucugaauugucacagcugcagacuuaaaccuccuccccuuucccucucuuugaguguuaguuggcaugauauauuugugaaaacuaacuaaaaccagaaaaaucgaaaaaaaaaaauccugugucaaguuaguaauaaugaucacaggcuuuuuuuuuuuuuuuuuuuucaauuuuucugguuuucucacuaguuagugucccuuuucuauuccagaauuagguccaggagucaccuugcauuuaggcauuauguucucgucaccuucagucuguggcaauuuccaucuucuuuugauuuucauggacguucacacuuuugaagaggccagguauguuguagaauguucccaauuugggucuauguaguguuuucuuaugauuagacucagggcuauggauuuggagaggaauaccacagaggugucuugucuuucucaucaugucacauuggagguacaugauguuaacaugaauuauuacugugacguuugcuuggaucauguggcugaggcugguuggccagguuccuccaaugucaugugcccguuguccccucucuguacccuguucaugagagccacuaaguccagccccacugaagggcggggcauuaauccugcuuccuaggaggauggaggaguuucaaauuauuuguuaaauucuuagcauauguuaaaaccacuacaaggaauugauaaauauuuugggggaagauacugacuuagagauuaugcaaauauccuguuuccuuaagguccuacugauguuaguuagcaucaucaguggcucuuggcaauuauguuuuaauggcaauuuccuauuucccucauuccuucuacauuuuuaauuggacuuccauuaggaagauuuguccccuucccucauuuguucauuauaauuuauucaguuacuuauaucaguauggacucaugggugguucauuuauucuuugcuacuguauuauuuauuuugccccccacacuguuccagcucuggccauuguggcuucugaguucuuugacaucuuugcaucccccuacccccuccccaacuguuuuuuuuuuuuuuaagcacuuccuuacuuuuuggcacuacaggauucucuggguuuaucuuguauuuucucuguuccaguccuagaaucagccauuguccaaaggaauuguccagggagcccaauucccuuuauugaaugguauuuagaaaccaagaucugggcacucagagggcacguggcuccugcuucuaggcccugucagcagaccaagccaggacauggauguguguuuacuaccccacugugacacauaccucuuuuuuaccucucuaccuggauguauaggaacuaaacaugagcugucaccugcauuuaacaaccucuuuuaauaggugaguucuuugucauggaguagaugugucccugacaaauuguuggccaacagaauccuguguccucacuucuguuguugcugugguuaugagcccccaguuuuucaccuucuuccaaugaugauugguauguccuucuuucccccaggccacccgcucucacugcucagugcucacucgcuacuccuccuccugcuguauguuuuugaguuagucauccucaugcacugcuuguaauugcuguugugggccccucuguuaguucauugccucacuggccuccucuucaccgagguguagcaagaacuucuguucuuaccuccuuuucuaugaaugugauagguuuuuauggccaguggcuuuuaaacuuuggcugcaaccuguaguuauagugagaaauacauguuaacaaggcuuccagguaugcacguaccugcauaguggcaguuucacaaaacagagcuugcucuuuuucuggcaguguaucuugcguauuucauuccauuuuauucuguucugcucugcuaaggagauuuuauaccuccccuuugaaaaauacuguucuggggacuaaauccuccagcuguguauagaagucuacaguccccuucucuuagcacucucuugauaugagggugggguguggauuagcacuggguauaggguggggucagaauuagcacugggugugggguggggugggggggucuugauuagggcugguugaggacagucuaggauuggugcaacgucuacaaggccaugauuuugaggaaagggauucagaaucuaggguguaagcuguggaugaauuagaaagcuuccaaguuuucucuacuucugaaaaggacauuuuugagaaauaauugugucauugguaugcaucuuuuuugauacuauagguacuauagguuugaguguuaggaguuuucuuuggccuaauuuuuucucacaugggaagucuuuugagaauuuaaauaguaaagcuggucuuaauuuuucugauuuugaaugaacaggaaaauaaaauuggguaaagacuaagguaagauacuuacauaauucugaauuuuuuuuuaagagaugggggggucucucacuauguugcuuaggcugaucucgaacuccugcccucaagcaguccuccugccucagccuccugaguagcugggauugcaggcguaagucacuacacccagcuuaguucagaauucuuauauugacauauuuauggcguagauuaucuaauuuuguuuuaaaauauauauuucacacuuaaauacugcuaaaaaauuaggaagccucuuucccucauuaaaauaacacaauuuaagaaaaaacucacuguacaaacuuccauuuuuacuaaguuaaaguaguuuuauaguaaauauacugauuuuuguugauguuggcugaccaucugucacagauugucaaaaguauucccuaaauuugcauuuaaaucuaucagaguauuagugggcauauuaucagugacuccaaguaucuugccuuauuuauuuucaguaaauauagaaucaucuaguucuuuuuaacuguagcuacaaaguuaauuuuaaaaugugaaacacauuuucaaauauacuucuuaaaagaauuuuuuauuaaaaggagccuuccugacuaaucaaacaguaucaguggggcugccccaaccccuguggcccccacacaggccagagucaggucagugacaggguagucccuggggucucucuccucuguguuccucagcuggacuuuaaauggcaaauacagaagaucagcaaaaggcaaaaauugguucuuugaaggaaaaaaaacaucaacauagacgaacuucugguacaacuuauugagagaagaaaagagaauuuacaaagaaacaaaggucgaaugguaauggccaggugugguggcucacgccuguaaucccagcacuuugggaggccaaggcgggcagaucaugaggucagaaguuugagaccagccugaccaacauggugaaaccccaucucuacuaaaaauacaaaaauuagccaggugugguggcacacaccuguaaucccagcuacuugggaggcugaggcaggagaauugcuugaacccaggagucagagguugcagugagccgagaucgcaccauugcacuccagccuggaugacagagcaagucuccgucucaaaaaaaaaaaaaaaaaagaaaagaaaagaaaaagggguaauaacaaguagagaauaaaaaaaaaaauuaugagagcauauugguagaaaaaugauguaacucucuuuuagacuuuaaggaaggaaggaguucugaguauauaaaaauguuaaugugaauaaagauuggugcguuugacuauauuaaaaugaagaauuuguguugaccagauagacgucuuuaaaguaugacaacaacuuauaacuagaaagaauuuguaaacuguaaaccaacaaauaauucuuauccacauauauaaagaacuucuacacaucaaagaaauuacagacaaaaauagugaaagacaugaacuggaauuucacaggugaugagacauauaugaccaauaaguauaugaagagcuguucagccccauuaauaagcagagaaaugugaguuaaagcuauauugagaacuauuuuuauauauauguaauuggcaagauuguauaaagucugacaguacaaagcauggauccuguaguucuguagcaugacccacuuugcuggugagaguaaauuggggcaaucccucuggaaaacaguuuggcauuaucucuuaaaguuguauauguauauauccuuugaccuagaaguucugcuccuaguuguauagccaagacaaacucuuuagauuuucagaaguacacaaaaaggagggaauagcauaaugaacgcccacgaaacuuucacccugcuucaucacuuagcaacacgacaugguuguuguuucaucuuucucccuacucucagacuuuugguuuuguuuuugauagaacaaaucccagacaucauguaauuucacccguaaauacuucaauaagaaauaaggacuuaaauuuaauauaauuaucuuaucuuacaaauuuguaauuccuuaaaaucaucuaauacccagucuauauucacauuuuccugauugucucaaaaaauuuuuuuuucuucaaauuagcaucccagcaaaggucuaaacauugaauuugauagaucuuaugauucuuaauuuaggguaguuccccuucucauuuuuugucccaugccacuuauuuguccaaaaaacuuagaacuuagccuguuauaauuucccugauucuagaucuggcugacugugugcuccugguugugauggccaugcuucucugccccucgucuuuauuguaaagugguauucagaccuguagguuggaauggauucgagguccuguguugggggcagggguacccaauaggcaggcccucucaggagguacauggcaugugugucacagauauuugggguguucuggauccuucugucacagguuccuccucagcuuuucaccuggugcccaccaggaaugaaugaaaguugccagacucauugccuucauuacagaagauggugcaagauagugauguucucauuguguuuuacauucuuugcuuauuaucuggaauucuuauuuaggggcauggccuuucugaaauuacaguuccuauggaaccauuuuauugaugacuuuucaaguugagcuguucucugaucaccaaaggugaccccuggagauuucguuuuaugaacucauggauuuuucauaugcuacgugcuucaguccauuguggacuuuauuuauuuauuucugauugucccgucuuuggccagcagggagccuucugaaauuggcucauguguccuuucagcaugacccuccuggucuuugacaguuccccacuuguaaggaagacggcuaggcuuaccguguguguucuggucccagguuggggacuagcuacaucuccaggaacucuggcucuccucuuggugaguuagcauugucuuuaaaguaggcaggcuacugucauugcaagaccaaagugugguagaugcuaaacagauaacaaucagguauugauaaaauuauugauacuagauuuuuagaaaaaucuaaaaaaaguguagaauuauuaggcaauaaagaaguguagaauuacuaggcaaaagacauaacuucucucuccaaaugucucagaggguucaagaaucaucccauagucauaaaagcugcucagugaguucuuuccauagccaaagacuuucuaaagggaaagcagugagugagaaagcaauacugagugucacgagaccuuguuuuagucauuuuaaaugguuuguuccucacagcuaccuuuugggagagaugcuauuaguguucccauuuuauaggucaggagaccaaggcacagagaggcugagugaccuagucaccguuaccugguugcugugcggggaagcugggcuugaccucagguuggacaccacggacacacagagcauucagggaaacugcuugacugcuaggggacuggcuuggagacauugauuuguaggacauacuugagaccagagcccguggccugggguggcugcuugcugcauuggcaucaaaccuuuugugugucuggcugagguggcaggguauccacaguuggccugauauugcggggcgggggggucacaucccugcuaguaaagaagcaugaacuuagaaauaaugcauccacaacaaugaaaggagccuggcggguaggggaaccucagugagagcugggcagcaggcagggaggcaccacccucuagacagacgaaucuggcaagaguugcaggaaggcugguuagugugaggugcuugucuguguggaagccugggaguagugacuggcuccagccugucccuuuguaagugaaaagguugaaggcugcagaggccaagaccaaggcccaggcuacgucuggguugcuggcguuggggcagaccuggcagcugggggcccagggcugggguccaggcaucgagucauuuuugagcacugaaaucagcaugaguggacgagcucucaggagugaacacuccuaggaagauaaaaccgagaaguaggaagugggccuggcagaccaugaguuuuaggcuucagaagcagggcagugggccucaaggaugggucauuuuuauaauaaugcuuauuuuguaaagcuuugaaaaugaagaaacccagaagaaaauucaccguauuuccaucagguggaagaaaucuugaguugagauugagcauaggcagagaagaguugacagaugaggaggaggauucauuugugggagcaggaggaaaaagggaggaaggagucaugacgacucaaucaugggcuaccucgagugccuugcugaggcccuggccuugucuccugggccguggggagccauaugagguuguugagaauaauguaaucacaguggcaugugaagaaacugagaagagacgcagccauggcugccauccaggugugggaugugccaggucagugagaugagaagaaaauugauaagagacaggugagaauuucaagggagggagugagccaugucugcugguugccucauacccauggcacguacaucacacacauauauacugcgugcccauacuauaccuuaugcacgcauaugcacacugugugcauacaugcauaccacacacaugcacauagcacacacacacugcaugcccacaugcaccacacacacauugcaugcacaugugcaccacacacauacaccacacacacaaacugcacacacaguacaugugcccacaugcacaugcagguacacaugcaccagccgcaugcauguggcacacacacauuguaugcacacacguaccccacacacacauauagugcacacauacuuuuaccacacagugcacugcacacaugccacacacauguacuauacacacacacacacauguuggccuaguccauuugggcuacuauaacaaaauagcauagccuggguagcuucugugagaaauuuacuucucacaguucuggauguuggaaguccaagaucaaggcaccagaagauucagugucuggggaggcccugcuuccugauucauggaccucuguuuucuugugguguccucccauaguggaagggaugaggaagcucuuugaggccuccauguaagggcacuaaucccacucagagccuccacccucaugaccuaaucaccuucuaaaggccuuaccuccuacugccaucaccuucgggguuaggauuucaagauacacguuuuaggggaacacaaacauuucagacccuagcacauauauguacauugcacccagauguugugggaccucuccugaggggacagugaggucaacagguggugaggugugaugacagcucuuacaccugggauaauggaaggagaugagggugacagggauguugucaucuuugcacagaguaguggcuuuugcgcaauguaguuaagggcaauguaguuaagagugugaacauuuaaaggguagacaggauugauugcaagagacaugaaagaacagcuguauuuggggugguggagaggggguugacaaaccgggccucaaucacugagccccagggggcgggaaguggggagcagcaagcuugacauuucugugcaaacaccuccgcuuuggaaucacuggcugugacuuggggagccaaaccuugccuuuagucaggcagucagugccuaucauaggcauucucucucuggagaagagcuugaggucagcccuugucucauugaauuauaaaucuauuauagguuuggggcucuagcuuccuagacaaaacucuucagguuaggucuuugaccuccuuuuacucuucauuuuacauacuugccacuagcuuuuugaaaaucagaauugucugauccuguuuuguuuuagagacagggucucauucugucaucuaggcuggagugcagugguacaaucauaguucauuauaaccuuaaacgccugggcucaagcuauucucccaccucaacccuccgaguagccagcacuacaggugugugccacuauguguggcuaauuuuaaaauuuuuuguagagaugggucuuccuacguugcccagacuggucucaaacuccuggccucaaguaauccuccuguuuuggccucccaaaucgcugagauugauugcaagugugagccuagccuaauccugugguuuuuaaaaacaaauggaaggaggcugggcacgguggcccacgcacguaaucccagcacuaugggaggcugaggcaggcagaucacuucaggucaggauuucgagaccagcccggccaacauggugaaacccuaucucuacuaaaauauaaaaauuagcugggagugguggugcgcaccuguaaucccagcuacucuggagauugaggcaggagaaucaugugaacuugggaggugaagguugcagugagccgagaucguggcacugcacuccagccugggugacagagugagacuccgucucaaaaaaaaaaaaaaaaaaaaaaggaaggagagaggaccuuuuuguuucuaguggcagcacucaaacaggcagauuggguaggucaguuuccugaccaugagucucaggaacccggucagaaaccucaccuacucaggaacugcuugucugcaugacagugacuccugguggcagugcugcuagcucucccugugcaggugacccuggugccuggcuugccacacucaggagcgccuaggccugcagucugccaggaagggucuggccuauccccaaggagacagagggcccugcuacccacagcacccaacagagccuguucuguguuuuuccuuuaacacauuuagaaccuuguuaucccagcucaucaggagugggagcugcagggagaccuacuccauaaucuucaaccugacugcugacucacuuuccuacucccacccuuggugcugaagcauggaugcucccuccccugccuccuaccaugugcccaggccugcagcugcaggggugaccaacaguggcacagugggggccagagacaccugcacuugacaggaugcuuauuuuuacauacuguuggcuggaaauaaucaaccuuauuuaaauagaaugugcauucagagcacuauaaaaagcacccaacaacuugcaagggcuguuuuaggagugauucuccugcuuccuuuggagggaaucugcagguuccaugcaagaggagccaggccagggcuacugaggacacggcaggaggaugggguuaggcagguucugugugaucagagcccuuuccaaaagcauacagcuuuacugcagcguguaguggcaagggugucagauguccccccucacucgaaggcagagacugacagccuuuugcccuggaggaggcagaacccaugugggcaucacuggugguauaggccaagugacugcacuguugcuggcggcagcguccccaaggauaucccccggcauuauacucauucuccuuucuugagagagccguuucuuuuucccaacuuuugaggagucuucauguuuacucccugaucucugccaagugcuggggccauguuggucuuuugugugugugugugugugugugugugugugugugaguguguguguguguggguauuuuauuuauauauuuucacaauuuugacuuuuuucaaaugguaauguauguacaaaagugucaaugaagagaagucuccaguuuccagccauaaagguagcugcugcuacccuauuguucuuuuggagauauucucugcauguuuaagcauauuuaugucagauaugagucuuaaagcugcugucagugcucaccuagaaggauccuguggaaacuuggggucugggugagucccccucucugugucugacuccuucguacccugcuccaagggucaggcuagugcugcugccguggccgugggaccgcaccuggguacaggggcugcagggugcaucacugucuccuguuagcauuuuuuaaagagaaccauuuuucucuuggcuauaaaaaugucuacauauucuagggaguuuggauaauaccuagguacaaagaagaaagauuccuguuacucuacuaucagagauaaccacaaaaauuuaaugugcuuccuuucagucuuuuucauauauaugugcacacuuguguguauauuauauauuucuucuuagaaauuaaagucauaccauacuuaaaaguaauaauacccacuuuucaguuuuaugguauauugaaagcuuucuucauauuacuaaauagucuuugaaaauauguuuauugguugcaucuaaaucuuucuuuugcuguccauuuucaaccuauugagcauucuuuaguuuccuuccccccacccucuuuucucaugucauucagucaggaauccuauguaacuccugguuucuguaugucaucucucugucccacaguggcccgccugugugaguaguuuaaggcuaacaucucuuccgauugguuagugccuaguccugccaauauucagugcugaauuuugaauaucaccucugauugaaauuaguuuccuuagccacuguguuugcucaggcuaccacaauaacguaccacaaaauggccggcuuaaacgaaaaauguugauucuucacaguuccuagaggggaagucugagaucaaggugucagcagggccauguucccucugaaggucuuaggggaagaucuucccucuccucuuccagcuuuaggugguggccugcgguccuugacguuuuuuggccuauaggcacaucaccccauugucuccacauggccuucacgucaucucuccaaagucccccuuuuaaggacaucagucauaguggauuagggcccacccuaaugaccuuguuguaacugcaucaccuguguaaagacccuguuuuuauuaaggucacauucugagguccuggggauuaagauuccaacauagcguuuuaggggacccaauucaguucuuaacagccacuauugcccagcccagaggacucaggccgugguggaggcccagcuucaugcauagacagugugcagggcauacccacaguagguaaauauguucuugucuuagaacucuggccagagaaagccugcccucuugaaccaccccuucccaauccuugucuuguaugugcaucuauauagauguagauacauguaguuuuguguuuuccugugugaaccagaucauagugcacacauuguuuacaagcccauggggccgucucccugccagguuuugucugcuaaucucugagcaggcccuggagaaguugacugagaugcaccuacuguuggaauguucuguguucauagcugcugccuucuccaugacuaggcuuuugucuguaauuuagaucuucaguucacuauaauggacuugugagucuaaacuuacauaauguuuauauuauuagcauuguuacauuuuauggaaaauauuauauuuuauuuuuaacaucagcuucuucuugguaggccuaucuguauuuagugcuguguuuauaacaggccuauacaauaagauuugcuugauugaguuuuuuaggcugucucauuaaacauacugcuuaugucuuaacaaugaugcauacaauuuuaaugcaguccuuuuagcugugauuuauuuacuaugaaaaaauagaggcuagggguuggauuaggauugaaguuuagcagcugcaggaugaagugguuuugccuuuuuuuuuuuugagcagaguuuugcucuuguugcccaggcuggagugcaauggugugaucuuggcucacugcaaccugcaaccuccgccucccagguucaagcgauucuccugcccaagccucccaaguagcugggauuacaggcaugugcucccaugcucagcuaauuuuuguauuuuuaguagagacaggguuucaccauguuagccagguugguuucaaacuccauaccucaggugauucacccgcccuuggccucccaaagugcugggauuacaggugugagucaccacgccuggccucuuuuuuuuuuuuuuuuuuuuuuuuuuuaaagauugacccugccaagcaguuuauaagaaaccaaggacucaugagccuaaggauuuuauuaauaagagcccucugguuaauuaacaggccuggaucucaguacugugaaggcuggcaguaccagcuaugguuugacuguggucacagacacuuuuccuaaacuguaggaugcugcacugggguuucuuuucuguagcuuugcccuuguccugugauuuccauggguaccauguaggagggucagaaaggaaaucaccugaaaagaagaggaguuugcagaugccagagccagugaacuugagaugaaacuugaguuggucacgucuccaggauguaggaguggcaugggcuaggcugcccaugggguccucugcucaggcauggcugacugggaucacauuuuuuauucuuucucaggauucaggagcaguuccagaaaaaucccgacaguuacaauggugcuguccgagagaacuacaccuggucacaggacuauacugaccuggaggucagggugccaguacccaagcacguggugaagggaaagcagguaauggccuuggcggguaggggugggcggcuucacccaagccagucaaagcuguugcagggaagacccaccagcauccuugagggaguguugagaucggcuuuaggaugugagguguguuccuucuccugcccucggaaugagcugagcacaccauccuugcuccccuuauucuguuugugagguucucccagcucuucugcagaaaccucccuuuggggauggugaacccuguucacacugcuuccugagagagaagcccacacaucugaugucuucaccucuuuuauaaauacagccauagacucuccugggguuccuauuguagauggccagcuucucaguuuucaagggaauacucaaacauuauuaccuuggugaauucucuuuuuuccuaaagauuaaaucugccuucaguuucccuaagaaaaguccagucuacuaaacgcacagugauagcuaacauacauucacauagcaucugucaugugaguuuccugggcuuugccagcccagggucuaauaaacucaaauuagacaaaaugacacaguggguagcaccuccccguguauggugaugagccaugcaucacagagaugaaagguuuaugauuuaauucuccacaaccuuuaaucacaggagagagcucuaagacucugcaguucucucagggcaacaacauggcugcacaggagggauggagggagggacaggcccaccucaucccagcguccccacuugcuucccuugcuauuuuuuuuuuuuuuuuuuuuugagacggagucucgcucugucgcccaggcuggagugcaguggcgggaucucagcucacugcaagcuccgccucccggguucacgccauucuccugccucagccucccaaguagcugggacuacaggcgcccgccacuacgcccggcuaauuuuuuguauuuuuaguagagacgggguuucacuguuuuagccaggauggucucgaucuccugaccucgugauccgcccgccucggccucccaaagugcugggauuacaggcgugagccaccgcgcccggccucccuugcuauuuuuuuauuuccuccauucacauagguggcaugcaugugcugaggauaagcuuccugauccccacacccucuuuucuaagguugacuuggaguccucuaagggcaucccaucccugccggggccagccaccuggugucacucccugugccucuguuacugcuuagcggcgugauggguaggucuguaguuugugcacugauaccaaccauucuccuuuccccagguuucuuuuaugccuccucagggaacaggugucaggcugugggccuuuguuccccucagcaacaaacacaaaauuuauuuuucuucagcuacaaacacccggucaccccccuuuaaacuacaucaggucaugggugagacccauugaagccccauccaguccugagaggcaaagcaaagaacccaggucacagcgaugaaguggacggccaggccugugugcuguggggcucuuccauggagcagggagccauguccuauaaguaccgcaugcuaaccgauugcgccacuggagccacaccaugucaugauguaccuguaacauucgcaacuugaguuucaaacacuaaaguuucugaaaccuccaucuaaugaguuuaagugaguagacguuuaaucuuuuuuaauuuuuugauagagaugaccucauucugucacucaggcuggagugcaauggcaugaucgcagcucacuguagccuugaacuccuggguucaagcuauucucccaccuuagccuccugaguaacugggacuucaggugcuugcuaucaugccugguuaaguuuaaaaaaaauuuuuuguagagauaggguccugcuguuucccaggcuggucuugaacuccuggccucaaaugaucuucccacuucagccuucugaguagcugggauugcaggugugagccauuguucccaguggaaguuuaaucuuuuagugggagagagaugucuacucaaggaauugugauaagaauaacauuaucauagguuguuguaaauagauaauuuccacuuuaaaaaaucucaaguaacaaugcaaaaugggacauuacauaauuuaaauccauaauauaaaaaaauuugauauaugccagaaacuguauccauguuuccuucuucaugagaaccugcaaccugugaaguaaguaauuucauucuauuuuguuguaaauuucuuuuuuuaaauuuuuauuuuacuuuaaguucugggauacaugugcugaacaugcagguuuguuacauagguuuacaugugccauggugguuugcugugccuaucaacccgucaucuagguuuuaagccccgcaugcauuagguauuuguccuaaugcucucccuccccuuucccccgaccccuuggcaggcccugguguaugauguuccccucccuguguccauguguuuucauuguucaacucucacuuaugagugagaacaugcaguguuugguuuucuguuccuguguuaauuugcucaggaugaugguuuccagcuucauccauguaccugcaaaggacaugaacucauucuuuuuuauggcugcauaguauuccgugguguauauaugcuacauuuucuuuauccagucuaucauugaugggcauuuggguugguuccaagucuuugcuauuguaaauagugcugcaguaaacauacaugugcauguaucuuuauaguagaaugauuuauaauccuuuggguauauauauacccaguaaugggauuguugggucaaaugguauuucuggcucuagauccuugaggaaucaccacacugucuuccacaaugguugaacuaauuuacacucccaccaacaguguaaaaguguuccuauuucuccacauucucgccagcaucuguuguuuccugacuuuuuaaugaucgccauucuaacuggcaugagaugguaucucguugugguuuuuauuugcauuucucuaaugaacagagaugaugagcuuuuuuccauguuuguuggccacauaaaugucuucuuuugagaagugucucuucauauccuuugcccaccuuuugaugggauuuuuuuuuucuuguaaauuuguuuaaguuucuuguagauucuggauauuagaccuuugucagauggauagauugcaaaaauuuucucccauucuguggguugccuguucacucugacgauaguuucuuuugcugagcagaagcucuuuaguuuaauuagaucccauuugucaauuuuggcuuuuguugcaauugcuuuugguguuuuagucaugaagucuuugcccaugccuguuccugaaugcuauugccuagguuuucuucuaggguuuuuaugguuuuagguuuuauguuuaagucuuuaauccaucuugaguuaauuuuuguaucagguguaaggaaggggccuaguuucuguuuucugcacauggcuagccaguuuucccagcacuguuuauuaaauggggaguccuuuccccauugcuuguuuuuguuagguuuguugaagaucagaugguuguagauguguggugguauuucugaggccucuguucuguuccauugguuuauauaucucuuuugguaccgguacuaugccguuuugguuauuguagccuuguaguauaguuugaagucagguagcaugaugccuucagccuuguucuuuuugcuuaggauugucuuggcuaugugggcuguucuuugguuccauaugaaauuuaaaguaguuuuuuucuaguucugugaagaaagucaaugguagguuggugggaauagcauugcgucuauaaauuacuuugggcaguauggccauuuucacaauauugauucuuccuauccaugagcauggauuuuuuuuccauuuguuuguguccucucuuauuuccuugagcagugguuuguaguucuccuugaagagguccuucaugucccuuguaaguuguauuucuagguauuuuauuuucuuuguagcaauugcggaugggaguucacucaugacuuggcucucugcuugucuauuauugguauauaggauugcuugugauuuuugcacauugauuuuguauccugagacuuugccgaaguugcuuaucagcuuaaggaguuuuugggcugaaacagugggguuuucuaaauguacgaucaugucaucugcaaacagagacaauuugacuuccucccuuccuauuugaauacgcuuuauuucuuucucuugccugauugcccuggccagaacuuccaauacuguguugaauaggaguggugagagagggcauccuugucuugugccgcuuuucaaaggcagugcuuccagcuuuugcccauucaguaugauauuggcuauggguuuaucauaaauagcucuuauuauuuugagauauguuccauuaguaccuaguuuguugagaguuuuuagcaugaagggguguugaauuuuauugaaggccuuuucugcaucuuuugagaugaucaugugguuuuugucacugguucuguuuaugugauggauuacauuuauugauuuucauauguugaaccagccuuacaucccagggaugaagccgacuugaucguaguagauaagcuuuuugaugugcuucuggauucaguuugccaguauuuugaggauuuucacaucgacguucaucagggauauuggccugaaauuuucuuuuuuuguugugucucugccagguuuuggaaucaggaugaugcuggccucauaaaaugaguuagggagguagggaggagucugucuucuucuauuguuuggaauaguuucagaaggaaugguaccagcuccucuuuguaccucugguagaauucggcugugaauccgucuggcccugagcuuuuuugguugguaggcuguuaauuauugccucaauuucagaacuuguuauuggucuuuucagggauuugacuucuuccugguuuagucuugggaggguguguaugucugggaauuuauccauuucuucuagauuuucuaguuuauuugcauagagguguuuauaguauucucugaugguagcuuuuauuucugugggaucaguggugauaucuccuuuaucauuuuuuauuguguauauuugauucuuaucuucuuucuucuuuauuauucugguuaguggucuauuuuguuaaucuuuuaaaaaaaacagcuccuggauucauugauuuuuuucuaagaguuuuucaugucucuaucuccuucaguucugcucugaucuuaguuauuucuuaucuucugcuagcuuuugaauuuguuugcucuugcuugucuaguucuuuuaauugcaauguuagggugucaauuuuagaucuuucccacuuucugaugugggcauuuagugcuauaaauuucccuguuaacaccguuuuagcugugucccagagauucugguauguugucucuuuguucucauugguuucagagaacuucguuauuucugccuuaauuucauuauuuacccaguagucauucaggagcaaguuguucaguuuucauguaguugugcgguuuugagugaguuucuuaauccugaguucuaauuugauugcccuguggucugagagacuguuuguuaugauuuccguucuuuugcauuugcugaggaguguuuuacuuccaauuguguggucgauuuuagaauaagugcuauguggugcugagaagaauguauauucuguggauuaggucagcuugguccagagcugaguucaaguccugaauauccuuguuaauuuucugucucguugaucuaauauugacagugggguguuaaagucucccacuauuauuguuugggagucuuaagucucuuuguaggucucuaagaacuuguuuuaugaaucugggugcuccuguauugggugcauauauauuuaggauaguuagcucuucuaguuucauugaucccuuuaccauuauguaaugcccuucuuugucuuuuuugaucuuuguugguuuaaagucuguuuuaucagagauuagaauugcaaccccugcuuuuuuuuuuuuuuuuugcuuuccauuugcuugguaaauauuccucuaucccuuuauuuugagcuuaugugugucuuugcacaugagaugggucuccugaauacagcacacugauggauuuugacucuuuaugcaauuugccagucugugugugguuuuuuuuuuuuuuuuuuagacggagucuugcucuguugcccaugcuggagucaguggcgcaaucuuggcucacugcaaccucugccucccagguucaagugauucuccugccucagccucccauguagcugggacuacaggugcacgccaccaugcccagcuaauuuuuguauuuuuaguagagaccccugucuucaccauauuggccagacuggucucgaacuccugaccucgugauccacccaccuuggccucccaaagcucugggauuacaggugugagccaccacuccuggcccaucugugucuuuuaauuggggcauuuagcccauuuauauuuaagguuaauauuguuaugugcgaauuugauucugucaucaugaugcuagcugguuauuuugcacauuaguugaugcaguuucuucauaguguuguuggucuuuauauuuugguauguuuuugcaguggcugguaccgguuuuuccuuuccauauuuagugccuccuucaggagcucuuguaaggcaggccugguggugacagaaucucuuagcauuugcuugucuguaaaggauuuuauuucaccuucacuuaugaagcuuaguuuggcuggauaugaaauucuguguuuaaaauucuuuucuuuaagaauauugaauauuggccuucacugucuucuggcuuguagaguuucugcagagagaucugcuguuagucugugggcuucccuuuguagauaaccugaccuuucucucuggcugcccuuaacauuuuuuccuucguuucaaccuuggagaaucugacgauuaugugucuugggguugcucuucucaaggaguaucuucgugguguucucuauauuuccugaauuugcauguuggccugucuugcuagguuggggaaguucuccuggauaauaucaugaaguguguuuuccaacuugguuccauucuccugucacuuucagggacacucagucaaucguagguuuggucuuuucacagagucccauauuucuuagaggcuuuguucguuccuuuucauucuuuuuucucuaaucuugucuucacaccuuauuucaguaaguugaucuucaaucucagauauucuuucuucugcuugauugauuuggcuguugauacuuguguaugcuucacgaaguucucauccuguguuuuucagcuccaucaggucauuuguguucuucucuaaacugguuauucuaguuagcaguuccuguaaccuuuugucaagguucuuagcuuuuuugcauuggguuagaacauacuccuuuagcucagaggaauuuguuauuauccaccuucugaagccuauuucugccaauuugucaaacucauucucuguccaguuuugugcccuugcuggagaggaguugcgaucauuuggaggagaagaggcauucugguuuuuggaauuuucagcauuuuugugcugguuuuuuccucaucuucauggauuuauuuaccuuugaucuuugaggcugaugaccuuuguauaggguuuuuguguggggguccuuuuuuuuugauguugauguuguugcuuucuguuuguuaguuuuucuucuaacaggccccucuucugcaggucugcuccaauuggcugagguccacuccagacccuguuugccuggguaucaccaguggaggcugcagaacagcaaagauugccaccuccuccuuccucuggaagcuucgucccagaggggcacugggcuaaugccagcuggagcucuuuuguaugaggugucugucaaccccuguugggagaucuuucccacucaggaggugugggggucagggacccacuugaggaggcagucugucccuuagcagagcucgagcacugugcugggagaauccuccuugucaggaucuguugcucucuucaaagcuggcaggcaagaauguuuaagucugcugaagcugcgcccacagccgucccuucucccaggugcucugucccagggagaugggaguuuuaucuauaagccccugacugggcugcugccuuucuuucagagaugcccugcccagugagaaggaaucuauagaggcagucuggccacagccacuuugccacgcuguguugaguuccacccaguccgagcuuccaggccucuuuagcacuguuaggggaaaaccaccuacucaagccucaguaauggcaggcgcccuuccccccaccaagcucgauugucccuuggcucccuggcuucagccuccuuuccaggggagugaacgguucugucuugcugggguuccaggugccacugggguaugaaaacaaaaacaaaaaccaaacaaaaaaaaaacuccugcagcuagcucagugucugcccaaacagccucccaguuuugugcuugaaacccagggcccuggugguguaggcacacgagggaaucuccugaucugcagauugcaagaaccuugggaaaagcuuaguaucugggcuggauaacacaguucuucacagcuuccuuggcugggaaagggaggcccccugcuccuugcacuucccaggugaggugacgucccacccugcuucugcucacccucugugggcugcacccgcugccuaacuagucccaaugagaugaacaggguaccucaguuggaaaugcagaaaucacccaccuucugcguuggucucacugggagcugcagaccagagcuauuccuauucagcugucuugccagauccccccauaucauucauucuauuucauagaugagaaauugaggcugagagaaguuacugaaucauccaaguuaacuuggaaaauccacagugucaucucccuuguuguuaugccuggaacagugagcacucuggauaaguuuuugaaugaaugaauagcugcaugaaugaaguagcaaagcugugguuugagucaggugugucugcuucuaaaccuuaugcuuuucccucugugccacccuccuuacucuauacauacaaguggugcuggcuucuuagaaggagagacuguccuggaacacgucucaugugcauuuauaggaaaugaaccucucuguauggugggggcaacuuggcuugcaccuugcaucccacauggugacaguaaggugacuaggcuuagucccauuccugccucggcuggguaggugugaaguccaggcuggccuggagcugagucccucuggcccuccuguccugugccuuccgacuccaugaccacucccucugcagucucuccuucauucuccaggggccacuugaaauagguagacauguccuaaaccugcccuguguguaggaguuugggugggguccauggcaucccuaagaagacugagacuuuugcaagugcccugugccuuuaagguaccacaggcacagaucagugaguugcugguggccuggcuucggcagcaaguagcugugugcucaauuuucccuucuucccaccccacauccccaguauaucucuuaccagcaacuggugaccucuagaaucauagacuucaguauaauuuuaagaucaaagucagaccagaucacuagggaucauccacacggaauucuauuuucaaaugacuacuuccugucuguuuuuaauaggccaggagcaggagcuaauagcucuucccaaguaguuuauccagaauuuugggguuuuaguggguuagguguugauuuccauuucauuuuuuguuaguauugccguguauguaguugaauaaauuaggaaaagcaucgauugccaugcuucauucacuuggcuaaaaaaaauuuacaguuuccugguccuuuaucugucuucugaacugcucuaugaaccccuggggcuuucucugaaaggguuuguauuaggcccaagcuaaaacugguuauuuucucuuuuuuugacucaagagacccagguuagcuaacagcuuucaccauacuuugcacagcuaccugggacaacuccccacuggaaauggugucucagauaugcuuguugacuaucugggauguugaugccaugauucuucccuguggucggcaccguguuaugaggguccugcccugaugucuugucugaaguucagauuuacaccucucucaaaugcacuuaucaugaccucuaagaugauguggcucuacuaucaccaaggauaacccuggauuuggcucauucuacauuagacguuuucuaaacgugugggcugugcuuugucccaggaacugggcaugugggagucaccaagacagacaagauugcugguuuggagcuuauaucccagugggguacagcaguaaaagucaguaaauaaaugagcaagauggaggcaggugccguauagaaccuaaaagugggugguuuguguauuuaaccagcacucguguggugcccucucugugucuugaaauagugaguugucccccccaguccuccuaucaugcaggcagucgcugugcacccaugagggcuacugagagcugugugugcauggucucagccaauaagagccaggucacaaucaaggcuugcucuggagcuagugcucucucucaccucagagaagggucgaaggugaaguuugguuauaaguaucaggauagaaggauggaaggaagggacuucuuuuuucaguggcuuauuuaauaguggcuugccuuauuuauuuauuaacacgguauaucuaugugacaauaggccuuuugugaugcucgcugaccuaauuuguacuggugaccugccuugguggcaugcuucaucuccuaugggguuggaaaaacuuuuuucuccuucaauaguauuuuuuuuccccaugucauucuuacaacacugcagaccucuuauuuuuuuuauuuuuuauuuuuuuuugauuuggagucucgcugugucacccaggcuagagugcgguggcgccaucuuggcucacugcaaccuccgacuuccuaacugcagaccucuuuuaaaaauucuuggcuuggcaugguggcucaagccuguaaucccagcacuuugggaggcugaggugggcagauugcuugagcccaggaauuugagaccagccugggcaucauggugaaagcccaucucuacaaaacagcacaaaaaaaauuuagcuggggaugguggcacgcugcuguaguccuagcuacuugggaggcagaggugggaggauuaccugagcccaggaggucaaggcuucugcgaacugugauugugccacugcacuccaccuugggcaacagaguaagacccuaucucaaaaaauaaauaaaauaaaguaaaaauaaaaauucuuggucucuuaauugcugaaugauuuuuuuuuuagucguaccucacuuaaaacuuuggaaaaaguuuauuuuguaucucuuggauuuugcuugucuaaguguuuuucuucagagcuguacuuucuuucuggccuggccaguuauucccuaagucuaccugucacgguugccugucagcaguguuuauuuuuguuuuuugucuguggcaccuaugggacauugucacgaugguaaccccggcugcaacaacucaacugauaaaaucagaaucuguucuggguuggugauucaggggcuuugcuuaggcagcccaguguuuguguuggggcuguggauagagcuucacaggagagccagauccucuacucuccagcuguagcuugaugcaggcauuaucagagcuuugccucuccuggaguuucucauugaucccuuuucuguagaauggguaugaugaguucacacuugcucucucaaggguaguaggagacaaauaagaguguaugcauaaugcuuuauguucuuuagaagaaaacuagaaaguguuccuauuuuacaucguaacauuuaaaaaaaaucaucuugcuagugaaucugaaagaaaacuucucaaaaugaagcuuuuaauuucauacauuaguaaaaugugguuaggucuuuuccaucacauguucuuugcucaaucuacucugcucuguuuaggaaaagcagcugacucccucucucucucucuucaguguacccacagaauagagacaaggaacuuugaguuaaugacagauguuuuugugauugcucaugucagaccugggugauuauaaaccuggcauuucauugaaucacagaauuggaaugcuuuugaaaauuaaacuccagagauuuuuaguuuaaccucucauuuugcagaugagaaaacucucaugguggguugaugguagaucauagaccagaaccaaggucccgucaccuccacccuguuuuauggccuuauugcaaaugaagucaugauuggauguuauugagugacaagugaaucuguuucccuugagucuucuuccucucauagauugugagugguccugcaggcuggugcagucacuguugugaccugccaucuuuguccucaccuuggguaccuuuuggaacaccaccuuagccacuaggugugucauuuauggcucuaacugauccccaggcuuagauucguagugaggccuugccugugagcuugauguaagugcuggaauuuguguuaaaagcuccauaacguguucuuagaaguugcuuaggaaaaaaugcaggaaaacguuuuauuauaggaaacuuccauaacagaaaagacuaauagacugcauuauuuuuguauuuacauaauuuuugagugcauaacacauuuauauguucaaaagcaaaaacuuguauaacaacacaaaaaucccuguccugccucugugucuuuucugucuuguccugaccccuccccagccagcccuaaccuaagucaucacauaacugguuuuggggauauuucaacaaauauuuuuaugcauguauaaucaaguaugaacauguauugcuguguccccaccuuuagcacagauggugcauuccacuuuuuaagaugaucuuacugccccugcccagugucauuuuggccgcaccaaagugacucccaucucuuuuuacuuccauguccccaagugccugaggggugcccaguaaauucuagguagacuuugcuuucccuggucaucuggcucaagugccccaaacccaccaucccucacaccugggacuccuguucuuugcuuuugcccccuucaaacuauaggcugauuauuaaaccacccucuuguuaauggacauuuagguuguuuccaaucuuuccuguuguaaacaauaaaacaaugcccuuuaauaaacuucauuuugcguauaugcauuuucauauagaaaaaauuccaugaaguguaguugcuauauugaaagguauauguauuucuaauuucuuucuuuuuucuuuuuuuuuuuugagacaggguuuuguucuguuacccaucauggcccgcugcagccuuguccucccuaggcuuaagcaaucuucccaucucagucuccugagcagcugggacuacaagcgugcaccaccaugcccagcugauuuuuuguauuuuguagagaugggguuuuccuuuguugcucaagaagcuggucuuguacuccugggcacaagcaguccauuuaccuuggucucccaaagugcugggauuacaggcgugagccaccacacccggccuguauuucuaauuucuguaaguguugcuaaacuaucuuccauaugggguuauacuaacuuacauauccaucaacaauguacaagagcccuugguuuuucacaaauuugcugacaauaguauguuaucaaauuuugggguuucguaaguugaauagaugaaaaauaguaucuauguguaguaugaauuuguauuucucuuagagugagguggagcaucuuucuacaugugccuauccuuugaacuaguuauaucuuuugcccauuuucuauuagguugcuguacuuuuucuuacugauuucuaggaguucuguauauauuagagagaucaguccuuuguaggugauauguauugcagaucuguuuucccauuuuguuauuaaccuuuugaguugauuuauauugauucucccgucucagccucccagguagcugagaccacaggcacgaacugccaugcccaauuaauuaaaaauuuuuuuuuuguagaaauggagucucccuguguuguucaggcuggucuuaaacuccuaggcucaaguaaucccccugccucagacucccaaagugcuggaauuacagguaugagcugccaugcccagccucaccuuacuaauuuuuauguauucaaguuaauugguucuuuguuuuuucauggcuucugaaauuugaaucaggauuagauaggagcagauugcguuugguagaguuucuuuggucaguuauuugaacucuugcugccuuauaauccacuuugaucuuuuuaccccauuagaauaguuuugucugaauucugccaauggucaaugguuucuuucuuuuuuuuuuucuuuuuuuuuuuuuuuugagacggcgucucgcucugucgcccaggcuggagugcaguggcgugaucucagcucacugcaagcuccgcccccuggguucacgccauucuccugccucagccuccugaguagcugggaauacaggcgccugccacuacgcccaacuaauuuuuuguauauuuaguagagacggggcuucaccguguuagccaggauggccucgaucuccugaccucaugauccaccugccucggccucccaaagugcugagauuauaggcgugagccacugcgcccggcccugccaaugguuucuaauuuaauuguugcagaaaugaaaugauuuguuuucuucauagaagacuucuaaguggcaauuugggccccaucucauuuguucauaaccaacagccuaacauaguaugaauuguaucacuuacaguugaucuucccauuguauuugauuagauacaggcguucuaaaaugcaaauguuuaaaaaauacagauagaacuugaaauugaacaaaauuagauacaacugaagcugaaaauggacacuugauuuuuaaaaauuguaauaaaaugaucuagauuguauacaccaucuguuacaaguuguaugugaauaaggauuuugugccauguugguugugaguacucuggguuuuaaaccaguuuuugcaucgaauauaacuuuaauuaugcucaguacacguggauguguuuuuuggauauauccacacacaguguacuugcauguguaucuucaucuuauuuauuguuugguaagggacacauugcucagcuuccuggauaucuuccuagucuuagaggggccucagugguagaguucuuaucagaaccuaagggugaugaccucuggccugugacauggcaucugccugaacaugagugugccacaagauuguaucuaagguggucucaaucucuuuucuuccuucagacugccuugcuuguccuuugcuggcaucugaggacuuguccuguggaaugaggcuagaaagaggcgucucuguauuuccccacugugcaucuacuuguaccuccaaucuuucccuuuaccacccauacauggacauaugcuuccaguucucuggacauauguuuucugucuucaccacuaggguauauaccuauggguggaauugcugggucaugugguaccucuauaauuaacuuuuugaggaacugucaaacaguuuuccaaagugguuguaccauuuuauauuuuacagauccaccagaaauguaugagggugcuuauuucucuguauccucaucaacccuuguuauugucuguuuugguuuuguuuuuuaauuguagcuauccuacuggguaugaaguaggauuucauuguuuugauuugcauuucccucaugacuaauaacauugagcaucuuuuuauguccuuauuuuccacuuguguaucuucuuuggcgaaaugccuauucaaguccauaugcauguuuuaauuggguuguuugccuuuuuauuguggaguuguaagacuucuuuacguauucuggauacuacacccuugucagauacauuauuugcagauauuuucucccauuuuauggguugucuucacuuucuugauacuacucuuugaagcauaaaaguuuuaaauuuugaugaagucaauauuuuuuuuuuuugcuuuggcugcuugugguguuauaucuaaaacccguugccuaacccaagaucacagauuuuaacucuugcauuuagguuuuugauccauuuugaguuuaaaaaauuuauuauaugcuaugaaauaguuguccaacuucauuuugaauuauuagaccaguuucauucuuuugcaugugaauacucaguucucaugguacaauuacuugaaaauacuauucuuuucccauugaauugucuugguacucuugucuaaaaucaauugaucauaaauauaugaguuuguuacuagacuuuauuuugagauagagucucgcucuguugccaggcuggagugcagugacgcgaucuuggcucacugcaacuucugccuccuggguucaagcgauuuccugccucagccucccgaguagcuggaacuacaggcacgcaccaccauaccuagcuaacuuguguauuuuuaguagaaauaugguuacccccuguuggccaggauaaugucgaucucuugaccucaugaucugccugccucggccucccagagugcugggauuacaggugugagccaccaugccuggccuguuacuagacuuuuuuuuuuuugagacagagucuugcucugucccccaggcuggagugcaguggcaggaucuccacucacugcaagcuccaccuccuggguucacaccauucuccugccucagccucccaaguagcugggacuacaggcacccgccaccacacccggauaauuuuuuuuguauuuuuaguagagacgggguuucaccauguuagccaggauggucuugaucuucugaccucgugauccacccaccucggccucccaaagugcugggauuacaggcgugagccacugugccuggcuguuuuuagacuuuuaauucuguuccauugaucuguauagaugccuguccuuaugccaguaccacacuguuuugauuacuguagcuuuauaguaaguucugaagauuuuauuccuuguuuuuguucuguuccuucauuauugacuuggcuuuuuugacaguuugauuaugacaucuaggugaggcuggcucccuuuuaguuuauuuuacuuggaauucauugagcuucuuggguguaauuuuuuucaugucaaauuuggaaaguuuuuagccauuauucuuucaaauauucuuucuucuuuucucuucuguauguugguaugcuuaauagugucccucagguucugugacucuguuuauuuuucuucacuguuuuuuccuccuguuucgcaguuuggguaaucucaauugaccugucuucaaguuugcuuguucuuucuucuaaaugcuaaaaagugguuuugagccccuuucaugaacgcuuaucuuuucccccuuuuacuuuugaacuccagaauuuguauuugauucuuaaaaaaaugguaauaauaauuucuaucucguuaucaguaucaauagugauacugauauuuauugauauucucuacuuaaaagacguuauucccauacuuuccuuuaguaauuuuugcauaguuuucuuagcucuuugagcauauuuaaaauaggugauuuagagacuguuuucugcuaaguucuucauaugugggcuuccucagggacagauuuuauugauugcuuucuuuuuccuauguaugggccauacuuuguuguuucuuugucuaauuuuuuuuuuuuugcuguuauugagaaauggauuuuuaaauaacacaauggggugacucaggaaaucagaugcuccuuucuucccaugguugcuauugguacgugauauaguuguucuuguuuaaugacuuuucugaacuaauucuguaaaguuuguauucuuuauugugucugaccagugaaaucuguacuuggugaacuuaguggccaaguaauuauuagauggcgauuuccuuaaacuccugggaucaguaaacaccuguuuuugucgaggggcuucaucuaccuguuggagcauaccuucauugcuuggccuaacaguuaaaaacugccuuagccuuuauuuccugcugauguugagucaaagucagccagaggugagagcuuaaggccuucuuagguuuuuccugagugugcagugaagcucuguacauucaugugucuuucuagauuccugggaaaaugucaaagcuuuucaaagcccccacggacauuuuauuucccaccuuugccuuugguuugccucaguuguuaucugccaccucaggaggcugcaaaguuaaaacacuugccguauuuucaacagacacuccuggguugggaggaaggcuuuucugaguuuagccagaaacagucagucagucuugcaaaugaggucuuacagggaaccaucagacaggucaaaugaugacaguucuuugagaaugaagcuuugaaagagcucuaagagcacuguuuucuccagcgauggcugcuacgcuguaccaggaaugcggccugcugagagccuggagaguggggaugggucuaggccaaauuaaaauaucacagagcucacuguucuuacugagaugugguuguuuuccuugaauuaaugcucccuggguuccugcaaaccuuugguuaguuuccaaaauccauaagaaguugauacugacaauuuuugccaacuuuuugguugcuuuuauggaggagagcuuuuuggaggccuguaguaaccaccauuuucacugacauccuuuggaucaggaaucucuuaaaucuuuuuuguuuuccugaggguucuugcugcccuucuuuuuuaucuuguuaucaaaaauaguauacuucaucauaaccucagaauuacccagauucauuaauacugaguauugucuagaaaucucuuucugccugaacuccacucuagacugguuauuuccuguucugcuguauagcuacacuccugguauuuucuuccugcguuuauagauuaaaugcaguuuuuggacuugaguuggauauuccucuuuuucaguuuucauccucauuuuguuuuucucaaagugauauauaauguagaauuguuguauaucuuaaaaugcauuuauuuuaacuuuucacuuauuucucaguuuggguguauguagaauucuagcuuaaaaauaauuuucccuuguuaggauugaaagggauaucuucuuacacucuguguaauugauucuggaagucuauuccaucucuuugugaguaagcuuuuucuccuccuuggaacuuucaggaccuuuuuaaaaacacccagugucauaaaauuucaugagucuuucauucauucugcuuagcucuuggugggacuuuucaaucuggaggcauauuuuccuuuggcucuggaaaauuaucuuauuacugucauaauuucuggaaugccaaauugauugccugaauugaucuguguuucuaccuugauuucuuugacuuuaucuuccagccucuuuauugaaguuuaauuuuagcuacuguauuuuaaauucuuguguucuuucuuuuuggccuaauuguucuauuuucauauuuuauucugguuauauggauauagugucuucucagaucucugugaagacauaaaauagaaauauuuuuggauaucuuuuuuccaaauuagcucuguauuuuuuuuuaacuuguuuucaucugccuguuuuuucucacaagaugcagucuucaguucucuaguuuuuuuuuuuuuuuuuuuugagacagaauuucacuccuguugcucaggcuccuguugcaauggugcagucucggcucaccgcaaccucugccucccagguucaagcgauucuccugccucagccuccggaguagcugggguuacaggcauacaacaccacgccuggcuaauuuuguauuuuugguagagacgggguuucuccauguuggucaggcuggucucgaacugucaaccuuaggugaucugccugccucggccuccuaaagugcugagauuacaggugugagccaccaugcccggucuuuuuuuuuuuuuuaauacaaaaauauuuuucucccauucucuugagugugggaccguauugauggguuugucuacugugugucugaaaccugcucgucccaccaccaccgacagcugaguggauugaccagucagcuuugcuuuauaggacauagggucuuggcauccuaaugcuugagugaguaggacuucacuugacacacaggcauccacacuagguccucagacugcuggucagugucuuuggagcaagguccuccauucuucuguagcaaacagagggauuccugucccuuucaguggggcguccagggccacagcaguucccacaugugccccuggccuugcuccugcucugcauaccugccgacucccaacuggagccuauguagcuguggcuucuggaugucuccuacccuauaggauuugucuccugugccccuccuccuuuugucuucugcagauuuguugacaucucaucuguuccuggccucccucuucccccauuuucacugucugggguuuuucucuucaugccuauuaugccugcaguucacaagaggucagagagauggcugucuguucccagugugacaucuucaccugggaccucuggaagcauuucuugucugguuuucucccuugaugauuugguucauuccccuggguaggcagugugagaagcuuccccaaauuuggaaauuauuauguuauauagagcugggugggagaauuauauuuguuaagugagcuuguucuugugaaggcaggcugaggagccuugggcccucugugucguguuuccauugcacacaaguucaugguuagacaugauuuggcccaacaugugucuggaucauuucaggagugaguggaucuguuguuccauuugcucacguuccucaugguguuagaagguagggagugaagcucaguugccuauuguucaauaggacuagccaaguaaauacccuuuuccgugguaaauuccccuaugaaaggucaugcaaguggaacugcgaucucaugagaggaugcuuccuuggagucugcaugugaaccuggcagagccgccugugguuagcagaauaucuucgcugugucccccagugggcagccuucugccaccuucuccccucacugcauggcucaggaacuaucuuucauuuaguaacuaucugaugggcuggaugugguggcucacaugugucaucccagcacuuugggaggcugaggcaguaggaucacuuggggccaagaguucgagaccagccugggcaacagcaagaccccugucucuacaaaaaauaaaaauaaaauuagccaggcaugguggcacguaccuguagucccaguuacucgggaggcugagguggagggauugcuucagcccaggaguuugaugcagcagugagcugggaucacgccacugcacuccagccugggcaaugcagugaggccgugucucuuaaagaaaaagaagaaaaacugacagcggugacuccugcacaucauuucucccauuuccauuuuuuauuuacgaauauuuaaacuacaguuagguuaugguauuguauuucauuggaaauacuaaacuccaguuuggaaaaucuaucaguuuggguugucuuuuuuuccaaucauuuuauaagcguuuaaugagccaucuaccaaaugacauggagaguagcuuccaaauuauuuuuauuccacauaccuauuagaaaaaaguuuuaaguacuugaucccagugucuucuuaaugcauacauuauacagauacaaaauguaaauggaaguucuguuuuauuuccucuucuaauuacugaccugugaaccuccugggguaugcauacccugcuuuggagacugcuggcuggaauacaugauaugaaguaaaaggaacccuacucccacagcugccaguccaguucuggagacggacaagugguggggcagggauagguguuccuagggcgguggggaaggccauggggccagucucugccuaggacaggcucagagggaggagggugagcugaggcuuuuagaggcuugguuuuguaaagaaccaagacaaaaugcaaaaccaugugcgaguguuggugguauauuggugagcauagcugccuuccaaaaccaaaggaguuggucucauacucuuggaugaagaccaggcuauagucaaccaggcagugcaguggcucauggaaggaagagguggugcuugucucuuguacagcaguccuggggugagcaauucagggugugcagcccccucagcuuucuugguugcugugguccagggcugggcuccugcgucucccagguagccacaaggggaggcaaggaagaaauaccacuugucuccucugcucacuuuuugcugugacaauuggucuccguuaacuggagaagggagaagaagauugggucacagcagcuuccaccacagcauuuuacguuaccaguuaugcugagaaagauuuucugguggauuuacuaaaugagcugacaucuucagguugcucuagguauaaauuaggcugguaugguuuucuucacugagaugccuggugagccugaugacagcgcuguagugugcagucagguaccuuggaaaccaucaccacucccaccguacagcacaccaguggucacccugauaggagagaugauuuucuucugcuguguccccaggucucaguggcccuuagcagcagcuccauucguguggccaugcuggaggaaaauggggagcgcguccucauggaagggaagcucacccacaagaucaacacugagaguucucucuggagucucgagcccgggaagugcguuuugguaaguuugggcaccuguguguagggcucccagguggacuucaaaccugcagugaugccccuuuugaccaacaagccuauuuacacuuaagcagugagguuguuaauuucagcugcuggggcagauggguuuuccugagcauuuuccauacugcucagagaucgucucugugggcacuugagcuuuggcccuuugaggucuuggucauucccaagagcuccacuguucuuacaucuaaggcaaaaacaaguaaauugaaaaugaaaagcuagguugaauuuuuacagaugcuacucuggaggguacagaguuaauaaauucagagaaucaggcucauugaccaacuggcuguccuuagccagcugcugguuaggcauagcuaagaguucaggacagugagauuaaggugugacuccaaaugaacagcucacauguuaccaguuagcagacucgcucacaaauugggcugcacgccugggccagaucuguugguggcucagcuccuucuccccugugaaagcuuugaaccuugucagugguggcucugugcuggugcccaaguggaggucaccuacagauaaauugaggcacaacauguucugaacuaacuuguuuccuuuuuuucuccuacugggguguuuacagggcaugguaaaaggaauaaaggugaaaagaaaaauauaaugucuggacaaaagucuuuagaauuuuauacagauauauucuucauaugugcaaaguaugcaauaaagguaucuguuuugguuucuauaagacaugcuuggcaggcuucugccugggcuucccuggccagugcugacuggcagggacaaacuaucucucaggcucacagugacucuguccuggcuguccucaugcucggagggacaugcaggccagguaccgaaaggaguguauucugucagugcugcagaaaccuggaccaaccuugacucuggucuugauaucaaaccuggacaauggagcucacucuggcuacacagagguggggccaaccugggcacagacaacaugcuccuuggugcugccguggccucaacugcucacucuccuagugaguguuucauccuaagcagggccuccuauuuaggcccuacgugaggcccuaugugugauguguagaguuuccagcaauggggcuuggacuggcccaucccaguucugacucuccuggccacccagggccuaccucugcugauggccagugguagauggcagugguucuuuuucuaaaucucacccugugugcuccccugcccauggcauucagcagccaaagaccagagaagugcucuucuccugccugcaaauacugugaagaucaccccaucacccagcaguucaguuccucauccuuugaccccagacauauaaagccugugcauuaugacacagccuggagccuuuucccaagcuauaggcuccugugacuacuaccaguuccuuuccuuuaugucauacuugacuuugcagaugccauuacggccucucccucacuugagcuucacgugguuguggagguaugagagcaugagugaugcacuaguaguacuggggccggcuagcuugcccucugaaggugcagcccuggccgccuguauuacacuagugagcccgugauccugggguugccaucuccauggacugagaggucgugauagcccugccuuaaaacacuggccuugacucuccugccuuccguugggugaacucagugcagaucauggagcaggucacgaugcucucaaguugguucccucugagcgaggagcucuuggugagcaaccccgugugugguccgguugcacuuuuuagauacuucaugcagaagcccaaagccuuagucacuggucucugagcccauagccaccguauuuggaaucuuuugggauuacaaucaggguaccaaugauuccuuuuacuuuacacuauuugcauaaauaugugauuauuaauacauagcucaacucuuaaggguuuuguugacggaaguaacucuaacuucuucguggauauuucaaagccauguuucuuuuuugugugcguuuuguacacuuguauguauaauacaaguggaauagggaugugacuaguggccaaaacauuaacuucuuuuaauaauggccgccauucaaugaacacagucuuugggccaggcucuuugugaggugccuuacaaucuguuuaauucucugcaaacuuauuuuacguauugggacauugaggcuaugagaagguaaguagcuugcgaagcggguagagcuagaccucaaacccaugccugccuugucccagaaggcuuuuuccagugcugugagaaacgggagucucuggagaaggcucagaccugucggggcugggaagcauugcuccguuucagcugaaaggcucuguggagcagaacaugagggaggaguguggguccccauuguggguuucagagucuucccuguguuagguaaaugugugagaugcagccaccaggcaggagguugggggagcugugccuuaagaggauagcuggauguuuaacuuucaugccagggcccccggggccauagcacaaucccggcaggccugucuccaccuguguguucugcuugaguccaggcuucauuugugcccuggcugccuuuaguuuuuuuaguuagcuuucaugaaacaccugcuacucaaagagcuuguagaaauucagcagaaccauugcagacugaggggcaccugucacugcccgugaacacggcuccuaaauauucucugcuaaaaauuccucuacaauugaaacacugcaugaguucuuucccaugguuccuuaaagugccuuuauuaucaauagauggcauugcguuccuaaugcaccuucaccugugagaaaucaaguaccugaauaaagaggaguuauggagagcauuuaaacucuucccauagugcucccgugcagggcucugccugccuccaccucuuucuggaccacguagccucuacugcaguaaacacagaguauaucacagaaacuuugcuguuuacaggagcuaaggcguuuguugucuucuugauauaauuauuuauuuaugugugaccuuuuaagcccacauuguuuccucugauuacauaucugagauaauauugugaauuaaugagccgauugcuuugauucacgaagauccuguuugccucccgcuugcugcaucacgucugcuguguggagcuuggcacacugcuuugagcguguggaugcagagagggacugcaggugaaucagaggggcuggcuuuggguugcagcucccugucaagcagcugccagguuuugggucaucucuuuagccuugcuguacuuccauuucucaccguucaaacaagguugagcacuguagucuuguugaucuccaauguuuguugguuucuuaucauuaaguacccaacccugugcaggcacugggaauggcuaaagaaagugaguugagggcuuugcucuaaaggguuggagauauccugugaauguggccuuauuugggaaaagggucuuuguagauaugauuaaguuaaggaucucucaagauggaaucacccuggauuauccagugacaccugucuuuauaagaaacaggagaagacagagauagacacagagaaggccaugagaagauagggcagagaugaaugauauaaccaccaagcccaggaacaccuggagccaccagaagcuggaaauggcaggaaggauccuccccuagagucucugcaggagcauggcccuacugacaccuugauuucagaguucuggcccauggggcugggagauaauaaauuuguauugccuuguaucgccuggucuguuguucccuguuagggcagccccagacaccagugcaggucucccaucacagcacugcugugaggcugcaugagaugagaaggaugcaaagggauggcguccagagcugcgcugcugccaccacccucagcuccuugguuagauauucugaccuucugaccuccuggcagcccagugcagacauggccuucgcuucccagcugccuuccacauaaccugcuccucccugugccguggaucccacaucagccagccagggcaggcagggguggcugcuaaaaccguaugacaguucuugccucccucccucccucccacacuucagaauguuaaaugagacuucuugacucaggcaagcuccuuucuugguuacgaagauguaaaaucagccguggcaacggcaccagcucuuuuuuccgauagcucguucaguccccaaagcuaggcaguuggcaugcgcaccauccuccuuucuuccugcagucgggggagcugacaggcuguccuccaugcugccguggguggcugcucugcugcgggggcucuuggacauggcuaugcuugagauggucguuguagcuguaugugaggugaaugccguuccauauacacuucuucauguauugacguggugcgcacacaagucauuuaaaaucagugaaauugcucuggaguauucuuugaggaguuagaccuugaagcucaggcuuuaaaacucaucguaauauauuuguuuaugauuuuugaacccugugaguguuuuugugcaagcuguauccaccuccuccccucaauuuagauuauuucucaagaguggaauucuaguguaacugcagccucugagcuguugcugugguucucccugguggaugaguuguuucuggagugucgccgaugacauuagcccuauauccccacauccccaccaacagugggcuuuucaucuucacuuaucuuugcuaauuuacccagauacuuccagugucacuucuuagaacaauugugaggauaaaaugaagaugggugguuuauugucuacuuguccucauuggcgagccacuuuccugaguccccacaacuuuccuggcucauugaggccaucccauggauuacuuaacauacuucuucauaaacucagagugggaacuacagauuaaauuaccuuagcauuuuggcaagagcccagagccuggaaauuaguaugugaauguaaugugagcccuuaagccuucagugcaagugaugucucuagggagagcccucagcguuuuucaggggaaaucagaauccuucaucaguuccaguagggaagagcugaagcuuacagauuuaacagaaggcgguagcccaaggaaaccuguuccagugugaguggaaggaaugugcugagcagagccggcuaauggugccucuugguggcaccauggacagggugcugggcacccucguuucaugggguuggaggagaggaaaggaacgcagcucggcauugcuuugucggccccaucccuggaauacaugggccuuccagccacacucagaccacagcuggguccuaucuggccuauacagugucuuaauuuuguuucuaauuuucaagcuuaaaaaaauauuugacagcauugaaaaucaggagauugcucauaacagugcugacuugugguguguccugagaagccagaucugcuccauuguggcccacauucccccagcagcaggugcugagcaggugcccuggaccucugccacgcugucgucucaccccguuaucugcccucgcucugaggugccuucccggaaggaacgucccacaacauucccauaagucucauuggcccagucucgaucacgcgggcagcugugaggaguaaagucguccucgcugggcacauugcuucccugaauagaaaugagguuccguuacuaaggaaggaaagggauauaaaugcuggugagucaucagcgcagauugggggaugcugagguaaguuuauucauguugagguggaaguuucugugaggacauuuugggaacacuguucagccugcagucuggggucccucagaaauggacugauuagaggucugggacuggguagauaaaagaggaaccuggagcauuuuguuaugcuggaaaaugagaacgugccagggaaaugauugagcaccaucaaagucaagcaaccuccaccaaccuugucugggauuguuucacaccaacauaauuaagcaugguaaugaguuauaagccauugagagaccagagaggccaggaauccaggggucaguacugacagcaauagauagauaauuucauugcagaagagaaggugcuugcuucaauaagaugcauaagccaucagucaguguggagggacuagggcaagaaagucagcauuucccagccuucgugggacagaugggaccggcagaugcuaugcggggcaggguggagcagggaugcagggguucuggagaggagaguuugcaagucaauaacuacaguggagaagucagaccucccuuuggccagguaaccugagugaacaccccacccacugagggcuguggauguugugugccugcagguggaacacauguguguccagcugggugugcacacaugaguuaaucaggagaugucaggggaggaaaaaggcuguggaaauguccuagauuaaagaggacaggacccccaagaugcaggaaggacucuggacuggacccuguuccguaaaucaucauaaguuauuuccuuguccuuaggaaauaacucaggacaaagggccaagaugaaugcaaccuauucuuaaaugauucagagaaaauacuauguuauuauauauuauacauacagcauacauauagagugagagagcuguguacagacacacagcugcuaaacacuuguaugggugucuuuguacuuauucuaguaacuuuaagcuuaaaauucuuuacaaauaaaauguuaaaaaaaaugagaaggcuaauaagcacaugagaagcuuaacgucaugauucauuaggggaaugcaaggcaaaaccaugaugagaugccccuagacaccucuuagaagagcugcuaagaaggcagacagcaccaagcgcuaaaugagauggggcaccuggugcucuucugugcuacugguaggggugcagcagaguggucagucuggacaguagcugacaucacgugacccaacacacgcauuccuggcuacuuaccaaggagaauagaaagcaggcagaucucuacagcagcucucuaccugauugcaaaacaauggaaaugcccacauguccacaaacaaguguguggucugccugugccaugaagcacaguguggcugagcgucaagaguccccacacucaaaggaggcagcagauacagggcugcacacugugugauuccacacaugugacauucuggacacggacaugcuggauggcaaaacgagcaucgggcugagaggacugcugagaaggggaacggggcugcugggauguggguugauuguagcaguagcucauggagaugugaccucaaaagagugauuuuuacuaugugcauacuauaccuccacaaacuugacuuuaaaaaaauaaaauauucacagaaaaaaacaaaaacaaauguaaaaccaucagacuacuuuaucagagguguuauuuuuagauagaggucuuugaacuccauccuaggaacauuguacccauguccucccagaacugcaucuugcacugggugucggaagacagcccugcaagaccuguaugcucuguaccauucagugguuuuuaagguuaacuaccagaagucauaucugaggccucccagaagcauuacucuaaggaaaguaguuaaauguggacagugacagcagaaacauuuacacauuaaaccaguuuauagaacaugagaauguucagagcauaaagaagcuugucagcucaaugacuuacgaggcgugggccauuaaaaaaaaaggucuggaguuugggaaggagaaaggaauggggaucugcagcucagagugagagauggaauucuguaaaggaacaguguggagagggacuccaggcaagucaauaacgauguuagaaugcccuuguuuagaauaauuaucaugcuaauaauauuguucauauuguuuuuacuaauaugcucauccuuaaaaauagaagauauucuaaggguacuaaauaaauaaauaauuaaaauuuugcaacugagaccuuccucuuccagagccuuuacaagaaccuuuauagacaacaccucagguccuguuugcugccccagcauggagggcagcccacuugguuacagugaugacagauggaaacuugacuggagcaggucuggaaggcagaggaggcaggccuguguguauauggucaggacaaaggaccaguggugcuagccacaccugugggauggcuguaauuaaacacacacacacacacacacacacacacacacacacacaacagaagauaacaaguguuggugaggguauggagaaacuggagccauuguaugccgcuggugggaagguaaaguggugcagcugcuuucgaaaauaguaugguaguuccucaaaaaguuaacuguagaauuaccauaugacccagcacuucuggguaaauauacagaagaauugaaaacagggacucaaacagauguauguacaucaauguucauagcagcauuauucacaacagccaaaaagugggggcaccugaaauguccaucaguugaugaaacaaaaugugguuuauccauacaguggaauauuauucaaccuuaaaaaggaauggaguucugauucaugcuacaacauagaugaacauugaggaggacauuaugccaagugaaauaagccagacaaaaacaaacagauaacuguauuauuccauuugugugaaauguccagaaccggcaaaucuguagaggcagaaucauuaguaguugccaguggcuuggugggguugagggaacaauuuagaggaaggguuagagcaaauggggagugacugauaauuggcacagggcuucuuugugagguaaugaaaguguuuugaaacuagauaaaggugaugguugugcaccauuguggauauacuacaugccauugguucacuuuugaaugguaaguuuuguguuaaguggauuuugccuccauuagaaauuguucaauauaaagucggcucacaucuccucauaaaauaccacacugaugcacaugcgugacgucugugagugaggauggcccccuuggagagcugcacugcccagcacaguagcugcuagccacauguggcagcugaguaaacacuugacagguggcucacgugacuggagaacugaauuauuuuauuuuaauuaacuuaaauuuaaaaccuacuugauuuaguuacuggaaaaccuugaauauuuuugaaacaacuugggcaugugaauauacccuuucaauuguaaauauuaugaaaucugaacacagaugaaguauuucugaugaaaaagugcagugcucaucuuaauuuuuguuggguucaaguguacuucuguguccaaaguacacuuguggacacagaagauuuggggauguuccccuccuuccuguugggcagguggcucauugucuucagguccaucucccacugugcccaggagcccuccacucuggguguguguuuggaccuggccagugaaacccuguguuggggucuguggagugccaaaaggccugagagcaccagcaccguccccuggaugguauguaggccgacccccugcccacauggugcugauggugggcugucagccccaguguagcucugcuuugccucuucaugcugggcaaucuggaaaaggcccuuacuuccaaggguuuguccucauuuuuaaauacaaaaaaugguauguaugguaaaugguaaugguauguguuuuacaggacuugugaacgcuaauaaaauaaguuacauggaucacaguaauaacuacuggugaagauaaaaaauucguaaaggaucucuucuuuccagagauuuacaguucugugaguuccucugaagucuucccuggaauagagaaaacaaugcauuucccucuuggaagguuuucauugcaucagcuugguaaagacgagguagaguuuguaguguuggggucucugagggugagucagguccccgucacacaaacuguaaagucaacgacaaaccagcuuagcagaguaucuggaaauggaagauucaucccaaauuuaaauugcacacuggcagagcagcgucauuuacuggguagagcuggcguguaggggagccacccacucccccuguucaccacucccccuaucugcauucggaaugucagacaagauuucugggaugcuggcuucagaucaugauugcagguuuuugucuugcucuucccaguucuggaaaaucuccacugugugcucucccgcaccacaucggugcccacccucuucauuaguagaacacauucucggacuugaucccugggcucugcagagucuggugcugaguaccuucuuugguguggguagguuuuggcagcaggagcuuggaggugggaagguggaaggugcaguguuaggacacugcucucucaagcccguguauacuggugagucuccagugcucccucuuggggggacgugguguccuguggacucacugugaccucuugagugucacaguuacccugaguguggcuugguagguuuugcccaccuggucaguaaguguccugguggcugccaccuccauggaugagagcugcucucacuugcgggcccuuugcuaccuuuucucccuuucugugagcaccuagugguuuaaucccaucagagagucccaucacacuugggcaugugaauguaccucuuucaauuguaaauauuaugaaaucuaaacacagaucaaguauuucuguugaaaaagugcagugcucaucuagggcaaaguagacaaacccacucuguugcuucuuggccacucugguaagaauuuugagcccagccacugaccacagcagaugcagccaguuuucuuguuuucugugucuguaugaccacugauaacagggcaugguguggccagggcccuccucugugucccugggacaggccaagcagccagggucaccuagguacauacagcaccccucacguuugcucucauacugcaguuccaguugucuuuuaaguuuuuaugguaaugacaugagucucacagaccccaacacugagggcuggaucuuaaaugcugggugcugcuuccuuugaccaagggaugucugugccauccccacagaggugcccaaggaggccucuuuugggguuguuucuugauggucguuucuccuucccaagccaucagagaacuuuagggaauggggcuggaggacccccucaugcagcaagcuuggccccagugaggaagaaguggggacagggcauggugcccugucauggggugaggacuccccaggagauucugucaugcauuaggcugagcccuaagucucauaggucccagcuuaccccuaagauagcagaauguuggauguugcucuuggaagcaagagagaucacuggagagguaguugguugauaagagcuaagcagagccuuccauggcaagcaugggggcaggcuggguuggcccaggacagguccuggugugggggggugucaugggucuuggaaaauagccuuucuucaugagagugggcaaggugugcacauggaacaggcacuguccugaguauccaggaccugcugaagaaggauaaaggcaucuuccagaaugucaguccccucagguaugugccuccuagcucuucccugggauauguuagcacaggcagcaaaugcauucccaggcacagaggguccugccuuggguucuggcacccccucuugucugucaccucccuuuguguaguugguccugagcuuauccuggacacccaucccucagugggcucugcucuguccccagcccuggacaccugucucaggucucugacucaggucucuguccugcuuguccccaggugaaccugagcaaggugggcgaguauugguggaacgccauccuggagggagaagagcccaucgacauugacaagaucaacaaggagcgcuccauggccaccguggaugaggaggaacaggcgguguuggacaggcuuaccuuugacuaccaccagaagcugcagggcaagccacagagccaugagcugguacgagcauggcaguccuggagaguccacccuuuaggcccuugugcuggugacaaggccgauaguggcagagggguuggugaugacgguggggaagaagguuguguggaccagcuuccugccauguccuagccuagcaaggaaccugucuuaccugcucuuguccccaaucacugccucacaggugcacucuggucuuucagcuguguucucauaccugggcugagagcccaguuaacaggaccucgaagggugucaugagaucugcccuuccugcaccagagccugguaacaucaaguguguugauggcuuuuguuugugccucaucugcacauaucuucccaugaagagucgcuuggugggaccuuugguagaggaggggagggagccagauugcagagccaguuucuggauguuggaggccagcaugugaagacucugugaugucagcaguggguuagggaggaggaagagaaagguuccugucugaccaguguagugcccaguguagaguuugcucauggccaaagagaaugauuaauuagauguauacauucuuucuuccuauuuuaauaacuccaagaguagcuauuuagggaaaaaaggguugcuuuccucagauuauuuuuaacuucccgugucccauauacccagcacguggguuugggccgcaguacagcagggcacgcggacgcagugcagccuugagucaguggggaggggucaucugcugggcacagucuccuuauuuuuguucuguaaacacggaccgccuccucccccugaagaucgcugaucgauauuuucuucucauuuugucucuuggaggaaccuuaccuugugguguaucuggauugucuuagucuuaccuuccgguacagcacguauuaauacaucguaggugguucugcaagcccuguugcugugucucguccguucuugccuauuuucacagacaggugcauccugcucuuaugaggugaaggagccugcggagaggagugucaacauguucuccucaccuggcccugccacaccaggggcauguccugagcacuuaguacacacaguuaaggugggguugacuggcugcacaguaccccugaaaauacaguuuguuuguuuuuuguuuuuguuuuuguuuuuuuccccccacaauagagagauugaauuucugagguugugacucaguagcuuaggcagcagggaugggguuugaccucugauuugauuucacaccugucuguccucacagcccuguccacccuggcccuugucucuauggaagagaauguuccucuagguuuggcccccuuuuccacccggggcauggcaagcuuaaaggacaucuuugcuuggccuacguccaugcagaguuugaagccucagguaguauugcagcaccugcucagcugagcucagcucaggugcuuagacagccagaccugccugguuauggcucauuccaguuaugcugcauuugccuguggccacuagaugaaaggccagccuuugaaccuuugcccuguggguagggcuucucaugguaguguuuggggaugguguaugugagggucugcccacucugugcccauauucagcauuggguccacaaaaggacugagauguauucaugaguugaccuucgggagaaagagucuguuuugacuggagaacaugaacccagaugccuuuuguuccagaaagauaagaaggcagucuuaccauguaccccuuagaagugucuuuuugugccacaggauggagggacuaaggucaggugguuucucacaucuuccccagacacugacacugagccuuuguuacagagagaugauaaaaauuauuguaguuugaaugguauuugugcguuugucaaagccuugaugaaguuuuuguagacuuuauuuuauuuuauuuuuuaaauuuuuugagacagagccucgcucugucacccaggcuggaaugcaguggugugaucucagcucacugauaccuccgccucccagguucaagcgguucuccugccucagccuccugaguagcugggacuacaggcgcacaccaccacgcccagcuaauuuuguauuuuuaguagagacgggauuucaccauguuggccaggcuggucucgaacuccugaccucagaugauccaccugcuuuagccucccaaagugcugguauuacagacgugagccaccacgccuggccaguuuucuguagacuuuagcuguugaggcaugagagaagcuaggaugcucuggcuguuuuuaucugugagcccucauguuuccugugauuguaucucuuacagaacuuuauauucaaaaacaaaauagcaggaauaccugcucaucauuggaguugccaguagugccaaagacacgcauggaggugucaggggcuccaccagccuuuucuucucuacauccuugccccuccccuucccuccuuucuuucuguuucccuuuucuuucccuuacauccuccccucuccuugaccuuccucucagucucuuucccccauccuuuauguucugugccaacaccuuguaacauugcauagucucaccccucuauuggggcacgucggugaggaagacagacacagaucugccuuuguggugcuaggauuccagccauuuuaaucuuaccuucuccaaagaguauuucaguccugcuuugcaguuucauugauaauccuccccaggaagcagcugcucuugucucuccauuucuggaggccuaaggccuccuuauuuuguauuuuuguauuuuuaguagagacgggguuucaccguguuagccaggauggucucgaucuccugaccucgugauccgcccgccucggccucccaaagugcugggauuacaggcgugagccaccgcgcccggccggccuccuuauuuugauggcuuguugccaagcccacugcccaggaccaggaauggggaggucuguucauuccagguaagccgaggcaacuuccaggcaguucuggaccucaaaccccuaccuggauccucacugucaguucgggacaggccaaccucaaggggugaaagauggcagcacuacacauuguauguaugcaccaugcacauacaugcuugcacacaugcagcaucauagggugcaacuggcaucccccuucaugcccugcugcccugcucugagggcaauucaguggggucauccuguugguguccucuuggcaagcuguuuuuuuggccccuagggcacugcauagcccaggcguggaacagaaagucccugugccugcaaacagcuucuugugaccuagcaugggggagcccguagacugggcagcgacccaguuaggaaggauucaaagaaccuugaagaugcugugguccaguggaaagagcucuguguguugaaucuaaaucuauucugcuguagacuugccauggggcagcauccugacccuugagaggaugugugucccuccccagaguaaagugcccugggagaucuucagcgacaugcaggagcccagggcugguggcgcggggguaggucccagagugacccucucccugagauugaccugcuccucaacagccagggagccuccagcucucaggugacagcuauagacaguaaugaacugaccucucagggcuauggucguucacuguguguguccaggcaccugccuggugcugaugcuaaagucucaacuccuuccugggcaugacagugucuggggcagggucugcagcauauggaggcuugcaacacgcagagguuucauguaaaauguccuuagugacuguagccuuuuuuuagaaaaucaaaugaggaaacaccuagaagguaggugugugcccucauguggccucauguagcagguuagccacauuuuauucaggcguccugagggauaccucacaggcagagagacuaucgugagaguuagggggccggaguugcuucacugggaucaccaggcuucgcuaaggagagagaguggaaaaugggccagguucuccugucagccuccaucugccguucacgucggcauagucacaguuaccagcgugcucuggcauugaugcccauuuauggugugaacucagaguuuucuaaauuugccaagauuucaaauugugcuucuaaugccacagaugcuguguauuuugaagcaguuuuauuuugaaaugacaauacuuuuauuguuuuaaauucuuuggugucacuaaccuuuuuccaaagucaacaaauuuaaaacccuucaucuuuucccuaauuuaauuuuuuaugagcaggauucccccaucuagaaagagaauguggaauguacaggugccauugcucugucugcgcucagaugugucugugucuaggaucucuucagccugguaggauucacccuaacaguaauugugacaucucauaggcagauagcauuagcauggucucuggucauaagagugaauuuggugacacacaggaaugccugcucuccacuuuugccucaggaaaggucugagugcugaucuuggcacccuaggaucccucuguuguaagaucaagucuacuaaucugcccuuugcacucugggcauccuacaucgggcccccaugcagcaacccggguucccaggguaagacugugguggcugcagggcuccacaggugucauuugcccuacagcuggcugggguucuguugaaagguucagaggcuucaugcagcugccugcugaagucauccauucuuguguuuuguugaggcugugcagaggggcuucauguagucuucucugcacccacagccacuccaugugagcugcagcacuuguucucaaaauggucuuuccaaagucucugaugugaguugccuguaagaaauugauaguaaugucaauuaaucccuaguauauaguaucugucuuugauaugcuuguuguugcaucacuuaggucuuaaaaaaagaaaaugaagcuggguaugguggacugcacccauaguuuuaaguacucaggaggcugaggugggaggaucgcuugagcccaggaguuugaagcugcacugagcuaugaccacacacugcacuguagccuuggaaacagagugagacccuaucuguaaaaaauaaaaacaggaaaaagaaaacccucuuguuaggaagauuauguuuuauuuaaggagaagcccuggugcugagaaucccacagccucguuuucugggccuaugcuacaggguuuugugcaacagggacuguggaucauauugguagaauaacuacuggcccuacauagucucuuuugucucuuguggucagaagguuagaaggaaggagagaucaucccuagcccucaguguacucaugguggccaggugaggagggcagauauagagucccuuugaggagaagagggccugccagcccagguacagaugcuucccucaggguccaaucucccugauguccccugccauggccacacacugagccuugcuucugauccuuggaggcuagauaguuccagaauggccacacguuggcgagggcuuagucaaccagcucugacugcaucugcaaggaugcaguggggaauuccugacugacgggucuaccacuggacauucugagguuucuuccuccgugccacauccugggucaacccuggauugucugaugauauaguucuugaugcugauaacuggggugcuaggguaucuccucugcacaccuuagucaugacucagguggggcuugagcacuuucucuacgcaccuucucuacaacccuggugggcugggacacucccucuuaaugccuuagucagugccuggugggaccauagauguugcaggguguuuggaauuuggacagagauccugguggaaaagggacaagaugaaccauaaagaggagccagugcuugcuggggacagaagauggaggguuagaaauucagucuguggagcagucuuggagagaaauuggcaggcacccaguaccucccuuggucgaaggcugcuccaggguaguacaguucucuggccagccggucuugccaggcaagugccugagcccugaggaagcaagaaggcucucuaccugcagucagagucugcucugggagaaaguacacagugcguugugauccccuuuaaucucucuauuuucuguuuguagaaaguccaugagaugcugaagaaggggugggaugcugaagguucucccuuccgaggccagcgauucgacccugccauguucaacaucuccccgggggcugugcaguuuuaaugaccagaaggaaaggaaacccucgccgguggggaggcagagccuuauccucggcugcccuucuuggcucccugcauuccagggacuugcucgucuuguuuaccccuagccauccuuucuuucaagggugaaccaggccuuccacccugaccuugcaucuccagacuguuccagagaaggugcggggccagcugcuaugugguggccgcuguggcugacacugagugaagguguuugaaaugcaggagaggauaucccagcaaauugggaucacaugcuuuugucuccacagcaaccagccacugcaggcagcaugucuuuccuccccugcucucugcuugcuguuguuuugacgcuauucugcuugcaugucuucugguugggauguggaguuguugcuggacucucaggcgaagcugaagucauugaagugugugaagcucugugcuugcaugagggcaagcaaggaauggcugugccugaggcugcucugggaaacuccuugccccuugaccucuuuugagagcauucacguggucuucuugcucauccccuuauaaaugugcuuugccugccucagccucauggucagagcaguggagacuggagcccuguuugcacguucuaguuguucggagaaagccuagguucugggcucagguccagaugcagcggggauucuguucucugacuguggcgaccuugcuuugguucuuguugaagugaaccaagcccggccaccacgcauggcaugcugugcuuggcuccccauaagacguccucuuugggugcacggugucaaagugugggcaggaguggagagcuggugcccucaggaggagaccacagcauguccaucagcucagcagagcucgacagccacaaguccugagaagcuuugaccuugaagggcuucugggagaggaggaauuucugcauggggcgugaaggcacacugucccaccacaacugaaccagaagagagugaagacuccccucuucccauccucugugccaggugccagacugugcuccuuggaacuuauggcccaaucuuaccuguucuccagggacuggucacugccucaggacccccaagccuaugcccugagccauggcugcugacugacuccagccaaggugcaaagacgagauuaugagacagguccucaggccuguguuccaaguacucacaggggcucugggugcccaucgccgggaguaugguucagcugccaccggcacuguccauuugccugucugucaagcucagagcauggauaagccacacagcagggcagugcacccuggcaccaugcacggccagcaagaaucaaggcccgcagaugcuaagagggccuauugucaggggaagguccccgcuccugcacacucucuauggauacuuggguugugggggcucucuuggagaguaaguuugugguuuguuucugguuuacagugguggcugacaccccuuguaagaaagcauuccugggaagucuucuguggguccaaacauguugcuccgaucaucacaggagagcaaaaggcccuagauacccccuuuggaaugugagagucuuguugucugauauuugccacugagcuggugaagccccucuaaagagaucucgacccuggggagcagaauucuugucaucuaugagggguccugagaaagacuugucauuuuuuuuccuggaguucuucccauugagguccuaggauuugcacaccacugucccacaagagcuuuccugccuaaugaaaggaggucuuguggugugugucuccucucuucucuauaguucccgaguuggcccccauugcagcccccacccuguggguagucuuccagaagugaugcaguggugugagaugcccuacaccuuguuauuugggagacuuugagagucauucacuuccauggugacuaguguuuguuuugccugauuuuauauucuguguugcauuucuccccacucccugcccugcuuuaauaaacagcaaaccaauaucuaggaagaaugacugagggauaguauuggguauuggccccauggcaggaacagccacuugcaucuggucccggugccacacugcggugcuuggugugguuguggagccugucccugcgcgccuugcucccguugagccacgcugucuggugggugauucucugcccugagccaccacccuggacuggcccagucuccagagcuggcacacccugccuguuuucucuuuuuagacacaacagccgcaguuuggccagccacuaagucccaccagcugagguccgaggaaagcggggugacucauuucccuuguccagggcccgaggagagugagguguccagccugcaaagcuauuccagcuccuugguguugguuugcaauaaauugguauuuaagcaguucugggucugcgugugacauuugcugcugagacaguucugucugugcauggucauuauuguugcauucuagccuugaggucccaggccaacguacacagcaaacaccagcauggggaauucuuagggguuguuucccaucuggucugaaugcacugggcaagaucucaauacagcuuuagaaauccuguaagauuuugaccaguggggagaaaaagaauguagcuauagaucuuacauccuuucaaacagguucuggaauucuguaguuacuggaaagcuuagggugagugcagaguugggaaugauuccacugaagggccaccuuugcccaccaggcuccaaggcccuccuuggucuccaggugcauaccugcuguuaacuuugcugagcccucgcaaugggcuuccuccaggacauaacgccgugucugacacagaagucucccagguggcuggccaccugcuucuuccucagucagaucuuugacucuccuucucugugcccaccccaucuccagccuccucugacccugcucaccccuggggacaggaccuaggggugugagaaguacuuggcugaauaaagacuguuucaaaggcaauccuuagaauugccuagcauacucccagggccagaaauaacccgccagaaaggagaggcguauuugccccugaagagugcaggagggagaacaguugagaaguguuuuguguggaaauguguccaagaggcgucagcugcugcacagagaacucacugcccagaacacugcgcuuggggaacagaccucacccccaccucaaaucugcucuccacugggccuguuggcagccagcucagcuggggaagggacagcaugacucgcuuugucgaugaaaagcacgaaguugucagcacagaaccuggccaguccuugagaaacucccuccuugguggucagaggucaagcagcccauguggcccacgguccugaagaacugggcuaugucccugaggcuccucucuaccgucugacuguggggucuggggaacaggcauuuaaaccaggcugcugcccuggggagugcccacuggacgccagggugccccauagggacagggucacaaagcccuggggcuuccccugccaguccuggugaggacaguguggucacuaucucagagagacgaaaaaugaauauucugucauuucagacuaaacuacucacccagcucacacuaa

SEQ ID NO: 192212 - RNA, 70075 nt, Homo sapiens
uguaagaggggagggcauucuucuccaggggagggcuacguguugacgccauacgccggggcggggccgagaguuuggagccccggaguggggugucggcgccucauucggguggagcugagccggagacagguaaccgugcgcugucgccgcgcccgucccagugccgggugucgcggcgcuuggcggcccgggguuggagaucgcgguaaagggggaggccgccgcgcccuuggugcugcgggcgccgcggugacaggggaguggagcuggauggaguggggcucacggagggugguaggagggacgggaccugauggauggccguggcagccaauggagccgcggggccugcccggcgggcggagauuggcggguacgggcgggcuccgaggucgcgcggggcgcggagcgacgcgccauuggcggugggcgagcggggggcgggcgcggcggcggaugugagggagagggcggugcguccgcaggggugacccccaaggucgccgcgggcgucacgugguuaggccgcucuccgacggcguccuucccgaccgggacgcacucuccuucccgccugugaggaccgcgucgcuuuguccgaaagacaguguggccugcucgaguugcgucggagcaucuggcuuugggguggcccugggugggacugccuguuuggauuaccgcgcagaccuuggcgccgcccccacaccugcugccagaaguugggucgaacagauugaccgagaugaagcuuauuucucguagaaacaucuuucaagcaccauuuucccucgaaaauauaucagacauuggauaugaguuguaaucuacugagauuuaauagaaaacuugccgcgcccucgcccugaccugggugcgucccaccugccauccccaucccuuugcccagaacauaggacuucguguuaggguuuccuugugccuugucuugcaguccguacuuugaggcugauuuccagguacacugcucugaacagcuggguuuaggauggguggcaugggauaaagccuuuuuuuguaaggcagcacuaguugcaacagucaaacuguacuuugccguguagaccuaggagaguauguaacacuauuguaguuuuguaaauuagcugaggacuggaucuugggaaguugaauaaagaucacuguaugcucauuuuuuguuguuguugucuuguuugagauggagucucugucgcccaggcuggagugcuguggcgcgaucucggcucacugcaaccucugccuuccuggguucaagugauucuccugccucagccucccaaguagcugauauuacaggcacgcgccaucacgcccggcuaauuuuuguauuuuuaguagagacggguuuucaccaccuuggccaggcuauucucgaacuccugaccucaggugauccgcccgccucggcccccaaagugcugggauuacaggcgugagccacugcgcccggccccucauuauuuuuuuuaagcgcacuuuucacauuucaguuacuuuuucccuuuaaauaacaucuuuauugagauaaaauucacauaccauacgauucacccauuugacgugcacaauuucggccagucgugguggcucacguuuguaauccccacacuuugggagugugaaaggaagaucccuugagcucaguucaaggagaccagccugagcaaccaaagugauacccggcgucuacaaaaaauaaaauuauccggauaugguggcauauaccacauauacuuguagucgcaacuacucaggaggcugaggcgggaggauggcaugagccagggagguccaagcugcagugagccauuauugccccacugcacucuagccugggugacacagugagauccugucucaaaaaaaaaggccgggcgcaguggcucacgccuguaauccuagcacuuugggaggccgagguggguggauccccugagguugggaguuugagaccagccuggccaacauggugaaacccugucucuacuaaaaauacaaaaguuagcagggcaugguggcgugggccuguagucucagcuacaggcugagcuccuccagccucagcaggaggcugaggcaggagaaucgcuugaacgcaggaggcagagguugcagcgagucgagauggcgccacggcacuacagccugagcgacagagcaagacuccaucucaaaaaaaaaaggaaagaaaaaacuacaguaucaucuacuuuuuagauuuuuagguaauuuuugagaucauuguacaaauuauugagaaauucauuuugaaaacaguaaaauuuuaagaaauuguacauaaaaauuuauucuaugcagucauaauaaauaguacagagagauccuguguuccuuucccacuucucuaacauugugcaaaacuauaguaaauaucacagccagauauugacauuaauaaaauucaagauacagaauauucccgucaucacaaggaucccuuccauugcuuuuuuauagccacacccacauuccucccauucccaguccuucaacuccugguaaccacuaaucuguucuucauuucccuaauuuuggcaugucaagaaugccaaauaaaaggauucauagagccuuuugggauugguuuuuuccagucagcuuaauucccuggagaaucauccagguuguugcguguuauggguaguucauuccuuggccaggcgcaguggcuuacgccuguaauccuagcaacuuugggaggcugaggcaggcagaucgcuugagccccaggaguucgagucugaggaacauagugagaccucgucucuacaaaaaaaaaaaaaaaaaaaaauuagccaggcgcagugguguguuccuguaaucccagcuacucaggaagcugaggugggaggaucgcuugagccuaggcugugguggcugcggugagccgagaucgcgccacugcacuccagcaugagugacagagugagacccugucucaaaaaaaaaaaaaaaaagguacuucauuccuuuuuauugaagccgggcuauugggcuauggauguaccacauuugguuuauucauccauuaaaagacaucuuuacuguuuccauucuuuggcuauuacaaauaaagcugcuacaaaccuucauguacagauuuuuauuugaacauaaauugacauuucuccaagauaaaugcccaggaauacaaucacuaagucguagugcgugcuuaguuauuaaacaaauagccaaacuguuuuccagagugauuguacuauuuuacauucccaccggcacuguauggucuuguuucuccacauacuugccagcauuuggugauguuacuuuuuuuauuauagccauuccaauaaauguguaguaaugucucuuugugguuguaauuugcauuuuucugauggcuaaugauguugaacaucuuuucaugugcuuauuugccaucugucuauucucucuuuuuuuggaagagaugggaucuugcuauguugcccaggcuggucuugaacuccugggaucaagugauccuccugucuuagccucccaaaggcuaggauuucaggcaugagccaccaugccuggccccuguauacucucgggugaaaugucuguucauaucuuuuguucauuucguaauuagauuguucgguuuuuguuaacuguugagcuuugagaauuccuaauguauucuagauaccacugcuuuguuggauauguaguuugcagauauuuucuccuagucagcagcaugucuuuucaucuugguuuuuuuuuuguuuguuuguuuguuuuguuuuugagauggagucucguucugucccccaggcuggagugcaguggcguaaucucuacaaccucugccucccagguucaagcgauucuuccgccucagccuccugaguagcugggauuacaggcgcuugccaccacaccuggcuaauuuuuguauuuuuaguagagacgggguuucaccguguuggucaggcuggucucgaacuccugaccucgcgaucuguccaccucagccucccagagugcugggauuacaggcgugagccacugcuccuagcccuuuucaucuuuuuguuuguuuguuuguuugagacggagucuugcucuguugcccaggcuggagugcaguggugcaaucuuggcucacugcaaccuccaccuccccgguucaagccuuucucagccucccaaguagcugggacuacagccgcgugccaccacgcccggcuaauucuuuuguauuuuuaguagagacgggcuuuuacuguguuagccaggauggucuggaucuccugaccucgugaucgacacccccuuggccucccaaagugcugggauuacaggcgugagccaccgcgcucagccccuuuucaucuucuuaacggggucuuuugcaaagcaaaaguuuauaauuuugaugaggucugguuuaccaauuuuaucuuuuguuagauugcuuuugguguugaguugaagaacucuuugccuagcccaaauuccugaagauuuuaucauauguauuuuucuaaauuuuuuuuuuuuuuuuuuuggagacacggucuuacucugucaccccaggcuggagugcaguggcaugaucacagcucaccgcagccucaaccuccugggcucaggugauccggugauccucacaccucagccuccugaguagcuaagaguaccggagucugcaccaugccuggcuaauuuuuguauuuuuuguuuuuugguuuuuugagacggagucucgcucugucgcccaggcuggagugcuggagugcaguggcacgaucucagcucacugcaaccuccgccuuccggguucaugccauucucccaccucagccuccugaguagcugggacuacaggugcccgccaccaugcccggcuaauuuuuuuuuuuuguauuuuuuaguagagacgggguuucacuguguuacccaggauggucucgaucuccugaccucgugaucccccccgccucggccucccaaagugcugggauuacaggcgugagccaccgugccuggccuaauuuuuguauuuuuuguagggacggguuuugccauguugcccagacuggucucaaacuccuggggucaagcaauccucccaccuuggcuuccugaagugccaggauuacaggcgugagccacugcgccuggccacuuuuauaaaauuuuuaaauuuuacauuuaaaucuaugauucauuuagacuuaauuucuuuuuucuuuuuuuuuuuauguuuucacuuuaugguacuuuuugaugaacaguuuuuaauuuuaauguaauugauauaaauuuagucuuguggccagcuuuuuuugaguccuaaagacucaagaucaaauagauauucuaaaaguuuuaauguuuuuuuuuauuauuaugcuuuaaguucugggguacaugugcacaacaugcagguuuguuacauauguauacaugugccauguuggugugcugcacccauuaacucgucauuuacauuagguauauccauuuggaguuaauuucuguaugugguuuaaaguuugaguguuuuuugguuuuugugggggguuuuugcuuaugaauaucuaaccagcaccguuuguuugagaagacuguuuuucuuccauugaauugcuuuugcacuuucgucagaaaucacuuggcuguacuugugugacucuguuucugauucucuguugcauuccauugaucuuugugucuaucccaucaccaauaccgagaguuuuuauuauuguagcucauaagaagucucaaaaucggauagauugauuucucucacuucuuuuucaaaauuguuucagcuaaucuaguucuuuugccuuucuuuuuuuuuucuugugacggagucuuacucuguugcccaggcuggagugcaaugggcaugaucucggcucacugcaaccucugcauccuggguucaagcgauucuccugccucagacccccgaguaggugggacuacaggcaugcaccaccacacccugcuaauuuuuuuuauuuuuaguagagaugggguuucaccauguuggccaggcuggucuugaacuccugaucucaugauccacucgccucggccucccaaagugcuaggauuacaggcgugagccaccacgccuggccaccuuucuucauuauacuuauuuauuauuuuugaggcagggucuuacucugucacccaggcuggaguagaguggcauuaucacagcucacugcagccucuacuuccaggcucaagcaaucuugcuacuucagccuccugaguagcugggacugcaggcacguaccaccacgccuggcuguuuuuuuucuuuucuuuucuuuucuuuucuuuuuuuugagacggagugucacucugucgcccaggcuggagugcaguggcgcgaucucggcucacugcaaccuccgccuccuggguucaagcaauucuccugccucagccuccugaguagcugggacuacaggcacgugccaccaacguaauuuuuuuguauuuuuaguagagacaggguuucaccauguuagccaggauggucucgaucuccugaccucgugauccacuugccucugccucccaaagugcugggauuacaggcaugagccacugcgccuggcuuguuuuuguuuuuguuuuuugagacagucucacuuugucgcccaggcuggaaugcaguguugugaucucggcucacugcaaccucugccucccagauucauguuauucucucaccucggccuccugaguaacugggacuauaggcacccgccaccacaccuggcuguuuuguuuguuuguuuauuuguuuguuuguuuguuuugagacggagucucacucugucacccaggcuggagugcagugaugcgaucuuggcucaccgcaagcucugccacccagguucacgccauucuucugcucagucucccgaguagcugggacuauaggcgcccaccaccaugccuggcuaauuuuuuguauuuuuaguagagaugggguuucaccguguuagccaggauggucucaaucuccuggccucgugauccacccgucucggccucccaaagugcugggauuacaggcgugagccaccacgcccggcuauaauuuuuauauuuuuagucgagaugggguuucaccauguuggccaggccguucucaaacuccugaccucaagucaucugcccacaucggccucccaaagugcugggauaacaggugugagccacugggcccagccaccuggcuuuuuuuuuuuuuuuuuuuugaagauggcauuuugcuguuguugcacaggcuggagugccauggcgugaucucagcucacugcaaccuccaccucucagguucaagugauucuccugccucagccucccgaguagcugggauuacagguaugugcugccacucccagcuaauuuuguauuuuuaguugagacgggguuucuccauguuggucaggcuggucugaaacucccaaacucgggccauccgcucgccucggccucccaaagugcugggauuacaggcaugagccacggcaccuggccuagcugucuuuuuaaaauuuuuauuuuuuguagauauagggucuugcucuguugccaaggcuggucucaaaccccuaggcaagcuauccuuucaccucagccucccaaagugcugggauuacaggccuuuuuuuuuuuuuuucuuguguauaaugcaccauuucucucuggcugccuucaagguuuugguuuuuuuuguuuuuuuuguuuguuuguuuuuuguauugaguuuucugaauuuguuuaugaugugucuuggugugcauuuauuuggguuuauucuucacgggguucuuuaugccuuuugccagauuugggagauuuguagccauuauuucuuugaaugcuuuuccagccccuccuucugccuucaucagggacuccaaugacauuaauauuagaucuuuuguuauuucccugaggccuuguucugucuucaaguucacugauuuccucugucuuuauucugcccuuuaacccaugcuaaagcuuuuuucuuuugcuuagugcauuuuucaguucugaaaugucuguuuuguucucuacaucuucucuuugcugaaacuuuauuuuucauuuguuucaagcauguucauaguugcucguggaagcauuuugaggaugccucuuuuagaaucuuugucagauaauuguaagucuacgucaucuugguauuggugucuauagauugucuuuuuuuguuugaaauuaucccgguucuuuugguucuuuuuuuuuuuuuuuuuuuugagaugaagucucgcucugucgcccaggcuggagugcaguggcgcgaucucagcucacugcaaccuccuggguucaagcgauucuccugccucagccucccaaguagcugggauuacaggcaugugccaccaugccaggcuaauuuuuguauuuuuguaaagauagggcuucaccauguuggccaggcuggucuugaauuccugaccucaagugauaacaccuaccucagccucccaaagugcugggauuacagguaugagccaccaugcccggacaagauuauccuggcccuugguguaaagagugaucuuugacuugcaaccuggacauucuggguguuauguuauggacucuugaucuuguuuaaaucucuaagcaaugcaggcuuccucugcuggggcagggaggggcugcuuccucacuguugcuggugcggugucuggggggagggauuccuuguuauugcuguaugacuguaagaguuccccauuaggccuuggugacaucacccugccugggaagggaggggugcugcuucauuacugcuggaugggauugaaauccagacucccuaccuggucuccacuaucuuaucagggagugaguuggaagggcucauuauucaccagguggggaugaaagucccuggucccuauucugacaccagcugaguggagugaggauauuuccuguggaauuuggccgcaguagagcaauuguuguuuaaaacuuuaaaaguuuuccaucuugcugcucuuuuccugguccuuuggcuagagagaacagguuucuguuuguaguuuucuuugucuacaccuguuggcauuucuggguuguaggcuucucgaguacccaggucugaaacacaugaagcauaaagaaaaucaagaacucagugcucggcugggugugguggcucauaccuguaauccuagcacuuugggagucugacacuugaggucaggaguucgaggccacccuggccaacauggcaaaacugucucuauaaaaaauacaaaaauuagccaggcauggugaugugcgccuguaguagucucagcuacuugggggacugaggugggagaaucacuugagccugggagguccaggcugcagugagccgagaucacaccacugcacuccagccugggcaacagagcaagacccugacagaaagaaaaaaaaaaaaaaccucaaugcucuuucuuuggguccucugguuccuagccagucugcuuccuucucuccaccuuucacagucuuguuuugucuuaaauguaacgccucauguuuuuagcuauauuuagcaggaaacacguuuuauauaugcuuuaaugagauguugaaaaauuguccugcuuuccauaaagauuuaauaauuuacacucuaucaauaccuuuuaaaagugccuauuuaucuacacccuccccagucaaccuguuuauaccacaucagucaugggcaucucagaugcuguggggccacgucucagggaaagggcagaacagucuucagaccuauauacugaagcguacucagggaucugaucagggaggugucagucccuaccaguggugaccacccaugauuggugagcuaaauaggcuucugugcuaaaugauggagacagccuacuaauguuuuggaaguuaccaguugaccgccacuccaaauuagcuaauguuuagguuuaaauaucuuggaaacuugaacuuuuuauaucacuaguuugccuuuuuuccuaggcuacauauauauauguauauauauauacacauguuuauguauauauacacauauauauacguauauacguauauauacacauauguauauguauauauauacacacauguuuauguauauauacacauauauacguauauaaguguauauguguauauauauacacguauauguguauaugcauauauauauguguauauauaugcauauauacguauauauguguauauauacacauauacguguauauauauacacauauauauauacguauauauauauguauauaugugagccgagaucgcgccacugcacuccauccuggacgacagagcgagacuccuuucggagcucuggagucucacucugucguccaggcuggagugcaguggcgcgaucucggcucacaguaaccaccucccggguucaagcaauucuccugccucagccucccaaguagcuggacuacaggcacccgccacaaugcacagcuaauuuuuuuguaguuuuaguagaggcgggguuucagcauguuggccaggcuggucucaaacuccugaucucaggugauccacccaccucgaccucccaaagugcugggauuacaggcaugaaccaccauacccaaccauuucuuuagucauagauauaccuucaaguuuucaaagugcuuucauauuuguguuacaauuacaaaaagacauuaugaggggguuaggaguaauuacugucuccacuuuauggcccaggaaagcucacacagugacuuggugucacguggucucuguuggcccaggaaagcucacacagugacuuggugucacacggucucuguaccugcaggcucaacaauuguuuccaucuagcaaugaaaaaaaacuuuacaguuuaaaaguaauccucacuacuucccucagcuuauauguaaugaggugucacuagugaaagauaauaaauucuuugagauucucagccaauaagggagaauugauaucuguacucuguacaugaguucuuuguauuacuacuaaaacaaaaauaauugcaggcaugagacaacagccauaggucuguagcaaauguguucaugauucaucagaagaauugagucugaaacugaaaaaaagaaaguggaugaguuguccuuuaaaaugguugccagcuaacacucauaggguuuaaggaucauguaaugauguguggguuuuuuucccucaaagacuuauuuacugagaaacagcagacuguuuuugcuaggucuugccuuuuuaaucaccccccuaccuagccaaugucauauugauaggcgucaguaguugguuuauuucccucauucuuugugcccugggauaggguaccuccuacccaacuggggaaauucgaggcauagaccucgaaggcuucauauuucagacagaacccuauuuaaguauaucguuuccuaagggcagggcguuuaacaccuaaaaacuaauuuuccuuugguuuuuacuuuuuuucuuuguacaacuuauuuuucccaaauguauguguuuauuuuugcaucuugaaauuaauggauuacaacuuguaucauuuuuguguacagugauaaguucaguuacauuuuuucuuacacauuaaaaaaauaacuuuauugagacauaauucacauaccauacaauucacucauuuaaauuguaaggugaauguuuuucaguauauuagaggguugugacaccaucagcacaaucuaguuuuagagcauuuucauccucuccucccaaaaagaaagcccuauguccauugaguuacuccucauccuucccucauuucucugccccagccccaggcaaccacuaaucuacuuucucucuguauagauuugccuauucuggaaugugauauuauuaucguauauggguuuuuguccaugauuccugguuccauaguucuuguuauuuccuaaguaacuaaaauaagcauguauuuuguuaaaguauuucuccuugguuccugaaguagcuuccaaacagcuucagagugauaaagguggaagucuuuuguuacaauguuggggugcuuuaggccccagaaacaggccuguggcacuccuuucaccugcugcuuuuucuccccaagggaggccauagaaacuaaaaauauacucuaauauuccuccacuguucugucuuggagccggcaauaaagaaauucucugaccuaccuugucugauuguaggucacaagacacccacuucaggaguccugccucacacccacaggaaggaauccugcacagagaggccaagaagaaucugaacaaacaggccuggcuggguuuccccacucggucuguugguauuagaucauacccuuuuugccugaucaccuaucuacaugguuaucuaugcuucagucaugcauauccaaugaagucuccauaaaaggcccaagaggaugggguacggagagcuucuggauagcugaacauguggagauuccuggaggguggcaugccuggggaggguauggaagccuccuuaccccauccuacaccuugaccugugcaacucuuaauccacauccuauguuauauucuuugaaaaaaacaguagauguaaguaaguguuuccugaaauuuauugaaccaaaggagggggucaugggaucuccaguuucuagcugguuggccagaaguacaaguaagacaacugggggcuugcgauugacaucggaaguaggaggcagccuugugggauugagcccuugaccugugguaucugaugcugucuccagguagguagcagcagaauugaauugcuuauugguagggagaauuccccacacauuuagucacagaaaucuucuguguugguuguugugugagagcagaggaauagacucauaauaugucuuuugcgucugcugcuuuuuacugagcauaauguuuucaagguuccuccagguuggagcaugcaccagcacuuccuuaguuucauugcagaaugcuguuauauucuauagauauaacacguuuugcuuauccauucgucagugauggacauuugaguuguuucuacuguuguuucuacuguuucaacuguuguugcucauagcaacaauaaugcugcuaugagcauuuguguacaaguuuuuuuuguggacauacauuuucauuucucuugauuauauaucuaggaguguaauugcuguguuauauggugacuuuauguguuuauuggcuguuaguauaucuucuuuggacaaauaucuauucaaauccuuuaccuauuuuuugauuggguugucuuuuuacuguugcauuaugagaguucuuuauauauucuguauauaaguuccuuaucagauaauugcaaauauuuucucccaucuauaucauuucuuucuuaauaaguucuuugaagcacaaaaauuuuuuguuuuguuuuguuuugagacagagucucgcucugucacucaggcuggagugcgguggugcgaucucagcucacugcaaccucugucuccuggguucaagggauucuccugucucagccucccaagcagcugggacuacaggcaugcaugaccaugcccagcuaauuuuuguauuuuuaguagaaacggcguuucgccauguuagcuaggcuggucucgaaccccugaccucaagugauccgccugccucagccuccuaaagcacugagauuacaggcgugagcuaccgcuccuggccagauuuuuuauuuugaugaaauccaauuugugguuuuuauuuuguuguuuauacuuguggugucauaacuaagaauacauugcuugaaucaagguuacaaagauuuacuucauggaaguuauaaaacuucuaaguaucuuauaguuuugucucuuacauucaggucuuugauccauuuugaauuuuguuuguauaugucuaugcaacuucauuccucuuuagacguggaacucuaguugucccagcaccuucaguugaaaagacuguucuuuucccugcugaauggaguuggcacccauuuaaauagaaauauucuuuuaaagcaagcuuguccaacucccagcccgugggccacauguggcccaggacagcuuugaauguggcccaacacaaguuuguaaacuuuguuaaaacauuaugagauguuuuugcgauuuuuuuuuuuuuaaagcucaucagcugucguuaguguuaguguauuuuauguguggcccuagacaauucuuccaauguggcccagggaagccaaaauauuggacaucccuguuuuaaaccaaaaaucaaaacacuuggauauuuuggacagcucagaggagcuuucacaaaaauuguuuaaacaauugaaugucucuaccaaauaacguacuauucuuaaaguugacuuagugucaguuacagaauucuaaguugaauuucaagaccuaauguugacuggcuggcaguuuuccuucuuuuuguauuuaauauauuuuguuuguuuguuuguuuuuagagauagggucucgcucugucacccaggcuggaguggaguggcacgaucauagcuuacugaagccuugaccuccugggcucaggcuauccuuccaccucagccuccgggguagcugguacuacagacaugugccaccacacccugauagcuuuuaaauuuuuuguggagaugugguuucacuauguugcccgggcuggucucaaacuccuggccucaaacaauccuuaagccuuggcaccccaaagugcuaggauuauaggcaugagccaccgugcuuggcuuuuaauaucuucuuaugccguuuuauguaagagagaaaggugaagaauggguauuuaccagaauuagaaaugugcguuaguguuggcucugucguucugucaaaguguggacagcaaauagcuguccuggccguuccuggguggaguuggggauguugagccaucugcugaagggcagcucuucccgugagucaucuuaagggaaguuuaaaaaucucagcugggugugguggcucacgccuguaauaccagcacuuugggaggcugaggugggcagaucaugaggucaggaguuugagaccagccuggccaacauaaugaaacccugucucuacuaaaaauacaaaaauuaaccaggugugauggcaugcaccuguaguccuagcuacucgggaggcugaggcaggggaauugcuugaaccugggaugggagguugcacugagccgagaucacaccacugcacuccagccuggacuacagagcaagacuccguaucaaaaaaaaaaaaucuccagcuguuguggcagcucugcugggcagcacuuaacuaugugucagauucagugacugcggauagcaaaaugucaugauuuacuuaaacaggaucauguggaaggggccacuuugggaagaacagaugaaauugguguuuuacgauugucaguucagugccuguuaauugggcuauugcagcaacugaauacugauaguuaaugaggugaugcuauuguuuucugggagaaaacccaacucagaggcaauuggguauuuaauauugccuuaauaaugacauuaaaggaaaaaaaugaacauuuuccuuugagccugagaaauuaaaaaaaaaauagcauaaaaugaagcaacaguaguauuuuugcugucaauguuagggcuguuugucuuccuuaaauauaucaguggaaaaacuuggaguguaguuggagguaggaagaacuaccgaauuaacuuaaaacuuuugauuucuaaagugaaaacccagggguaaagauugcauucccuaauuauauccagaauauauugcuuguuuaccuuuaauuuguaaggagcaaguuuuuguuuguuguucaguuuguuuuuaaagaauauguucugcuguuuacuuuugcugaccuaucucuucucaguggagcaggccagaggugaaugcaggacacucuaagcccucucucuuggugucccuuaaguguauucugagcauauuugggccaagaggaaguuucugauaaauaauauagaagauauuuuuauguaacaguuauuucuggguaauucacacuauguuucagagcuuggauuuucuucggguagguguggacauggaguguaguucuaacuuuacaaccagagcaccugcuuugagacaaauucaugagcaaccauguaggccagcaagcaccuuuuuuuccacaggcagcguccuugugaacuuuccgcuuggauccugacucugcuguuaguagccuaugaccuuggaugaaauguaagggaauagaaacugaagcuaucuguaaagugaaagagcuggugccugccuuauugggagccucuggguuuauguaugagucagaugcguagaguugcucaccauggagggcccaggguaggcaggcauuauugaacaacugcuccaugugcucuuuucaaucuuugcagaccccacccacgucucccuugcucagaccuggcuccccauggcuuaugaaagggggcugagugcagaagguggcaggcaggacacuggacaacccucuguggcuuuuccuuacccuucguaguaccaugagauucuggcucuucccgucucuguguuucugccuauggguccuuccacaugcagugccucgucuucccuccuucccauccauguccuuuugucuucaggcacacccacuuggaaggagcccauccucucacagggucugcuggcauauucugcaccucucaaguacucauauuuccucugcaaucuuuucuauguuguuuuuccucugcucaaggguaaauugagaguaaggaaaguauuuuucuaauuucuuuguauuuuccauaauauuguaaguacagcagguacucaguaguuucuggacagauuagaaaauguuuuacuuauucuccaauuaauccuaauccuaauucuaaauuaauuaauccuuguugccuuucuucuaauuguuuuauauauauguaauauguaaauuuaaagaacaucguauguuuaucaucuuagcccuuaaacuagauuuaaugguuuuuuguuuuguuuuguuuugagacagagucucacucuguugcuaggcuggagugcaguggugcaaucucggcucacugcagccuccaccuaccagguucaagcaauucuccugccucagccucccaaguaucugggucuacaggcaugcaccaccacacccagcuaauuuuuguauuuuuaguagagaugugguuucaccauguuggccaggauggucuugaucuccugaccucgugauccacccgccuuggccucccaaagugcugggauuacaggugugagccaccgagucuggccuagauuuaaauuuuuaagugaagaugguaauaucugcaacugugcacucaccuuccuugggcucgcacaggcauccuguguuaguaggugcaagaguguguuucaguuucacacagucacagcucuguugugcucucaggcacaugaacugguggcacugagcagguagcacucuugugaauacauuuauaggccagggucuuucuccucaacaauuagaguugaacauguuuuguuuuuguuuuuguuuuucuaguagcuuuuaaaaaaaaauuauccuuucucuagagcaucaggaucuaguagccuugucuccuaaauacucauuuuuaaaaccuuucuuucuuguuuuuuuuuuuuuuuuuuuguacaggcaguugugaaaaacuucaggacaaaaauguuucauuuaaggacuugugcugcuaaguugaggccauugacggcuucccagacuguuaagacauuuucacaaaacagaccagcagcagcuaggacauuucaacagauucggugcuauucugcaccuguugcugcugagcccuuucucagugggacuaguucgaacuauguggaggagauguacugugcuuggcuggaaaaccccaaaaguguacauaagguaaggcucgcagggcugugggucugccucauguugguguguuggccuguuccugacuggucaccagguaagugugugcguccugaggagucagcgggcagacaggcagcuggagcgccauaccaaccaccguaucuguaucggacccagcauagccccagcagaagccauggucccuggauuggcguccagcaguagacacugugcuuaacucugcgaggaugugaagaagcaugugugugacccuccagcaucuccgcaagggcugcuucaggaugaagccgcugaagaaagaagaaagaaagaaaguguguggaaaagagcaggaccucaggaagcuccuccauucuaacugucuggagaggauacuuucauuuguaacaugccguagucaccucauguaauuucuguaugaauggccuuuuagcucauuauguucguauuuuuuuccuguuuguuucuaacuucucuguauuacauauaagggcauuuucuaaacuuuucaccacaugauuacugauguaagucaugucuuguuuuuuuugguuuguuuuuguuuuuguuuguuuuguuuuguuucagacagagucccacuguuguccaggcuggagugcaguggcgggaucucggcuugcugcaaccuccgacuccuggguucaagugauucuuaugccucagccucccgaguaacugggacuacaggugcacgucaccacgccugacuaguuuuuguauuuuuaguagagaugggauuuuacuuuguuggccaggcuggucuugaaccccuggccucaagugauccacccaccuuggccucccaaagugcugggauuacagguaugaucaaccacgccuggccaugucaugccuugugacagaauuccuuuauucuguuuugagccaauaaauauuuauagguuuugauaaccauuccuugauuuucagggaaagcagccagccuccugaaggaauugggaagacaguguaguauaguaauaagaggguaggucccagcguuucuaagcuccugugccucaucuguaggugguugagagaaugaaaggagguagcaugagcagggcacucagcucggaggcagugccuagccaacauugcuuaucuucacugugaauuuggcuuuuuuccuacucuugaaucuugggggcuuaucaccaaaaggaagucugcuuccacugggcuccuguaaacaagcuuucccuuuaaguauuagugacacuuacgaauuuuuuuuuuuaauuuagcuaggugugguggcacaugccugcaguucuagcuacuccacaggcugaggugggaggauugcugaagcccaggaauucgagguuacagugcgcugugauggugccacugcacuccauccugggcaacagagggagacccugucucuaaaauuuaaaagaagguggggggcggguauauucccaugacugcugggccaccaggucccauuuuuucaggaaugccacuuugucucagccuuauugcccagaucuagcccaguccuucccuguuuccauggcaaccugggagcagccuugcuuacugggcaaggugagaccugguuuucuguaagaaaucuguaguuuauuucccuagucuguaaacaaauugcccagaagaagugcucugugaaacuggccccugcuuuugaugugauaucauggauguuacugaagacugugguugcagauuguggcagauuucacacacacacaccccuacacacacacacacacacacacacaccccuacacacacacacacacacacacaccccuacaccugcagauuauaucuagaauaaaacugagcccugagguuucagaaucaaggacuauuaugugcccaggccuauucuuuugccuuccuuuucucaaacauaaccuuuucuuggaaccaaccaaguuguuuucagugauguuaggauuuggagucaguagcuccuaaaugacagugccuagugucugaaagguaaagagcaccuggcugagacugcauguccuugugaagguuugguccucagugauucauggguaaaaggugcacucugugagcaguguggccacagugcuguggacacugggccuguugccaucauagcugcuccugcuggaagcuuuugaagaugguuuuugugggggcaugguggcuuuaugucuuuaugccuguuucuguugcugggagucuccagggggcacagugugggaaucacaugcaugcucugccccucccugcuuguagaggggaggggacaggaugguuaaaagugggcgugcccuccagcaaucccgguugucauccagcacggacuucaucacuccucugccaucccagacggcaagguggguccucuuuaaguugaauugggcccaguauguggugugugcauguuuuuuguuuguuuguuuuuuuguuuuguuuuguuuuugagauggagucucacucugucgcucagacuggagugcaguggugcaaucucagcucacugcaaccuccaccuccgaggcucaagcgauucuccugccucagccuccugaguagcugggauuacaggccugugccaccacgcccggcuaauuuuuguauuuuuaguagagacgggguuucaccauguuagucgggcuggucuugaacuccuggccucgugauccgccugccuuggccucccagagugcugggauuacaggcgugagccacggcgccuggccaugugcauguuuuucaagggagauaauccauaacuucuguccaaauuucaaagcaucugucacccaugaaaguuuaggauccauagccuuagaggcauuucacuuuauuugugcucuuauuuuagaucacauaguuuaaauagacauaauaauaguuuaaauagagauaauaaaauuagaagugcuguaggauuuagauagaucaucuaucucaucuucuguuuaaacaucagaaauguccugaggucggauuccguacuuauuuucagagagcuuauggggggcugcaaggacuaaacucauauagcagaaaaggaacaaacucagcaucuuccucuccugcccuuuggcacuacuuucccauuguuguuuuuauuuuuauuuauuuuauuuauuuuuuugagauggagucucacucugucacccaggcugcagugcagugaggugaucucagcucacugcaaccuccaccuccugguucaagugauucucgugccucagccucccgaguagccaggauuacagauacgcgccaccacgccuggcuaauuuuuguauuuuuaguagagacgggguuucaccauguuggccaggcuggucucaaacuccugaccucaaucagucugcccaccucagccucccaaagugcugggauuacaggcgugagccacugcacccagccccauuguuauuuuuaaaucuguguuuuauaguguuuccaagcauacauaacaguagagagaagaguagaugauaagccuaaugaggagacuggucacgcagcuucaacagcugucuuaaaaaucuauucccuaccccagugacuuuuuuauuuguugguuuauuugggguuugaggagaguagacacuggaguauuuuaaggcaaauuccagaccugugucauuucuggcauaaaugcaucaguguaacuaacuguuaaguaauuguuuucauaaccacacccaauaaaauuaacaggcuaauucucuaauagaauuuuuucucaguccauguuuaaauauuuacucuucucuuaaagcugcccuuuuacauuuuguuuuguuuuguuuuuuaauuuuuauuuuacuuuuuuuuacauuugguuuuacacuuuauaauuggucguuguauuccuuauuuuuaauuuuauuuauuuuuuaauuaaaaacuuuuuuuuaauguaaguaggagccaugccuguaauccugauacuuugggaggcugaggcaggaggauugcuugaguccaggaguuugggaccagccuggacaaggcaaggccuugucucuauuaaaaauaaaauagaaagcuuuuuaaaaaaauaaaaaaauguaaauagagauggagucucuuuauguuguccagacuggucuugaacuccugggcucaagcaauccucccagcuuggccucccaaagugcugggauuacagaugugagccaccacacccagccucuuaaaaaaaacuucuauucuuaaaaugcuuaacugaugugaaaauuauauuugugguaaaauauuuuagcaaaucagagcugcaaguaccuuuuuuacccuaaguccacuccccagaacagaauccgguuaacuagcugaccugggucugucucuguggugggcccaucugccaucucccuuuuguuccuaccuuugguccuguccuagacuuucgucucuguucuagucuggcauuugugcuccucacugaccccucuuaagagccuucagcgguggccugggcugucagccuaugaaacccuccucauuagggucucagcauauuugaggucacaucaaaugaugacaucuuuauuuaugucuuuaagacacagucagagcuaaguuauccuuguuaauguuuaagacaaacagguaauugagaacugcuaagcccccaugagucuggguguugaucucauuuuguuuuguagggacaggugcccaccuacagcuguagcaugguguugaguuccuugugaugcaucugccagguucuggcccugcugaggaagagccaggauuagguccugagggaguggaaggagcuggggccuguuguucuucucccaacagugccuucagcagcugccuugagggugccaucauuggcccugcuuuucuucuaggcccuccuggccauuuggcuuucucacagcuugcuuuguaccucagggcucuuccucugcucugugcuuuccucugcccugcccaccugccuaaagccugccucccuguucuuguuaacugaugcccauuucuuuucuuuccuuuuucuuuuucuuuucuuuuuuuuuuuuuuuuuugagacgagucucgcucugucaccaagucuggagugcaguggcgcagucucggcucucugcaacuuccgcuuccuggguucaagcaauucucguaccucagucucccagcuagcugggauuacagacgugccccaucacgccuggcuaauuuuuguauuuuuaauaaagacgggguuucaccauguuggccaggcuggucuugaacucccgaccucaggugauccgaccgccucggccucccaaaguucugggauuaugggcgugagccaucaugcccggccugaugccuguuucuugaugguuuuuucuucuugcacuuuucacgugucagcuccuaaaguguguacauguggucgcugcaggagggagggucucuaugcguucagauuacaggugcaggcuguuggccugcugcugagucuggcaucgcugcucaucugucgacaccguucugcuuccuccuuucgugcuuaugaaacacaguacugguguuuucuaugggugaaacuaaguggaggaaaagcacagauacacaaacugucccauuaugcaguguuaugggccuuuucacucugcaguguugaaacugccuuggccucacuuugaaaaauaggacuaugguacccaugguuguguccuggccugggguuccucccauggcaggagcccugcuccaaguuacccuccuagccgcugcaugugcggugaaggggcuucccacaguggguauguggaagucugauggaagucugaugugcucauaaggagaucugauauguucacgugacaaggaacagcuguguugaaaaaucugcagaacacuuuggugccacucaaguuauuuauuucugggaauaauucacaaggcacuuuaggcaaugccaguugggugguuggaaugcauuuugaguauuuuaaucuuuuauguuugauuuaugaaugacuuaucagaaauauauguagucauuccuugguaucugugggggauugguuccagggcacacugaggauacuaaaauccaaggaagcucaugucccuuguauaaaaugaaauauaaacuaugcacguucucccauauacuuuaaaucaucucuagauuacuuguaauaccuaauacaagguaaaugcuaugcagauaguuguuauacuucauuguuuguggcagcaguccccaacuccuuuggcaccagggaccaguuucguggaagacaauuuuuccauggacugagggaucaggggaggauggcuuugcagugaaacuguuccaccucacaucaggcauuaguuagauucucauaaggagugaacuuagaucccuugcaugcacagcucacaauccaguuggcucucccaugagaaucuaaugcccccgcugaugugacaggagguggagcucaggugguaaugcucgcuugccgcucacuuccugcuaugcaacccaguuccaaacaggccacugaccaguacuggucuguggcccggggguuggggaucccugguuuagagaauaauaacaggaaaaaaaaguguacauguucaguacaggcaguuuuuuaccaacuauuuucaauccacguuugguugaauccauggaugcagaacccacagauacggagggcugacuguauacauaaacugcauggucuacguaaaugggguuucagcgaugagcuuugaaguuaccccuugaugauuuuuuguuuuugaagauucaggagguacauguguggguuuguaacauggguacguuaaguaauggugggaauuggguuucuaguguacccaucacccagauaaugaacauuguacccaauaggcaauuuuucaacccucacucuccuaccacccucccccaccgccacuugauaaucuuuaacuucacauguuaagagcaaucucagcacuuguggcuuuuuguguuaaaucagcuaaacugacugagugcgccuucuccaacuuuagcacaguauuucacucuuaagcaguuugcauuuaugguuuauuuagggugauaaaauuauaaccucuuugaaacaacaggaaacaugaagcaacacccucacuugugugguaguuugcagcucaugacagcuguguucgaagcuugugcugaguggcggcugcaagaggaaaagcagucuugcccuguuauccuagcaggaugauuaaauaaguuuaaacaacaguuaaaauucuagcucucuuuucucucucucucucccccucuccacccccuucccucuuuccuuucucucuccucucucucccggcccuuaaaaagaaaaauaaauaaauaaaaacauuuggaauucuaauagaacccacugagcuucugaaaggaagugcauuaugcugugcugugaaggagcccaacaggggcucacggucacucagcaggaugauggaugcaggcuucagggccaggagccagacgcagcaagaaaaaaccaaaaauuuggauuaugaaguaaauggagagguuccaagaucaaaccaagagguguuuguugauuuuguuaugugcugugggagcauggaccccucagcagguagaaggagagcaaguuugaggauguggugcaggaggaguugggauccccaagagcaggagggacugaggccaggacagcaggcauacgaggucacugaggcuggugggaggagagaggcuuacucuaaaugaggaucacugcaucuuuuggagcucuucuuuuugagacagggucuccauuacccauacuggagugcaguggcaccaugauaguagccucaaacuucugggcucaaguaauccacucccccgccacucccccacgccucagcuuccugaguagcugggaguacaggugcacaccaccaugccugacuaauauuuuauauuuuuuauagagacagggucuuguuuuuuugcccaggcuggucucaaacuccuggcuucaagccauccuccugccuugccuccuaaaguggugggauuacaggcgugagccacugagccugguggauguuuuuuguuguuguuguuauuguuguuuugagauggacuuucgcucugucacacaggcuagagugcaauggcacgaucucggcucacugcaaccuccgccuccccggguucaagugauucaccugccucaggcucccaaguagcugggaccauaggcgcgugccaccacgccuggcuaauuuuuuguauuuuuaguagagacgggguuucgccauguuagccaggauggucucaaucuccugaccucaugauccgccugguggauguuuuuaaugauuauccuuuuguacuguacuuuaagaaaaaaaaaauuuuguuuaaugucagaaauugaaaggggagagagaucaaaaauaccuuaauggggccaggcacaguggcucacgccuguaaucccagcacuuugggaggcugaggugggcagaucacgaggucaggagaucgagaccauccuggcuaacauggugaaacccugucuguacuaaaaauacaaaaaauuagccgggcaugguggcgcaccccuguagucccagcuacuugggaagcugaggcaggagaauggcgugaaccugggaggcggagcuuuuagugagccaagauugagccacugcacucuagccugggcaacagagcgagacucugugucaaaaaaaaaaaaaaaaaaaaaacccucaaugggaaaguagacuccaagagugaaaaggagcaaauuguuccagugaguuccauucuguagcacagguggccacaggugcuugccuuugaggaaaugaaagagccaugcuuuguaagucagaggcaggcucagcuuccccgcacagucugaagcuggguggcggugagaaauuacuaaaagguuagugccgguuuuuuagaugaagucaucauguuauuaaaaaauagucuguuuagucucuagguuacuguucucuggcuccccuccccauccaagacucccuuggagggagguuugaggacuuugggauucucauaucucuucgcguccaugauuggaucgugaggugaggagauagccuuuagaacccucucuuugaguggucagucacgugguauucccucugaaacccuggagcagaugcuuuguguagcugggcugggguucccccaaauaggguugcauaauuauugaggacagaugaggccucaaccagacgaccacaggugaccccagacugugggucuuccucaccuccuugagaguugcaauucugagagcugauaaaaugugccauugugugcagaucuggguaguuugaagcguucucauuuccugaggugugucagaaagacugcgugagaaaggggucacaguaucuuggaugucaucuuuucaugcaguaaaaagucugguuuccaugaauguuuguauaacaaaccaccucaaaacuuggcaccaguguagcaugucucaugacucuguggguuggcuagguuuccccacuccucccacugccagcucccuuggagcugaggcucacaccaggcuagaagccaugaaggccucugaugugucuggcaguuugugcuggcuguucacugggcccugccauccuccaguaggccggagcgauuccugcacaaagucccagaguagcuccagacagggaaaagaaaggcuguggggccuuugaggccuagguccagaccguacacugcuacuccccacgccauuaccuugguuagagcaagucacagacaacccuuagggacauccguuuggggagaggaaaaggcauggccacuggacagcccuccacagcucuuuucauaaugaccugauagagcagccaccuuuagucuagugcagaaucccagcaaauaucauucugauaucaguagauuccauagggcagagcugaagcagcuguucuuugcuaaucuuggaaguuuauugauguuuuauuuacacaccuguacagacagaagauaauagagauuguuuagaaauauucugucaccuauaaugacuaagcauugcuauaauggagcaugugguuuccuuaauugaagaauaccuaaauagaagcccauucuuaacuggccucaguauaaacagcuuguaguggcaggucaccaggccuggaucacagugcccuaccuuguuuuugcuucauaggcagaauggugguaagugguacucuggccugggcaaggucugagcaaggccugcauugauggaggguccagaguccagcucuaccaucugcacauuuucuuuggagacuugugcuuagcccaacagcaugaaucauuugcugaaggcucuggaggugggcauuccauccacaagucuccccaauagggaguacccuguuuggacauacaggguagucacacauauggguuuuaaaucuuguucuuaggauauuuucaggaaaagcucuggcccacacguuuaggaccauuuccugggcagcauuggaaggagugguagaggucaugcaggccugcccugucuugugugcaggaaaagaaugaguuguuggucuacacugaggccgggaugggaggccugccccuuacagcagcgccggcugaacuccaggcuggcuggucacauggugcccagcagcugacuuuuuaucagcuuggcuggauuagaaugagcugaaagaagagccauacgccgguguuccuugguuacauggugcccuguaguugauauuuauagcaauuaaaaagcauugucagugucagaacuuaguaagugagguuguguggauagugcugggccucaucaacuuaucagcugugcgagggccuuugagcauggguguggcuccaugcagcaaggagaccggagccugccccacccgcgccgcggauuauuuagacaagguggcaguaauguggugaccaaggguagcuacgugggugggcugggcuuguucuguggcugagguggaguagggagggcagcuggaguggcgucuguaggggcuauggauagaugagaggaaguggucucaucaguccagagccacccguagucauagagcuugggcuaaguuguaacacucuccucauguuccucaucaacuucuugaacaaaugcaaguauaugugcaaggacuuuauaauuuuuuuuuuuuuuucgagauggagucucgcucugucuccaggcuggagugcaguggcacgaucucggcccacugcaaccuccgacucccugauucaagcuauucuccugccucagccuccugaguaauggggauuacgggcacgcaccaccacgcccagcuaauuuuuguauuuuuaguagagaugggguuucaccauguuggccaggauggucucaaucuccugaccucaugauccgcccgccucagccucccagaaugcugggauugcaggcgugagccacuacaccuggccggacuuuauaaauuuuaaaaagcugcaaaugcaggaccaucaucuuaaauagccuguguuuaggacuuuuacagacaagaaaacaggccagagagcugaagcaacuucccgaauccucaugcaguucaugggaggcagaccuaggaccuggggacccaggagguggccacagucaguccuacuggucugugagugggcacuggggggcuguagagcaccauccugcaugacaaugggugucagcuacugcugggggaagggaugucagaugguauauuugccacccucagaaauaggaagcccuaccuauuggaaaccucacaaccaaggacuggcagggagcuuggcccucaagacucccaacugcugacucaggaagggcagagucugcugccuguagcugccgauaugugggaacagacaagugcuccuugguuaggaguggcaccugcuaaggucagcgccucugcugcagugaggggcagcccuggacucagacucucccaggguggaaccccauaccugucaggcugcucccucagaaaggaggcugaauaucaucugaauuuaauucaguaaagguuaggugagcagcugccacaugcagagagcacugaggauacuguuucuagccuuucaagagcuuccuuugaagaaagagcacuggucacugugaggaaagugcauuaugguugcauagaauucugaguuugugggagcuuggggagcagugacuuuugacuuggaaaacagagcuucauuuauuacagcuaagugcuuuuaguuaccuaaaauuaaauaggaggucugguuucauuucauccagaauguaaaaauuauuuaccgcugaaaucuaucauguuuaagucaucucagcaacaaguugaugaucuuaaacccacucaugggaaguuggcugugaguggggugggggggcacacaagcucccugccugcgaaccaccccucccucugaugccauuugguggcaaaagucagccauuacccuggucaggugcuuguuccucuugggggugguuagugguuuucuccuuaaucucccauauucuuuuucacucaccugcagccuggucccagcucaccugcccagccugguuucuuaaccaucuguacacccugcauguggcaguaucaugagucucagcacauggugggcaggcacuggccaggugcuccuguugucuauucucuuuggccaaaugucuucucucuccuccucaggcucugcaggccuuaccuugccuuuagggcucagaccgugggccccuccucagagcauccuugcuuuccucucccaucccacuugucuuacucuucguuucucagcacuuggauccauucugugaauuuacacguuuacugguuuuucuuauucuuguuaagaguaagaagcucauuuuagucaucuuccuguucacaaaccuuacaguaugccacauauaguuaauagauauuuguugaauugaaugagaauuacuggauuuuuagaaauaaugguauucauuggcucagcaucgugccucacaccuguaaucccagcccuuuugggaggcugagguggguggaucaccugaguucaggaguuugagaccagccuggccaccauggugaaaucccgucucuauuaaaaauacaaaaauuaaccagacacgauggcggugccuguaaucccagcuacuggggaggcugaggcaggagaaucacuugaaaccgggauggggguuggggggugguugcagugagccaagaucacgccacugcacuccagcccgggcgauagagccagacucugucucaaaaaaaaaaaaaaaugguauucauuuuuugacaugguacauccugcacacaucugacacucuuaggaaaauguuuaugugugguaagaacuucaucagaaucccauagccccuugcagggcucagaaguuggccuuuugggagugagugcuuucccgcaccccuccccuggcccaggaccccucacuccuucuggcagcuuccugccccuugaaugucauuuacaaccuugcccacuuaccuuaacauuuuaaccuuuucccccuuaucagugacauugucauugguggucagagaauuaacuguguguaacuguauauuugaggcaaggcaaggggacagauauuuuccuuacguuauuaguugugcaacagaagccaauuaagagauuggagagaugaauaacacuagugauggguugcaacuuggguguggagcugggcacacccacguacgucauugugacucagaagucccugucaccgcccugagccaaguacuaaaguaaggcccaaauaccacacuuacuucauaaagaaaccaaagucugacugccuccauuucucaugagugaaaaacuguuucuauuauaggaaacuuaggucuucaguguguuugaugguagcaugcuauuagauuguguauucucaagucugauuuuccccauuacugugcuuucuccuuuucacuucugcuuugucacuuggaauguuucuagaaguagaagucacugccccugccuacaucagacugcaauuccgggacauccaggcaacagcaagggauaauuaggaauaaauuuggcuggaagaaagggaaaaugcagcuuaggcagccuaaaccaacaggcuuauuuuucucacucaguaagagagcugaggucgccugacucagcucagguucucagugagccaucagccaccaggugccaccuuucagugagugggcuucuaucccuuccaggugucucuucaugcuccaugggaauuagaugggacaugcuuugacucucucuuccagaagcuuucucuucuuuuugaaggggcuucuguuugcgcuggguggucaaugacucagccuagucuugauuuaucccccaggauggggacagacagcaggggagagaucucagguugagaugaguguacaguaagggcugggaguaucagaaggggaaacgcucucccagauagugacaaagcuaagcgaccaugugaagggagaggacaaacaucccauggaaagaaggguagcugccaggccugcgggaaggaaggagcaugaugcuggggcaugggagcaaguggacagggagggcucugcagguccccuggaaccuaaagccagggguuauggaaggcagauccagauucagguguucagaggaugaggcagggguggguaguuuaaggagcuggagaagagguaucuccuuggggaguggaagauguuagagagauacaggguugcaggacaacagggagguggaaagagagugggggauggacuguggcaucugggccccaccaggaaggaaguggccccauuggugacucauacagggagggguggggccagugggugccugggagcucugguacuugggcaggucuggcuuccugcugccacaucuguugggaggugaagccugcaggccaaauaaugaccuucauuuucaaagccuuuuugaauaaauaaacuuuuuugagguuuaacuuacauauauuaaaauucacuuguuuuaaguguuuagugcaguagguuuugccaaaugugugcagucacuacacucgauacaaaacauucuaucacucaauucaaaaaccuuuuaguauaccuccaggucuuggcgcaaagagggcuugcuguuguugggugugggggcucacccaguccuggagacagaaugggcucuuugucugaagguggggcagggugcucccccaguggugugggaacugagccaacuggagagugaagugggaugcaugguguaagaugaauaagggaaaggcugcagaaguugcauucccagcauuuuccuucccggggauucccagcagcucagcaguaccgguaugaaccaguuuuuuucugacugccuccagcaugagcugaauuuccgucugugcaguuauccucagccaauugaaaaucaccuggaguuguauuccaagcacaaaagaaggucagagaguggaggcccgaugaucaugaucgcccugucuccagggccuaggcuggaaggaguccugcagccuuuguggcucaggaccagagagcugaccuugacccugaccuugugaucccaggcaucaguggcuggaaauuccuuucauuuuauuguugagcccagaagcgcccagcucucuuuggcaagguuaagcuaggguaagaggcacuguuacuagagugaccagaguucuuuaagcgucgcucugcuauuacucaguuaaccuuauuaauacccugccuggugacugcuguguguaaauucugccugagcccacaucucuccagugggaauaugauugacauuccaggugcucuaaguaaguuggaaaagcccacagagagccucaguaaaaguuagcuauaccuaucccugcugcuauugguggguuuuuuuuguuuuguuuuguuuuacuauuuuaauuguuauucaaagcuaauuuuauugaaaagaaguaaacuugugauuuugcuaugacuuuuggcucuggauccaaaagugaauauuguccccuaggauaaaggaggcugucuguacagcuggagagacucuugaucuaaggucuugcucuugggugacuuugcccuguguuucuggacacuuaauggguuuuacgaaauagaagaaaauguuuuagggguuuaauaaaguuuggguugugcuguucuccaguacuuacuggguuugagggucaugcccuauccaugaaccuguuguggccccagggaacuaaguaagugucuacagcuagacuuggggugcgggucacauggugugaggguagacauucuagcacuggagcaaguuugggguaaagaaaaauuuugauuagguuuuuuguggguuuuuuuuuuuuucuuugagacagagucucgcucugucgccaaacuggagugcaauggcaugaucucagcucacugcaaccuccgacucccugguucaagugauuguccugccucagccuccugaguagcugggauuauaggcacacaccaccacccccagcuaauuuuuguauuuuuuuuuuuuuuaguagagacaggguuucaccauguuagccaggauggucucgaucuccuaaccucgugauccgcccgcuucagccucccaaagugcugggauuacaagcaugagccaccaagcccagccuuuuucuucuuuuuuuuuuuuuuucuuuuuuuuuuuuuuuuuggaaacagggugucacucugucgcccaggcuggaauacaauggugcgaucucagcucacugcaaccucugccucccagguucaagcgauucucaugccccagccucccaaguagcugggacuacaggccugcaccaccacacccagcuaauuuuuguauuuuuaguagagacgggguuucacuauguuggccaggcuggucucgaacuccugaucucaggugacccacccaccuuggccucccaaagugcugggauuacaggcaugagccacugcgccuggccugauuagguuuuacgugacagugguagcuugcuguugguucuugcugugcaggggugggauacagccagacugacuccugcucaguuuccugcuguauucaagggguuucuccuuuuaggucagguccucaguuauuggaggccuggguagaggccaagaagugcagucauuggucaucccugcuuucacaaugaagauggauguccaaugcaugugguccccagucaucucugcuucuagaauguauggagcucucaguccugcuggaaaagcuccaugaagucagaaguaccugaggguguccaguguauuugugcacagccaccuuuuagaucccuguguccuugacagaaccagucauggacugagugggaggcagccuuuacuuugccuagggaguugaugcugagacauccucuguuuucucuccuaagaguaagucaguuuuuuccucugguggaaauacugccuuuucucauguuggaggagaacacugaguuuucaugagaaccgauuuaauggaggaaggugagaaucucuuuggagauuccaaacccuggguuucuuuagcaaacauuuugauagcaucuguugaaaaggaaaguuuaggcccagaugguggcucaugccuauaauccuugcacuuugggaggcugagacgggcagaucaguugagcucagaaguucaagaacaacuugggcaacauggugaaaccucaucuccacaaaaaaauauuuaguaaaaaaauuagccaugcgugguggugcgugccuguggucccagcuacucaggaggcugaagcaggagaaucacuugagccccggagguggggguuacauugagccaagaucgugccagucuacuccagccugggcagcagagccagacccugucucaaaaaauaaaaaagaaagaaaaggaaaguuugcagccuuuuuucauguuccugauuguuggguuacauuuguauaagaugcuucuguaauagguuuugugggaggugccagaagagaaccccaaaucugucuucuacaucagacaauacaccagaaauuaaccagaaagguaaaaaccguaaaaccucaaauaguuugauuuguaaaaacauuuuaaaggccaggugcaguggcuuacgcauguaaucccagcacuuugggaggccaaggcggguggaucacaaggucaggaguucgagaccagccuggccaacacagugaaacccugucucuacuaaaaauacaaaaauuagcugggcaugguggcaggcgccuguaaucccagcuacucgggaggcugaggcaggagaaucgcuugaacccaggaggcagagguugcaaugagccgagauugcacuacugcacuccagccugggcaacagagcuagacucugucucaaaaaaaaaaaaaauuuuuaaauauaauucacauaacauaaauguaauuauuuggccugguccuggugacucacaacuggauucccaucacuuugggagacugaggcaggaggauugcuugaggcugggaguuugagaccaguuugggcaacagagcaagacccuguuucuuuaaaaaaaaaaaaaaaaaaaaaaagucauuuuuuaaguguaccauucaguggaguuuuguuuuuaacagauggguucuugcuguauugcccaggccagccuugaauuccuaggcuuaagugauccuccugccucugcuucccaagugacugggacuacaggcacaugcuacuacacccagcuacagugguuuuuaguauguucacaauacugugcagucacaucucuggugguuguuuucuuuaaguuauuuuuucugaauaccaaaaaauacaugcuuauuauagaauguuuuaaauauucuacaaaaaagaaaaagggaaggaaaaaaaaaguauuccacaaaacuccccucaaaaacagauuucacugagagaucagacuccccugcaugaggcagaugguccaggccugugcauuaucauugugucuuuucuaguuugugucuagcagcaguauauagcagugcucuugguagugggaccaucugagugacguacaucugugcccuagccagcauuauaaaagaaccugucugaaaaaaacagaagaccuuaaggaccagcauacuggauucuguagccaucucuaccuucuggucuccagacucagacagacccauuugauauccagccaugucccagacaaggagcacaucuggguggcaucuuguuagaaggagaaugcaaagaucucauaaaguuuugccuugccucuccaaguuuuucaagacagucuuaucagaguuuauugauggaagaauuuuagaggcuggaaaagguauugcagaaaagaaaaacaauguuucuauuuuuuuuuuaaacugauguuuugccaggcgcgauggcuuacgccuguaaucccaacacuuugggaggccaaagcaaguggaucacuugaggucaagaguuugagaccagccuggccaacaugauaaaaccccaucucuacuaaaaauacaaaaauuauaagccugguggcgugcuccuguaauccccgcugcucaggaggcugaggcaggagaaucacuugaacccgggagguggagguugcagugagccaagaucaugccaccacacugccugggcaacagagcgagacuucaucucaaaaaaauuaaaauaaacugauguuuaauugugcuuuucuuuucuuuuuacaaugaacuuuugugaagucuuaguaugucugaucucuuaaauauuuuaaaaacuugcaucuuuguaugagaugaauaaaccauuacaguucacaguaucugcaaauuguaaaucaaauaauucagacauggaauagccaaaaauaguaggaauauaaguaaauuaguuuauaguuuuucuaaggaaauucaaacugauaacuaacaccugacuuugugaaguauuagacugugugcuaaugccuuuaacuaggguagucuuuacagcauaccuaugaagaauguauauauuucucuccucauagaugagaaaacagcacagaaagguaacucacuaagagccuaccucuugaauuugaauuuugaucccugacacagagaucagauuugaauuuccaucucugaccccacacuuugagcucuuagcuccugaguuucuccugagguagcaaugauauuauuucucugugggguuagugcugccucuuacaaaggaucagguuccacuuuguucccagggaagugaaaggacaugagcaaggugacccugggcucuucacagguugugcugagcccuuggggccuugagggagguguuugaugggguguuugaucccacagaaaaacugguagaguuugcagaccuauagacagaaggucaagagaucaccucccaggugcuggggccggggggaaggcugagacaguaagugucucuguugaccuacauccugaaucuguccccaggcccagugaauaggaacugaggagagcuguuggcauugggccuuuggguuauguguguugauggaaggcggccacagggcaucuguguuauagcugugggggucagaaagugcaucccgaagacaaaaguuguggaaagcagggagccugaaugcugagagaaacccaccguuugggaacagacagagaccccacuguccaggaggaagcaggcucagccagccuaugguagacuugccuugccugcagagagcaguucucuguggccacagaugcauccuggacuuaggggagcagugagguaacccuguaccuucuuugucuuuagucaugggacauuuuuuuucgcaacacgaaugccggagccccaccgggcacugccuaccagaguccccuuccccugagccgaggcucccuggcugcuguggcccaugcacagucccugguagaagcacagcccaacguggacaagcucguggaggaccaccuggcagugcagucgcucaucagggcauaucagguaaggcgggugcuuuacccgcacacgggaaagggugcaguguuccuuaggucaugccucaugggcccuauuggccuuucugaguguauguugucacuuuacuuauaccuccucaaauacuaggugcuuucucccugcuuugggaggcuaaaaaacaaauacacaagaaaaagaaccaggcuagcccuauuugagcaaaucucccagcaccacuaaugccugccuuauaaaagggauccuuauuuccuuuccuuccuuggcaagaaauauuugugggcagggaaaacaagucaguacccgggcaucaaggagaagugcugcccaucugccagugagcagugacugggagggguggugcuuuugggugguugaugcccccuucucaguugcuaacaacugaauacuauaagagaagaaaaccauacuauagaguuuggggauguggaggcagggagaggcagcugaggguacagcugagccuacagagagugaugaggggcaggggaacucuccaaaaguauugcaguuaguggccagucucguuaggcaaguguugagcaggacaagguuuuuccccccauccuuucccagagcacaauaaccaaaguuuuucuaggauguccaccugauacauggggagagccuagaguucagaucuuaagacuucaucugugauaguucuaaggacgacagguagagacaagugagccuggugcuucccuucuggaagcucccaugggcauccaggacccugccaccuguucuuguguaacugcuuugguggcaacaaggggacucaugucccugggcugucuuuucucucaugcuuugguuucugguggcaugggccaugggcagguguuguaauggggcaacauaggggagguccugggucucuggcccuucaugccauggccuggcaaguaaggcucucucccuggggcaaguguauucugccuuagaaaggagaugcauggaguuuuguaaaugcuauaugcuuuaaaguguuauccauguggauauuugcauaaggaggaagcccagugguguuucuuuaucacugccugcacgcaguuggccucaguaacaacuucagccugaucuugcagugacuuaccagcagcugcucccuucucaaauugcuagcaagaaguugugaaagaaucuuaaauuggaagggauuuucuuucuccuuuugguuuuuaaauaguucaaaucagaugcuuuaagucugugguguagcaggguuuuuuuguucugacuacugugugcugaccuacucagcagcagcaggaccagagcccucacuccucacggggauauauaauaaaggcaaaccuucucuuagugagaugaccucuuaucugcacuccuccccaguuaaggccaacacuuaagccuucauuuuccuacuuagaaaaauuuuucuuuaaauuugauuuauuuuaaauugaggugggaucucacuguguugcccagguuggccucaaacuccuaggcucaagagauccuccuaccucagccucccaaguagcuggaacuacaggcaugugccacuguacccagcaccuuagggaaauguuuauguucugagcugaggcaggcuucacauuggaguaagaauugcccagcauaucucauuucuguuuauccauggaaacuguauaaagaucacaagaaauggauccuuucagacuccuaaguuuaucauaaccugaguuuaucucuuuuuuauaaaaguacauuuaugcacaauagugcuuuuaaaauaaguuauuccaagacuuuuaaaaacuaauuuugucguauggguuuauuggugcuguguuccucuuuggaaaagguuugcauaaccugugacucuuuuaacccuccccacagcucacuggaucugcuuaaugacuugcuuguguuauugcuuccaggucaggggucaccacauugcaaaacuugauccucucggaauuaguuguguaaauuuugaugaugcuccaguaacuguuucuucaaacgugggugagaauuaagcuguaaaugcuaauuuuaauguaauuuuacuuuuuuuuuaccccuucccucuuuuuuuuucuucuguccuuuuguguguguccuucccucucaucguuggccacucauagauacgagggcaccauguagcacagcuggacccccuggggauuuuggaugcugaucuggacuccuccgugcccgcugacauuaucucauccacagacaaacuuggugagggucugagagcagucagcugcguugcuugagcuccucucgcugugccacgaccugugguagccaggauguccaggcaggagggaaaggcucuuaaguuuccuuucauucugaucacuugaaauuuaucgguauuguagccuuaguguguuuugggcaaguuauuuuuaucuuacuuuuucagccagauugucuuaagucucaaaauuugaaaauaaaauuuuggacagaaagguuuguggcacagggaaaaagcuuguccaccuggggcagguggaucagaagcacuucagaguauagcucuuuuggcuucagguuuucaaaugucagugcagcacugccuucagugaggcauguccaugaggccuugcucaggaacugcugacacagccauccuuuucugaagcccaguguggccugcccuugacuggaggccaugucccuuaggggacgaauucuagagcaaguugugcaguugggucuccugauuuguaauugcuggugaucacacugaggaaacuuuggaaggcauucccacagcgucaggaggucagggccuuugggaggugcauguauggagcacacugggguuuugucacgguugccagaagauagucccaccuacacccccuccuccucaugaagugagguggguguuguggcugggcucucaccugcaguugcuuugcagaguuagucugcuuuaugucacugugcugcuaaccuguacuaaagaaaugaugaugugacuaauuuuuaaauggccaggguguucacaauagacacugugcaugcugaugaaauugaugaucacuuacuugccuaauacuccucuugggauggguacgaaauuagccuccucacaggcacuuuuggggaaugguacagacagucucuaaggcucugcagugccuggauaucuuuauaggcauuacuaaguuaugucuaggggaugaggcauuaaucaucaaacaucauugacuuuggaauuggcauugaugguuuguaauuguuuuuuuaauaccagcccuuuagcggauuuaggaagggaguuuagagaaauccucuugaauuuuauugauuaaggccaguucagaugguagacugggcaugaguugaacccugcuuuuucauuccguggugacaacuuugugcucccaagaagagggccucucuuugcaguguccccggaggucuuggagccucuucccuacugcucaccccuuaguacagcaaaccucccugcuggcacccccagucccaucacagccugucugcccugugccucuccagcccccagagacuucuagaccugugggauccucuucaggugcucagagcaggccaaacuccccagcugguagacuugcugcucccugaugaagagcacagggacuugcaucuggaagccaccucuucagaggaaaaccucccucugcauuuaggcaggguaggagagcugcggaaugcucauuuucuguuguuuuuuuuuuuuuuuuuuuuuugagauggggucuugcucugucacccaggcuggagugcagcagcauaaucucggcucacugcaaccucugccucccagguucaagcaguucuccugccucagccuccugaguagcugggacuacaggagcgcaccaccacacccagcuaauuuuuguauuuuuaguagaaacgggguuucaccaugucgcccaccucagccucccaaagugcugagauuacuggugugagccaccgcgccuggcuggaaugcucauuuuuuacaagcagcaaaacauucgaacaggagaggagcagaugaagugacugacuucucccucuccuuccagaaccugcauugucccagcucuuugucccaacugugcacguuaguauaaccaggggagcucuaaagcucuccucucuuccccuucagacuaauaucaagaggggccacaccuagguaaacccaacccagcauagucuuuuaagggugagaaacccuaagcacugucaacauacgcacuaauuucccaucucauuaguggccgaggcagggccagaaucugggaaucucuucccaggccaucacaaggucuuaccauauauuucacucuggaauaguguccucaguauuucugugagguuugugguuccagauucagcaacaacaucauggugagggugagaggacaagaggacuuuauaaaccaagaaacuaaaacauacagaaguggcccuaaagcuuccugaaauccuuugaggaggaaaacuucugacaucucuggccaggagcccuuuggaaccacugagagagagagucagggaguagucuccacguuucaagaggaaggugcauuuuaauccuguggauuugaaauagugugaccuaaaaaucccacuagucuucagguacaaaaaauggaaaccgcguaaacuuguuaaaacauuuguaucuguaggaaaauuggucucgaacucucacccuugauguaugcaggucuucaagaaaacagcaggucagaugugaccgcuagacaguuuguagaacacuucaagacccgucgucucauuugaaccucagagagccgggacucuggagccacacucccugcauuggaaucccagcccacuauuacuagcugugugaccuugggcuaguugcuuaaccucucugugccucaucaccucaucuguaaggcaggggugaugguaccuaccuccucaggugguuucaaaauugaauaaacuccuuaaaguagugccuugaccuuaacuaugcuccaagugggcuuacuagcaaucuuuugagaugaguagcugccaaacucucugauaauaagauaaauucagaaacugagaggucaagcaaaaagaccaggaacacacaggaguuaguggugaagacugcccuguagccaaauuauaaggaagcagcguagcaucuagugcaggaguuugcaaacuaagaagugaggacucuguaugggggauguuuggggcccaggagaacuguuugccagcuuaggaaugaggcaguagaaggggauaggcugaauggcaaccuggugaccugaccaguguguagacgggucagggacuguuguguagugguguacugugucacaugacuauuuccccagagcuaggauucuugccaugccuccgcuuagccgcccuucccaccucccuguggaugcaggcacaguuucucccucuccuuggggaaacaggcucacagcagugaucauacccauguuggaacauagccuuuggugcuuccgucagagcuuguucugucuuuuguuggaaaagcuccagguagggggcagugauggagggcaggagccguuggcaaagccauucauucucaaagggcacugaugaugcugcccugaaaacagucugccagcugagcaccugggugguuggccaguuuggucugcagugcaagcagggaauucuguccacucugaguuuuuuaauaaaguggaauauaugcuauaguuuccacugaguugaccuuuuaugaccauuuuugaaaaguuugggaaauccuggcuuagggcaccugucuucacuucucagaaauucuccuggucccugaaguaauaaggaaagauaauuaacaaguagacucuuaccaguuaggagagacuguacagacacagaacuccacaguagcgccagagugucaggauuuaccaucagauguuauggacacacucuugcccucaguuuuaucuuucaaguguagcaugacagaacuuguuaugaauacaguaaaaaauauuguugagaugguagggccagugguuuauuauuauuauuauuugagauggaauuuugcucuuuugcccaggcuggagugcaauggcaccaucucggcucacugcacucuccgccucccggguucaagugauucuccugccucaaccuccugaguagcugggauuacaggcacccaucaucauguccagcuaauuuuuguauuuuuaguagggaccauguuucaccauguugccaggcugaucucguacgccugaccucaggugauccaccugccuuggccucccaaagugcugggauuacaggcaugagccaccacacccagccuaauuaaauuucuaaaauuuaaguagagacaggguuucaccacguugcccaggcuguucucaaacuccucugagcucaagcacuccaccugccuccgccucccaaagugcugggauuacaggagugagccaccgugcccagccuagugauuauuuucauuaacaauuuuuaaaauuaauuuuagaacaguuucucaauuaugugugaauuauguuccguaauugugccaggugauggcuggaacagagauaaguuuuuuuuuuuugagauggaguuucgcucuuguugcccaggcuggagugcaauggcacgaccucauuucacugcaaucuccgccucccggguucaagcaauucuccugccucagccucccaaguagcugggauuacaggcacccaccaccaugcccagcuaauuuuuuguauuuuuaguagagaccggguuucaccauauuggccaggcuggucuugaacuccugaccucaggugaugcccucgccucagccucccaaagugcugggauuacaugugugagcuaccgcaccuggccagagauaacuuuuuaaugaaguguuaaaguuaggggccaguuuccagguaaaucuccagaugcccaucuuaauuugugccaggcuauacuauaaaccucauuucccuggggaaagaggguugagaguuccaacaugagauacuuuauuuuuuuauuuuauuuuauuuuuaaaauagagacagggucuuauuauguugcccaggcucgucucagacuccugggcucaagcaacccuccugccuuggccuuucagagugcuagaauuacagcagugagccaccgcgcccagcugacauguauuaaauacacauuucucuucacucacauuccauagugagguuccuugacagcaaauuugcagaucuggagaaugaggcaccaaccucauguuauaauaucccugaauggauccagucagagugggagguaguggcagcccaacgucuucugguaggagggcuccuagggagucuuuuuccacuggcucuugaagaagggucaucaguugggguaccacgguagauauggguguauauugcaaaacacuagaaccagaguauuaucaauggaaaggucuagacagugaggcccacucauuugccuaauuagaaacaguuagaaacuccugcuuaauuagaaauucuugcccucaguuuuuucuugcuguuguuugguuuuuuuuaauuauuauuuuuguuuuuugagacagagucuuacucugucgcccaggcuggagugcaguggugcaaugucagcucacugcaaccuccaccuccagguucaagugauucucgugccucagccucucaaguagccaggauuacagaugugcaccaccaugcccggcuaauuuuuguauuuuuaguagagaagggguuucacuguguuggucaggcuggccuugaacuccuggccucaagugagucgcccgucucggacucccaaaguguugggauuacagaggugagccacugcgccuggcccaauuuuaucuuucaaguguagcauucgaauuaguuucccacuuaaaaaugccacugucugugguuucgguauaaauucugaguauaacuuuucacagugacaaaaaugauugagauguacuuuacuggguuuuuuguuguuguuuuguuuuuugagacagucucuuucuguagcccaggcuggaaugcaguggcacgaucucgacucacugcaaccucuccuuccagauucaaccaauucuccugccuuagccuccugaguagcugagacuacaggcaugcgccaccacaccaggcuaauuuuuguauuuuuaguagagacaggguuuuaccauguuggccaggcuggucucgaacuccugaccucauguaauccaccugccuaggccucacaaagugcugggauuacaggcgugagccacugugccuggccuaauuaaauuuguuuuuuuuuauuuuuauuuuauuuuauuuuuuuuugagacggagucucgcucuguugcccaggcuggagugcaguggcaggaucucagcucacugcaaccucugccucccagguucaagcaauccuccugcuucagccucccacauaacugggauuacaagcaugugccacuaugccugguuaauuuuuguauuuuuaguagagacgguguuucaccauguuguccagccuggucucaaacuccugagcucaagugauccaccugcuuuggucucccaaagugcugggauuauaggcaugagccaccacgcuccgugagauguacuuuaaugugagauuuaaacauaauuaaaagagaauuaaaaaccaauuguauaaauaaaugggaagaaagugugaaacuucucucccauuuaccauugauguuuacaaauugcuaauaccauuuuaggaaaugaacgugaguuaaauaguuaaaaagucaauuuaaaaguugaaaaauguggcaaaaugucaacuacuuaguucuugccuuucucugacaaccugcugucauuaacagcacagcgagucaugacaaaguuuccacauauccuccugaccuuccagggcucuccgguuuguuccuuugauggcugagaaaaauaagcuaaaaauagaguugacguuuaauuagcuuuuguaauuucagagugauauagagcaguucauuuaguaagcauugauugcuaugugcagcgugcugugugccacagauaaccgaggagcuggagacgagguuuccuaagugacucgggagggcggggccaagcuaagaacauaaccagggugguugaagccaugggcgauauggucacccucaaggagaaugaagcuggccaagcagacaucugacauuugagaagauucuuugacuggagauacccagaaacugguaaaccgaguccccuaguucccagcgucacauuccugcuucugugcuucacuuggaaguacuguggccaaaucuccauccgcucccucucuccucccucacagcaccugcacucuucaagaaguaauuuacaaugcuucaaagcacucagguguuggaaaaucugugugcuuucuguaaauugugacaaccagaauaucuucuauuguucucuuaacucuccucuucuuugguuugugucuuuuguuugccuuuuauuuuaaaaauauaaaaaaguacagauaaaagagcauucacauacucaguacuaagaauguaaacauuuuaccacauugccuuuagauuuuuaaaaauggguaugaguauuuaagguuccuuucgaggcccuccccuguguagauccuuaccuggagucuccaggguagcuaacauacaccucacuuauggcaucuugacauggucucaugucuugguuuugaagauugaaggagaaaauuuaagauucuucauccuugccuuaagcaaaauaucgacauuuagauauucuguugucuuaagagccacuuggcucugaguucuucagugguuguuguucccugggggaaggagacaguguggcuugcccaggacuggagacuagccccugucacagcccuaggaagcaggccuguuucuuggggucugagucugacuucaaaggaagcacuugcuggccuuucucugcacucccaguacagggagcauacccagugacagcacucugagugcucaaccaucagcuucucugugugccuguguuacugccuaccuuccugaccccaucccccaggcccacaagcccagacaguaagggucaggagcauguuuuguguauccaaauaaaugccuugauuucaccaguggcucagaaagcuguuauguauaguagaaauccgaugaaaaguuuacagguagaaggaaguguacagcuguggagaugcagcuguggcucuuggguuguuuucagcuagcaagcacuucuuuccuaguuugccuucuugaaaugggagaucaaggaauccuuccauucuuuagaauucuucaaaaucuuacgguuuagaguagucugccaccugaaucuagugcugagaaauaucugcucuaaaaauuaggcuuuuucauuuucuuuuccucaauuuucaucucaaaguagugacuucccaggaaagugcuguuauccgccacuucuugaagcuaaggagaugaggagcucucaaaugacgcugccugauggcuuuccaucgucagggugcuaaccuccccuccuucugauucaccuuauuccagcuguucuaugaaucauuuccauguuuaauaaaauugacccccugaccauguaacccacccacuucucccuugaugugugugugugucccugugauggugucugugcuaccuguuacugugguaaugguguaggguuuugguguuugggucuuuuuuaaacuaacucucaccugucuuuuuccuucugcgcucacccaugauaccccacucugccucucagaucuugcaguuuucaaggaacgacuucgaaugcuaacaguaggagguaugaaaauaaugagcuuuucaccuuuucagaguugaggacuucauuugaauaggaugugcaacuuuuccuagcaugcaauauggggaaaguugacgcaacuucugucacguguuuuuaaguuuguuaauuguucugaaauguguuuuucccuuccuuuaauuauuaaccaauaaguagagcuacuuauaugguaucguuuuguuucuguucauuuguguuucaaagagcacuuuucaucuucacgugugcuucaucgcuucacugugagcugccaucuucagcauaauucaccuuuagcugcugccauagccagcugggcacaugaagccauguucagcucugcaugguggcuuguccuguccuccacauucugugcugaggcuuugacuggacucuggauucuuccagauucugcuuccugggcauuuugggcaagauuuccaaaauguuuuauguuugaaggccaacugaaguauuaauaaaaacuuacugagaacucuuagugacccucgguugggcaaaacacauuugaggaauccagagucgaaaugcugggggaucaucagccuguugucauccacccugguggccagucucuucuuuacacucuggcuucucuaagcaguuaucuuuuuuaucauccuucuaauaucugugaaacucuacuuuuuaauuacacuuuuaauuuugagauuauuauagauccauaugcacuugugacaaauaacaguucugugcccuuuggccagcuuccccagugguaacaucuugaaaagcuauaguacaacaucacaccacuacacuaaauugauaaaguaagacucuagacauccaucaccacgaggauuccuccuguugcccuuuuaugaccauaucuacuucccucccaucccagccacuacuuguauucccuggcaaccacuauuuuguucuccauuucugaaauugucauuucaggaauauuauaaauguagaaucacaguauguaaccuuuggggauuggcauuuuucaaucagcauaauuuucuuagagauucaugcagguuguuggugugaaucaauaguuuguuccuuuuuauugcugaguaguauuccaugguguggauguacuaugauuguuuuuaaccauucaccuguugaaggaccucuucauuggaauggauuguuuccauucuuuggcuaauaggaucuuuugcagagcagaaguuuuuaaucuuuuuucccccucguuuccuaccucagcuucuaugcccuaaguuuuuaagcuugaugacauccaguuuauuaauuuuccuuuuauggauugugcuuuugguaugaagucuaagaacucuuuccuuagcccuagauccccaaaauguucuccuauacauuuuucuaaagguuuuauaguuuuguguuuuacauauaaaucuaucauccauuuuguguaaauuucuguauaagacguuuagaucaagauucuuuuauuguucauuuuauauuuuuguguguagauguccaguuguucuggugccauuagcugaaaacucugucuuuccuucauugaauugcuuuuguacuuuugccaaaaaucaguuggacuuauuggugugggucuauaucuggauuuucaguuauuuuccuuugugugucuguuuuuccaucgauaccacagugucuugauuacuguagcuacuaaacuuuauuuuucauuuacaaaauuguuuuaacuauucaagggccuuuuccuucuccauauaaauuugaggauaagcauaucuaugucuacauauaccuuacugccauuuugauaggaauuggcuuaaaccuauagauccauuuagggagaaaauacauuuuuaccauguugucuuccaauccaugcacauaguaugucuccucauuuauuuggaucacugauuuuuuuaaucagcuuuuuguaguuuucagcauauacauuguguauauguuuuguuauauuuacacuuaacuauuauuuucuuuuuuaaccuugguguccacauauucauugguaguauauagaaauauaauugauuuuaguguuuauguugcauucugagaucccgaugaacucauucuagggcuuuuuuuuuuuuuuuguagauuccuuaggauuuucuauauagacagucaugucaucugaaaauaggaaguuauuucauccuucccaaucugugugccuuuuauuuccuuuucuugccuuauuacaguagcuacaacuuuuagcaccguacugaauaagagagguaagaguggauagccuuaugcccuguuccugaucuaaggguaaaagcacugagucuuucaucauuaaguauaauguuaacuguagauuuuuuguaaaugcucuuuaucaagcugaggaaguuccucuguauucauauuuuuucugauaguuuuaauuaugaauguauauugaauuuugucagauguuuuuccugcauugauaugaucuugugauuuauuauuauuauuauuauuuuuugagacugauucuugcucugucacccagucuggagugcaguggugcaaucucagcucacugcaaccuccaccucccagguucaagcaauucucccaccucagccucccaaguagcagggggcuaccagugugcaccaccacgcccagcuaauuuuucuacuuuuaguagagguggggguuucaccauguuggcuaggcuggucuagaacucccgaccucaggugaucugcccaccucacccucccaaaguucugggauuacagacaugagccaccacccccggccgauuuuuauucuuuaauguagaugauuuaaugcuaaugucgugguagacgauuuaaugcuaaugucguggauuguauugauugaguuuugauuauucaaccagccuuggauuaguggaauaaacaccauuugaucaugguauauaauucucuuuauaugucuuuguaucugucucuuuauauauuuugcauccauauugaugagggauauuggucauuuucuuuuuuuguacuaucuuugcuuuugguaucaggguaauucuggcuucauaaaaugaauugagaaguguuucuccuauuuuccaaaagacaguaaauagaauugguguuaacucuucuucaaauacuuuauagaauuuuccagcaaaaucauuugggcuuagagguuaguuuuucacaagguuuuuauuuauuaauuagauuuccuuauuagccauagggcuuuucuaauuaucuguuucauauugggugaguaaugguaguuuguguucuucuagaagugguuuauuucaucuaaguugucaaauguguguaguguuauuuauaguauucccuuauuuuugauagucauuuuuuaaauuucuuuuucaacuucaagaaaaggaacagaaucuucuugauauuugaagggucuguauugauauccuguuucauuccugauauuggucauuuguguccucuuuuuauuugucagucuuguaagagauuugucgauguuacuaaucuuuucaaagaaccaguuacuuguuucauugguuuuuuucuguuguuuugcuguuuucaauuucauugauuucugcucuuuauuguuuccuuacuucugcuuauuggcuuuuggcuucuuuguuguuuuucccucuuuucuaggaaugggaacuuagauuauugauuagagacugucccucuuuucugauguauuuacuacuauaaauguuucucucaguacugguuuagcuguccuacaaaguuugauauguuauauuuucauuuucuuucaguuguuuuugaggcaaggucuugcucugucauucaggcuauagugcaguggcauggucacagcucacugcagccucuaauuccugggcuuaaguuaucuucccaccucagccucccaaguagccaagacuacagguguaugccaccaugccuggcuauuuuuaaaauuuuuuauagaggugaaaucucacuguauugcccgggcuggucauuauuguauucuuuguauaccccuugauauuuugucuuuggccuuuggauuauuuagaaggguguuauuuaguuuccaaguguuuggagauuucuuguuaccuuucuuauuauugcuuucuaguuugauuucauugugguuggagaaugcacccuauaugauuugaauugugcuaaauuuguuggguuuuuaaaaaauggcccaccauauugucugucuuggcauauguuucaugggugcuugaaaagaaugcugcuguugaaaugcuauuguuggguggaguauucucuaaaugucugcuagagccaggcauggugguucaugccuauaaacccaggacuuugagagaccaagaugggaggaucacuugaagccaggaguuuguugccuggcaacauagcgagaccccuguuuccaccaccaccaacaacaaaauuagccaagcaugaucgcgcgugccuguaguccuagccacucaggaggcuaaggugguaggaucauuugagcccagaaguuuaaggcugcagugaucuaugauugcaccacuauacucuggccugggugacccuaucuguaaacuacacacacacgcgcgugugcacacacacacacaucuguuagauccuguuaguuaauggcuguugaguucuguauuuuugcugaauuucugucuaguuuuuuagucaguuauugagagagggguauuaaagucuucagcuauaaauguggguuugucucuuucuccuuuuaguccuaucagauuuggggucacuuauuuugcagcucuguucuuugguguauacacauuucagauugcuguaucuucucaguagauugacccucuuaccaugauggaaugucccucuuugucuccaguaauuuucuuugcucugaaguuacuucaucucauauuaauauaagccauuccuacuuacauuugauuaauguuuacaugaugcauuuuuuccucccuuuacuucaacuugucuauaucacauuugaagugaguuucuuguggauaagcauauagguggguuuuguuuuauauuuauccacuuuucucauaaucucugucuucuauuuaauauauuuaggucauuuauauuuaauguaauuauugguauguuagggcucaagugugccauuuuauuauuuauuuuuuguucugcuuuucauugcuuugcuuucauuuuccugugcuguggauuuuuaaacccacauuuaaaaauuuuuuuuuaauuauguauaguuuaugguuuuuuggguuuuuuuuugagacggaguuucgcucuuucacccaggcuagaguggugcaggggcgugaucuuggugcacugcaaccucugccuuccgguucaagcgauucuccugccucagccuccugaguagcugggauuauaggugccugccaccacacccagauaauuuuuuuguauuuuuaguagaggcaggguuucaccauguuggccaggcuggucuugaacugaccucaugaucuaccugccuugggcucccaaagugcugggauuacaggcgugagccaccacgccuggcguguuuuugaguguauccuuuuauauagcauuuuuaguaguuguuuuagguauuacuacuuuauauagacauaacuuaucaucuacuagugucauaacuuuucaauacauauuaaguauggaaaccuuaccuccuuuuauaucucuuuacuguccugcauuuauaauauaauuaucuuagauauuuucucuacauacauuuagaacuucaucagacagaguuauaaguuugcuucaaccaucaaacauaauuuagaagacccaagaggaggagaaucugauguauuuacccagauuuuugcuuuuuguguucuuucuuccaucuugguguuccaagauuccuucuuuuauuguuuccuuucuguuuaaaauacuuccuuuggccaauuuuuuagggcaggucugcugaugacaaacuuaguuuuccuuugccugggaaccucuauuucuccuucauuccuacaggacauuuuugguggauguaagauucugguuagacauaauccuuuucccuuaucuuucagguccugaaaaguguugugccauuucuuucuuuucuuuucuuuucuuuuuuuuuuuuuuuugagacagagucucacucuguugcccagguuggagugcaguggugcaaucucugcucacugcaaccuccgccuccuggguucaagcgauucuucugccucagccuccugaguagcugggauuacaggcacgcaccaccacgccuggcuaauuuuuguauuuuuaguagagaugggguuucaccauguuggucaggccggucucgaacuccugaccucaugaucugccccaccucggccucccaaagugcugggauuaccggcgugagccacugugcccagccuauaccacuucuuucuacccuccaugguuucugaugagaacuccugucauuugaauuguuuucccuauagguaaagugucacuuuacaacaacugcuuuuaagauuuuuucuuugauauuguuuuucagaaguuuaauuaucauguguuuuggcauggauuucuuugggaauauccuguggauucacucagcuucuugaaucuuuggguuuggucuuuuaccauauuugggaaguuuuuagcuaaguaccuuuucagccacccucuuuauuuucugcuucuuugauuuuauccauuuauauguaugugaaaucuuugauuauacugucacauguccccugaggcucuguucauuuuuuauuuccuuucuguucuucagauugguuaauuucuguuguuccgucuucaaauauacugauucucugccccuccauucugccauugagccuauccauugaauguuuuuugauuuuuuaaaaaaauucuauuugguacuacuuugcaucuucaguuuuuggcugagacauucuaauuuguaacucacuuuuaaaaauuugucucuaucguguucuuaauugcucauugaaauuguuugggccaggugcaguggcuuacgccuguaagcacuuugggagaccaaggcaggcagauugcuugagcucaggaguucgagaccagcccggccaacgugggaaaacuccaucucuauuaaaaauacaaaaacuaggccgggugcuguggcucacgccuuuaaucccagcacuuugggagacugaggcgggcagaucauuugaggucaggaguucuagaccagcuuggccaacauggugaaaccccgucgcuacuaaaaauacaaaaauuagccgagugugguggugcacgccuguagucccagcugcucuacucaggaggcugaugcaggagaauugcucaagcccgagaggcggaaguugcagugagcugagauggugccacggcacucuagccugggcaacagagcgagaugcuaucucaaaaaaaauuacaaaaacuagcuggacgugguguugugugccuguagucccagcuacucaagaggcugagguuggaggaucaccugagcccuggagguuaagguugcagugagcagugaucaaaccaguacacuccagccuaugcgacagagugagacccugucucaaaaaaaaaaaaagaaaaaagaaauuguuugaugaugacuguucaaaucacaggcgauucuaacauauuggucaucaugguguugaugucuguugauuuucuuuucucauucacuaugagauauuccugggucuuguuaugaauuauaguuuauugaaaccaggacauuuuggguauggugagagucaggaucuuauuuaaaucuucuguuauagcagaccuuuuguagacacuguuccccacuguggugggggaaggggagggcaccaccuuguuauugccagcagagguggaaguccuucucccacucaaguauccaccguuacugggauuaggggaaggggcugaugcauuaccucccagagagaaggacauuuuggauucccucuugggccuucgcugaaaccucugugaugggguugggugcuagggcccauuacagccuggugaggguggggucacaguguuuucucugguauuugccuguaguagagcaguuuuugucuaaaaguuuuuugucuugauaggcuaccucuuuccuggucuuuugguagagagcagcuuuugucaggcuuuuguuaucaaauacaccucuuaaaguuuugggguugcugguucuucugcuccaggucugcaauauuugaagcaaaaaagaaauuccagggaacucccugguguguuuugccuugagaccucccuagcuggugugccuuauucucuccaccuuucagaguugucuuaugauuguuuugcauauaaugucuaggauuuuuaguuguacuuauugggggaauagggaagaauauguguacuccgcuuucacaaagcacucauauauagaucuaguuucucaaauagcuaaagaacuaaaaguguaccagcaguucugaggcucagcaguauagcccaagaacuaugaacucaggaugauagaagugaaagaccaucacauggugaggucaagggauaucuguaggcaccuacuucacaggguccaugcugaaagacugcaaccaauacacagcgcuuaucugggggcauacacuggaccgauauaguuucacaaucaaaauauuucccaacaaaaugugcacuguuauucugguccccagucagcugcaccuggccugaguuuuuuagucaggaaaaauuucucaaagaugauucuguuuuuccuccauaaauacuauagggcaauugcccaaaagccaggccauaaauggcaagagccacgugcuucaccuaggcccaagugguugcugugcccucaguguugacagacuaacaggagggaauggguguucaggcuuaacuaagccacuacuaccaucaccacccuccagguuaaaaaaaaaaaaaaaaaaaagccagauuugcuuuguuuuaauaaaacaaacagggcuuggaaaauguagaguuugcuuuuaagacuuaaaaaacaaaacaaaacaaacaaaaaaaaccucuccgaaagcauuagauaaauaaaggcuguaguucccaaaccaugcuugaaucagaaucaccuugggagauuugugggcccacccugagacucacugauucaguaccaggguuggagccuagaaacaagccuuuuuauaaaucuccaaggagaucaaaauacacaauuguguuugcaaacuaccaccguuaaucccgugcuggacacuuauggcuccuuuuagucuuaauuuggccaggaaacaauaagaacauuucaucaggucuagucagauguuggagacuucgcaaaauaccaguucacugugcauuccuggagccugagaaaaugcugauguaagguauucaagcgcuagugauucuugaacugugcuuuuugcuguacucuagcugauauauuaugucaggagagaugccaaacuggauaaaagaauguauggugucauuugacagucuuccucuuugauacagcaagaugaaacaagcauauaaugccacagaaagagcucuuccagcauuauucuuucucagacugagaugcacuuucaggugagguguugucuucccccacagugcugcagcgaauauuagugcuuacucaguugguucccgcugagugauuggagucaggagaugggaggguuguaccugugacugcugaguauugccugcagaaugggcucagaacgcauaguucaggaauuucaggagaagacgaugguccuuaauccaaggcuggggguuguuugcacgcugcugugcugcccuguggugcaccccugccuggagcuccaacagacaaguugacuucuggugacuguuucuccuucacuucuuagucccccuccuccagcuuuuugacauucaccacauacauauauuauugucauaugaucuguucuucuauaucaguucuucauuuucuacuuuaauuccuccuuaacuauuguacugauuuuugauugacuuacccagugccuuuucauggaccucucuucccacccccaaaauugguuaucuuugggaccuugaaauaaauuugucucuaaauuaugaauaauugguguacuuaacuaacuuaugcauaauaugaauuuuauugugacuuaccugucauacucuaauagccucagcuucuauuuauugcuaaaguuuguguuucuggcuguaaaauauuacuuauuucacauauaucaggggcuuuuuauaugauuuuuuucuucucuuuuugcucaccuggggaguuccuuccccuuuccauaaacuguggucccugcauggcugugccccaucccuccucaucuggcuuguccugcccacaucgcccugcaggguucuauggccuggaugagucugaccucgacaaggucuuccacuugcccaccaccacuuucaucgggggacaggaaucagcacuuccucugcgggagaucauccgucggcuggagguaagagcaguuucuggaaaaaucuaauggacuucuuaagaacuuguauuggcaggauggcuuugagacuaguuuuauuuuuuuucuuuguccuaucuuucuauuuuauuuuuucucugagacagaguuacugucacccaggcuagaaugcagugacacaguuuggcucacugcagccuugaccucccagucucaaaccauccucccaccccaaccucuuguaucugggacuacugguacacaccaccaugcccagcuaauuuuuuuuuaauuuuuuauuguagagaugagguguugcuguguuccucaggcuggucucaaaugccugggcucaagucauccuccuaccucggccucucgaagugcugggauuacaaacaugaaccugucugucuuuuuaaaaauuguaagggaaggaggacuuuuguggcuauuguugccauuuuauagauagaaaccagugguuuugugaucagccauagagaggggaaguaaauucugcuuucagaucccacuaggaguuuauuacagauggaaggagagucacuucaacccugagggacaggccucaagucagggguggcuucgugcacagcucagugucagggcugcugagugguggccacucuucuuuccucucucccucuguuccucucauccuuguguuuuguuucauuuuuuuccuucucucuggacucuguuaguacuaagccugccaggaaauucuuucauucacacacauuauagacaguggcuaagaguuguggcucugcuguuaggcuaccugugucuaguucuuccauccugggcaagucauagccucccucaguauaagggugacuucuaugcccauugcagaggggagaauggauuugaugagaggugcaugccaagaguuggcuauuacuguuacuuaaugcuguuccugguauucagagcuaaaggaucgagguuaaaauaaacugaggaaauacccuggaauggggacccucagaauugaguauauauaucagcugggguccugccuaucaugcagagucugaauccugacgucccuaacuaacccagguugaaccacacuggccaucagggcucucugaggcuguuccucucauggcuggacauuagaaccaccuggagagcuuacagaacugauauccaggccacagcccagguccccuaaaucagaagcccucuagcaccccagggauuaaugcuugcugccgcaagugaauuuuaauuuaaaacucucuugucaguguuuccaguuggcugcacaguggcuuaaaaagaucugaguguccaggccaggcacagugucucacgccuauagucccagcacuuugggaggccgagacagguggaucauaaggucgggaguucaagaccagccuggccaagaucgugaaacgccaucucuauuaaaaauacaaaaauuagcggggugugauggugggcuccuguaaucccagcuacaugggaggcugacgcagauaauugcuugaaccugggagcgggagguugcagugagcgaagaucgcgccacugcacuccagccugggcaacagagcaagacuccaucucaaaaacaaacaaaaaaaaacugaguguccagugcuggcauuuucuguaguuugugaugagcauccugaaguauugucagcaucucagcuuggagcugcuucaccgccugccuuccucacuuguugaggagaaagggguagaaaccagaacuaugugccagcaucagaagcuuguggccagugggauguauugggcaccaggggggagugauaaggauuaauccaagaagaaugaaccuuuggguccuuccugucaccuuuaucugcacccacaucaccacacugacuauaguuucuaguucugccuacuagccacauguuacuauugagcacuugaaauguacaaaauauuugaaugacuuuuuaaauguugaaaagauaauguuugauacaucgggucaaauaaaauaggaaaauuucaugugggucuacuagaaaaacaaauuacauauguggcuuacauaauguuucuguugaauguugcugaucugugaaguucuuguguugccuggaccccccacaaauggcaccccauauagcuucuccaaguggcccuacccccaaguuauuucacugcucauguguuccacccaguuccuucaguguauuuucuguuacaacagccaucuggugauaccagccugugcugagagcagacucagcacuaguaccuuuuaccucagaggaguccccuguggggagcccggcagcuuuuuuuuuuuuuuuuuuuuuuuuugagacagggucucacucugucacccaggcuggagggcaguggcacaaucauggcccacugcagccucaaccucugggauuaaccaaucccccuacuucagccuccugaguagcugggacuauaggagcacaccaccaugccuggcuaauuuuuguauuuuuuauagagaugagaucucaccacguugcccaggcugaucuugaacuccuggagucaagugauccucuugccuucgucucccaaaaugcugggauuacaggcaugagccacugcuccuggccccagcagcucauccuuaaacaugcucucacauuggaaagcucccauggagucacugucuccauagcacgucacagugucaccucucaggggccuguucaggaccuuccuucccagagagcauaggcauugaugucccuauggcuaacuuccuaucugaaucuugaaucccagguaauuucgauuucaucauaugaaggggguggagggccugaagcacauugaagggcugccucccuuucaguccaguugaugccagagccuuggaguuggcucuuguugucugagaugguuggaccuguacccaggagucuaaggcuguaugcgcuccuggccccagagcagccccaacuuagaagacuccauuuucacaacaguuuacagacauuugcauaaaguucucauugcccugccugauggugaugcuuuacuuacauuuaauguguguguauguuagauuggugauauaaucagacagaucuuaagcuauugaucacgugaugugguggucaauuuguaccuuuuucaaaaauuagaggaaauucaacuuauuggcuuccuaaaaauugucucauuagagggaaaaacaaagaaucagccccugaaucuugcugcccuuuucuccuggagacagggccaagaacaggaaaaacacagcaugaucuaguggcccgguaacuacaucuccaaguuaauuguuaaaguaaugcugauguuggagagauacugauuucuagaguuuuuaacccaauaguuucuucuguucaauaauggaaauucugccaccgucagguguaaaagggagagaggaaaggcaugggcagagccuggguagcacaguucugccagcucuguaauuggaaacagcaguagugaugaagggaagaguccuucccucacagcaccccucaccagugggucauuuggggucgugaugaugaagaagggacagauagccaguuacuggguuugcaacucaggcauggaccccauccaaagaggguagguccucuuugaagguucucauuaacagccacucuggggcuggccaugucuucuugaauggguuucugcagaaauguaguuucuucugcuggucaguaccuugggcacuauggauccccaagugucuguaaaguugagaugguacaguggacugauguugacucugaaauuagggauuagggggccaacuacacccucuucuuguauuuuuugugcaucuaauuuagaaguucauaguuuuaucuuagaugugauuagaaaauaugguuuguggggcugggcgugguggcucaagccuguaaucccagcacuuugggaggccaaggcgggcgaaucacgaggucaggagaucgagaccauccuagcuaacacagugaaaccccgucucuacuaaaaauagaagaaaauuagcugggcgugguggcgggcaccuguagucccaacuacucgggaggcugagccaggagaauggcaugaacccgggaggcagagcuugcaaugagccgagaucgugcuacugcacuccagccugggcaacagagcaagacuccaucucaaaaaaaaaaaaaaaaaagaaaagaaaaaaaagaaaauaugguuugggguugucuuaguccauuuuguauugcuauaaaguauaaaggaauaucugagguuggauaauuuauaaugaaaaagggguuauuuggcucacaaucuaauugggcaucugcauuuggugagggccucaggcugcuuccacuccuaguggaaggcagaggggagccugcuugugcagagaucacauggugggaggggaagcaagagagaguguggggaggugccaggcucuuuuuagcaaccagcucucucaagaacuaauagagcaagaacccacucaccucugagcaagggcauuaaucuauucaugagggauccacccucacaaacaaaacaucucccauguggccccacuuccaacauuggggaucaaauuucaucaggagguuugugggggaacaaacggguuaauaaaaauaucuuaaauagccgggcgcgguggcucacgccuguaauuccagcacuuugugaggccgaggcgggcggaucacgaggucaggagaucgagaccauccuggcuaacacggugaaaccccgucucuacuaaaaauacaacaaaaaaaauuagccgggcgugguggcaugcaccuauagucccagcuacucgggaggcugaggcaggagaaucgcuugaacccgggaggcggagguugcagugagcugggauugcaccacugcacuccagucugggcgacaaagcgagacugcgucucaaaaaaaaaaaaaaaaaaaaugccagacgcgguggcucacgccuguaaucccagcacuuugggaggcugaggcaggcggaucacgaggucaggagaucaagaccaucauggcuaacauggugaaacccugucuccacuaaaaauacaaaaaauuagccgggugugguggcgggcgccuguagucccagcuacuugggaggcugaggcaggagaauggugugaacccaggaggcagagcuugcagugagccgagauugugccacugcacuccagccugggugacagagcaagacuccaucucaaaaauaaauaaauuaauuaauuaauuaaaaaaaaaaccuuaaauacuagggucuuucccagcagcacuuucucuuuuaguuccuaggcaagauuuuucuucuguugacuuggauaauaacuagaguauugugguuggccauaauuuugaguuuaggcaaaguuugcuuuguuucauggucacggagcuuguguacagggauagcccacccuccucugcaaagaacagggcuggucucagauucagcacauccuuuaacugcucaugccagcuggucucauugucuguugugaaaaccaaguggggucauggaugagagcugcugagcaggaccuaacacucuaaguacucuggcagcaguggcugcuguaaaggcaguuagaggaggcuuugggggucuguaaagugucuguuggcccacauuagggccuaucuucuuuuuauuccaugcugacuugcaguuugcucucagacucucauucugguccuccagggcagcugugcaggucgaguuuugggccucugcaggaguaccaggaugagggcagcccgagagggauuucuuuuuguuuuuuguuuuuuuuuuuuuuuugagauggagucucacucuaucgcccaggcuggagugcaguggcaugaucuuggcucacugcaaccuccgccuccuggguucaagcgauucuccugcgucagccuccugaguggcugggauaacaggcacaugccaccauaccuggcuaauuuuuguauuuuuaguagagacgggguuucaccauauuggucaggcuggucucaaacuccugaccuugugaucugccugccucagccucccaaagugcugggauuacaggcgugagccaccgcgccuggccccgagauggacuucuaagagccuggugccuccucucgcuccuggcaccucuccucuuccugaauuccucccugccgagcucugcagaucuggaugcugcuuccucacccagcugugcagugugaacgugguacaggacaucuugaucugcucaggauccugacuuuugucuuaugggcaaucuugcuuccugaggcagaaggaucauuugagcccaggaguucaagaccagccuggguaacauagugagaccucaucucuccaaaaaauucaaaacaugaggcaagaagaucacuugagcucaagagguugaggcugcaacgggcucugauagcgcuacugcacucccgccucgaugacagagacccugccucaaaaaaauaaauaaauaaauaaauaauuuuuaaaaccugcaaaucuuuaacagccauugagccuaugacacccuaugggcauuuccugucaugggugcugguacaggucugaccuugaugacagccugucuucccuggggaaggacccaguuccacaacuguugcggucugugcuucuugccacaaagguaacagaguagaacugggguugucccuuggccugcccuuggaaggcuaggagguucucuguguacaagugacccaggucccugaaggaagcacuucaugacccuaugaagagggcuucugccuggcacccacuccaucccauccucagucacacuugauuggaguacauuucagaacaagccuccugcuuauccccuccuucuggcugaaugggcagucggcagucuucauucagccaggccugguuagaaauccccuugacuguguguuucuguauggaauagauggccuacugccagcauauugggguggaguucauguucaucaaugaccuggagcagugccaguggauccggcagaaguuugagaccccugggaucaugcaguucacaaaugaggagaaacggacccugcuggccaggcuugugcgguccaccagguaugggucuggcccugggccauggggcagacauucccagggaagcagugacccugucuguguugaucgggccugugugcagccuguuggccgaggugagaggggguuuggggugguacaggcaaagcuccaucugcacaugugugaagagacaccagacaaguagagucagccuucagagcaaccuccgccuccugaauucaagugauucucuugccucagccuccugaguagcagggauuacagaggcacaccaccacggcuggcuaauuuuuauauuuuuaguagagaugagguuucaccguguuggccaggcuggucucgaacuccugaccucagcugaucugcccaccucggccucccaaggugcugggauuacaggugugagccuccaugccuggccagaauccccucuuuuuggucaggaagagugacauugcccuucaagguggcuugguucccuguccagguuugaggaguuccuacagcggaagugguccucugagaagcgcuuuggucuagaaggcugcgagguacugaucccugcccucaagaccaucauugacaagucuagugagaauggcguggacuacgugaucaugggcaugccacacagguacagccaagggcgcgcccaaccugguuucucaccaucccugugggcuguguaggaggcaccagguaaaggcacugagagagcagcuguuuccuccuugagugccaguugugagucugggcucaucugguaccugaggguguauugcuuugcaggggauucucacauugccugccucuggaggacugcaaagucauggucaccuccaaagccacauguaguuucagacuggcauuuggccuuacagugcaucuuuaugaaaauuaaacccaaguucccuuguuggggucuaaccuggagggaaggcugcuuccugacauugaaggggaggccaagacugugaaaauagggaagguguggggagggagaaggguaaggaagccucaggcccauggcauugcugcaucuucuaucuuucugcugcccacuguggccuugauugcccagcacggagaggcucgguucccacauuagcuccaguuuacagcuauccuugggcugcaaaccgaggaggugccguguccuggggggagggggagggggggauuguaacacccucaucugccaucuggaaaccaugaccucaggcucugcucacccuacucgcccauacguuccagagggcggcugaacgugcuugcaaaugucaucaggaaggagcuggaacagaucuucugucaauucgauucaaagcuggaggcagcugaugaggugaggcaccugcauagagacacauccagcauagccccaacuuacacaagaccccuggcuccacuucuuucuuagaaugacuuacgggggguugguucuucuguaccauuugugauuugccuuccuuguugggagaauuuuaguguugggacaaagguggccaguggcccaccuccuggucagagguccagcagccccacucugagugcagggguguguccccucuggcugagggacguucuccuuaugcccuggaugggaaugauccugggaaaaggccuccauauccuucugcguuggguuccugggaguagaaaucccauauaaggcugggcaugguggcucacauccguaaccccaacacuuugggaggcugaggcaggcggaucacgugaggucgagaguuugagaccagccugaccaacauggagaaaccccaucucuacuaaaaauacaaaauuagccgggcgugguggcgcaugccuguaaucccagcuacucgggaggcugaggcaggagaaucgcuugaacccagaaaguggagguugcagugagccgagaucgcgccauugcacuccaaccugggcaacaagagcgaaacuccaucucaaaaaaaaaaaaaaaauucccguauaaaagggcucuuuuggagacugagcaucuccuuggccagggugcaaauucacuguuuaccccaucagggcuccggagaugugaaguaccaccugggcauguaucaccgcaggaucaaucgugucaccgacaggaacauuaccuuguccuugguggccaacccuucccaccuugaggccgcugaccccguggugaugggcaagaccaaagccgaacaguuuuacuguggcgacacugaagggaaaaagguaaggcccagagagaggcgugcaaggcagaucgucaaggccccauguuccagcauggaguuccgcucaccaacauaacccagagcccugggugcaucuagacuuuaaaaaaauauuuaaagucggccgggcgcagugucucacgccuguaaucccagcacuuugggaggccgaggugggcagaucaccugaguucgggaguuggagaccagccugaccaacauggagaaacuccaucucuacuaaaaauacaaaauuagcugggcgugguggcgcgcgccuguaaucccagcuacucaggaggcugaggcaggagaaucgcuugaacccgggagguggagguugcagugagccgagauuacgccauugcacuccagccugggccaacaagagcgaaacucugucucaaagaaaaaaauaaauaaauaaaaaauauauguauaugua

SEQ ID NO: 192213 - RNA, 16338 nt, Homo sapiens
gggcggaaccacuguucgcgcugccguguuuccgggcggggacacucagggcgcgacgcuuuucuguuacccacagaggcccgccgcggcugcgccauccgcggccaugaaguuucgggccaagaucguggacggggccugucugaaccacuucacacgugagcagggaggccggagaggagcgagggaggaacggaaggaagcagugagcgcgcgguggggaccgcgcaggaggaucagaacggggaugggcgccggaaggggccgcgggaggauggggccgggaugggggugcugguguaggccgcgggaggguggggccgggagggcgcggggcgggucggagggcacuuguggggaugaaggcggcuuucaagggacguuucugaaacuugauuccgaucacguggcuuuaaaaaaaagcggccacugcucccauagacggcuuuaucaggcauugacauaccuucaaggccccauucgucccuccacccugacagugccuaaccuugcauuuaacuguguauugcaguaccuaguagucaauaaauccauguugaaugaaugaaugacugguaggugccuguuuucuuauuugaacacugaugaugugugcuguacaucuccccuaguuuguugggagaauugcgugacaucagggguauuaaaguacuuuccagugugauaccaacguuaagugguuauuuuuccaccgagaaguugaugaacaagaaauucugcaaaauaaguuggucucuaggauacauaaugugcauuuuaguaauuccuuauuuuaaccccugcuuuaggaaucaguaacaugauagccaagcuugccaaaaccugcacccuccgcaucagcccugauaagcuuaacuucauccuuugugacaagcuggcuaauggaggagugagcauguggugugagcuggaacaggugagcaaaagcuucugagaggccugcacacucugcagauugucacuggaaagaucacauauacccucccucaucccucauuuuuuuucccuuaggagaacuucuucaacgaauuucaaauggagggugucucugcagaaaacaaugagauuuauuuagagcuaacaucggaaaacuuaucucgagccuugaagacugcccagaaugccagggcuuugaaaaucaaacugacuaauaaacacuuucccugccucacggucuccguggagcuggugaguaggagagucaggguuucuaacacagaagucuuggccucgaaggaauagacauaguuagccuagccuuuuuaacaauaaauacuguugaaagcuguuugguuuauuuaaauuuaaagaucugguccauaacuauauuuugcauuagagucaguuccuccucauuuuaaaauuguguuguuaucauaugcauucagcuagaaugcugcuuuuuccaagccgugaaacuuccagccucucuguuucuuguagugguauugucaccuugucuagaaaucaugguuucucuauccauuuucaccuuugacauguuuucuccccacucccacccugccucaucugcuauaauaaccuuuaaauggccccucguucuucaguacacguauguuuuauaugcuacugccagaugaauuuagugcacagcuguccuccaaacacacaaauacacaaacucaugcgcauacauacaauccagaguugcucuuccuacucauagaaugagguucguauuuccuuuuuuuugagacggagucucucuaucacccaggcuggagugcaguggcgcgaucucggcucacugcaaccuccaucucccggguucaagcgauucucaugccucagccuccugaguagcuggaauuacaggcacccaccaccacacccagcuaauuuuuguauuuuuuuaguagagucgggguaucaccauauuggccaggcuggucucgaacuccugacgucaagugauccaccuaccucggccucccaaagugcugcgauuguaggcaugagccacggcgcccagcccagcuuuucuucauaacucucaacucuuugcagucaggcaguucucagagcuaauuagggcauuucaugucacaguauaaguuugguauguuuuuucuauugcuuaaggaaaagcaagauaguaacguauaauacuuuuuguccaaaagugcaagauauuuuggucugugagucucauaggagccccuagaaauaaauauaguuugccuuuuaacuguuagaaacugcagcacucugaguguccuaugcccaaagaauggccuucucuugguugcgucaacauagcaggcuugcuucuuucugccucacggcuuuacaugugcuguuuccccagccugaaacccuguccccuuguucuugucuucccauggcugcugcuucuccugcuuuuggugguaucugaaaugucaccuccucagucuaaggaaacucccccacacucacccuggucucuguggagugcuuucucacggcuauaaugagcauuucauacaguuucauuuguuugcauuuuuauugaucuguuuguuccacuggaacacuaaggaccuuuuugucuuaucaccacacuucccaguuccuggaaguacccagagucuguuccauaaauauuggcaccaucaauauuggucgaauggcuuuugagugaauaaacugacagcauuccacuuagauuugguauuucaacuuuuuugucccgggucuucggguuuguuuuguuguugcuuaauauuaacaacauaaaaauauuuuuaaauucuuuucuuggcaguuaucuaugucaagcaguagccgcauugugacccaugacauccccauaaaggugauuccuaggaaauuguggaaggacuuacaagaaccgguggucccagauccugauguaggugaugccugcaguccugcuguacaccccacauuaaauggcaugacuugaauucucuaguuuuaguuguagucuugcaguauauuuuauuuuuaaaggauacuuaacgaaaacauuagauuauuugccuuuuguuauuuacauaaagcaucuuaaaaauguugcauaugauagaaaugucaugccauccuauauguagaaaaugucucgcucaguaacaucacuuaaaacacaaaugauacuuuuggaggacaauuaguauuuauuaguauucuuggccuuagacaccaauuuggguuucacaggacuugaucuuuuccucagccggucaggagcgauaucuggaugugcacgaaagccaagaagagaagaauuucauggcuuagggcuaacaugggguaacggucaugccgaugguuaacccuagagcuccugaaaguaaagaugaugccaaagggcccauuuccucuugcucacaauuuguuuaagaagaaaguacagaaauaugcuggguaaaauaauuacuugacuuuuacuagauggcaccuacacugauuuugaaaaagccuguguuuuauagagcacucuugguaacagucucagaugugaugcagugacugucugccauguuuuuguacagagcauggaaaaggcccuugaaucauagguguaaaugucccuuagaggagggccuccugcugauugccugaguuauauucccccuggaccaauauaggggcaucucagcugaaguacccuauuccuucuugagccaaaagaaugcccacagggacaugguugcugagguaaccagaggcaggcauuccauucuuuaauuuugcuugagcauccuugaguuagugaaauagaauugguuuucuuuuuauauuuuuaaaagaacuuuauucagaaaauuguaaaauaguaucccauaguuuuugagcaugcauguguucuagaguuaguuauggggcccuugucauuacuagaguauauuaauauuuuuaauacuugugcuuuuuucucauugguuuuguagguuaguauuuauuuaccagucuugaagacuaugaagaguguuguggaaaaaaugaaaaacaucagcaaucaccuuguaagucacaacuucuuuagaaaagaacucugaaguauuuggugggacggcguggguucuccagcucacccugcagcaguccaugcaggugggcaccuccuaaccgaguucccacuuaugaggaccuggccuggugcugagaaccugcagauugcuaguuggauuuagaaaccuauuccaauacuuuucaacucuaauucuuugaggaaagcuuuuauauuugccuuuaaucugccuguuuuuccucuuauauuuuguaugaaacauuguaucuuucuuuuuuuuuuuuuuuuuugagacagagucucacucugucgcccaggcuggagugcaauggcgccaucucaccucacuguaagcuccgccucccggguucaugccauucucccaccucagccucccgaguagcugggacuacaggcgccugccaccaugccuggcuaauuuuuuguuucguauuuuuaguacagacgggguuucaccguguuagccaggauggucucgaucuccugaccucgugguccgcccgccuaggccucccaaaguacugggauuacaggcgugagccaccgcgcccggcuggaacauuguaucuuuuaccugcuaacgugcccguauuuuucugugagucacugauaugacugacagugaguuuggaguuuccugucugcgugccaagugucuuucagugagccagggacaaagauaugccacaccauagcagccuuuauuccaagcacaccucacaccaagcuagggggcacuuuuauauuucuguuuauuuucuguuuauuuuguggaagucuccuauggccacauggcucgaaauguuacagugugugacaguggugggaaauguguagguuauccucauucauaccugggguuauugugaauucuuccuucacucacugccccucccuccucccccugcucccuccuauccugcuccaaaaaacacccuugguuaugucccugaaucuucuaaaaaccacuguccaccugaugaagcauaaacuuuugaucuugacaguguaccaggccaccuuuauagccacaucucuguuguauugccacacccucccugcagaacgaggcuggguucugguauucccccacaaugccucuucuuuuuuguucaguuucuuugccauuugacacauggcuucuucucuccaucucccuggaaggcacuuagccauucucaugcuucaucacagaccuuuccccaccaccccucuggaagcuccuccauggagcugagcuguccaguguacaugguaaaucaccugcuaagaucucugaaggucucgugaaccaccagcuucuugauaaaggaaaccccaucuuaaucaucuuugugucccagcugcccagugugggauugccacucaguaggcagcaauaaguguugcauggaucuggaacaaaauuuagcuucaagaggucuuugaaaucacaaaaguauuuugaagccuagaaaauguacauuugacuguuuuuuucuagaguucugcacacuaagagcaaugcugucauuggaccuggguaacucaaagcuuuuccuucauaacuuaaucuauaaaaucuguuuuccaugaagcagugugcacugugcugacguuggugucaccugugacugcagugaugcugauccaguugucaggcuggcuucaucuggggauacccuggggacuuccagagaaauucagagaggcccaggagagaaaagacagggcuguuaauugaaggauggcauuuguuuguucuuucuguucaaugaaaaugagucagcaagguagagagguagaaggguagcuuagaaucaucagagguguuuuguuuucucuuuuuuggaguuuaaaaaaacauagaaauauuguggagaggcuacuacgaucuggaauuacuaaauggaaaguuaucaaguuacuguagcaaaguacauaaugaggucuuccuggguauccagaauucuguaucugaauauuacaggcaguagaauuaaggaaaauggguagacuuaacacacuaaaaaugcccaccuucccauuagagaugcccaguuacuuccuuucauuaaaugcgaggugugacugaugggguggguuguaugugacucaugcaggagcagaaaaagaagcaagaacuggagggaauugacaucauguucuaagacauugcuucuaaguucuaccaugcgugugaauccccuggaaucugguuaaagugcagguucugauuugggaggucugagcuggagccugaggcucuguuucugaccagcuccugggagaugucgaugcugccugucuucagaccacaucauguagcaguacuuugugaugugugccuguauuacuccguuuucacgcugcuaaaaagauauuaccugagaccagguaauuuauaaacaaaagagguuuaauugacucacaguccuguauagcugaggaggccucaggaaacuuacagucaugacagaaggcaaaggggaagcaaggcacgucuuaacauggcagcuggagagagaagaacacaggaaaaacugccauuuuuaaaaccaucagaucucaugagaacucccucacuaucaagagaacagcaugggaaaagcugcccccaugauccagucaccuaccaccaggccccuucucagcacuuggggauuacaauucgagaugagauuugggugggguugcugagccaaaacaaaccacaucauugccauacuauauuguacuucaaauguuaucugagaaacggcucugcagggucaccuaaugauagaaaccagagucuauguuuaggagucaugauauggaagaggggagucauuggagccacauaccuggguucagcuccaggcugcgcugugcagugaguacccuagugcuggauacuaccccaaauggggauaacagugcagcuaugacaggggcuucgucaguuuuuaaaaauuuagagauaauuuuuacuaggugcccaguauagucagcauucuauaaacaauaguugacuauuuuaaggaaaucauugaaagaucuuacccugauacuuaagaaaucaaguguguuguuguguauaauaucccaaauaacugaaucuuaaaauagacaugagugaccaguguucagagaauuaguuguuuguuaguuucuucaguaaguauugacuuaaggccaccaugugcuaggcaccagguguuaaugguuaggagggaguuggaaucuaauguucuguuacugagauucuuaggaauuugaagaaaacacaagagaacauuuaagccugaagugcaucuaggcccauugcaaguugcauuuuuaaguaaguauuuauuuauuuauaucuaaaaccauugcuuuucaaaacaaugggaauuuacagaucuugggugugugguuguuuggaacaaaugagcuaaggucauguguuagccuuagccccacuaagcagucuagcauauucacaaagauuguuuuauauauuuuauuucagucaacuauuguuccagauuguaggaaaacggguuaggaaauauaacaauauauuuuuuuggauuaaugaaagaaaaggguugaaaaugaguauuucucauucaaaguagauuauacaacagguaaguuuggggcacuauuuuucuauuaaugugaaaagcucagaaauaagagcucacccaaauuagaaaaacuuuguuucuggaaugaaaacuauucagaguucaccaauuuuaaggaauaagaacaaggaacacuaaauuguauucaguaaacaugaacacugauacagagccgugcagacagagugccuucucuguuuucuuucugugacacugugaggauggaauggcccuaaauaagaccaguugcuagguggcacuuuucuaguacuagauggcaaaaugcuauccagcagacuacacacuggcuuuccagagaccuccuaggcuuuaacauugggcagauaucaacaucaaaaagagaaauaacagguacugguucuuuuaggaggaaauuucauuguaggugcgggaguggaccaggauagguuagcaaaaccucaaaccauacuguggcauaugcuucacuucuagguuccauccaauuaaaagaacugauugguuguugggguggguagaggagcuucaaaggaaaggagucccuugugaccuguggagacaguccccgggcagcaagagcaggaguagaagaggggugcccgaugguauaugaggggauggcagaagucugguagccugggcguguggaguuuggcucagccauccucaguccugguaacccaacagcagccccagacccuucuggauuuggacauuucauuuuccaacaugugaguuuauuuucuaaauaaauggcuauguucucaugagauucugaaggccuuauagucauauuaaauguguguuuaugacaaaugguugauuuauauuuuauaaaaauaagacacugauuuccacauucuucucauuuucccccuuccuguuuuguaaugguuauauuaugucuacaucaucagagcauaaaauuuuauuacuacacguuauucuguccucuucauuccuguuguuuaguuuugguucuaaaggucaaaauaaggcucacacuguuuaugcuguaacuucuccaaugauuuuuuugguuauuaaaagccuauucucuagcauaucacucaagaaggacucacaggaauaggauuucauugguuaucauguguuuauaaugucaguuuggcucacugcacugcauugucugcugguguauauuauugcuaucaaaaagaaugacuccauucugauuuuguuucacagcuuggauuuauucauuugaaaguggggacuaaauacccuggggauuuuucccauuuuucuuucaauccaauugucuugaccauccggggucaguuuucccaggugugugguguguccuuucaauaugugggccgaacucuucauucacuucaggaaaguuuugagcuguaguugauagcauuucuuuuccagugcuuuguuuuucuucugggacucagagggcuuggaucuucuccacugucuuuauuauuuucugucagauccuuuuaacucuuuguuucuguuugguaaauuuuaucuuucuccuuuccaucccaguuucucuuacuauucucucuguggugccuauuugcucuagucuuccuucuaaacuaguuucuguuucugaaauuuuuccuuauguuucuaauuacuuccugugcugucagcuguguuuuaugugcgugcucucuggucaucucaugucugagcuucccuaauucugauuuauguuguugugucauagcgucuauuauuguucauuucucuuuuuuuuuuuuuuuuuuuuuugagacagagucucgcucuuucacccaggcuggagugcaguggcgcaaucucggcucacugcaaguuccgccucccggguucaugccauucuccugccucagccucccgaguagcugggacuacaggcgcccgccaccacgcccggcuaauuuuuuguauuuuuaguagagacgggguuucaccguguuagccaggauggucuugaucuccugaccucgugauccgcccgccucggccucccaaagugcugggauuacaagcgagagccaccgcgcccggcugguuuuucugguucuuuuaggaggaaguuucauuguaggagugaaaguggaccaaaauaguuuucuaauuuaaugacucuagaauucucuauucuuuguaaccacaaaauauuaaaacaugcauccucaccacauccccaggacuuucugagaucugucccucuuuuuccuucauuuaaaguuucauucccuuuuuuuugcccaaggugcccauucugcuuaguugaggcucuuacuucccgugguuccuucucagugcaggacucucuccugcugugagggaguucucaucagcuccacccagcccucccuagagcccugcccuugugcugcuguagucuccuggcaaguccucucggaguuccaccuguuuucacaucuucacugaguucuucauuccgggaggcaggcagggggacuuccccuuugagauuuuugggagauuucugaguucuuggcucuugggccuuaucuucucacuuucccugauagcacgggggucucagugugcucugagguguuuugagguuuuguaggguacuuugucaucugguugugugaaagcuguugcccauggaguuuuuuuccuuuuggcuuccuuuucuaagacuauguaaaauacucaauuugcagguuauugaagcaaaccuagauggagaauugaauuugaaaauagaaacugaauuaguauguguuacaacucauuuuaaagaucuuggaaauccuccauuagguaaguuuucuaguggguuauauuuugcuuuggauaaguuaauuguuucagauaaccuaccuguugaggucucuucauguaaaaagguugaaauucaguugacuuuguuucaugcuugggugaagaacaaaggaauugagacuggacuauguaucccugugguguaguggggcaguuagccaccagggggagaagcugugccaccaaguagcugacagaucugugcagggucuccauccucuguagaauucggaucaaguuacauaaccuccaagaucccuuccagcuauucaauuccuguccuacuccuaaagauuucuauuucucaccuggcauggauucagaaagguagauacauuuguucuuauauucuccuccuucaguuacuuccauauguaugaaauuaguguagcagaugcaaaacuguuucacuugaucacauuucuuaucucauacaagguaauaagggacgauagagucaguucagcaaguggggagagaggggacgguuggacaguuuggugaguuauaagccaagaggggguuagaaucauggcuggaaaguggcagcugcacaguagcaggggcugccugagcaggaaagcagguaaaggaccaggggagaaacaccuggggaugaugagaaaaucauuuuaugauacauaagugugccagaaccaauaaaaucggcccuagucacauuuaaguuacuacgagucugcuugaauauaaacacagauuuuagcauagaguuggaaggaauuuuuacuuucuaguuaagagcauccugcuccagcagagugaaauccauacgguuaugccuuugauaauauuguguaaagcgauucauucugaugucacucauuuuguuucuuuuaauaaacauaaggugggacuuaucuuugguacuuucucagagguagaaaggauguuuucuuuuuuuuuuuaauuccacuccagaaugacaggccuuguauuaguuaauguauauauuuucacucuuaaaauacauaguaaguacaaauaaauaaaauuuucuuugaccugaagagggagauugaguuauauuucaaguccccuguaaauaaagaugccuuggaaauuaucauaguauuuuaaauaguuaggaccuaaugcuuaaugaaugacaacauuuacaaguugcaauauuucuucaggaugcuaaaaucagugcuaaagugaaucauuuauuuaaguaaaaugcauugaguaucuccagguuuccuguuacgugggaagauguuguauuuaaaugcauuccuaucauuuuagccucugaaagcacccaugaggacagaaacguggaacacauggcugaagugcacauagauauuaggaagcuccuacaguuucuugcuggacaacaaguaaaucccacaaaggccuuaugcagugagugugcuucucuguuuuguuuuucauauucuuucauauucuaaauacugcagucaacucuagucuaacagauugcauauagucucauaaauccaaaaaaaaaaaaaaaagcucaauuauguggacuuuaacuuccuagaacagugggguuuuuuaaauuuuccuagauucagaaguaccuaagguggcagcagagaaacaaccccugggcacucuguuagggccugaaaccugcagccacacugguugguagguggguugugugcugccucaguuggccagcacaccuggagaugccaucgggagaaugggugcagaucaucccaccuucuccauggucaucuaauuugaccugcucagagugccagacacgguuuggcuuggauuuaaguuuucccuugugaugucuuguuuccuuucuguggcuaugcuggccugcauucgcugccccauaucugucccuuggcugcugguuguuaacaguugccucuugauucuggcugggccccaucuugugaggucacacaccugcuccagcacucuucaucuacugaccacacaugagaaaggcauuaccugccaagagcuuuucaaggcauuuuugucaccuuacuacugaaaucacagcaaccuaaaagcgacugcauccuggauuugaaguuccacguuuuguagcauagcucccaggcugagcugagagggagguugagccaacacugcaccucauccccuucagaucugcagugugcuguagagaaggaacagaagauucuagguggcaaugucaaggaccagcccuuuugaaugagagacaugaagagaaucagaagagaccaugggaggggcaauggguguuugggaauuggggaaggugucacacaguuggagugaugggcacagaaggagauaucgccagagaagcagcucugaggguagagauggagaagcuagacuaggccagaucauggggaguuuuggggugagguaccugugcugcauuuuaaggaacuuugacauggacgaugucauauuucuagggcugagcauagugggagcuguguggcagugcaggguccuuaaaggugcuucugagaaccucgaugugcauggagaucgccugaaggucauguaaagggacuccuuauucauaguuugggcugggccucauggcugcacuucucccaagcuccuguacaaugcccagacccuugguccugacaagcacagugugaauggugagagagugaaauaccccuccugucugcagaguguggaaacacaggguguggggggccccugcgcugcacaacaucagucuuugaacuugguauuuuggggacuuucugaauccaaggcuguugaggaacauggaagaguucuuaucaaaggugguugacuaagccaagugucuucccaacauucacuuuggugucuccacguguagcagagaaaggaagaccagcaaauugugauguagcaaaaauuuuuuuuaaaacaccguggguugaacuucucauaccuucuuaacuucccaaagccccuuuucugucucuguuagucuccuucaggugucggcucaauuguccccuccucuagcuagguccugccacccucagucucugccucuccugugcccuugcaccaccucuccuaaagaauguuugucuccugcuuguccuuucugguccuuuccccaaccucccaucuccugggauuggccucucugcagccugcucacacaugguuucuugucacucacucauaucugcuggagagcuuuccucggcugcugugcugcagcuccccgagcucucggugguugucacacugugugcuccugcccacccucaugugcucuuuacuucccugcuugguugcaugccugaugccuuggauuuuagccaucacccauggcccucacgggauuggcaggaccguugagaugcagggauccaucccauguagcagugugugacacagccugccccagguguugggggauccuggcucuuggcucuucucagcacaguuccuccacucacuggugaggagcugcucuucgcugcagaaggaugcucaugugggugaaugugguuugccaggaagccagccugcuggguguuuugccaagggcuugggccgcuucacuuuuccucuccucgcacagggagccgccagugcuggggccgugauguagccucagcuguggcagugagagugagagacuguggucucugcagcugccucagggaagacagaugccuaaaacaggaggugcaggcugggaaggcuguucugaaaaaguagagaucaaaaugugugugcugcacuaggucucuaaaaucauggcuuuucucuucccagauauugugaauaacaagauggugcauuuugaucugcuucaugaagacgugucccuucaguauuucaucccugcgcuguccuagcacccugucgcuggaguuggcaugcagagacuuugucaggaugggagaggccgcagguguuguguucugaucacuggucugugcccucacagcaccgcacaucgacacacuguacuuauuugucccucucuaacauuuuaacuaaaaguugauucaacaacacacaguuggauaaacauaucacuucauguugcucaugucuguuuugcuuuguuuuuaagacacugaaaagaaaagcuagaauuuauuuauucagacuuuaaagaacaauuucucauugauguugugaaaaucgucauguauuuagacuugguguaguagccagaauucguaaagcuguugccugggagcuugguacuuucccuccaggcagaggcucuagcucagcacggccuguagcgcacagucagucuugcauuucaguguguucaccccgcugcuccugccccuuggagcccagugacagaaagaacagccucugucaccccgccgccacugccuugguuacucagagcacuguggggugucacagcugcagcauuuggagucucucucuugcugaggacucaagcccaccugaguccacuccccucuugaugccuagagagcuggcccagccaacacagcucuuagcugggagcuccuucugccauuccaacuaguuucuuccuggggccaguuuuggguuuagguuguaauuccuuauauuucuuucuuccacaguguaucggaucugucguucuggaaagaagacccuucuauuuagaguagaaacaaacgaaacuucuaagguaucaucuguguuaagugaugagaccauauuucuuugauguuucugaacaucaaagcugauucaguacugguagaugugcucauucucccugaaacauacccaucauauuuccuauuauaauuacaucucauuguccuguggagguggacaugauaaacauuaucuuuuguuuucuuguuuuguuuuguuugagacggucucauucugucacccagacuggagugcagugccacaaucauggcucaccgcauugaccuccuuggcucaaggcauccucccaccucagcuuccugacuagcugggacuacuggugugcaccaccacacccagcuaauuuucaauuuuucauagagacagggucucacuguguuguccaggcuggucuugaacuccugggcucaagccacccgcccaccugggccucccaaagugcugggauuacaggcaucagccaucacacccauccauaaacauuauauuaaugucacauuacaaaacugagaccuaaguugcuuaggauaaaaugaaauuggaagacuagcuaacaugaaaauuuauauuuuggcuuuuucauguuuuuugauaaaaccaguguauuugaaugauucuuuugauguuuaguaaugguuuuuuguuuguuuuuugguuuuuuuuuuugagacggagucucacucugucgccagucuggagugcuaguggcgcgaucuuggcuuacugcagccuccacuucccaaguucaagcgauucuccugccucagccucccgaguagcugggacuacaggcgcaugccaccacgcccggcuaauuuuuguauuuuuaguagagacggaguuucacuguguuggccaggauggucucgaucucgaccucgugaucacccaccuuggccucucaaagugcugggauuacaggcgugagccaccacgccuggccuauguuuaauaauguugaaauaggauggaauauuuuguuaaauuaacauuuuaaaauuagaagacaccguuuuaauuuuuaaacccuuccuccucucauuguaacgaaauuaauuccagcugcagugagaaaacuuaaaaaucaugauacaaaaugaaacaauaucugaaaguaguuuuauaaaacugaaauugcuguuaaagagaauguguuagugacuuaaccauuugcucuaugugauguuuauuaucaaauacauauaauuuugaagauuuuaaugaauggcuuaagauuuuaucuuuguguagaauguggcuaaagaaaccuuaguugagauucaa

SEQ ID NO: 192214 - RNA, 6257 nt, Homo sapiens
acggcgcgaguccgagggcgacagcagcgcgcaggcgcacgucaguccccgcgcuuuucggaggcugccagcgucccacaccagccgcagguaggaugcggugacgggaggcggggcaggggcgcugcugaccccuguggagcaucaggguuggggcguaggggagaggcgggcgugugccucuggaaugcugggggucgcggggcggugacuucgcgggaggccgugggaggcgggagccaggcaguggcugugcccuuuugcuucugucuuagcgggaggguggcugacccgcuagcccagaaccagacucauccaggauuaggaagcuggggcccggcguggacggcaggcucggggccaggucugcgggcggcuuccuuuggcagagccuguccgggggcggggccgcuuaccgcaggcauuuacugggcccagcggggcucugggcgcccacagcgggggucagucaguuccccugugacccaggcaagcucuuaaucucugugaugagaaagaagggcucauaccuuucaggggucaucgugaggaaucagaagaagcaguauuuuauagaguauuuucuaagugcugaguccucugucuagugcuuugcagaauuaaaauaccuugucagcucagugauguugcugcgcuucuuuuauaggugaaaaccggcagaaagacauuaagagauuuuccugcagucacugcuggcagaugauagagccaggauuugaaagcaggcagccuggcuccagacccugugcucuuaacucccguuuugcaucaagaacagaauccuaugaaaggcuugcacagugcuugguacugaguaggcacuccgucaguauuuuaguagcuauuauuccaaaggacacuguauucuagguacuaagacaaugugaauggaauggaaaacaauuccucccugcagaagccaacugucuaggaagacagauaaugacauuauuaaaauaaucagaacauuggcaaaauaaagaagauugaaaugcaguucauaugacagugcuaauuaaucauacuuuuuagaucuaggaaaggccauaaagguuaaauugacuuggaaaugguaaacaagacaaugguugugucacugaucggugauggccaguuuuugguuauccuuauuugccauuuaaaugauugaauugaaaggaagaaguaagacuuggaagaugaauauugaaggaaaggugaagauggaaaagagaaggggguuuauucugagaacagugacuagaacucugagguaugguagaaauuucaggauaacagaugauaaaggggaaugaagccauggagaggaagagaaugauaauauuaauugugaaaguuugugucaaguguuuucugagucaccuuucuuucaguuucucauuucuaguauuguauaaaugaguuuaacaucaaaaugguauagugaaaaaaaggaugaacugcuugacagaagaggucagaucuaguuuugacucuagcuuauuuagcuuuacagcuuuaaauaaauuacagugucuuuaaagcucuggaucuuaaguuuucuaauuguuuuuuaaacaaagauuugugaacaccuacuuacaaugugacaaaugucuuuguaaggcauuaugggagauaaaagcugcauuaaaccuggcuguuguacuuacaaguaauuuggaaggcaaaauuucaaauacuugaaccuaaaguaggguuucuugguuuucauuuaauugaaauacuguuaggaaacaaaaauuuuucauaaauuuuucuuguggauauguaaguaaauucuauauaucuagcaauaugauacaucuauaguucuguuuaaagguaacaaugugaggaagcuuaugcgaauaacuugacagaagaaaucuaaaguaaaagcauuuuccuaguaggcuagcuuguucucuuauuucauuuauuguaacaguuucacuuuuuaauaauuaugugaaauuaggaaacagauauucuagggcauucuguuuagggugaugaacuuauucaugaauguuauuaaaaccauuuaaauaugccauaguuuaaauuugugauccaugcuguucaaucugugaccuaggauagcagcaucaaggagcauuguguacaugcagaagugcacaguaccuggagugaaacugcuuguguucgauuucugauaccauucauaacuggcugugugaucucaaguaaguucuuuaagucucucagccucgguuuguacauuugugugauaaggauaaugauaguuuucagauuauuuucauagucauugcuugauuugauucuuccaaugguuccucucacuuugcagauaagaaaacugaagaaccagcugggcgcgguagcucacgccuguaaucccagcacuuugggaggcugaggcggguggauuaccugaggucaggaguucaagaccagccugacuaacauggcgaaaccccaucucuacuaaaaauauaaaaauuauccaggggugguggcaggugccuguaaucccagcuacuugggaagcuggggcaggagaagcacuugaacccgcgagguggagguugcagugagcugagagcgccacugcccuccagcagccugggugacagagcgagacacugucucaaaaaaaaauaauaauaaaauaaaaauaaaccaucagugauaguaaaaagcucacuuaagcucauucaccuaguuuuauagaucagacuuaaaccucuuguuuauuuuguuuugcuuuauguaucuauaguuccauuguuuuuaaaauuuaaaauuaauuuuaaaccuuaugaaugcuuucccuacagauaaaauuauguaacuagaacaauuuaacucauauaaauuauuauuuaaucaaguccuuaauuuugaagacuucauauugauaugucuugaauacuugaaaucuauaguuaacuagauauuucucuuauaaccuguccuuauaaaucuacauuauaaauaaaaaguccagugucccuuccuucagauuagcagaaguuucaaaauuacauuuaaaguauuuucuuuguuuuccuucauacugauuuucauuuuuauuguuuguuauagaaccucuaaaaugcagaccuccagcucuagaucugugcaccugagugaauggcagaagaauuacuucgcaauuacaucuggcauauguaccggaccgaaggcagaugcauaccgugcacagauauuacgcauucaguaugcaugggcaaacucugagauuucccaggucugugcuaccaaacuguucaaaaaauaugcagagaaauauucugcaauuauugauucugacaauguugaaucuggguugaauaauuaugcagaaaacauuuuaacuuuggcaggaucucaacaaacagauagugacaaguggcagucuggauugucaauaaauaauguuuucaaaaugaguaguguacagaagaugaugcaagcuggcaaaaaauucaaagacucucuguuggaaccugcucuugcaucagugguaauccauaaggaggccacugucuuugaucuuccuaaauuuaguguuugugguaguucucaagagagugacucauuaccuaacucagcucaugaucgagaccggacccaagacuucccggagagcaaucguuugaaacuccuucagaaugcccagccaccuauggugacuaacacugcuaggacuuguccuacauucucagcaccuguaggugagucagcuacugcaaaauuccaugucacaccauuguuuggaaaugucaaaaaggaaaaucacagcucugcaaaagaaaacauaggacuuaauguguucuuaucuaaccagucuuguuuuccugcugccugugaaaauccacagaggaagucuuuuuaugguucuggcaccauugaugcacuuuccaauccaauacugaauaaggcuuguaguaaaacagaagauaauggcccaaaggaggauagcagccugccuacauuuaaaacugcaaaagaacaauuauggguagaucagcaaaaaaaguaccaccaaccucagcgugcaucagggucuucauauggugguguaaaaaagucucuaggagcuaguagaucccgagggauacuuggaaaguuuguuccuccuauacccaagcaagaugggggagagcagaauggaggaaugcaauguaagccuuauggggcaggaccuacagaaccagcacauccaguugaugagcgucugaagaacuuggagccaaagaugauugaacuuauuaugaaugagauuauggaucauggaccuccaguaaauugggaagauauugcaggaguagaauuugcuaaagccaccauaaaggaaauaguuguguggcccauguugaggccagacaucuuuacugguuuaaggggacccccuaaaggaauuuugcucuuugguccuccugggacugguaaaacucuaauuggcaagugcauugcuagucagucuggggcaacauucuuuagcaucucugcuucauccuuaacuucuaaauggguaggugagggggagaaaaugguccgugcauuguuugcuguugcaaggugucagcaaccagcugugauauuuauugacgaaauugauuccuuguuaucucaacggggagauggugagcaugaaucuucuagaaggauaaaaacagaauuuuuaguucaauuagauggagcaacaacaucuucugaagaucguauccuaguggugggagcaacaaaucggccacaagaaauugaugaggcugcccggagaagauuggugaaaaggcuuuauauuccccucccagaagcuucagccaggaaacagauaguaauuaaucuaauguccaaagagcaguguugccucagugaagaagaaauugaacagauuguacagcagucugaugcguuuucaggagcagacaugacacagcuuugcagggaggcuucucuugguccuauucgcaguuuacaaacugcugacauugcuaccauaacaccggaucaaguucgacccauagcuuacauugauuuugaaaaugcuuuuagaacugugcgaccuaguguuucuccaaaagauuuagagcuuuaugaaaacuggaacaaaacuuuugguuguggaaaguaagugggauacuuggaaucaaggcaucucuguaguacagucuucuuuauuuuuuagcauagaaaguuggggauguguuaauuguauuuuuaagaauauauucuaaguucuguacuucaaauaauagcacagauuuuacaucugauugacauaguguauguuaauguaaguuuugcuuuccagugauuaccugauacguaagccuauuugaacaaagugagaaugaacuuuuguuucuaagaagucuuuaucuugaagcuauauaacaugaaaagugagcucaaauuuuuuuuaguugaagauuacauauaaaguugugucugauuaauauucaucuuuuauugaagaaagugccuucugauggccacauaauucuuaaugucagcuaguauaaugguuuacauuuggacaaaguauugcuuaguguuauuuaaguagauuuaagaucucaaagcuaaagugccaauuuuuacuuucuucagccaauuuguuaccucuuuuaugguuuuuaauuuuuaucaggacuaacauuuucagaaauagcaaggugugaucuaguauuagauucacagaacugaaagguuaauuaagaauguugguuauuuucacgggagcgugugauauuuaacauuaauauuuuauuugacacuacagccuguaauacugcucucuuucaaaaacaaguuuucagauuuuuauaacagacccauuuuguuuuaugaaacauguucauuacagaaacaugagaaaauagagauaaguaaaaagaauaaaagucacuauuauccuaccacuuugcgggacacacuauuaauauuuaagcauagauucuuccagauguuuuguuuuauacagcaguaggauuguguaauguauucucucuuguagccuauucuucaaagcguaucuucacuuuccauguuaacauaaauguccuuuuaugauugucuaggauuccauggauggauggaauauaauugagucaucugguagagcgcauauaggacaggacgcuagguuguuuaucuuuuguuuauuguaaaggaacuaugugggaugcauuuggugaucuuuuuaaaaaauguauaaauuucuugaguaauuccuggauuaaagaauaugcacuuuuuaa

SEQ ID NO: 192215 - RNA, 300607 nt, Homo sapiens
ccgcccgcuagagacgauuccagccccuuccguccgccgcgcuccgccgcuguccuccgccggcccgcgugggaggacgaugggucagcgcggaaaaagugaaugagggcggcagcgguggcggcgguagccagcgccugacucggcgggcccggagcaccgcccgcgucccggcccccggcaccauggacgcgccgcgcgccucggcggccaagcccccgaccggguaagcggccccgcggucgggcgggguggagagggggcuucccugggcucggacgcccgcguccgcaccgcgcgcucccgggcagggcgcccucucugccgccccagcgggugcuggugguagugguggagcagguggugcggugcugguguugggugcugguguugggugguggugcgugcuguguacuuugggcacccgggucguugcccagguaaccgugucgggccggggccggagcgcacuuuucgcgcggggugguuuguaugcaggcguccuuauggggguccccgccagcacagcccccacucagcuccgagcuuuccucaggccccccaaguguuugccguagggguggagcggggagcgaggggacgcccggccuuugacuccggccucuucccugcgggcuugccccuggccgguucccaucaagucuucccucucccggccucggcggcagccccaggaucggcucucccggcagcguggaggggagggcuccccggcuucgcagccgcccgggccccgcguucucggaagguguucggauugcccggaggguuucauggcagcagcucucccucccugccuuuauuccagggucuccccuggcaguggaaggggcguccuaguggggccaggccugaggcgcagacauccguagcggacccgcgagucuggcggcccaucccugucuucgcgauuccgcuuuugcccaaaccucucccgguuucuguuugcuauccccacaccuugcgugcagggauuacacgucacauucaggauuugacucucagaaagaguaauuucccucaaacaggacgagcagcccugcucauuauucagaccccgagccaggugcgccgugcucaucccggccagcggugcaggcugggccgcgggguagcgcgcagucccgguggacuuuguaguuuucagcgcggcgcgccggggaccuucgaacucgcucgcucgccuggagcaaauguguaugagucuugcaaauggaaugaggguuggggugagcccugcaccugcuuacugaaugggcccacuuucugcuauggcaacuggacuugaaggaggcagcuuuggggacaacaaaucuuuuuuucuguuacaguugugucccacugacucacccugcccaugugcccauaggcgggcguguugcccaaguguguaaaagacuuucagucgggcucuuuuuaaaauuuuaaaguuuuccuuuaaugccaggaaaaggugagccagguuagcaaaucaaauaauccugaagcugaggaauguuaaaaagaaguuuucuuucucucucucuuuuuuuuuuuuugcagugcacuuacuggugguuauauaauucucuuugaacaaacaaauuccccagaaagaaaguaaaugugggaaauccuuuuucaugguaauaggcaucccaaaauaacagggaaaugugaaacagagguaucuuuaaaucuguggcuuucauagccuauuaaaugagccuauuuaaggacacugaauuauuuugucacuaucaccuuauaaauaaauaugaagacagagagaacauuuaaaaggccggcaaaacuguauccaaagaguaucuguaagauccuugaagggagucuaaugauagaagugaaaggacuuacccuaagagcguggcacucuuuucagccugguacuguguggcaagagguagucgagggcuggccuucucagggcuucccagagcucugauuggcuuucauauuugaauugcaaaguaaaacuaaggauuuuugcuauggaaaacaugaaauuauuccugaugcauucaguucuuucccucacucauauccagugucuaauuuacuuguccgaacaucuuuguccaagaaauguagacauauuauuuuuaacuucuauuguucucacuuugucauuuguuaauacuuucagugaagaagcaucaagaaaauguuaauauccuuauauuuuuucagacaagaauuacguguuuaauaagcaauuuuguguucaaaucugaggagauaaaugguguuaggucuucgaauauuuuauauaauuuagguguaugcuugcuaauuauaaagguuagauauugcugugaaauuuguggcuuuaguacauuauugguggcaggcagauucuguuggcucuucacugagauuacuccucuguucccugagauuaaggcaguguuugcagugugcuugagggaaauuuguuuuccaucugauucugcaaccguuuauuauaaaaucaaacuuucaguaagccucugucuucccacaugauaacaaacugauguggugaagcuguugcuguugcugaaacuaccacuccuccuuguguuguauagaaacaagcuagacugggugcagugaauuaacgagauuucacccuguggccuacaaacgcucuucuagaagauuacugaagggagauagguuggugaauguaaacucacugacucugugucuggcuaaauuauuaacagguaguuauuaguuaucuuugugaaaaacacaaauauacguuuuuacuuggauugaaauuguauguuuuuuacuaggaauuucauuaaaacagugauguaugacuuccuugacuccuggggaaaguguucuuuuaggaaagaggcugugugcaaaaacuaacaagucagacuugaugugacuuuuagggaguuuuagagcucaguugaaguauaagaauugacagaauacucagaacacaaguaaaggcaaauugccuuuuggugagguuuugaaguauauuuaacucucuacuuuaucuguuuacuuugcguuugucugaauauuuauaggagccaucccaguagucggcuguuacagaacacagggcuaaauuucccauuggacccucuguuaauaaaggacagaagaaggcuugcuguuuggcaggaccaugcuuaauuuuuuuuuuccuauggaggaaagacauguuucuguagaauacaguaaucuccaaugacaugaaaugucaaaacagcuggugcauuugaucaauggcuguauucaagcaguuugcucauguaaaaaucaguggaaguuuugcuaaucaguuucgucaaaauguggacuucauguacacauagcuguuauucauuucuuugcauaaauuuauauuuauuuaaucaaguuauuagaaccaaaagaaauuuuaaaaaauuaaucgaaguggguaacuugagcuacucuaguccugucggugccgcacauaguauuaaguguagaaggccugugacucuugguagugacauggggcagccacagugacauuuuguaugaaacccucauaagcaugcagauauuaagaaaauauuaacucuacaccauaauaggaagcuuagguuucuaggccuuuggcuuuuggcuaacauguuagagaaaguguuuacauucuuucaaaugagagcauguauaaugaacuguuacauaaaacuuuucccguuagauuugagcauuauuuuuaaaagauauuacuucugagcuacucuuuauuuuggcaauucauuuaagaaaguaaaaguuaagaauugcuugauguaauguggagaguaggccuaggaauuuuaauguuuuguaauuaaaauauuuacuaauaaauuagaagaguuggacauuucuguguugcaauaucacauagucucagagcauuuuuauuauuucucagugguucuauaaaggggauagaacugaaguaugauuaaaauuuguuacaaagguauuuguuaaguguugcaucucuccugcccccaggaacuuuugccugcagucccuccuguguuuucucgugaccuccagugcacagguggaguggauuauuauugaguggaaccuugacccaggcagagcgacagcccccacguauaugcaggccuggauucuguggacuucuuaauuugggauccagggaaugaagucauaaucuguguccacgcaagugcuccuguaauuauuaagaaaacaaugauuauaggaugcaucuauacaccguaauaaguaguuuagguuucuaggccuuuugugcuuuguuauaaauuuaugauuaaauuuaauuuuguaauugaucugcaguuuugaaaagugagcauaaauauuugauaccaaaguaguauuaauauuuagaucaaggacauacaaaugugaaauaugcuaacacuugguucugauuuagacuugaacuuuguaaauacacuaagaguuccuguauuuauuuauuuuuuugguggggggacauaaucucaccaugucacccaggcuggagugcaauggugcgaucucagcucacugcaaccuccacuuccucgguucaagcgauucuccugccucagccuccggaguagcugggauuuacaggugugcaccaccacacccagcuaauuuuuguauuuuuuuuuuuuuaauagagacgagguuucaccauguuggccaggcuggucuugaacuccuaaccuugugauccgcccgccuuggccucccaaagugcugggauuacaggugugagccacugcccccggcugagguccuguauuuauuauaugguguuuucguacauuccuucauucucuccccauccacauuuaauuaugaagguuuuaugcguugguuaauuuuaauugugugguuuuuuuuuucaguuaccuuauacuauagcugaaaaaaaguugguauuucaugacccacugaaagcuuuuacauaucuucaucuuuguacuuuuucuuuauuuaaaauacuguaguuauugguuuauauuacuacauagagauguauugauaauaugccuuuuuacacuuuuaugauuuucauuuauuugaguuguaaauuuuaguuuccaucucccccauuuuauacuuugcuuucucgcuuccaccuugucacuugaguguuucuggauuuuucagggccacucccuggcuuucugcuucugaauugaugggaagccuacgucacuuuucuuucaggguuccauaauuccuuauuuuucaucugucucuugcuggaauagaauuaaaacuuuuuuccucuuguauacuuuauaugauucuaguugcuucuugcaaagcuaaggauggucaauacuuucaagaccuagugcuauuuauucuagacuagaguuugcugucuccucuggugcgacaauagacaauggguuuccaacaguguguguauuuucugcugccuaucucagggccaucccugugcuucugagccagccccuccagagaaggauggcuuuccccagcagggagaaacccuguggccucuugggguguuagcacgcuucccucugcucuccucaucagguggcgagcugcucccugccagggcauugucuucuauaggccaaguccaauuagaguaaucccccagcuaaaaacauuucuauuaaaaaagagaaaaagcuuuuuaagcaacugccagaguauauuuuucuuggauacauuugguuagacagauucccagaccacaaauacuuuuguacaaauacuuuuguagauccaguucccaccugcaccacaccaagugaugccuguaaaaaggacaucaauugauuuagagaaaccaauaaaguccuuaucccuuaaaaaaaaaaaaaauacaaccggccgggcucaguggcuuacgccuguaaucccagcacuuugggaggccgagguggguugaucacgaggucaagagaucgagaccauccuggccaagauggugaaaccccaucucuacuaaaaauacaaaaauuagcugggcugguggcacaugccuguagucccagcuacuugggaggcugaggcaggagaaucgcuugaaccgggaggcagagguuacagugagccgagauugugccacugcacuccaccugaugacagaaagagacucugucucaaaaaaaccaaaccaaacaaaacaaaaacaacccuccaaagauaaaccagguaagucacgcguccuggcuggucgaucccaucucuugucuuccaggugcuccucuagcauucacugcccaagaaccugaauccccauggggagccauugccuuagagaugcucccaccucucuccagacagaggcugccgagggccagacagggcauccuucccugauucagaaugcccucugcuuauuuguuaauccuauugacuuucuucuaucaaaggcagacagcgggaggauuaguggaaagaaaauugucucaggaacaagaagcuuuggacccuggugccaguuguccaaggugaaauugcuccuucuccacgcagccugcaggcccauccugauggggccucuccagacuuuuucagcccagggcugucugaugaugcuucugccaggugccaguguucucugccagugcugccagacacaggugcuucugaacacuugacuggugauuauugcaacugggagcugagucuuucaccuuuuaaaauuuuaauccauuuaaacuuacauagcugugugcggcuaguuccaguggacagcgaggcuccagccuuuggauuugccacucuuuguuugccaccgcagcuucccaggccucaccuggggucucaggcuuucucucucaccuuggccuggagagcuuucuugccccuuucucagaaugccuguuguuuaagcugcagcuggggcucccccaggaggccuucugagaguaucccucucacaccccacgcccuccccuguccgaaaaccuccuaugggauuaugauugucccuuuacuugccccucugacccacugaauucugagcagcuccuuggagccaggacuauuacuuuguaagcuuuugugucauugguuuguggccugugaugcacagaacaaccccugcuuccuucuugcugguggagggaguuagauaacaugaucuuaagacucaugugagcucuaaaaucauaugauucaguguucccagaauauucuagaguccucuuucaaaaaaacuguuucuuaaauugcugcuuaaaucuuguuuuugccagccuguaugagaacagaccgaucaacuggcacuaacauauuuggaacugaugugcuuggacucagcuugccagccaugcagccuaguucggugcagauuugggagguguuaagaggucuuauuuugaggaacauaaagugacaguggcuuaaagaggagauaauucucucuccuaucuaaaagcccaccucgggaguccugggcugguguuggggugcagcguucccagagaccugcugauuuuuauuuggugcucagcuguggcuggugugcagucuccaucuguuccagccuggccugaggagggggagaugcaccccguccuuucgugcuccaccugccagccauacaagucccuuugcucauguccccuuggcccaaccauaaucacaucguccuuaaaagggcagcuuggaggcaggggggaucagagaucuuagccguugugauugcauuuaugacuccugugagggccgggggaacguagguguuaaagugugcagauggguauguggcuccucugccccuugccagggucuugggaaggggugccccugacaguuucuggccuuucugaaaaacauguccuuaguuugcugugacacacacccacguuauauagagcucugaccuacaaagccuaugcuuuccagacaucuaaggggaggaagugacguuuagacuguaaucuuaaaggccagugguaaacaggacuuugcaucugcaacacaucggggugcugacguccuuugcuuuuuaugaugucucuguucuccuuguccaugcuacagccagccgcuuccacuuauucauagugggcaccauccuggaggaguuggggaaagaggaucccccagcccccaauuaggguaguugcaccugggaaagucagagcuuccugcugguuuggaggagguaggcaaguuggagagacuccuuguuagaaugaggagcauuggcaaagcguugucuuaucauaagugcucugcuaagugcucugcguggcuuaaggacucauagagcuggaagaggagaaauaccaaauggauuaacuuugcaauuacauguggauggcuugagcaguuaaguaaguagcaaacuaaggcuaaggaacauaaugggaaaaccagcuguuugugugaauguaugugugagugugugucugucugucugucugugugagagugggcgugaaguuaaagcuaacuuccagcacuuggcaaagcagcagauuaccaaaucaguucuggcgguuuucaaacuuaauggcuugggaguuguauuuaaaaauagucuuggguaggaguguuaaugcagccgaaguguauacuuuuguucauguggcuaauuuuuuagucucuaaauacaguuugguuggcuagaacccucuuaauuaagugcaaaauccacuaguguucaaugcacaaacuguuaggcuggagggagacugaucgacagcagccagagucuaaacauuugccaugcagggcagguccuugccaggcuuucccguccgcccaccuauccaucugucuuguugucuauagcuaccagguagaauugguuuuggguggaacugaaaacuuccuuccuccugcuccugccuaaaccacuuauuacgugauaaugguuaucugcgcucugacaacaucacacguaggaagagugaauugcagaucucucacaagagccaagccacccaauuggauuuaaaaagugggaauuggggugaugaagucugaauguuuuucaugcugugacaacgcucuaaauugcuacacuuuaccacuucucagaaauauuugauugguuucaacggcacaagccauaaucaaagacuguguucugaaugcaguuaauuugugaauuucacagucaacagaaaaguaaggaaaacuaguuuggaagcuagacuaaacugaaaaauaugucaguuuggaauauuuccuuauuauuuguccauuucuuuuugcuuaccaucauguuucacauuuuuagaaugauagauuuuucuaaaggaggacccaaaaaauguucuuugcaaggacuugccuuauuuuggcauuagagccacuugccuguugccauugucuagcugacagagauaggagauggccagaaccugcuccuugugugugggaggucuggcucucccaucagggcccucugauguugguaggacaguacuguccucuccuuuuuuuguuuuuguuuuuguuuuuguuuuuguuuugagauggagucuugcucuggcacccaggcuggagugcagaggcgugaucucagcucacugcaaccucuaccuccuagguucaagcaauucuccugccucagccuccugaguagcugggaucacaggccugcaccaccacgccuggcuaauuuuuuuuuguauuuuuaguagagccgggguuucaccauauuggucaggcuggucuugaacuccugacuucaagugauccacccgccuuggccucccagagcacucggauuaugggccugagccacugcacccggccuguccucuugguuuuguaggugagauugccaugugacucugacgucucucgucaguguccacguccucaucguuggccacucugcuaggccacauugaagcacggagcucauuuccaaagcugcuuuaugaaagcuacugcucuagcucccugcaggaugaaggaggauguugcucugcucuauuucugaagcccuggagugucucagcagcauuuugccaugaaaagccagugugccugcagacauucuuacgacuuauuccugguauaggagccucaugauuaccuguuugauugugacagaacucaugcuuuucuaggaugugcgauuccugagacuccuacgugggauuuuacuuuuucaaagaaauacguggugugugauaggagaggaccaaacucagcuguugcugagcacagagcaguuaugaauuaguguaaggagucgaauccagacuccccuuccucaaagcaagauguucugccugauacuggcugaugaauuaauaaacauugaaaagccuucccuuuuguacuggauguuggcccagcucagugucuugggcugauacauuuaaugaaaacacagagcucugcucuguucaauaaacgagcuuccuucaaaguagaagcuacacagaacccagacccacaaauucgcuaauuguguuuucuuuggguaacuuuauacagcccuugcuccaagcugcaagagccucaguaaugagcugggugaugcuuuuagggccucuucucugcaggugagugggcccuguuggccugggugugcuagucaguaucggggcuucuagaggccagcacccuccagcagggaugaacugagcacggagagaaaauagcccugguguguggcacuuccaagccgccucuagguucauggugccuagugucacuguguuccuggggccccacucaucugcauuacagcucacaccucaagacacucgggaagcaagggccaucuucauucaucaaguacaauguuugcccccacccccgccccaagacagagucuugcugcucugucgccugggcuggagugcagugaugcgaucucagcucacugcaaccucuaucuccuggguucaagcaauucuucugccucagccuccugaguagcugggauuacaggcacgugucaccacggcuggccaauuuuuuuuguauuuuaguagagacgggucuucaccauguuggccgggcuggucucgaacuccugaccucaagugauccaccgccuuggccucccaaagggcugggauuacaggcaugagccaccacgcccagccaucaucgaguacaauguuuuaagcgcauaccugguaccugguuuaggggcuuuuuagugcugugaaugagcugguguucuuggcucuccuggggccuaugcaagcagaaugucccucaaucuauuuuuuguuuuuaacuuaguuuuagucacuuucacaaaaguaauuuauccuccuuaugauguuucacuuaccugugcagaauccuccuucuguuagaacugauuguucuaaaugacaugcaccaaguuggaagauuauaccuuuugucucuuuauuuuaacuguugaucuguggaaaauauugcuuuguagaugagguaucuagacagcaaccucagaggaaaauuauauguuagaaauguuuucuugauguuuacuuuucauuuucugaguuaaaaauuauauaguauucuuacagucagggauaagacuggcugcagagccugaugggaaguaaagcauggcuuguguuuacgcugggcuggcuuucaugauuuacccaugugccuaggaaggggaugcacuucauuuguguaacauuuuuuacuuagggcgguguuuuuauaaugcuaaauauuuauugucaugaaaagguguucuuguuuauuuuaaacaagugaaagugacauauaauugaaacagauuuuccacaaggcucagcuuaugucccucuuuguugugucacagugacauagggacuggcccuuguauuaccuaguggugcuggcauuuggaggggcgggggcuaugcucuggggagcacggcugguuugcagcucucugguaacuucuuggugagggugucaaccuacagaacgugaguggaaggacaaggcccacacauccgcccuccccugaaagcuuugucacuucgagggacuguuuagccuccucaucccucaugacuaaggcggagaugacuggauugcaggguuuuaugagaugauuagagaccaggaguaacagcaucaguggagggccugucacaggacaguuccuauuuuuuuuuuccaauuauuuuucauuauaaaauauuguuauuuucccauuauuguuuuucugccaguauuccaucauucugguccaagaacauauaauagaugugaaacucuguccugacaccuguuuuuacaaagacuugcacugccuuuccaguaggaaauauuacugcuaccauuuguuuucuuaugguagaaaugcggccaaugccaccuugauaggaaacuaaugauucuaaugaucagaagggaucuguugguuuagaacagaaaaauagcacuagaaauacaauacaaaucauagcuuguauucacaaauuguuuuucaguggauguuguaaacacagguuuguaccaggaccaggugggucacaccgaugaggaagucaugggcuggacaggguggguuggggacuguggggagaaugaauggugacucccaucccacuggaagagcuuuguuagaaggcuggaccugccugugaccucugccuccccacuucuaaauagaggucauuguguuuugcccuuuguuuugcucuccuagcaguucuuggauguugugagggcgagaccacgauuccuccaucaugcagguguggcugccucucucacaccaucacuuuccaagcugaccuuggugcuggcgacaacaugggacuggauucuggucuccugacuguuggaccagugagugguuuugggggagcauuagugucuggggacuuccucugaacuucaaggugccgccagcguuauuccaugauacccuuuacccauuaaaaauaauauaaaaauaaaugucugaguuuaguguuggugugcaugcagucagcagccugucccauauguucugucggcggcucugcagaccacucagagaaaaauaacagcauugggugaccaccuuuaaaaaugauguuuggauauuggauaaaauacucagccagucuguagacccacugggaaaaguauaaggaaaggauccauacagaacggaucaguauacauuuguaccuucccuguuuggaguugggucagcagauaagcugaauuuugauacaugucuguguuugucacauguaacaucuaagagcuugguaaaaucccucucccaggcacauuaacuucauauaaauaaauaggugcucaugaacaccaguugcuuugacacacuuccuuguggaaugagucuguuuuugcuagaggaaaguaaugacaagugaugccucuguuucuguggcucccuccauccgggagggcuggggaugucacccugucaccucucaccuccaguggccgucucugcaugcauggucaagucaggugcgcacagagaccggauugcugguuuuguauuuuuguuuguuuguagagauggguuuugcuggucuugagcuccugagucaggcaaucuggccgccuuggccucccagagggcugggauuacaggugugagccaccacgcccggcccgggauuguugauuuuggaugaugggcuuuccuguccacauucgauuagguuuuguguccccagauuuuauaaaaggguauaaagcauuugugucuaucucugcauccgaauguaaaagcauaaaucugaaaguaugaucuauuguguuaacuuugucaugaggcucggggaaacauuaauguauuguauuuuaaaacauucuaauuugugaagugcagguuucuauugcagugauaaaacaguagcuuguuucugagccggcagcccugugagugggguauuguugucauaguugcagcauugcguugggaagacugagcuggugauuuagcacaugccaaaaacugagucaccacagccguuugguugggggugaggggugaggcgucuguaacacucucugauaacagugcuuggugcccuguauagcgucaucuuuaaaaaugguaauuuauuaucagcgaguaaaacugaucucaguuaaguuccaguauuuucaaagcacaauuauuaccagaauugugaauuauuauuauuuuuuucuuagaaauagggucuugcugcauugaccaggccagucuugaacuccuggccuuaagcaauccucccugucuuggcuccccaaaguguugggauuacaggccugagcgaccacacccagcccagaauugugaaucuuuuuuuuuuuuuuuuuuugagacggaguuucgcucuuguugcccaggcuggagugcaauggcgcaauaucggcucaccacaaccuccgccucccggguucaagcgauucuccugccucagccuccugaguagcugggauuacaggcaugcaccaccacaucuggcuaauuuuguauuuuuaguagagauaggguuucuccauguuggcuagguuggucucgaacucccgaccucaggugauccacccaccucggcuuuccaaaaugcuaggauuacaggugugagccacugcgcccaguccagaauugugaaucuuuaggaaaaaaauuaauggucuuaucaauuuacuuuagcaguagaauuucuuacaaaacuuaacugcuaggaaaugauggcaucauugcuuuauuuaugugacccccuccaaauuuauuaugcugggagggaggccaggccuuugcccuuguuagcccagcagucuucaccuaguuuguaagcaccuccuaggauggggccaggcuguggagacaugcagcucggcggcugcccucggggagggccacgacacugaagaccugucagagccaaccaggggagaggccccuggcucugacuguucaggagccaugccucuuugaagcugggagaggcaaagcuaccagguuuugagcuggggguugaaaacuagauaaaauguaaaauguggcugggcagagaggcaggcauggacugacugccaggaguggaagcccaaggauggaggaaugcacagggguucccagcacagugggacccacagaguggaggaaccugcaguccacuggaggggacacugaggacagcagauggcuuagaugccuggaucugcgcuggaaucuguggcuuggaaccacguagcggugggcaggcaauguggggguuuggauuuucucuggaagagcugggggauuggucagaggccuuaagcagaggagcagcuugcuuacagaggaagauuguucuucgaauauuagaccgacacucaggugugagggaagucccggaggaaagaagagaggguggggcccggcagggacggcugguaggacacggcccaggccugagagacaagggcuuggccuugccacccacaguacggcugugaaggaaggggcagugccacuguguugugaguuccgcgcugagguacaggugaugggggcccaggcaguuccccgucacagaguggagagcacgggcugugaggcuccugcucagauaggaaggagaugccaggcgcgguaguugaaguucccucacuuacuuuucuuuggcguauuagugcugagggugcugccugcccagaagaggauaaagggugagcguccuccagaggcuccagucucagagaggagacagaucugccagggagccccagaggaggggaggguggcccagggcagcgccggagggagccgguggagggggccgcuucagagcagcagccugcgcggugcguguaucccaccgcacucacuccucaucucagcgugcggggugagggugcucuucccauuuuaacagugaggcacgugggacacaagauagcaacauggugaccaagggcagcugauggagcgguuaaccccacaucuggaccccgcggucacacagcccagugcacacuccugacccagucacaugcaccucagauaucccuggaaaagaucccaggggcccugaugacaguugugagucugagccagaaguggggaaagggugggaaggguuuuccaggaacugugaauggcaggaacgaguaagguucuugggagggugugaguaucccaagaggaagugagugcgguggcaggcuccguccuagguccuagcagguggacuggcaguuaucauuuccucuccagagcucccuggagaaggcauucucccauuuuacccacgaguacaaugagccccagaccgcguuccugcgucacuugggcaguggugacaggaugcagacccaggccuguaggagcaggcagcuccuucugacauaccacauggcuccuucuaacacaccacgugacacucuggguaagaaggguccagacccaggccaggugugagaggcuuccccgcuuuaauaaccucuguuucggccagguaugguggcucaugccuauaaucccagcacuucgggaggcuaaggcaggcagaucaccugaggucaggaguuugagaccagccuggccaacauggugaaaccccaucgcuacuaaaaauauaaaaauaagccaggugugguggugggugccuguaaucucagcuacuugggaggcugaggcaggagaauugcuugaacccaggagacagagguugcagugagccgacaugaugccacugcacuccagcuugggugacagagugagacucugucucaaaaaacaaaacaaaacaaaacaaaacaaaacaaaacagaaaagcaaaccucaguuuugauucugaaaucuaaggcaagcaugagcacauguaauagggaaguaaggaaggcacagcggcaauagacugggucauggggaucagagaugcauggccuguuugcagggccuugaggccagcacuaguccaggugugguccguggacuggucugcaguaagaugagugcaccacuaggagugagcaucugcagacuuucauagcagcuuaauguuguugcgauauuuaagugcauggucauugauggugccucaaguaggguacagaugaccugucuuguggagucaugggucaccugugacauggagagcuuuuccuguauuauguuccucaucccccuaguagaccuguacauaggugcuguuacugucacuuucuugaagaggaggacacugagugucagagagguugagcagcuugcucaggaugacagcccaccccuauagccaugaagccuggcagcggccucucccucagcaccauuucagcucuucauguuucauuguucucagagcaggacugccagccucuuccugggcccagggcugcagcacccuuccuccuuagagagcgccaacuggguuugaggagugccagcaugcuaugggucagucccccugaaaccuggacucauaugcuagggauuauuaaccauucagucccuuugaaacuugugacuuuugggaagaaagagagacagauaggagaagauagguaaaauuuggauguccauagucuccauugauuuaccuucuuuucuguucuagcaaaucgaagcaaaggauuugcacaaguucuuuggaauauaauacuuucuaaacagccagugcugcaccuccugggcagacaggcaguggacaccgcugugugugacuguugcuggcucacgcauucguuagugucuuaaggauguccagcccuggaggaguguguguguguguguguguguauguaugugugcucauagacuuggaacguuguguggcucaucuuugggaggugugcugugcagccugucuggccuaagggcagaaagauaugaggugcccaccggcaacaccuccccuuggcuuuccuggccuaugccauucaugggugaggaaagcuguucagauguugccucccugacuccaugaagauugauugugcuggggagagucugaguggagaguaucuugggguagaggaggaagaggagagcugagauaugagaaagggcuuaugugcucggacaaguggauuugaccucagagcuucgaugucaucugugcucagacaaaggcacuguaggcuuguuuacaguuuuggaugguacaguaucauguuaguggugcaguuguuguuauuaacuccugagguaggaugagacucaugcagcaugugaagugacagggucaacagugaaaauuuacacauuugcaccauuuugcagcuuucggagucccaacaucuguguauucauuugacaugacaugcucaugagccuggugggcaagcauuucuuucccuacuuuucagauggugaaugagccaugagcuaaguaagagcaauggaguggccugccuugcucacaucugcuuuguugcuggggugggggaugcccuguggccccagcccauguguuaggaggucagagcucagaaaugguggagaaugucauugcaggagcaugcacaggcagcaagcugcacaauuagcccugaauagcaggccaccucuuaaagcaugcccugacaacaaaggugacuggguugaagucuguagguguaguaguuaccuauugcuacguagcaagucucccuaaucuuagcagcuuagcagugggaauggcuuuacugggugguucugaugagaauuuuagguuguaacuaugcuuagagucauaugcaguggcuggacaguggcucaguuuuugccaacuuuugucaggaugccucagcucuuugccauguggccucuccguaugccugagugucuucacaaaauggcagcugacuuccuguagagcaugugauucaagagggggugcaaggagcaaugcaaggccuuuuaugaccuagccuuagaagugauacacugucacuggcuucauacuuugucagaagcaagucacuaaguccagcccacacucgggagggaaauuaggccccaucuuuggaagagauuagucugaaacauuuguggucauacuuugacuuaccauagggcaauauggucuugauugucuuuucccaaagcaacuugguuaagcuccuagugaagacgcauuaaaaacauacaucgaguggccucugaagaggagacuuuuuauaaccaaaucccacugauacaaaccuuucugaugguuggcuuuuccauguaucaagggcugcaugugguaguuuucuuuauagaaguauguauuguuguuuauguaaagauuuucaaggccaggcaugguggcucaagccuguaauccuagcacuuugggaggcugaggcgggcagaucaccugaggucaggaguucgagaccagucuggccaacguggcaaaaccccgucucuacuaaacauacaaaaaauuagcugggcauaguggcaggugccuuuaaucccagcuacuugggaggcugaggcaggagaauugcuugaacccgggagacggagguugcagugagcugagaucgcaccauugcacuccagccugcaugacagagugagacuccaucucaaaaaaaaaaaaaaaaaagauuuucaaaaugaugaaacuuagcuuaccauguuaagaacaacaacaaaagaucucagguacugaaaggugaucacaugccacaguugggacagucccaguuaacaccuggugugauuccuaauaaugccuauuucaccuaccacauugcccugucuggacuauacauguuaugauugcucagccuugaugcugagucuaccuacguaaaaaugagggugggauucuuccccgguggguguuaaccagggaugugcagccgagucaccgaggagcuuuggaguagaaacauaccucagcucuuugcagggggaugcugccugggccagcagagaggggacucaaaagaggguuugagggugcuucccuggugauucagacguccagccuuggcuaaagaugauccuuucauucaucauucaguauuacacccagccaucaauuccuuaaauguguauuaguugagauguuguuccagcucccaagguggccagccugggaguucuauuuaguugaaaagaccugagugcauacagcauggucguuuuccaguacaagaauuuccucuucaagaaauauguguuuguaacgcacuucacaugguuuaaccaaauugcuuuggaaaaaggcgguccagcccagauugaaagcaagcucucguccuauacuuagcaccucccugugaguaaucagcaacaucaaaaugcccauacauccuugcaagcaaacaucuaccaugaaacaaaaacuauuccguaaaauacuuucagagucauuuaucaaauugauuugcugcaguauuauuugccccccaaaaaaguuaucuuaaguuguugaucaaaaaagaaaugaaauauuuaacuuguguaaaauaacuuuacacaaguuaacuuugguaaaaaagcaaaaccaaaaacaaaagaauagaagaagaaaguaaagccaagcuuaauuaaaaaaaaauauugcacgccuucauuuaaucaaacaucucccauguuaggacaaacuuuacauuaaaauaauauguguaugauugucucuguguugucauauuguccuacauauuaugaagguuuaaauaugaaaugauccauuuuucugauguaggaucauuuuaaaauggauuuauuuaauuggcucaugaguuuaaaaaacucaguauuaauuaaaauucaccuaugugcugauaucaugggugucccugcucugacagaucccacaauaaagaagggaggacugaucucuaaaguccauuacaacaaguguuaucauagagauaugugcaaagugcuucaugaacacccagaaaagaaggagcggagcaguuaguucuacuuguaggguggggcuuagauaagucagguuuauuuuuauggaaggccuucucagaaaaucauuuugcugaagcaguucuuaaauauaacacuccuuccagaccuaagccccagccaggccagacaagcuguaacuaucccuaagauuagcuuauguaaauaguagcuuagggauuacucagugaggguuuuuaaauuuucauugaucacuuaggaggguaaagaaguauggagaagugcagacuucugugaggcugccaggauuugaaauuuuucggaaagguuaacaagaaaguugagauuagguuggccacaaguucuugggcuuugauggcaguuguuggacacaucaucuguagggaccuacagaaggccagaggcacagaacaguuaacacagaaugugaacugauggcccuggaaggguguuguacauauccuugucuccaggaugucguguuugcuuugcugggugugucccaauccuugcaaaguaguuguugucagugacagucugaaaggacaggccuguaucagugacucuguacuacauaucuaggcauuugcaagauuauuucauuggucccaguuaauugggcaguauuuuuuuugaaaaauguuuuuuaauguauguauuuuuaaucguuauuuuuuugcccuaauuucugggauacaugugcagaaugugcagguuuuuuauguagguauacaugugccauggugguuugcuacaccuacuaaccugucauguagguuguuuuuuuuuuuuugagccagagucuugcccugucacccaggcuggagugcaguggugcgauaucagcucacgacaaccucugccuccccgguucaagcgauucucccuccucagccuccugaguagcugggauuacaggcaucugccaucaugccuggcuaauuuuuguauuuuuguagagaugggguuucaacacguuggccaggcuggucuugaacuccugaccucaggugaucugccugccucggucucccaaagugcugggauuaugauugagagccauugugcccggcccgucauuuagguuuuaagccccucaugcauuagguauuuguccuaaugcucucccuccccuugccccuaccccgcaacaggccccagugugugcuuuucccuaauugggcaauauuuuuuaaaauaaacaauuuugauaacuuuaaauaagugauaccaguaaaacuuuaaauucuauauaaauggagcauagaccauguacaaggacaaugcuagaucuacaggggguauaaaaacaugcuuauauugcuggaccccaaggaugacaugguuugguuagaggcuagcaauaucaaguacagaaaaauauuaaaccuuuacuuagaauuaagaccaaaaugguuuuuuuuuuuuuuuuuuugagauggaguuucacucuugucgcccaagcuggagugcaauggugcgaucucagcucacugcaacuucugccucccaggcacaagugauucucccaccucagccuccugaguagcugggauuauaggcaugugccuccacacccagcuacuuuuauuuuuuuuuuguauuuuuaguagaaauaggguuucaccaugugggccaggcuggucucuaccuucugagcucaggugauccaccugccuuggccuccuaaaguacugggauuacaggcaugagcucugcgcccugccuuuuauuuauuuauuuauuuuuauuuauuuauuuauuuauuuauuuauuuauuuauguuuugagauggagucucacucuguugcccaggcuggagugcaguggcaugaucucugcucagugcagccucugucucccagguucaagugauucuccugccucagccuccugaguagcugggacuacaggcaugugccaccaugccuggcuaauuuuuguauuuuuaguagagaugggguuucaccauguuggccaggcuggucucgaauuccugaccucaagugaucugccagccuuugccucccaaagugcugagauuauaggcaugagccaccucgcccagccuaagguaguucuugacuguugaaaaacuuaggcaaauagcuacagacugagugccugucacuuauauacugggagcacugugcaugauccagcacccuuaccgagcaugggacgaccugggagcacugugcgugacccaggaccccuuaccaagcauagaaugaccugggaacacuaugcaugauccagcaccccuuacugagcaugggacagccugccuuguagccagugucuguugguucucacuuauggaugaauuucuucuuuuuccucuuugugauugagaagguguacuguauuuuggagcuacuuuacugagggauauuuauguacaauaaacuauacauauuaaggcauacagcuuuaugaauuuugaugugugugacacccuugaaacuguuaccacaguugagauacagaaguuuuucuguugcugcucaaagguuucuugugcuucuuugcaauccauuccucccucuccugcgccccucaaccaccauugaucuguuuuauuuauguagguggcaucuuuuugucaaauuuuuucacuuggcaugaugauuucauggugucucuauuguucaucccucuuuauugaugaacaguauaccaucauuaauuuacaacaauuuguucucccauugauugacauuuagguuguuuugggguuuuagcuauuacaaauaaagcuauuaugaacauucauuuauaguuuuuguauggacauguauucccuuucuuugagguaaauaccaaggaguggaauggcugagucacauuguagauguuauguuucauguuuuacaaaacugccaggguuucuuagcugaaaaguaauuuggugaaaacaaaacaaagcaaacaaacaacuacaaaaaugccaggcuguuuuccaaaguaauuguuucuuccucuucuagcaguggaugagaauuaacaguuguugggucagucuuuaauuuucaccauucuagugugugugaaguuuauugaauuuuaaaucuaaacuuuuugauuuggcgcaucacauguguuuaguaacuuauuccuucaauucugucauugugucacucaagggaaaguggaauccuggccccaggguagcagcagccuuggcuguggggugcaugaaaccugugugcccaggccugggauacgugggcaucccuagagggcccugcuccucuuuacucagggcugcucggggccugcaggggcugcaaagaguugggcuugggcaagccacgggccuuggaaggagcuuugcuuucuaggcucuggaguguggagggaggaggggacagaacaagaucccagacaggagggacccuccacacaggggagugcucagccuggucucccucagagcuggcagcaggucucacagaugugugcugaagaggcuaaaggagaacagcuaccuagaaaugcacaagaaugccuuuugcgucagcaaauagaaugugucccuuucuaauaccuggcuucaggaaauaaaggggccauuuaaagaaugugauuagguuggcugaauuauguuuuuccagcuucugauggacguuuuuuaaugucuuuaucagucauauuuaaauaguacucauucuaaucagauucuuuaaaacauaauacucuuggaauggaugacuuuuuaugggauuuccucaaauauaauaaucaacagucauugauuugaagauucauuucauuccauucaguggguaccuuaaaaugacaaaauggacauggaaccuuucaaauguaaauaaaagcagagaacauaguaaagaaaucguauggguccauuaaugagcuuuggcaguuuuuaacauuuggcaauucucccacuuuuuuuuuuuuuuuuugagucaaagucucauucuguugcccaggcuggagugcaguggcacaaucucggcucacuacagccuccgccuccuggguucaagagauucuccugcucagccucccaaauagcgcccuccaccacacccagccaauuuuguguuuucaguagagacaggguuucaccauguuggucaggcugguccacagcuccugaccucagguaauauaccuguuucagccucccagcaaugcugggauuacaggugugagccacugugccuggccccacuucuuauuuuuauuuuuggcuugaacguuuuaaggcaaaagcuccccauucuaucuuuucauuuguaaauacuucugugcugauugugcacugauaaaucuuacuuuuuuuuuugagacggagucucgauuuguugcccuggcuggagugcaauggcguggucucggcucacugcaaccuccacuuccuggguucaagugauuccccuuccucagccacccgaguagcugggauuacaggcauccaccaccacacccagcuaauuuuuguauuuuuagcagagagaggguuucaccauguuggccaagcuggucuugaacuccugaucucaggugauccgccugccucagccucccaaaguguuaggauuacaggcaugagccaccaugccuggcuugauaaagcuugcuuuuuuaugacugucaccucauuacccugccugacaguaauuccuuaaugacagcuaauuuccuguccauacuuaaauuucccagauuguguucaagguaacuuuuuacaguuguauaugauccuugugcuaggacuccuggcuaggacuuuggaagacacagagguuggccucagcaaucuccuuucuggugacucugugaaugugcccucacaguucaugucuguaucuucuggucacucagacaccccuugugugucugugugccucagccuugcuugugguccccgagaugccuguuccccgcugugccccucagucuuucuucgcugccucgcgauggcuugcuggcucuaacagggauuucugcuuuccuugcucuggcgcuccaugcagcuagccguucaucuguuuauucagucauaccccaaggguugugagccccuggcaggaaugggcacugugcaaggugcuggagaccuaaagaagacguggccuuugcucuuggggaggauggugaggggcagaggcagauuccaugcaguacagugugguguugcuauggcagacaccagccggagggaagggcacacaccuggggaggcacccugcuucagggaguggcacuggaguuccuaccugaggucaagguguucacauggagaggggaguaugcauggugccagaaagggugcuggcccaggugucugggggaagugggauuuagcauauuaguauucaggguuauuauuugagcaguuuaaucuuccugaaacucacaaggaggggccgaggcugagguugugugggaagcuggagagaaagucagggcaguagggagcccaggaaggcuuaagcaggguggggcgagccuaaauuugaauuuagaaagauagcacacaucuuucacgcacccuuuguucugauaucuguguuuauuuagggguaaacuaacuucugauuaagacaagauuuaaaggaaggcugagcacaaaucauuuuacaauguagacaagcuuuuuccaagccagcaaucugaguugugacauugcagguuucacauuaucucugcuggaaaggacccuggugaucacccggccaggcauucuaguuugccuguuccuucagaauccauguuccccaaugauuagcagucagauuucaaaauaaugcaaauuagaugugcugauggcacacauuguccucugguaaccaguagcacauaauuuaugccacuggcauugugacuugcccauucuauugagucucugugauugguguaugcauuugauuguguuugcucaaguccaaguguugaucuugagcagucaccaccuuucauucagguugcaaauaugaccacccuaagguuacugcugcucauguggaacauuuugcuuugcagcaucuuagggguauuucuguuuuccugagcugccauuuuucucuguaucucauuuguuuucccaaggcccucguauagggcuggcaugcaggaggaugaacaaaaauagacacaggaaaccaggccaaagaaaggcagagaggggagagauaucagccaugaaagcaaaucuguguccugcaauugaacaucaguucggucuuuauguuucugacaagcugggcaacagggaaacaauaauuuccauaguucucauuauugaaaguaggacaaguugcguuuccucaaaggaggcgucauuguuuuuggcacugaaagguaauuacuuguaguuguuuguucugaucacugcuguucacuuccauucuguggcuugcugggaguguucacauauaauuugcagacauuguuagcacagcuacugugugcaaggcacagaaguguuugagacugagucuuauuucuggaauaaggagagguggcacucuaggacgggagguaagcaggagagcagaugggcaggaucagcacaugaagguccucugagcccugcugcccggcagagcuccguuguaggcaguggaggagccauggaagaucauaagcuccuguuuuagaaaacaagcucuggcugcuuuguggagggccacacccgagugcagugacacaggauccagggagggcugagaggaagugucagcaggagggcagugaggucuguggcucugggagccuagagucacuugggaggugacuuaggagagcagacaaugagaacacagagagggaaggacacaaguauguagaacgacuugcaaaauaaucaaaugauagacuuguucccaauuguuauaacaucauuuguugaaaagacuauuugggaaagaauaacaauuuaaaaaggaaacuguuaugaaacaaucaguugcuguccauuccucacuggacccugagcaccagugcggugggcaugcugggaggagaugcugcugacuuuagacuaugcagggcucuguucuccuuucucucugugcuaucauuaugcacaaguggaaacaagacguuuuggcccugcacuccugaggacuauuuuauauuguucuuuacaguuuuaacccugaugacuucuuauauuguucuuguucauauuuuaacaaggacagguugaguaaauuaguugcauacaauuaguugaguagguagaagaguauuuccauagauauccaucuugaagacuaguauuugaauucaguucuuauuucccauuuguauuuucuaaaauuauuauuuauuuauuuuauuuuuugagacugaguuuugcucuuguugcccaggcugaaguacaauaacgugaucucagcucacugcaaccuccaccuccuggguuuaagcgauucuccugccucagccucccgaguagcugggauuacaggcaccccccaaccaugccuggcuaauuacuguauuuuuaguagagacaggguuucaccauguuggccaggcuggucucgaacuccugaccucaggugagccaccugccucggccucacaaagugcugggauuacaggugugagucaucacgcccagccccauuuucauuauuguuguuuuuucuuucuuucuuuuuuuuuuuuuuuggagacuguugcccaggcuggagugcaguggcgggaucucagcucacugcaaccucugccucccggguucaagcaauucucuuguuucagccucccaaauagcugggacuacaggcgccugccaccaugccuggcuaauuuuuguauuuuuaguagagacaagguuucaccuuguuggucaggcugaucucgaacuccugaacucaggugauccacccgccucggccucccaaagugcugggauuacagacgugagccaucaugccuggcccccauuuguauuuuuuaaauuuuacuuuuuaaaccaaaauggaguccaguugacuucuuucauaauuccaugaauuuuaacaugugcauagauaccacaauuagcacacagaacacuuucaucaccccagcauuuucuuuuguucucuuccuggcaaccacugauuuguucuccaucacuauaaucuuuuuugagaaugcccuauaaauggaauuguaggguauaaccuaaccucuuucgcacagcauacugccuuugagauucagcuccuuucagucaacugucaguaguucauucauuuuuuuuucuuuuuuuuugagacagagucucacuuuguagcccaguuauuaugcagagucaucuucuaucauauggguccaccacuguuuguuuacccauccacccauugcaggacaucuggguuuucuccaguguuuugugagugugaauagagcugcuauaaacauucauguacagguguuugugugaaccuacaguuucauuucuuuaggguaaauacccaggagugggagugcugggucauaacuauaugcauaaaguguuuaacauuuuaggaaauugccaaaugguuucccagagugucuguaccauuuugcauucccaccagcagugcaugagagcuccaauugcuuuguauccucaccagcacuugauauuuuuaagauuguuucauuuuagcuauucuuauauauuaguauuacaucaugguuuuaacuugcauuuaccuaaaggcuaacgauggcgaagcuuuauguguuuauuuaccauccauaugucuuuuugggggaaaucuuuugccugucuuuuaagucuuuugccuguuuuucaaaggguuguuuguuuucuuauucugugggauuguuuuuauuuuuugauuuuucaacuuuuauuuuggaauaagaggguucauaugcaguuuuguuacauggguauauugcgggaugcugagguuuggggaauggcugauccuauuauccagguagugagugugguacccaugcuccucuccuuuccuccccaccuccaacaucgccagugucuguuguucccaucuuuguguccauguguacucaauguuuagcucccgcuuguaaguaacaacaugcaguauuugguuuucuguuccugcauuaauucacuuaggauaguggcauccagcugcauccauguugcugcaaaggacaugauuuaauucuuuuuuauggcuguguaguauucgaugguguauauguaccauauuuuuuuaauccaguccaccauugaugggcacuuagguugauuccaugucuuuccuauugugaauaguguugcagugaacauaugaguggcaugugucuuuuuggcacaaugguuucuuuuccuuuggauauauauccaguaaugggauugcuucauugaaugguaguuaugcuuaaguucuuugagaaaucucuaaacuacuuuccacaguggcugaacuaauuugcauucccaucaacaguguauguauuccccuuucucuacagucucaccaacaucuguuauuuuuugacuuuuugauaaucaccguccugacuagugugagauggcaucucauugugguuuugauuugcauuucucugaugauuaaugaugaugaacaguuuuuucauauguuucuuggcuguuuggauauuuuauuuuaagaaguaucuguucauguccuuugccauuuuaaaauuagauuuuuuuuugcuuuuuuuuuuuuaguuacuugaaguuucuuuauauaauguggauacagcuccuaggucauaugugauuugcagauuuuuuuuuuucagucaguaucuuguguuuuuauucuuuagcagugucuuuggaagaguagaaaauuuuaauuaugaagaaguacagcuuuuuuuuuuuuuuaaacuuuaugcucuagacaugauuuaggcaccauaucuaggaacucuugccuaacccaggccaugaauauuuucuuggauguuucuucugaagguuuuauaccuuuacuuuuccauuuagaucagugguccauuuugaguuaauuguuguauaaggcaugugacuuaggucgaaguucuucugcuacuucucauuuuucuuuggcauaggguauccaauuguuauaauaccauuuguugaaaagacugucuuucgucuauuuaauugccuuuacaccuucauaaaaaaucacuugaauauauuuauguggaucuauuucuugauugucagucuuguuuaauugauuuauaacuguugcuucaccaauaucacacuaucuugaauacuguagcuuuauaguaagucuuaaggcuauguaaugugauuccuccaacauucuuauuuuucaaaauuaguuuggcucuucucauuucuuugccuuuccauauaaauuuucagaucaguuugucuaugucuacaaaaacagccaugcugagaauuugaaauuuuguuaaaucuguaaaucaauuugagucgucugaccaaugaauauaugucucuccauuuuucuagguuuucuuugauuucauuaaccaguguuuuguaguucucagcauacaaucuuacccaugucaacuagacuuauaccuaaauacuuuacuuuuuugguagauguuuguaaauggcauuuuaaaauuuuaauuccuaauuauggauuguuaguauagaaauauacuugauuuuuguguguugacuuuguauuccaugagcuugcuuuaaacucuaucaauucugugaggauuuuugcuuuuuuuuuuuuucuuugcagauuccuugggauuugcuauguaugucuagaaaaaaggugugguuuauuucucucuguccaaauuugaugccuuuuauuuguuuuucucuucuuauuguacaguguagauuuccaguaagaaguugaauagcugggcacgguggcuuaugccuguaaucccagcacuuuaggaggcugaggcggguggaucacgaggucaggaguucaagaccagccuggccaagauguugaaacccugucuguacuaaaaauacaaaaauuagccaggugugcuggcacgcuccuguuuucccagcuacuuaggagucugaggcagagauuugcuuaaaaccaggagguagagguugcagugagccaagauugugccacugcacucuagccugggugacagaccaagacucugucucaaaaaaaaaaaaaaaaguuggauggaaguagugagaauacacacucuuaccuuguuccugaucuuaggggaaaacauucagucuuucuuugugaagcuugauauuggagguagguuuuuuuauaccuuuuuuuuuuuuugagacggagucuugcuuuguugcccaggcuggagugcagugguacgaucuuggcucaccacaaccucugccuccuggguucaagugauucuccugccucagccuccugaguagcugggaguacagaugcaugccaccaugcccagcuaauuuuuguauuuuuaguagugaugggguuucacuauguuggccaggcuggucucgaacuccugaccucaugauccaccugccucggccucccaaagugcugggauuacaggcaugagccaccaugccuggccuuauagcuauaguuuaauaggcuuaggaaguuuuuuuuuuuuauuucuaauuuacugagacuuguugauacugaauuauaucaaaugcuugucuuugcuuugauugauacacgcaugugauuuuucuucuuuaaacugucaguauggugaauuacaugaacugauuuucaaauauugaaccagccuugcauuccugagauuaaaccuccuugauuguaguguauuauucuuuuuucuuuuuuuuuugagacggagucuugcucuguugcccaggcuggagugcaguggcgcaaucucugcucacugcaagcucugccucccagguucacaccauucuccugccucagccucccgaguagcugggacuacaggcacccgccaccaugccuagugcuuuuuuuuuuuuuuuuuuuuuuuguauuuuugguagagacgagguuucacucuguuagccaggauggucucgaucuccugacuuugugauccgcccaccuuggccucccaaagugcugggauuacaggcaugagccaccgugcccagccuauucuuuuuauauauugcuagauucuauuuuuuugaggaauuuugcaucuguauucaugagagauauuuguguauaguuuucuugugaugugucugucugauguuauugguguuuuuucauuuuuuguuuuucauuuuaaaugcuuaguaaaauuggccagugaaaccaccugggucuaaaaauuucuuuuuucauaauguucuuaagcuacagauuuggccagaugcgguggcucacaacuauaaucccagcacucugggaggccgaggcaggcggaucaucugaggucagguguuugagauaagccugaccaacauggugaaaccccgucucuacuaaaaauacaaaaauuagcugggcgugguggugcgcacauguaaucccagcuacucaggaggcugaggcaggagaauugcuugaacccaggaggcacaggcagcagugagccaggaucgcgccccugcacuccagccugggcaacaagagcgaaacuccaucucacaaaaaaacaaacaaacaaaaacuacagauucaaauuuuuaaauggguacauuugaauuaucuauuuaaucuuuaaugaguguauguugguagugauuuuugagaaauugaucugugucauuuaaaguugcugaauuuauguguguagauauguucauagcauucccuuauuauucuuguauugucuguggucucuguagugauaucuucuuuuuuauuccucauguuaguaauuagugucuucucucuucuuugucauucuuuuuauagguuucucagauuuauuauaaaaaaucuuuuguggucauuguuuucuauugccuuuuuucuguuucagcaauuuccuuguauaugauuuggguuuguuuugcucuacuuuuucaaauuugauuuaaauggagguuuaaaugauuaguuugagaauuuuccucucuuauauacgcaguuaaugcucuacauuuccuucuaagcacuucuuuaucaucaucccaccagucaugauuuuuaaaagcuguaugcucaagucccucagaguucucuuucuccaugcauucuguagucauauaugauuacauuuccaaguguuuauagauuuuaugguuaucuuuguuacugauuuccggucuaauuucaguaugguuagagaacauacuuuuguaugccuuguaauuuuuuuuuuuuauauuugguaagguuuguuuuaugucccaggagauugucuaucuugguuaguguucuauuugcuguugaaaacaauguauuuucugguacaguuggguagaauucuaguaaugucaauuaaaucaaguugguugauuguauuugugaguucuucuauauuccuguugauuuucuguguaugaguuguauugauuuguaagagaguauugucucaaaaguuaauugugguuuuaucuauuucauuguuguuguaucuauuucaaagcuucauugucagguguauugaaguuuaggauuguuauaucuucuuguugaauugacucuuuuauguaaugucucucuuuaucccugguaauuuucuuugauuugucugaugucuguacuuugauauuaauauaaccaucccagcuuucuuuugaguaauauuuguaggugugguuuuucaucaguuuaccucuaaccaccuacauaaucauauuuaaagugaguuuuuugaagauagcauguaguuaaauaauaucugucuuuuaguuggauuguuuagaccauuuacauuaaauaauuauauuaaacuauuacguuacaucaaaucauuugcauaaaugaaggauaauggccuaucaucucuacugauauuuuuggauuuagaucaaccauuuaacuauuuuuuucuuuguugccugacuugcauucuuguuucuucuuuccaaucuuugaguuguuugagauuuuuuaguaucuuauuuuaauguaucuacugggauuuuuaguauaucccuuuguuuauuuucguggguuuucuagggauuaaaauaaucaaacuucucacagucuccuuagaaucaguauuuuaccauuuauguggaguauaacuuacuauuacauagguauccuucaugguuauguguuacaucuacauuuuaaagaacucaaaaaagaagaaucauguauuggccuagauguuuaacaugucuguuccuccucauguuccaaguuuucuuuccauacuauuucuauucuaucugaagaacuuacuuuaacaauuauucuagaacaggccugcuggcagugaauucucuuugccuucauuugagaauaucuuuguuucacugucauacuugaaggauauauuuacuggauauaguaacaugguuuacaguuuuuuuuuuuuuuaucucaguacuuuaaaaguuguuucgacuucauucuagccauuguaguuucuguagucauucagauuauuuccauuuaagaaaugucacuuuguuuuggugauucucaagguuuuuuccguguuuuuaguuuuaagcacuuugauaaugaugucccagagugugggcuuuuuuuguacucauccuguauaggguuugcugaacuacuugaaucuguuuucuuucaggaaguuuugugaaauuugaaaaguuuucuguuaauuugugaaauauguuuuguguaccacauuauuuuuccuuucuuucuaggaucccauugacaugaaaauuagaccuguugguauugccccauaggucccuaugccuguucauuuuuacaguccuuccucuuuauguuguucagauuagaugauuucuguugaccuguaugcaaagucagugagucugcuguugagcccauuccuugaguuuuucauuuuaguuauuguauuuucaaaucuaaaauuuucuuuuguuucuucguuauaucuucuauuucuuugccaagacuuacuaaguuuucauucauuucaagcguucuugcccuuaacuuagagcauuuuuauaaccuguauuauuuccuagucauuuuguaaaccucuauuauuuccuagacauuuugacuauuucauuaugguacucuggcucuuauuuaaagcuuauggagaauguugacauauauaauuuuuaaaucuggcaauugaccuaguuggguucguguuuaaauuucugcugggcccuuugugcuugucauuucaaugguaguuaaguuugaaagucuguacagugcucuucagaucuucucauguuucugcuaccgguggccagucugggaacuugggugguggucuguucaguucuuaaagccacccaggaccagauccauacgugugcaguuuggggacgcacccaggaguucacaaaugacuuuauguuguuccucccucuccaaagugucucagugcuuucuacuucccuagaccuuuccuuuuugugcuccagccagaaaacuaggcuuuauuuacccugcuuugcugcacauauccugugacugcaccuacagacggggcaaagcagcagcagaaaagagaaaggagaaaaaagcagugggguuuacuccauccucuugggaccacagcuccucugauccgagagaagaguuuuccucuuuuuguguuugaagcuuugcgagucccugugcugccacuguugcugucacccacucugccaccucaggacugcuuguggacuggggcucauaggagcagggagaugagcauaauagagaauucucccuccucauuaaacauuaggggacccauucccuucucuuuagcccagcacuagaagguuucucuuguagcucucucugucuaagccauugcccacugcccagguuucaggcugcauugaauccaggauugggaaaaaaaaaauguuaaacugagugcuguuuucgugguacuucgaauucuggucucuaaucccaacuucucagagucaucaaauagcuguuccuugcauucuggccagauuuuuuuugcugcucuauguggaggagagagggcacaauguguuauuccaucuaaaugauuuuucuuauaaagugcauguuccuguuauauucaggcaauggaauauuauuuaaugcuaaaaagaaaugagccaucaagccauagaaagacauggaaaaaccuuaaauacauguuaccaagugaaagaagccaaucugaaaaggccacaugcuguaugauuccaacucugugacauucuggaaaaggcaagauaagaucaguguuugcuguugccaggggucaggagggggaaagagcaggaacagaggauuuuuagggaaaugaaaauacucuguaugauacuaugaugaugaauacgugucauuguacauuuguccuaacccacagaaugugcgacaccacaggugaaccuuaauguagguuguggacgcugggugauaauaauguguccacagagguucaucaguggcaacagauguuccagucugguggggcguggguugucggggaggcucugcauguguaaggucagagggaauacgggcaaucucugcaccucccucucaacuuugcuuugaacuuaaaacugcuaaaagaaaaaagucuauuuuagaaaaaugugccaguugauuucauauuaaaauaauuggagaaccuggugaauauaguuaaaaauuucaggugauuuauuuaauaacaaagaggaaacagaauuauuaaagaaaguauaaugcacguuggaaguacauggaguaaaugccacccauucccuuuagucuuuaguaguuagucauggcucucuuaauuagcuucuuccauacauuuuugggauuauaucccuuaugaccagggauuuaguguagcuacuuugaaagaugcugaaacuucaugaugaauuuaaaaugugugccacgccuuucccauacauuugucaggcagccucucuguguaucacuggguuuuuagaaagccaagccauaggauuauucacugucagugcaggacuaguacacagggcaggcccugaugguaauuugaguaugacaacagcuguaucacuccuuacaggacugcaagugucuuaggagaaaagcauuuccccggccaccugccgccugcugcgugggugcugugauuagucacaaugugcauugugcuggguguguuuuguaguuuuguuguuccuguaauugacaguuaucuccaaacugaaaucgucuggaaaagcagaugcuacacguugggggauuuuaauuuuccuguucucuagaugauuggugucauuuucauacuguaaaaaagugugcuguuauuuuugcuuuugguagaagggcacaugguggggcuggucuaucacugccuggauuuggaggcuugagucaagaaccugucuaggccaggugccguggcucacgccuguaaucccagcacuuugggaggcugagguggguagaucaccugaggucaggaguucgagaccagccuggccaacauggugaaaccccgacucuaauaaaaauacaaaauuagcugggcgugguggcacacgccuguaaucccagcuacuugggaggaugaggcaggagaauuacuuagaacaugggaggcagagguugcagugagccgagaucgcgccauugcacuccagccuggcgacagagugagacugugucucaaaaaaaaaaaaaaaaaaagauccugucuaaauauagcaugcuugucuccccaggcagcugggaggaggggccugcaugaucauagaugagggugccuuguccaccuggcucugggcucucacugagcaugcucuuccuugggacggcuucucaauucagcuaaucuccagauuagauucacccuguuuggugugcaugugugugggagucucugugaauguggagcuucuaaauuuauuuaucauuugauacggguauugcguucuaguauuugcagagcuggcacucaaggcuggccacuauguuuuuaguucagagauaugauucagagagaugauuguaguugagacgucccuaggggcccgcuguugauuuguugugucucucugcuguacuucacgcaggcacagagaagagaucaguaaauaacgaaaugaaucugcccuaugauguugacagauauguccucucuuacuugcuaguuccucagaggcagcuugggaauauuguuggguggucagaaaguauuuagagagucugggcuacaagugacaugacuugucuguccaucugcugugccucuugaguguucuuaccuggcucugugcccccugcucucacaaugcccugccgugcuggaucccuguagcaacacuguaggggcggcauuguuaccaccuccauuuggcaguguagaaacuacaaugggcagaguauuccacccuuguaucucucuagcagcccguccaucccuuccucuagcccgcuguccaacuugcuauuuguuagugucuaauauacacaccaugaauuagcccaaagucgggugggcgggaugagggcaccgacucuugcugcgugugagcugaaguaucagagagagauuaccacugugugcucaacaguccugucgucaauuuuuaaagauauauuuuuuaacuuuuuauuuuggaauaacaaagaauucccacgucgucuucagcuagaugccacagauguuaacagguguguuugcucuauucucucucuccuucccucacaagcacauguguguauuuacacuucugcaugcacacaugcacacacacagaugcacacacauaccuucucucuuagagcaaggcacacauauucaugaacucacccucaggcuuccgugagagcagaccuagcccauuuuaacuuagucggucauuggcuugggucccugcgcauguguggccgucauggaaacagggaaggccuuguucugugccuuggcaaugagcaucccuggccuggcucugggaaggaugacuggccugugauccuuuccuccaggugcugcuuugguagagguugaugauggggccucaguggagcuggugugaggacaggagggcugugucauugucuucuggcccucaccaucuguguguucgcugcucccagaugcaucuccuuuucuguggugcccucuccuacauuucaccucuuagcuggucaaaucuuaugagccucagcugacuccucucccuuguaugguaaaagccaccucugaacucuucccuuucugggcccaggcacccuuaagggccagccaacaccagcguccagcuuuccagaaugcccuuggguuuuccucccaucuccuggaggugucuuccuucuuaccugccugcucacucugcaaggccuguucacaucuccccuuugccccacacagcugcagcucccagccaccccagcucagcccuggcaguguuuacugcgggcaguggguugugucugugucuccuuucaucccccacaccuugugcagucccuggcggguuggagguguuccuuaaagcuuguggaagguuugaacgauaaaugacaaggacuggcauuaucaagaggggaaggaaaagccugaaaagcaagaaagcccacaguggauagggcuuguggcaggcaaggccaccugugugcagucccuggguauggcccguccccggccggaggagcuuccacagggugacuccuuucauagaagcucagguuccauucgccuuucccagaaggaaccccaggacagggcucccaggaagccacagcaggaccaacuuacauagcucuuggugcugcugccuuuuacugccacgacaguccccagccucccugaaacaguuacucauggauuaagaaaugucugagaacagcuucaaaaugugcugugcaugagugcugucacccagcccauaucugugaaugccaauuaaaaugggcuccuuagaauuccuguguuauuguaaacagaagaaguugcauggucccagagccucagugcacauuuucauuuaugagcuugauauuuguuucuucaaacaauucuucccccaauguuuaucauuuagaaaagccaaagggcuuuuguaggaaaaaggaugaggcucauuuccauugaagaguaaauauaaggaagauaagggcuucuuuauuaaaacagacaaccucacaaaaccccggcagagcaggucagaggaaaagaaaacaagcaggggagagagaggccuacagccccuaaucaggcuguggaaacauucucaucaaucagcauggagacaggggccuugauuuuccacugugaggggaagguggaaucgccagccuucugggcucuguguuuucaccguuguugggacaggccuccugggugggcugcgugcggagcucacaagagcagucacggcuggugguggcugguggcggcugguggugguugguggcggcuggugguggcugguggcagcugaugccaguggcggugguggugguggcagguggagcuggagugcacuguugcugagggugccuugagagagacccaggggagaauuccccccagaccugcucugcaugggcugcggugaccacauguggccguggagcugggaucucagaacagccaggcccugucagacagaacuggaggcagugguuccccagcaaucaaaaacaaauccucguuguaaaaagggaguacugaaccuugacauagaacuuucuucaauuucgcacagcauuacuggcagagggaaaaaaccaggaggauggaggggacuugugccucaaaauuuggauacaaaucagccuuguucuugccucucccucagguccuuugcaggagggcagccuggacacugugcaacuguccccuccacagccagcccuugggccucuccccuccagcccgcaggggugaccccucucucucaugugcagagcagaacaaacauggagcggcuccacgugcgucccucaccuguccugagccucucccguccucuucagcccugucuuuguugcuucucacugcucugucucccuggaagauggagguucaggcagcaaagaguugaauugcacggccagaugauuuguauuuuaauuuguuaauaucgguguuucccacuucagacaaagccaugugcguacauaugcagaccuaaaaaucaaaucaaaugauugcuaucagagaauucuuuuuacugaaaguaucucagaaaacccugaaaguaucucagauucccaaaugcugaucuucuaucuuauauuuuaaaacaugacugguuuacaaaaauuaauacuuacacuguuguuuucuagaauacgucuguuguacaaggcauggcaucccugaacuuggaguuuucauaugaaagucauuuauugaaugaaaauccuccacugcacaaauaggaaaggacauuuugagccuacgcacaaaagugugcuuaaugaugggcuagaguauuucagcugagcuccugaggcucagccuuccauaguaaagucacugcaucugugaaaaaguggucuucucugcccagcaccagacauccauucugugggguacaauucuuuccuucuuucauggauaaugaauggucagcuuggcugguuucuuugaaagcaaagacuaagaaguggaaugcagucaggagccuguuguguugaugagacaaacagaugaaggggagcucaccuagagcugccucaggaccaugcccaggaggacacauucaagauuuuggcggugauacagucagcacuggaggacaaaggacagggugcucuucuccugcgagcagugagggucaugugcaguguguuugggagggaagguguguuugggagggaaggcguugcagcaaggcugggugugaguuugaagugcugugugucuaccguguggggagugaagcgggaggcggcccaugcgaugcacagcuggcagcugcagguccugugcuggggaaggggagcgagggccucacuuaaggcauggacuggggggaacugugagcauggugguauucgaggcuacgauguccuguggucuaaggagagcauuacagggaagggaggagagcccagaacagaugacugaagaagaucgcauuugaugggugagggggacccaacugcuacagggggaguuggcgucaccagagaaaacagcacuggguacgugaacuguggcgguucgaugacacuucaaaauauaaacaccuaaaauagguuuuaugaggcguuggcauucccaaaacacugaaguguuuaaguauuuugggaauuguauuuaauuauugaacaauuuaggcaaguuagcuauuuucaaauagguaaaauuaguuugucucucugguagaacuugucauucauuuuuagaaucuugaguuuuaaaugccagauagauccagcugcuauaaauaugcugcagauguagcuguccagucacucagacaggcaagagcugaugauugaggacuaauuuucagucuaacggcagaagcaggugucacaagguaagucagcuucaaggcuucauucccugaugucaaugaugacuuccuuaggaaugucacugcagauauggguuuguuuuuguuuuuugguaaaugaggaauuuuagauagugguagcuacuguucaccacacauaaccuuuguaacaagcuagaauauacauuaaaaauucacaaaguaugcagcuuuguauuuugagauaacuuucuuuucuuuuucuuuuuuuuuuuuuuuuuuugagauggagucuuauucuguugcccaggcuggagugcaguggcacgaucucagcucacugcaaccucugccuccagguucaagcgauucuccugccucagccucccaaguagcugggauuacaggcaugugccaccaugcccggcugauuuuuguauuuuuaguagaggugggguuucaccauguuggccaggcugauccugaacuccugaccucaagugauccuccuaccuuggccucccaaagugcugggauuauaggcaugagccacugcgccuggcuuugagguaacuuuucaaugcccuauuauuugacuuuuauuccuuaagagaaggauguuuuuguuguuguuguuguuguuguuguuguuguuguuguugguauuguguuccauagaugaaaacgcagacauagagagggggagaaaugacuggacuuguguaguauuaaguugucuuuaccugcagauaagagcagaauugugacccuagaauugugaauuacaugucuuagcccaauggcuugucuugggcuuuaauuuagacauggggagacucccaaaguacaagcuuugguguggaaaugccagaaaaacaucauuugaagaaaugccucaggcccuguguguccaauuugugcaacccuuugccucuuugaguguuuuagagguccaagcgcaauuucacugauauuuucagaucuagauuggaacuugaagagccauggauuagucucuuuccugagugugcauguucccaauauucugaauuuuccuuuuuaaagcuccaaauuuaaaugauuuuuuucuugcgucgcccaugauggagugauaaauagggagauaaauacugaugauucuucuaauuuuaacuauuuuguaguucuggcuucccuggagugaguauaauagaguaguugaugaggauugccucuuggaaucggacugccugggaugaaacauacacuaugaauugugagaccuugcgaaguuauuaaaacccaagcucaauguuauaaucugcaaaauggggauaaaaucuagccuacuggaaaaaaaucauaccuugagugggguguacuuguaugaaacaacagggagcggagggaacugaagcaugcaauaguagaaaccauuuaugugcccugauuggcacugaagauugcucacuuaguuaaaugagugaguuuaaaauguuaaaugcuuaaaaaauaugcauuuacauguauugagcaaucuuuugauagagggccauguccagaauucauuguuucaguuuguuuguuuauuuauuuauuuauauugagacagucuugcucugucacccagacuggagugcagugauacgaucuuggcucacuguagccucugucuccuggguucaagcgauucuccugccucagccucccgaguagcugggauuacaggcacacgccaccaugcccauaauuuuuguauuuuucauagauaugggguuucaccauguuggccaaacuggucuuagaacuccugaccucaagugauccuccugccucggucuuccaaaguguugggauuacaggugugagccacuguguccgacugguuucaguuucuuuaaagccagcuaagagcaugcaaauaauugugauuaaaaucugagugcagaauccugaaacugaugaguuuuuucccuccucagucuuuuucaguuuccucuccaucaccuaaguaaacuuuuaucgauuuacucauuuuauaaagcagcucaccuuuguuuuucuuaaauauuuaauguagguuucaugagacucaugcuacgcuuucucugugcacccauuaccuucuguaaaauuaacuagugggauuaaagcaguuaaccgugacugacguaaguaguugccuccuggugagaauauccccaaacuggugagaacagaaguguuggggcuuacuaaggaguagcccagcagcuccaaggaccagccaguggguuuacaaaaagcaaugaggaaaguguggaaugaaguggugcauugagcaggagccagucuagguuuagguucaggagagcauggugugcccugcaagcuuuccugcuuuauccugugggucaggaaucagcagauauuugcagcuuuguggcccuguguuucuggugacgacgcaacccugccauuauauggagaaagcagccauggacaggugacacgcacugaggcuggugaaacaauacacagacuccccagcguggagauacaccaggccuggcggccugucccaagcauuccugggaguagcagggccugugcagacccuaaaggauguagaggauuuagguugaugcagaggaggaagacuggcuuguacacacuccuuagcucaugaccccccuacugucuguauaggaauaauuaaauugaacaaaaauaaguuaauaugucaguacuauguaccaggaacaaacauacauacuugcaaauuucuaaaaucugauuucuuguuuuuuuuugguuuugauuuuuuuuuaagucgaauaauaaaauguauuuuaggcacauaguaauuauugagcaaauugccaucaagucaauuuugaaaaaaagaccuuugggucuuucagaauucuuuuugcauaacuuuaguguccguauuuauuauuucuccuuuuagcaccucuguuuucucuagaaauauucugccuuuaaaguccagucucaagguagcaucugaugauggugauuaaauuuauguugucucucccaggaauauuuguauuugcauuaucuguuuauccagugaaaaaacauugugucuuuaaaaaauuauuuaaguguaaggaagccggauguuuuugucuucugccaaaauucacccuauguucccuuacccucucuuccccacgaggcuccugagaacagugccuggcacguagugggcacaucauagauaugugaaugaaugagcauauugaggaaauucaggacucuaaccaagaauuugcaucuuuggaggagaucuuguuuugaaaucuuucuugaacggaacuaccacuauucagcaccucagagccagucuuggcucugaguuuugcuauauuugggccguauaaagaaaucuuucuaggguaaacaucuucuauuucccucuuaaaagggugcauuuuauuucgcuccagccaagcccugugugcucagacagguguccagauucagcuccugucacagguuaugccuggcaaaagugcucaugcaacaacacaggugcuuuagaaccugaguccauuucagggcauauaaauaggccgcagcugaaaacauguccguugggaacuuuucagagccucuguauuuucuuaacuugcugacuugaugaaguucagcuagagggaaggagaagcugugcacagguggggguguuauucccugugucaguauggccgccagcaggcucaggauuuucuuuggugcuuucuccugccacguccucagucuggagacagagcaccucuugucucuugaccaggguuucuuggauggggagcauugguguaacugugaacaucaauuuucuaauugaggcugagaaaacuaauagaaagggucuauaaagaaccucuagaaaagcaguuucccuuuccucacucuggccuucauaaaauacagggucguuauggugaaaccaaguggcuguggcauuugcuguccucugguuuaagcugaguguaucuuguguguuuaccuggaagcagccacgggcaaggagagcaguggccggagcaggggcagggcugugacauggagcccacgcuccugagcacaccucugccccccacguccugccgaugcaccacccagaccugccuagugcccgacucuggaggugagggacauugcguggcaguugcgucuggacccugugccacuuaccagcagcacggcaugacaagugcuggccucccaucuccuucuuaccugggucacugaugcaugaugugacuuaggaccccacugcuguacuguuuucuguccccuguguggaugcauccuggcuuauucagccaggccccuaaaggaaaaaugagccacuucugcccucccauugugaggaaaagauccccaacacaugggcuuuuguacccguccuuccuucccugcaguuuugauccagcaguucugaggcuugguggggggcugcaauuuggacacagaagcacuccccaucccaggagugcuuggggacacagcagcuauacagagccugcugcagcggguggcugggugcuggcgccuucuggcuggccucccuccaucaaccucgcuucccuggggugcacucccugcugaagggcuggcacaacugcuccagcuccagcugugucuucugggaagccugaauuuuuuuuuuuuuuuuuuuuuuauugagacggggucucacucugucacccaggcuggagugcaauggcgcgaucuuggcucaccacaaccuccaccuccugaguucgagcgauucuccugccucagccuccugaguagcugggacuacaggaaccugccaccaugccuggcuaauuuuuguauuuuuaguagaagcgggguuucaccauauuggccaggcuggucucgaacucccgaccuugugauccaccuaccuuggccucccaaaaugcugggguuaugggcaugagccaccgugcccagcuggggagccugauaaagacaccuguguucuuauuuccacaucugcaaaagggaauuacucugugauccaccugcuucacagggcugugaagaucacaucccuuaaacauaccuaacgcugccuugcacagagugaaugcuuaguaacucuucuucucagcguucaucugcguugcaggaagggugguaggaaagacuuuuugaggaggaauuaaguguccaguggguggaagugucuaguggguggauggugaggcuguuagugaaggagcuugaggguccagagggcagagcuuuggcagaggugauuuuucccacaguggaggguuaccauggugcagggugcauugauugcauuuuccuuuuagacaaauuacugggaauagugaucaugcucucuucuaguccuggaucuauuguaacacucauucauaauaaaauuccuuguuacauauuugccuuccuggagugcugaggaagagauuucuuuauugagagugggcgagaacagugccccagacggcacguggaacugaggacacccgcagcggacacagcgccugcagggcaggagggaggaaggcuguccaguccucaucucuaccaccaauaccagauaccagggcagggaucuuccacuugauaaaguaauagagccguggucucaaaaguggagguacaggcccccgggugugcuucgugauccauuugggauaaggaggaagugaauaaauuugggaagagaauauuuguuguuucuuuccaaaguucuuuuuuuggccgggugugguggcucacaccuguaaucccagcacuuugggaggcugaggcaggcggaucacuuguggucaggaauuugagaccagccugggcaacauggugaaaccccgccucuacuaaaaauacaaaacuuagcugggcaugguggcaggugccuguaaucccagcuucuuggaggcugaggcacgagaauugcuugaaacugggaggcagaggcugcagugagcugagauugcgcuacuguacuccagccugggugacagagagcaacccugucucaaaaacaacaacaacaaaaguucuuuuuuuguguguaauuucuguaauguucucaauauacuaguaacauguauaauauacucucaauauacuaguaauauauauauauauaaaaauacaaauaaaugaauguaugaaaauggaaguagaggccucaagucuuugcggauggggcugugcuguggagguucucuugagccccugcucaccagugcagguggcugugagucagguccugcgcugguuuuguucuggcucaucugugugccucagaaggccugacacuccucaggccagagugccugccugaacagaggaaaaucuuucauaaaguuuuuuacagcagggguuugggaaaggguaccagguuuggcauuguuaaaaauguagaaauaacaaggguuucagauuuuuauuuacugaaaaaucaaaguaaaugagauacuuauuuuuguucaagguuuucuuccaacaugggccuuuguguggccucuguauuuaugcggugggagagugguggugagcggagauuucuaaaaauugagaggguaucuuugauaccuuuuggguuuaucgcaaagcccuguggaaauccugaccaugauacaauguuauaugcuuuuuauuuguaaucguauguuauuaagaagcagagggcauugaugucgaaauguaaguuaauagggaauauaaaaaugggacucauuuugcaaauuugccuugggacuccucccaagggcaacuccucccaacccugaauuggguuaucucaauaaaaauguuagguuucuuggucuagguguccauagcacucaaaaaacauguggaaaaaaacugugugugggugcuugugucguagaguccuuuccuuccguccauuugugggaaacagggacagcccuugcauaugccauguuauuuguguagaaguacuugcaagcagcagccagaaaagccguuucucacuuugucauuuaaaauaagaaucaguugaucuuuuuuuuguuuuguuuugagauggagucucgcucuuguugcccaggcuggagugcaauggugcgaucuuggcucaccgcaaccucugccucccggguucaagggauucuccugccucagccucuugaauagcugggauuacaggaaugcgccaccaugcccagcuaauuuuguauuuuuaguagagaugggguuucuccauguuggucaggauggucucaaacucccgaccucaggugauccaccugccucggccucccagaaugcugggauuauaggcuugagccacugcaccuggcaaucaguugcucuuuaaagcaaaacuaaaaagucagaaauuaaguuaaugacagcagcuuuugccuauaauacaauuaguuuucaaucuauauuuuaccauguauuuaguguccauacagaagaugagauaauuuauuguuuuguaauuaauuugcccacaugugauuguuucuuacaaaauuaaaauguuuuagcagcaugugucacuaauuacuuaaaacaucagaauuugccuuucuguguaaugaauauuauuaaauauuauguuaaucccagggggcuuuuaagguuguauauuacugugaaaggaauugugaauugaaaaaaaaaugguagggaaacgccaauucacuggaucacaucgauccacuggaucacaucuggcuguaacuuucauuauaaauucagagguguaauggaaaucgcauaugacuguuucuugagaaugugaguggauguacauuuuauguggcaaaacaucugccaguccacguggacaguugauccacauggacuuugagccugucauagaagccugagagccggggcagggagggaggguugcagaggaacaggcacaggcugcccuggcagggacagguguccggagaagccagcccaccuaccugccccuucuuccccucugggcaccucagguaucacaucauccagggcuuucuccugguugggguucuguggguggcccuggcugaggggcaugcucuccuuuucacuguccucugugcacaugugcuuugggucuuugaacugagauaaguucuauuccuagggcugcaaacacccugccucaccucgaccugugaccuugcuagagcagaggugcagccuguccccauccagccuggggagccuucugcccuaagccugguggcgguuugccugguggguguggcugggcgugcuggggucaguggauggggaacagccccugcucuggguuucucuggaacccaguucuucugguucuccccucuccacagcuauuuaacucccaacccccaccugcuuucccaggucuuuaaaagcagguguggaugcagauguggcacuacccuuguaaagcagcagugaggcugaaacagaugagcacgcgguuguuaaaggacugggaacacacacagaaaggugucagaaaugcccugagguucugcuguguagacuuucuugaguggggcaucagaagugcugccgcugguugucgggcaucgggcugcuguugcaugccccuucaggaggccuucacauuggaaacgugagcaugagugaccuacugagggccagaggccucugggcauucugggaugagaaggaagcugcacuugacaucuaaguccucuuccaucccacaguuuaaaauggcauacaguuaugggauauuuccuauggauaugaaaucugauuucauaugcacauguguaugagagagaacaauguaaugaaccuuugguguacacuccaacaugguauauuuuauuucauuguauaccccacuugcccucuaccucagcugguguguuuugauguuaucaaugugcauuuaaaagcauuuuguucauuuuucuucaaguguuagagguugcuuuuuuuuuuuuuuuuuuuuuuugggagauggaguuuugcucugucacccaggcuggagugcaguggugugaucuuggcucacuacaaccuccaccucccggguucaagcgauucuccuuccucagccucccgaguagcugggauuacaggugugcaccaccaagaccggcuaauuuuuguauuuuuaguagagacgggguuuugccauguugaccaggcuggucucgaacuccucaccucaggugauccacccguguugaccucccaaauugguaggauuacaggcgugagccaccaugccuggccggggguugcuuuuuaauuauauuuuguuuugcaauuauguaaaacauccaacuguuacguagagguguccucacucucugugcccuguguggcugcauccuggcuuauucagccaggccccuaaaggaagaacguuugagccccuucugcccugccauugugaggaacagauccccaacacaugggcuuuugcacccauccuuccuugccugcaguuuugauccagcaguucugaggcuugggggcugcgauuggaacucagaaggcaucucauggggaccaagcucagauagaccugggccggcguccuggcucucuuccucacuaguuuuguugucuuuugacagcuacauaaucuagguuucaguuucaucuucuauaaaaguggaauaacagcaccucccuugugagcugucaugaaaacuaguugggacacuaagaaccuaccacagugccaaacucaugguuagcauuccaucaacuuuaguuaucuccuguccucauuugaaauggggaucauaguccuuaugucaacuguuuuuguauaggaaucauaucaaaauauuuaguaguugccaagaaaguguucagugacauaaaaauugugucauuaucagcagcacaauccaauaaaaccagucuggcugguucugucucccaggccuugcugggcagcccuugaacuuaacaaucagaccugcuggugcugacaccagugagcuggacagccacgccugggaacucuucauccucccagguacuaaagcuucaacuaaaagcacucaggugugggcuccauaauuccccaccaaaguggggaccuccacccacugugugaaaaaaaaaaagaacuuuuuuuucuguuuuauugucuugguucauagcucaggcccuugccagcacuuugcagggcuucugaaaugcucuucugauuuccuuccuccagccuccuacuuuccuuauccaccccccauauugcugccaaaagcaguuugugaaacauaucccacugaccauuuaucuuccugcuuaaaacaauccauuugcucccuccuucucacacgugggagugcaugagugugagaccucgugggcccuccccaggccuccuggccugugugcucuugcucauaggagccuagggcuggagggugucucuugcaccuuuccccagugcaguguagaugacaggugcuguucacagguaggaccugcucccagggccacccucggcuugcggguggcuuccggugagcuggggggaacuccccaacuccacacaccaccacuuuguauuaaugagaauguggcuggcgacaccuccaugucucuuaacacugcgucagggccccacugaugucaguuccaccugcccugguguggagacgaggcucguccgugccucaccuugcccagcuuaccugcuggacacugacuucuuuuuccagaugcagcccagggcugcugccgguuccaguucccaggcuccuggcaaguugggucucaaugccucugggcccugcccugccuccuaccagggguugcugguagggcgugggcagugagggaaggacagcuucuucauuauugcccucuucauccuuguaucccagcacucacuccacagccacugagacugcccugggaccaaccggccccugguucaugcuuuaauacuggcaugucuucacacacaucugucauguaaaucacuuugauuguuugccccagacguccaugugauggugacugcauggcgaauguugccgccagcacccuguugguucacaggcauggcgacuuggcgcugccugucgugacuucccagugcauccuuccugugcgcucuuacuaggcuguccuaaccgggccauuuucccugagggucucagacccaguccugagucgcaggaguccuuucccauggccaccucgcuguggaacuguuuguaugguccuacugacuuccucucuucagcuucugacucugacacgguuucguccggaaacuuccuuuucugaccuuccuggccagggucucccuccucacuuuccugucaccuccuggggcuccuuugaagagucugccccuccucugucccugccugagacauugggguucccaggugugccccugucuugcaccugcacuucuucuucugccuuguguucucgaggauguggccuccuggggcugggccacugucagacuccacuuuggcucugugcccugagccagccagggcugcugugcggugagugcggugagccuggcaggagcgcugccacuggccacauucuuccugcaccaucagcacgggcccaccccucuccagcuccaucccaaccccucuccuggcagcuuuggacuugccugcccagagggugccucacagaaucuggagcuuagcguuccucaggcugccuucuuuuuuguuuugagauggaguuucacucuuguugcccagguuggagugcaauggcgugaucuuggcucacugcaaccuccgccuccuggguucaagugauucuccugcuucagccucccuaguaaggcagaugccacaauucccagcuaauuuuuguagagaggggguuucacgauguuggucaaggcugguuucaaacuccugaccucaggugauccgccuacuucggccucucaaagugcugggacuacaggcgugagccaccgcgccuggccccucgggcugccuucuuucaacaccuccagggccuguacaacugggcuuggugcacaggccagccauccucccugucaggcaucaccucagauuccuccauucccuggugcgucagcucuccaccaaacaugucaucacacugcuguguucuuagcucagacgaaaucaccauugguguuuuguguuucgcaguagcuuuugacucuagucucaccuucauucauucauugcacagauauuuacugugagccugcuacucaccagcauuuuaugcccugggaacacagccaugaauaugacaggugaggucucccugcaacucugacacauuauguucuagugggggagauagagaguaaauaaauaaaguauaauuucuggaagugauacugaguuggaagagaguugcaagggcugcaguuuuuuuauaggcgugugccaccacgcccagccaaaggcugccguuuuggaugggcugucaggagagcuucuuugaggagguuuugcuguacauguacgccucucagugaagagaggaguaagccaucuacuguguacggcagcaugugcacaucuccugcgguggggcugagcuuggcgugugugagcagcaggaaggcaggcaguguggcaggaguaguggggcucuggggagaauggcuggaggugaagcaggagagaugggcaauggagaagggguauggagguuuauaaaguucaugagaugcccucagaagguuuuggggaaaggcaggaugugaucugagccuacccucccuaucccuccagagaagucauggcuaaaugcaagugcccuguuauugaccugccuggaguccucugaggguuucugccaccucugggauaagauccaggcucugccgccuggucccugcauccuuuccauggcugcccugcugcacacugucaguccccagcugcagcuuaccugcgaucccaguucuucacacaucccacaaccuuucccaucuucuccuguagcgacccuuccuuaugcuagacauguccuuaucccauucugcaacacauagcucaaccagugccuuggaauuguccccucaggccacuacccucuuuccuagaaagagcaucugcuccacgagcauuguauaugagccuuucucauggcacaagccuuggugucuugaguguuuguuuaucuguguuuccuaccagugauggacuugcaucagggagggauccuguuauccucauuuguggauguuuagaaucuaucccagauacugacccauggaagauaaauaguaaaugucuuuugagugaaugaaagaaugaauacaaaucaugugaucuuucucccuuuuuauuuucaaugcaaacuuuacauauuauccuguucuauaaaugagauagacaaaagccacuucauaauuuauuuuaggucuuuaaaaauaguauauggucuugauagagugagugccaucuuccccaugugguagaguuacgcaugaucaguagcuacaacucuagaaagauaauggagcaagagcaaagaaaaaucccuuugguuccagaaaaucuccugaaaaagaggaaggcuuaucaaguccucaaagccacccaggcaaagcagacacuuuuggagaagaaggagcagaggaaaggaaaagggcucaaguuaaacgacuggaaucauuccuauaugauuccugguggcagaaacgugacaagaugcaucucagaugacuagaagugaaaccucaugccuuggaauugccagauaacauuccuuggccuuuauuguacgcauugaaaggauuaaugacaugaguuuacuggugcagagaaccauggcaagacuucgccuaaagaaaauuuuuagugguaucuuuguaaaagucaccccccagaaccuaaaaaugcugcccauaguggaaacuuaugugaucuggguauuuccacaucugaagucugccugggaacucauuuugaaauguggaugagccaaggucaagaauaagaccaucccucagacagacaacacagugaugaggagcaccaggggaauuuuggugucauuugcuuggaagaccucauucaugaaauugccuuccuggagaagcauuuccaggagaucucaugguuuuugcgcccuuuccacuucucaguggcccaucuugcuaccacaaauagaguggguuuccucaaggagaugggccccaccuggcugucggggugaacacaucaaucagcucauccaccagcugaacuagacccaggugaggcagggcugaaaacugcccuugggcugacuuuugaugggucaugccuugccacuuaaaagugcuuuuugcaguuacuaguauuccuauuaguaaccgugagauuggguuacucuuuuuuuuuuuuuuuuuugagcuggagucucacucuguuccccagccuggagugcgguugugugaucucggcucacugcaaccuccaccucccagguucaagcgauucuucugccucagccucccgaguagcugggauuacaggcaaucgccacugcaucuggcuaauuuuguauuuuuaguagagacaggguuucaccauguuggucaggcuggucuugaacuccugaccucaggugauccaccugccugggccucccaaagugcugggauuacaggcaugagccaccgcgcucggccgagauuggguuacuauuaaggguaacuuugagauugggaugacagaggaggcugguacuaauagaugggagaccuucugggagcgaugaaugccugauuaggacauuaggcuaugcauagccuaagaguuauaagcuuaaagauguugagugacuaaaaacuguauugcuguggucauuuagauggaaauggggaaggaauaauauuaauaacugauuucaaaaaggacuuaaagauaugaaucauuuauuuugcugaagaaaucuuaacucuuuuugaaauuacuuuuuauugcuauuuguuauuacucuuaagugccacacugcaguaaauuuuuuucaaugcaguagaagcauguguuuuugcuuuuuuggggaauuuuuaucaaguauguucaaagaagauuauuuccugcuuuaucuucaaaagcuggaaaggaagggucaaagaaaagacaguagguuauguucauggcaagcaccucucaucacaguccaauuccaaggaaaaauuucaguguuuucuacauuggcugccgccucgucugaaaucaguacauuccauggaggaaggaguccugcuuuguugugucaucuguccuaggguuuaaugucgguaaaugaguaacucuaccauuuguccaagggucccuaagacuccugcagugaucaaccaagcccagggacauaauugaaucuggagauuccuggggcuuuguuuugaaaaagacuugaaauauacauaggaagaauggcacaaaaauaaauguucacuugucucuucaaaaaaaaaaguauaugguuuuaaccauucauugaagaguuauacacuuuuaaauaauagcuuguucuuuuaauuuauuuaggguagucaguuauaacugucuucacuaauuaaguguugcuucuaguuauaaaaaaguauauuuugaaaagagcuaccuuauuucuaggaaaguaauuuaaaaauuagcaaacaaguacacuauauuacagguaaauaaauaauacauuuuccuuguuacaacgaauacacugugucuuaaagcuuagcuuuaaaguuuaauuucauuaaucaaaacauuuccucauugauuaucaauaccugcuugcaggucuuauaggaauagacagggaagauuucaucaaaaucugagugaacuuuuagugcuuuuguuaaucuaucuguuuuuuuaaagaucagauuauuuuacuaaauauuaaaauggcucuaguguacaaauucuuucauauuuggugugauuaaugccaaauauuagcaauauuuuuagaaaacagaauuuuaacugaaauauauuuuauguauacaucuuauaaaauuauguauauuuauauauagguuuaucuauaaauauacauaaucccagaauaaguaacuuggucucaaaugaaagcauauucaaucuaaacauugaaguguauaagccuacuuucuuaugcagaaugaaccuuugcauauugcuugacgguauucuggauauaccaaauuaauuccaugauuuauaaaaucgugguggugcuugauacaguucaguguauguguccacuguguucuauuccucuacuuucuuuagauaugcuaucguuuauccucagucaagccaaaccagaagaauggcauauucgacugcauuguuuggucucuguauuuaaugacuucuacugaguggagucuuggugugauguagguuuuauugaggggagaagcaacuguuggaaaaccaucuuuguauuuuuguuuuuuggcacguuguuggggacguaauucacuauugcacaccaugucuccagcaugagggcugcagggcacugguucucuggaucugucuucuuuuaucuugagacaugggagcuuugaaucuggcuuugcaucucaucuuugccaugaccgcuaggaagcucagagccucaucuugcuacucuggaaugcaggcuaugcaacaauauaugugacacuuccacuggacugguuuaguuucugcucuucugggcuuccucauucccuguucaagucucguguauauuuuauauaauauaauaaaugaguaaggaaaauuaguaaaggaauccuuagcucugcucuggugcuauauguaaaauuccaugucuaagaagaguggaauuacucacuuuaagcaguaaauccgggaagcagcugucagacaggaaauauuuuugaguaaaacaauauagugagguaauaaaacuucucauuagagcaccuaucaucauuuagccaguuggugaccuucaucaagucucacagcuucucugggcuuucauuuccucacugguggugguaguaacacuugcccugccucugccugggaucugugaaaccacgugacgcuugcaggagugcucuggaggcccuacuagggcgauugaguggauguggauccggguaguggugcugccccagggcaucuuccacgguguuuuuccaugagauccgaacuccugagugaaagcccaggcccacguggguguggucauugccucuucguuguguucugaaauuggacacagccugugaguuauugugugcacugaaagccccagcagugggcccuccugacacacaaagacuugcuuguggcccugggagucagcuuuccaaagagccugagaguggaauggugggacccgggcuccugcagggaauuucauggccugaccuuuugugccucggcuccagcccuuuauuuagugugcuacaguauauauagauugagaaugcuaauuuguucuuugccagcuaaaguacccagggcaauaugaugaggagucaauuuaaaggacugcugucuugggugggccgccuggaaacacuccugccuuugugcuugugcuugauagugcagcugcuacgacagugugacauggaauucagggucucagcugagccacacggcauuccagaacacauuucagaaauccuuuaagcauggguguguuagaacaaggaguaaaaauagagaccaagcuuuugguggagagaaggcuaggugcuggcccggguccccaggccucugguugugagaucuggccuugcccucaggagcugggcuucucaaacucugcacaaucuaagggacaaagcaggggcugggcuggagucucaucggucagcugaguggccgcaucagguggggcaacauucagggccugcauugcuccugcaucggcacaccaccuugaugugaggucaucggaaccuccugaggugacaccacugagugccuggcucacugcagccccgugauucauugugagucucugcucucuacccuaagcccuguggagcccuuguuuuugccaggaggaagugaucucggcagagaacuuuccuagucgugccacuggucauugcuagaguaugcucaguccccuucuuuguucucuuccaugggugaacccaggccuggccaaacuucugagcauguuccuccagacccucaaauaugcagacccucccucaugggaugaacacgaugcgggaaugaaagacaacuggucucacugcaagugaaggaggcccuggaggauacuguuccacauuguuucucuaguuuggucccuaauaauuuuauaaagaggagauauaggaagggcugcauugugguuguugaugaguuucccagagaaugaaucuuaagagucacacaauggguuggauguuacugucucugacaguaacacugaugacacugcccagcagugccucgggcagcaguuccucauuuuaucuuuguaacagcugaaggaggucgcuaggauuauucuucucuuaauugcaucauguauuuuaaauguuuguuuauacgcaagggaagcuugcauauucuacaaagcagggucagaaauaguguaaaauauucagauugauucaggcuucacauggauccugugauuuaguguuuagugugacuuagcuuucagaaauauauguuuggguagcagcuugaacuauccacaacguacuuuuuaauugaguggggagggauacauagagauugaaucaugguauaagauguaacuuuuuaaguauuguuagagcuuuuaaauaguaaucagcaacugagaaaccaguacaucaaccacauuuauucagcccuuugauaaggucugaggaagaucacgagaaaauguaacacaaauugaaaucagcugcccaaggguugauguuuuucaccuuaugcaguccccuucaugaggucagaugguggcuguggagcuuaugaaaaagcugguguucauagacaucagugcaucuuggcugcuggacucauaagaacucaguaggccacuuucuagagaauucuagguagucaaccauucuagaaucugauugagaagagugguggagaggauuggggguccaccuguaccucaaagaggauggaaaaaugggggauggaaagagagggaaggaagacagauaacaaggguauaugugcacauuaccaggauguuguuugaauguuggccaauuuguuuugguuugguuuaguucaguuuuagauuugauguugaaaguaguuuuugucuauuuguugcaagugaauaguguguuuucccuuauauacaagucuauauguaggacucaguuuagcacaaauaauacuucuguaccagaaggacuacaguauaaucaucggaggucauacgccucucauccuuccauuuucuucuaaaacaguuggucacagucuugccucaucuaugaaggucacuuuacaucagccauaaaagugaaagggaaaaaucauuaugagcugacauggagugauuugcaguaaucauugucaaugaagaggggacauggaaauuguuuaugguauauaucuuugugcaagaaagaagagaaaauaagaauaaacacauauuugcuuucuuuugacaaaaaaaaaacaacucaaaaaggaagaaugaggaugugugggaaugagguauccaacauaaaaauaggaauuagauuucuuugaauauggcuugcuuauauaauuuugauuuugaacuacacaaguuuuuauauauucagaaaacagaauagcaucaaaauugaaaaaggaaauuuuaaaguugaaaaacagaaacaaaggaaucuaacugucuaaaguugauaacacaacugcccagaauaaagacuuaauucugauaauuuugaacaguuuucugaccauauaucuuuauuggaacauauuuuaagaacaaaagaaauggcaaauaacuguugagauuuaucugguacaauuauaguugguaaugguguuguguuguaauucuuaaauuauuuuguagguauuguaggugguacaaaaaauaaaauacaaugauguuauugggaauggaaguucuaacuguggaagaagggcuacaagcagugugaauucucucacucuccuuuucacucucucuauaauuagaaauacaaaauaaauagcaaugauaccuuuccaauaguuacauuaacuacaguuucccacauggauccuuggagaaauggcugauuacagaucuugacaagguugugccugggguaucuugugcuagaaagcaagaagguguucaaaggccuguggaguacaucaaaacaaacccaggaguaggcuugcagggccuccugcuggcaagaguaaucguauuaauagauuguaauauauuaaaagauucaggagucugaaguguuacucaaauagagagaaugucaccuuaauaaauucagaagaaauaaugcauuuuauuuauuuauuuauuauuuuuuugagacggagucuguugcccagacuggagugcaguggccccaucucggcuuacugcaaccuccgccuccuggguucaagcaguuguccugccucagccucuugaguagcugggaucacaggugcccgccaccaugacuggguaauuuuuguauuuuuuaguagagacgggguuuugucauguugagcagucuggucucgaacuccugaccucaggugaucugcccgccucggccucccaaggugcugcgauuacaggcgugaaccacugugccuggcuaaaauuaugcauuuuaaaaaucaucauuuugcaaccuugaccugggcaagaaucauguuugagugcuaaaaucaccgggugaaagauuguuggagaaugagauauuuaugcguucucaaauauuaucucacagauuacuacuuauaaaagagaaaaaaaccauuacauuggaauaaucuagaggccagccucuuaaccuacugcuuaaauugaaccccuccugcuggggacaaccugauacuaugugccaauauuauacccuuguauaaugcuaggagaaaucaccuguacuccucuguaguguucuugccccaaaaagcuuuuaaucugaauuaugaagaaacaguugaacaaauugagagucuuuuucaaaacagcugcagugaagucuccucagagaacucagaaccuucaaaacauuaggcuaagugaaagaagccagucacagagcaugcguauuguaugauuucacuuaugugaaauguccagaacaggcaaauccauagagaugcaaaguauuaauacuggaucagugguugucuagggcuggggagauuggaagaaaaaaagggggugacugcugaugcuaauggguuugggauuuccuuuggggaugauaaaaagagucuaaaauuguggugauggucccgcaacucagugaauauaugaaaaacauguacaauauauugaauuguacaauguaaaugggcaaauuauauggugugugaauuauaucucaauaagccuguuuuuaaaaagccagugucaugaaaacaaaacaaaagcacaggggagaguguucuaaagagaucuaauaaugaaaugcagugcacgaaccuugauuguauccuggauugaaaaaaaaagcuguaaaagagcacauaaggacaucgaggaaguuuguguuugaauuauauguaggauccuauuuucuuagcugugauaaagguauugagcuuauguagagacugcucuuacucuuaggagacaugugcuaaaggacuuuagagugcagaacuguuuuuucagcaacuuucaaauaauucagaaagcaaaaaugguuguguguguguguguguauacacaugcaaguaugcauagaaagggaaaauggaucauggaguaguuugaggguaguucauuguaccaaucuuucaacauuuuuuuaggcuugaaaauuucaguugcuucucaucacuguguguucaaucugacagauauugguugaguguacaccguaugucugguacugugaucugggcaugcaguggggacaguaaacauugauguccaugccaggcaauaaucucugaaggauagagaaugcaauauaacuuagagauaugaucccugccuucaaggaucuugauauggaucuaaaucuugauaacuagugcuagaaauaaauucuaagcaaaucuaaacuuuuguaagcuaggagcagcuuuguaugagucauucggcagaggucauuugagaaugaucacacaugggugguuuaaguugucacaccuuuguauagcuggcagcguccugaaacgacagcacagaauccucucucaccaacaaguucccuguaacacaaaguuguuaacauucagccuucaccccuggaauauuaugagcuaauaucguguuggauauauuuuguucuuugagcuccuagaguuaauagcuauguaguuuacaggaagcaaaauaccuggcaugucauauacauucucuugguguccuuuucuuaguauauuuuacguguucuaauuugcagguucgaccccgguccucugccacucaggugaccuuuaacaguugcugcucgagauguuacuauuuaaaauuuagaauguauacuguuaucuauuauuagaauaugauuaucauuaaguagauuuaauagcacuguaaaaaucaucacaaauaggucaauuauuuucaauaguaauuuaaagcagggaaccauaaaauauaacaaguaauaccuuaguuauuuuaaugaaaacuuagagguauguuuauuggccaauucuuugauguggcugaggccccucuuuugcgugugggcagagcugcuguaucagucuuuugggccuuccagcauaaggguucccagucaagggagcaagagggacugaaauccagcccauugucacucagcaagcugugcauccauagcuuugugugugaaggacugccaccuuuuuccagcuuacauaauaccuuaguuauuuuauuuaugauggcuuagccauauggguccaauguuuaagguucaaggacaacuucguaaaccauuuuaguaauauaugaacuagaaauuucaguuuguuuuuuaaaaguaccuggacaauaaaagauacuugcacacaaauuugagaaguaaaugccucuguauuuuuauaauuccucccacucugucauuuucaguuuucuugcccacacucaauuaaauaauauuuuuuaaaaauaaagauagccuuuauaaaauuuguccacagcauuuuacaaaguuuucuuggaaccaucaacuauuuuuauuuucaaacuuuaauuucaucaguuuacauaauauuuaauuacauuuuauaauuauaauagcauaggcaacuggcaguaauaaauuggugagcaagacuucuaugcuuugggaauuguaaaggccaccuuguaggaugaguucucugaguguguaccagucacuuucuggcugcaaggcuguuuggugcgggguggacacaggcccaucagaaagagggcagagcugugauuaccaggcuggccagcugguggagguuugucaagggagugucuacucuguauuuucuuucuucuuuuuuuuuuugaaauggagucucacuguguugcccaggcuggagugcaguggugcgaucuuggcuuacuguaaccuccaccucccggguucuaguaauucuccugccucagccuccugaguagcugggauuacaagcaagcgccaccacaccuggcuaauuuuuguauuuuuaguagagacaggguuuccccacauuggccaggcuggucucgaacuccuggccucaaaugaucugcccgccucaaccucucaaagugcugggauuacagguguuugaaaaauguucuucuucaagccaguuccugguucaguuuucacagccagcucugcagaggguuugaaugugagccucugugcccaguuuaggucugguggcuccuggcagcauugucugguaauccaguuguuauucugaucaacagaagaauuguaggguggugaaaguggaaaaauaaagcuuuuauugaggagcaaaaguaaaaggaaggugucaaaucagaacaaaggugauuacgaagaaauguggguauucucugcuuggagaagagaaguuacaaaauuuauuauguuaauaaaaauguaauuagaaggagugacauuggaaucuuuccuugucuaaucuaucuuugaaggauuuaggaagacauguccauuucuggauuccaugcucugcccucaucucagacaugacucauccugugagaaugguuucacgcucaccuuuccaggcauauguccugugggaaggaugaugagagauuuccaggaauguuucaugcuuaggguuaagcaauagauuuucugugucuguuuguuguguucaccucauugccuucccuuucaaggauucuguuuugggguugcacguccucaugucaccuaauggauaguucccuggaugggggcccccucacucaccacaggucacagauagccuugccuugaacaccauucaucuggaucugauacacaggaguucugagagacaagagauucacaaauggguucaaaaguuccaucauuuaaacauauuuaauagguauauaugcagacuuggauaaauaaauuauacuaugucuguuuuagaaaaagauauguucagaaugggucuuaaccugguuuaucucaguaucuuuuccaaaucuuaauuacauaaugggcuuagaaaaaguaaauuuuuguucagacgauaaagauuguaaaguuaucccugaauaaauuuguaucugagguacuuuuguagcuuuggggaugacugaauaauuuucuccuuaaaaauuuaaucacuaggcaacauuguugugccuaugcccauuauucugucugaggcaucuuucauuuuuauuuuuuaaaauuuuguuguuaaaauauauuuccuaguucuuuuaaauuaaaaugauuuguauuuagauauuuacaaagacuggguagauugaggaguguuaaaacugauauaaaccaaagacauuuugugccauuagaaaauaaucuccaaagaaucauuuguguccuauuuguaaaauggggaguaauuuaccacuuguguaauuuacaugcacucaaaauacacauuuuuagaccccuauccuccgucuuguaccauccaacugaaugugagguugaauaacaagaaccaauggaucgucugacaguuuuuuuuagggggcuggcugugguuccuggggucuucugaagugucuugcuggugucuccuugaggaacugcaaagcccauggucgggacauuuugcuguucuucucuucccuuccaauuaaguguagucuuccccauaaaaucguaucucuuauuucauauucuaaaucaacgagauagagcaauauuauuuuauauguaaguuuuaugauaugaaucguuucauaaccacggaugcacaguaggaggaaaauucuuuauauuaaacucuuaucuuuugugccucaaagugguagacucuguguuacaauucugugugcaaagccuguuuugcucugucgccugggcuugaguguaguggcgugaucucggcucacugcagccucccccucccugacucagacaauucucccaccucagccucccgaguaggugggauuauaggcgugcaccaccaugcccagcuaacuuuuguauguuuaguagagacggggguuucaccauguuggccaggcuggucuugaacuccugaccucaagugauccaccaccucagccucccaaagugcagggauuacagugcuggaauuacagacaugagccauugcgccuggccuuguguuuguuguuuauuuauuuuuaacuuaaguagaauaacccuuuggcgucuucuuucagcaguaacucagcugauuggucugccuuaggauaauuucaauagggucgaauauggcaagaaccagccuggccacuguuugcuggagugaugcagaccuucuaaagaucacuuugaauagguggaggagaaagacuccccacccccugccaugaaugccuuuauguuaugggagaugggagcaagcuucagccaugagaugcuuccauagucaccuugucccuaccuguccaguguccaccuuuguauacuuucuucaaaagaaaaauaaagccaccaucuccccaauucauccaaccaguugucuugaaguguaagauuuuaaaaauuccuauuucguuuccaauuuucaacacuuccagggaaucuguuauuuauaccuugcuagcaggaaccucaggagauccuguccaaaagacugguucugauaguugagagggaacagagaacaugauuccacuggcuguggguaacaugaagagacagcaccacugagaaagcagaguggccccgaaagaagagagacuccaagcucaugguguuuguuagggccaaucccaauugggagucauuugggagagucuucuccauggauggccucuggccuuuaaggugcaagccugugacuuaacguggcagaugggagguagaaaggagcugaggcuucugccuugggcauggaagggugcacggucaccacaagauuccgcgaugaccacagguauccgcugguuuugugaggcacugaguccugcaggcccgcacugcuugguguuugcagggaggcugcaucuguguuggcuauggugacuuacuggggcgugcugggcucuaauguuuaggacuugguggggacagggguccacccuaggcuauuuugggaacacacucugauuuuucuuugaaucguucaauguagucauuuauuguucauguaguuuaaaaauaauuaaaaauguaaaugagucaucugcacaaaaaaagcccauuuguucuugccaaacucuggaagaagucugcaaguaugacaaucuguguaacugauagaaucuacaaaucaaggacaucauggaauugcaaccacaauaacucuuucuucauaaacauuauaaugcuucauuaaucagcguuucugcauuuuauuugaaugagauagaaguuauauggcccagaucuaauagcauggccugugcuacacuguacggugugcaggcaggauucucucuccaccucacgggggcugacagccagaccagcagggauguuggggcugggacaaggucagggcugggcugugugccaggggagaauuuucuccuggagcuuuggggagugagccaugauuggaagugggaugagaggaugggcaggaggcccaggggaggggaauugcuuggugcauguguccugcugacaacaaacagcauuuacuaugggcuucugagcugucagggacagaggaggcggccccugcugauggagauggagcuccugcuuggauagacuugcugcaggccauuugucucccugguccaaauuauacaagaaaaugccaucuucuucauagagucuuuugucuuuuuauuucaaguaggaaacuuacauacuugcuuuucugcauuaaggcuaggauauuuauuuuuuuaguuuuaaauucauggagugauaaaaagaagugugaaauauuuucuaaaugcuacuagauauuuuuaggccuuucuacuuaaaaauaaaugacacauacauaccacaugguauaauucauagauaucuucuuugcauuugcagagaucuuugccauaaugaaaacuaagucuuuggauaauauauuauuuuugcuaaaaucauuuccucacaaaauuucaaguuacucugcaggcaggauuugucccuuaccuaacuuuguuuugcauaauuugauaaugucaauaagaaaacuuuaaaagugccccaauguuugaauagugccauaugguuugcgaggugccuuuugcuuauuucacaucacuuaaucccagccuugcuuuuagcuaaacaguugugucuaucuuauugccccucuagaaccuuucugagaucugagaccauacacuguacuaucauuuauguuauagacucccuaggaauuaccuuguaaaugguagguccugauacauguuuguagaaugaaugaaacuguauuucuaauuuuauauauuuuuauauaucauuucuucuauggauguaauucauucauuggacagauaccuguugagcucacacuucagcaagcugcuguuagcuagucuggugguugagacagaauuguccaauccaagggaggaagggaaucaguacaaauguuguagagcuguggagaaaguguuuaguaccgcagaauuggaaucuuaauuuaggguuugcagaaaauacuucuaauuucagcaggaguggguagggaugaggagaaagugaagaugaaagaguaugggcuggguuuuagaaggggcugguguuuuguuggacuuugauggcaauuccagguagaagaacagcauccacaagacucuggagaugugaaagcaggaguuucagggagcuguggacuugcaggagaagggcgugugggaggcagggaaggucaucaugggaagaggcaacugaucagguccguuagaguguggaggaagccuggcuguaaaggcgcggguuucggaagcuaugaggaaauugggacauuggguguagggcuccucuuuggaggcguuuccucuuuugaauggaaggagguguggaaagaggaaggaaagaacagucucagcuagcgagccaagacagggagagacuaaagauaggagagcagagaaaaaaaugggugaagccuuagaagagaugugagcuuagcccuuuucuggaacugcguuccuugcaggaacucccuggggucucugcagacagaggcguggugaagguggagcccaggacaagaacauguugggcgaggucuuccgggacuuggaauggcugcagcaaugauauaauggggcugagagcaaugagcaggaacaucuaccugagggcccuguuggggucaccgcacgugacuuuguggggagggccuguuuccucuggcagugucuugcagccugggggaaagcugaggcacuuagggauuggaacuggagcaugcugugggugagagagaguggccguaggagaggcugggccccaugagacccuaucgguuuggugugaaagggaggaaguaccucuguauugucaaauggcagcauccacacaacucucucuaucuguggccagaauauagaguucccuaauugaagguuuuggacaugugaguggcuauuacagcagccuggcaaagaaggccgugugauugaacaagucaagaaaccaugaaguauuugaaaagucaguguuucuguuuaugccuugguggaugacagcagguguacaggaaggaggacagcaaauacccacuacagucauggggcaccggggcaugcugguccaggcgucuguagaggacuuagacauucuccuuggagugcggccuauucuuguguuuacauuuugcaguggaacaugguuugcagccucaguucucauuggcagguugugcacuggguuucauccuggagccuugagggugggagcugagcacacaugugugugcagaaaacugugcuggagaggagggcgugggcagagccaucuugcagggaccaacauggggaaagcauuuucacaugaugguuuaucuuuccuuagcugauauauuuuuuaauuuuuaauuuugaagauucacaggagguuagaaagcuggcacagagguccugguacccuccccaguuuccccgugguugugucaucuguaguauaggacaauaccaaaaccaagaagaggacacuggcacgggugcccgccacgugcacguccucacaccugaagguccaugcaggccagacacggcaccgcuccuucaccccaagaccucccucuacccccuuucaggcacagccaccuccuccugccguccccaacuccgacaaucacuagucuguuuuccauugcuaugauuuuugucauuuugaggauuuuauaucaguaggaucauacuguacgugaccuuccaagacugcuuuuuuucacccagcguaacguucuugggcuccacccagcuugcuauguugccuccuuuuuccugcugagggcuagcccguggcacgggugcaccagaguuuaacuguucaccaugauccccacaucauguuuucauagauauauacaagauuauaccuuagcucauuuuuaauuguguggugaguauauaauuuuaaauuuccaauagaucccguaguagcagcugguauugagugcuuugcagucccaugagggcagugacaucaccgucaccccugugucaccacuggaaccggagguacagaggggugaggugacucgcacauaagggggacaggaagucacaccccagcgucagcuccaguacuucugcuccccgcacacagcugccuucacaucagugcagcgaggccacaacaucuuuucagcuucauggaauagcguccagaauagcccccaccucagcacguuggcuugaacguguucucuuacaucaguucaugccauguuuugcccauccguccuuagugggaccaacgggacuggcucacucauccaagcagugccaccaaggcgaguuuaacaagcgcagaaaauuggucuggucccagcucugugucccuucauaccuggucauccccuccugggugccuggugacuuugggcagcuucccaagggagcacccagcccuucuucuuuggggccuggacuucccuugguagcgguuacccugggcuuuccucggugucagguaccuuguuggaugaaccagcugugcggaggugauaauguuggcauucgacagggccucccagagaggaagcaccugggcgagugggccucuucuacccaggagucggguucagcucugucuccagcucuuccagggcccaauucucagaacagagcagaugguggguaucuagcuguguucaaauccuaaguuaacauuuucuguuuguggaucuuaugaaccugaagaucauaacauucaacagcaucaaguaggugaccucagagaucagagucaauuuaugggugaggaauuggcguauagcagggucgguggacagcucagguugaugacacucuggaacuuucuggcaccuuuuuuauacuguacaacauggagcugaguccagccaggacagccugugauaccagcagaggguguccagcuuccugugucuugagcaaagaauuggacaaaaugcacaaacaaagcaaggaaagaaugaagcaaugaaagcagagauuuaucaaaaaucaaaguacauuccacaggguuggagugcacccgagcaagcagcucaagagccugguuacagaauuuucugggguuuaaauacccucugaagauuucccauugguuacuugguguacacccuguguaaaugaaguaguggcccacagucagucugauugguugugggaggggaccaaucagaggcugaagugaaguuauaaaguuacacccuaugcaaacuucugauugauugcagaaagugaccaaucagaagcugaagugaaguuacaaaguuauacucuuacgcaaaugaagacuuggccugagaccagacugguugugagaggggaccagucagaggugcuuucaguuuuucaucuguacgcaggaaaggggaguagccucuggucuuuuuguuacuugggagugcaaaguugggguuuuccuuuugauuuaggucuaggaagucagcgugaauuggccuuagggucccugucuccagacauuacucuccugccucaccuguguuaucuuaucccaugugagaggacuccucccugaaggaccccuagcacuucucugcaggauggaccuugugagcagcugaggaacgaggaucaugagucuggaagaggcuuuguuaccuuuuuaaaaccaugugaagugaggaaauacugacacacagcaguguuuggcugccagaguugucagccuccauuucuccuugccauacguguucauuugucacauguacagacuuccauuucaucaaacugcucuuccaaugacagugacuuuuauuuuuuuaaaaaauauagauuaacuuguuucucuuccucuggagcaggagcuacaucacuaaaauguuaaucggugaucgugggaacggccgaggagcauugguuucuuaaugggaucugcacaggggagcacccaggccuuccgaggggaccagcucugcccagcacugagugccuguggggagauauguucucacuggcauuugguucauuuauguucuaaaaugaguuuagacacugaauuguugucaugaauaacaugcaaaauaguguguauugggcugcaaauauagacauacuaaguaucaguuaguaaaagaauguuuaaaaguuuguguguaaucuuuuguuauuggagggacacguugagacuucauugaagcauuuaccacauugugaucaaaacuggaauuugcucucucuaauaauccuuaaaaaacaacagauggugcaggaccaaggugcugugcccacucguguuuguuuacuuagccugaacaccagcaggguuaccagguccuauucuggggcagggaaaggcuggaucagauacagcucugccuuuaaagcacucacugccuggaaguggguggguggcaaggcccacugcucaccagucaccaucaguaccucugggauagcccuugcuaggcuaggaacuguugaacagccagcucuccgaggaaaggguggucucguaaauuucacuuauaaaaaggauguguaguaccuaauuuaaaauaauaguaggcugggcacggugguucaugccuguaaucccagcauuuugggaagccgagguggguagaucaccugaggucaggaguucaagaccagccuggccaacaugcugaaaccccguauuacuuaaaauacaaaaagccaggagugguggugcgugccuguaaucccagcuacucuggaggcugaggcaggagaauugcuugaacccaggagguggagguuguagugagccgcgaucgcgccagugcacuccagccugggcaaaaagggucaaacucugucucaaaaaaauaaaauaaaaaaaaaauauguucaguacucuuuaaugcaauuuccguagagccaguugcugaucauagaugcuuuuguucacuugagccgcacucaaguccauggccacgcuguggcugcucugaugaaggagcucaguucugacaugaauguugauggauauuuucacuuacaaugaguaaagcaaagugagaaagcgaauguuagaauguccucuuuccuucagugauaugagacuuugcugaccuggauuaaguguaugaauacucacaguguuuccuuaaauuauuaugugauucacaauguggaagugacaggcaggaccacuugugagugugaucugcauugucaagauuuucucaucaccauccuaggucuuggaccaaggcuuggcaagcuguggucaacaggccagauccuguuuugguacagccugcaaucuaagagugguucuugcauguuuaaagguauuuuuuaaaaaaauuaacaggaaaauaauauuuuguaauauauaaaaaaauuauaugagauucaaaauuguguccauaagugagauuguauuggaacacagccaaguucauucauuuauauauugcauuuuugccacaguggcuaagcugaguagcugugacagagaucauauggcccacaaagccuaaaauguuuacuauguagcuauuuauggaaaauguugcugaucccugaucuagacaaucaauaaaacaacgugugccuugauuugucacauuugcucauuuccauggcaaaauaccaugaccguuaaccagccacuaaagugagacaugaguguggagcugggcagaggcuguggcaacucccaucgaguaguauucuuaccagaaaggggucugauccaaaccccaagaaaagguucuuggaucucaugcaagaaagaauuggaggcaaaucuguagaguaaggugaaagcaaguuuauuagagaaguaaagaaacaaaagaauggcuacuccauaggcagagcaguagcgcgaguccugguuggccauuuuuaugauuauuucuugauuaugugcuaaacaagguguggauuauuaauaaguuuuccuggaaaggggugggcaauuccuggaacugaggguucacccccuuuuuugacauacaggguaacuucuggacauugccauggcauuuguaaacugucauggugcuggugggaguguaggagugaggacgaacaaaggucacucuuguggccucauggcuuuggugggauuuagccaguuucuuuacugcaaccuguaaucagcaaggucuuuacgacuuguauuuugugcagaccuccuaucucauccugugacuaagaaugucacccagcaggucucagccuaauuuuacccagccccuauucgagauggaaucgcucugggucagaugccucugacaguauuucuagccccagacagaauggauuuuaauaaccccaaagguacagauaacagugaaaucaguaggaagugauaagggcugcauauuuauuacccuuauuuuuaauguauuuuauuuaaccauaaguuuauauaauuuacuuuuuaauaaugaguacgcuaccagcauuccagaagauuuaacaguuggcucuugagagcccuaugagcugguuuuagggcaucuguagcuggguggaggggaggcuccuucaccggggacucccgggaagaagaauuuccugacugguauauuuagggaugaggcaggguugccagggaaauaagagguaagacuucucugcagaggagacagcagucagggucacagggggaaagaggagcacagggucaggggccaggagcauuguggugggggcugggaggcugcuggauacacccugcacugaagccuugaguaaaaacacaaaaaagacuggcuaguguguauucaaaaccaacauuuuucccccuuugcuuuaacauaagaaaagacacagccuuauuuuacccauccccuauucaagauggaguugcucugguucggaggccucugacaauuuuguuagggcuggcggacaaagaguaacuucaguguaaguuacaacugcucuacccgguguugcugcaacugaagagagguuuucacaggggaaaugagagcucugccccgcuacugucauuuacugagggcuucacacagaagcccagggaagggcaggggucuccuucucaugagacccaguauguggagggaacugcagggaaaggaccccggaguggccuagccauccuugcuccaaagaacagcacuucuguuguucucuaagguacucagguguggaagucauguggcuuccgugcuucaggauacaaaacugguaguugaacaaaucuaccauggcaaauccaaaccaguacaguggaaggccuggaggcggccaagggagacccccaaagccgcuuggucccagcguccucucuggucacugcuggcugucagcaugguggcuggcgugggccaucuuggucagaucaggcucagguggaacuuccuuuuccuucuucguuccccuuugguaccugaggggcaugcccuggaggguguagcccuggcagguugugaggaugucaacagagccaccugugacaucagcaguuacuuccugggcuggacuuccagguguaagcagacagcucccagccuucagagagaaccacaaagcuucaggaacagaaauccugucacacccuuuuggggaccuggucacuguauaaaacaccauguaaauauuggucuauucuaauacacguuuuguuuucauuacugaacacguuccuguuucugaaauagaggcagcccuugaauuuuuuuguuuuuaacggaccaugacauggcccaaggcacccuagcauggggaaaauaugacaagcauucuguguuuuuaauaauacuacauuaaacuuucaaaagcuaguggcaaaaauguagacauauggcauauguauuacuacacccucuccuauuuuggaaguuuuuuuuuuuuuuuuuuaagaaaaaaaaaggguuaagggacucacaguuuauguauauugagaucggcaaaccguaaaaguaaauucagcuguuacaucuuagugaacuuauuuuucaauauuauugucauuuguguuuuaaacuuuaguaaaguuacaauguaauauuauuuucaacauaggaaacaaaaguguugucuauggacaaauuauuaugaggaugcagagaaguaaacuccuuuauuugcuuaaaaucuuuguuuuuuuucuaauaggcuagaauuaagaugaaaaaauuaacuuucagcucuugugaguuauuaaagaauuaguuuacuuugugagugcuaagucaaagcaaaugagggacaggguggcagaucuggagucuggggagggguaccauugaacucaugcacauugaggacuuccuugggccaggcccagagcugggcauuucgcuucaucauuucuguuuugauuugaaagaagcagucagggagaaacugcaaggaaggaaauauucccuggguuuuccucaggccaguccagugcagaccggaagcagggcacacagaaccaaaugaggugguuccuuccccacacagcccugucaagcucagcugugaagaggcgagaccguugacccccugaguuccugcuacagagggagggcaguggaggauggagacagggcagagguggguuuaggacaccgacccugcugcauucaucgcagacaugccuuguuuuuugagugcaucguguaccagaugccuugaccacauuauuuuauauacuacgcauugcaccugggaaguagguauucccauuccccuuuacaggugaggaaugugagcugcagagggacagcugggaaguagcagaccuaggauuucaacccaagccccucccuguuagugcccaggcucuuucccaaggcacuacccuaaauuucagcucaagccagggacuuugaguuugguucuggcugaugagaacaccaagcaauaaaaaguguaaguuuccagucaugagcugcuucauucagaaggggauggaucccuaaguuuucuuaaagucuccuucaccaggagugaauggguguacccuccugcugagccccaagccuccuccccgugacccagagcccugcccuguccuguccucugugaggccuucaugcaucuccccuggaaaaauugucucuuccucugaaugguucauaagauuucucauuucugcccagugccuguugcacuguaaccucuaccucugaaucccccucuauguuuuaaaucacuugcaaacagaaacuggauuuuuccauuucuuagauugucccagcacuccuuguaagggcucugggccucaguuuucugucuguuaagugggaugaccguuccuggcuagguugccgucagaggcuugguauguugguacauuugaguguuggucagcguuaguuuccuuccacuggaggacacaccaagugagcccaggccccugcuuacguaaaaggggaaggguuuuuuuugaaaacauuauguuuuuuuuccaaggggaugucgggguuucuguuaaguuuuucucauuucuuuagccaagcugaaguguucugccuuggcggggaguagaagguggacugugugaauggugggggcccucucggcccaggaagagugcaggaggggguggguagucagcuggaaaaguggucuguguuuuugcugaggcuagagagucagggccucccauguugggccaagcucacugccugacuuacaauguuuguugugcuuuuguguucuuuaucuuaaagaggccucucagacuguuaacuucaggccccuccaaaccagcaccugcccuguggugcaggguuuuguccagccaaugggaagccguggguggugggcaaagggaagccuucucaaggucagggauguccgcggcuguuuccggugcuuggcuuuaggcugaggugauauaauugcucucuggaaaucacgcacuugcagcaaaaguucuggauauaaaaguucugcaacaaaaacucccaccacaguuuuguaucugguuguucaaggugucugggggcuaaaggaagggcccaagagguucuuggacguaggaagagaugcagggcagcugcacuugcuuagccacaucacacagucccuucagaucccugaccugucagcugucacagcacagcagaccuaacacuggauucccucaauccaaucaagaaagacuggguacaucaaggaaucgcccguccuccaaaccugggggccacgauauaaaacugagagggguuaacuuggagaauugugguguuagggugcauacgaagaugguguguuucuucgugggcugucaacagguugggcugcuugacuucagagcaugguggagauuggaagugcagauuaguggaggaggaaaugccaggccaaggcuggagauauccauaggaacaggcaugagcguugugagggcugcagacugucccucaggacccccagagacagguuguggagggaacagaacuuuuggaguggaauagccucagagauaaagucuucucuuucucccuccauccuuuucucccucucuucucucucccucccucaccuccucuagugcucuuucucucugucucucucuuuccaaagguaacugagguucagguggccccagaucaaucaguaaacccaagcgacguguuccacagcaugugcccuggucuaguccagccugcuguccagcccuggcccuucagucaggguucuguguucugaacuuucuuuucuuuuucuuucuuucuuucuuuuuuuuuuuuuuuuucugaaacagggccuugaucugucacccaggcuagaguggaguggugccaucucugcucacuucagccuccaccuccugggcccaagcaauucuuccaccucagccaccagaauaguuggggcuacaggcacacaccaacacgcccggcuaguuuuuguauuuuucguagagaggggguuuuucuguguugcccaggcuggucucgaacuccuaagcucaagugauuugccugccuaggccucccagagugcugggauuacaggcgugagucacugcgcucggccuuuucggaacucuugauggugguguuauuugggaagugggcgagcccgaugccaggucuggccuugccgggcagggcugugccugaggguggguggccgcaggucuaacaguggacaagaagugcccagaggccacaugguugcucagcagugccugucagagccacucagcucagguuucgccagcccagggauccucugggaggcccagucucuauuuugagagacaguucacgaugaggugaucaagugucauauuuucaacggagaauuaaagguacccaacacuuagcucuuagcucagaaaacaccaguaucaaaacaggcuggcucugggccucuuauuucugcauauuuucacauacccuucuuuucugcuuuucuuacuggaaaguaucuuucaguguagaauaauucauccuaaauaaaauacuuuugccauuuauuuuaagcagugaaacuucuacuuauuaauagaggcagaaauaagauuguaaggugauuacauuugagguaauaaauaacacagucugguuguuuuuauagcaaacaugcacaaguuuguuagugggauugcaacgaaguagucaaaaacaaggccuggaaaucaggcucucuccauuagacauuggcaugugcacauccugaaaacguccguuucccugaacuguggugucaugugaguccguggccccaagugaagggaguugggguucauuuuccugagaaauucucacaguccguugaguuccaaucaguuaugcgcuguguggagagcgggcuagucagauuucacugcuuuucaguuauugacaaaaguacauagaaauggacggggcuuaucagcaggcggcagagaugccuuucagagcgcacggccugcugucucacgucucgcucugcaguuuuugucuuaggauuuccacucgguuugguucucuuuuccacacuuugcuggaaggaacucaauacagcucugcuccuuuuuuuuccccccacugaaggaaaaaacaaacauuuugggugccuuggugaaggcaaaucaccauccuuaauauguucuugccuucuaggucuggcguuucuguucuguugacuuuucuugccccuugcuggcucugugaguugaauccagaagaaaacugucgguuuugccaugggucuucugagcugaaggcagcacugauuuggccagccugucucugcagaugcucauggaaaaccaagguguuuucugucacuauacauaauuagaugccuguuaugccccaaauacaugaugaagccauuaaauaauuuuuaaaauuaauauuuguaaaaauucauucugacauauucaagugcuuaauggcuguuuguauuuauuuucucuuauaccucuuguggacuauuugucaugaccauuaugugugguuaaauuuacuccugaucacuugcauaguuaucuacgauuuaaugccuuaaucauuaaacuaacacacagcgucucugguacuuuucaugugauguggauguucauggccaaacaacccaggaagaaauugaauaaauguucaggagaaagucauaaaaauaucugauugcucuuucuuucuuucuuuuuuuuuugugguggggucucucucugucauccaggcuggagugcaguggcacgaucuuggcucacugcaaccuccgucucccagguucaagcaauucuucugccucagccucccaagugucugggacuacagaugcccgccaccacgcccagcugauuuuuuguauuuuuaguagaggcaggguuucacuguguuagccaggauggucucgaucuccugaccucaugauccgcccgccuuggccucccaaaguacugggauugcaggugugagccaccgugccuggcccugauuguuauuucuuaagaaaauaagaaucccccugcuggcugaaucucaauguagggaugcacuggugggguccucuccauggcucugcuuucucggucaucaguguggcuccauuuucaccccuuccagagcccacagccagauggguugugggaacucucaacucugcccuccccucauggucccccagaaaaggcaaaaggaagagacugauauuguauggugauucugugcuuuuccuuuuuuauuguuuucuucuuccuuuuuuggggggaugaggggagaguuccauuuuugacuaagaaagugaugaugaagaaggugaccauguguagugguuuguagaauggauuagacucaacagauuguagucauucuuuccugauucucuaucugggaugguguuuuggcagcccauagcacucagcucugcaucgucuaccagaacgguccuauuucucagagguuaggaaguucagccucuucugaaugacagcgucaaucccacauccagcugaagcucuccccuucccacccucuacugcacucagguccgaccauggcaggagcucaggccuggguggcugugguuagacuuggguccccuccccccgaggugcugcuuccauggcuggguggggaugaggggcagggucucuucuuugcugguggucagcauaccuucuggugcuacaggucuggugccacaugcucuuguggcguuuaucugcgggugugugggggucccacccucagcuucugccuugugagcccacagccucuccuggcucggcccacccugcacccagcccucugguucaggccccuucuaaguccucuugggucaccugagcccugcagcagcuaccugcuuccaggaaccaccuucugaccucucugucgcaugcugcuguggacagcccuggccagccacccucuggcgcuccuuaggacacaggcauuuguuucaagcuccugcacuuccccgauccagagacucacaucacagugcucccgggcagcuucaggccugcaguucugcagcuccaugucuguggcccuugacccagcccugcauauggcuccccaggaaccccugcuugguuugguagaggauggagaggcaccaggugaggggaggaggccacugugauguccuuacuagacagaccugcuggccauggagacacuucuuuuugcugaucauucaucaucucuuuagcauguuagagggggaagggaagcacacugggguuuccucugcacuagagcaaauagguaagaacagaaggguuugauuccacacuggguuacaauacuuacacuaacugaaggcuuagaucccagccacugugguauggguuuuacaagaaugaaauuacuuaauuuuugccuaauccuguggagaagguguaguuaucccaaauacaacccaaaggaaguuaaauacauuguguuaguucacucacuaguuagcgguggugcugagauuugaacccaggcaguguuaaccccucucccagucacuucccuaaagucuucucucccguaguaccccuuugaucuccacugccauugugggacacuucuagagucaagucuugugugacuuccucuuuugugacuuuacuccauucauucacucacugaaggcuggugaggguugauggagacaggauagcaggggaucugccccacgugcagaaacaccaggguucaaguaaccacgaugugggcgaugaggggugugguggaaauagccuugaaguuagaggcagaucagacagaggaguuugggcuucacccagugggcagagggaccacuaacguguuugcauuaggaagaauggccagauggagccguccuugaggaauauucaucuucaguguguggaaaugggacucaagaaggggaggcaggugaugcaggagauuccuucagaguccacuguaagagucugggggagagaagacaaugccccgagcagcaguggagcagggguggugggaaggggccagcaggaagucagauagaaucccauguguggggaaaggagcaacaguggagcaggaacgggguaaaggaggggcuggguuugagccuuggcagagcuggaaucagcuuggcagucuuuggccuugggaggaagaagagacagagaugacaaugagguagaaaccuuggcacauaaugaagccaugacugaaauggagaggcaggagaggcaguggugccccggagagcucuucauuggguguuguuaggccuagaaaccagcagacugguacagucuccucagguuguggcagcgagguggcagugugcugcaggugugguguccacguaggagagaagcuuggaggaggugugugucugaugggggcagcugggggcacacuccuugcuucucagggcugugcuggccuggccaugccucuucccugcugggggagcgaggucaaccagagcucuggggucugccagucagggacacgguuaaauucaggugauacugcagccugcacagauaaggcagcaggggcuaaagguaggggugugaucuagaggcaugaccagaucccuccauccccaaaccuacugugcccuugcugggaccuucgggcccuugcuuggacaggagcugggagcccgucaagcucacgguguauccaucugcacauauugagcaguuuggccgugucuuuguaguccugggacaaugguuggcagaaaccaaauacggcuuucaagcuugaaaauccaugcugccacauagagacuggcugcaagaaagcagugagcuucugguugcguaguuuugggggauaagagaagaaaaaaaucaaaacuccuuuaggaaaagaauguacuaaaucaugccugagagguggcaagaauugcuuuauacaaauucagcaaaugccgagguuggucagcuaagguacagagcugacuuggcucuccgggaauaauuaggcuuucuccugaagggaucaccugggcugccugcccuggaaaacuccaagaaggugguggacgaaugcaccuugggaaaaggaaguaagguugcugccaggcaucccgaugaaaggcgagcucagcccuuccucccucacaacucucgcggucucauucucauuuuccaggcuuggaggguuugugaacaagugaaccaagacaauucacucacugucuuucugcaaaaugacuugagauuuccguugccgggaguacaggcgccggcaccgcgggcuugcucggggaaaagcugcaucggguggcacauuuaugaauaagucacuagcugaauuggaucggaugccucugcuaguucucagggcacugcuucacucugcacuccucguccagggaagcccaaggagcgguuucuguccguuagcuccuggaacagcguuggcugugcgguagaaagcccuuugugcuccuuuuagggggcaaagcaaacccacuccaggcaagggcaggggacagcuugggauguaugcaaacauugccuggugguuugggaaucaguaaguuuucucugaucuauuccauuucauuuguuaagaauguucaaacuucaguaaacuagcacugcuuuuuuuuuugaaggagauauccuuuuucuauaauauugaacaauguaguaacucaggguuuuaucugaaacuuggaacagggguugcucugcucagcaugagcauggaguauuugccgauaguuaagugauccucaccgacaggcucuuucuucacuugcugggaguugaguaauagcugugggacugggcucucaaauguuccucuuugaauauuuacuugauguguugugagauaucaguguucccauaucuacaggcccuggaguuuaguuuggugaguguuauggauauguuuuguuauuaugucuuagagaauccuaucuagaaagcuaaucuuuuuauguugaguuacugaaagcuucccccacccccaggucaaaacugugaaauucuauuguguaggauuucuuaggcaguuaugaaugcauuugcugcauaaaugagcuuuuauuaggcauuuugaggagccagcuucuacucuacccucgcagagacaagaggccugcuucuuuuuuuuuuaauccaaaagaguaagcgugcuaauaauaauaguaaaaaaauuuguaauuaccaccagucauugagugcuaccugugucucggugccauaccagaaacuuuacaggggucaucucauuuaauccucccauuuacucagcugauaaaagcugaaaucucucucuguucagcucuuggggaaacugaggccuacagauuacaggagcuuaucugggggagaugcacagcguggccacgucguggcuggauuugaccugauguuuuuccagcucuagagcauguaaccaggaugugguggaugguguacagcuguggaguguccuggggcagacuuucaacagacagugccuuugugugcccugaaauguggcguuuugauggguaaagucguuucucccuggcuuauugcuccagugugauauuuauuguuuuuaugccacaauucugugggcugcagugugauuguuucauagacacauauuucagcccuuacuuaucuggaucuucuguugacuguuuuucuggcuuuccguuuuguuugcaggggccaagacaguggggaaagcuuugaugggauuuuccucugauagcucuucuccucuauuagaaggaauucuugucuucacaggaacauugcccugagcuugggaggugcugagcuccaagaaaagguauuacauggauucuuaaucuggagucccuggucaucagggugguuugcagaaauaauguacaaggaagaggcuuaggagucugagacucaggggcauguggcaguuuaaaaagagcagggucucugcacaagucuaaggaagucaucagagcugggaucuuuucuagcuccugcugggcacacccauagcaggugcuccuggcugguggcaagcaggcuggagugcaucuugccuggaagaagguccauggccuucaucagauacucaaagaaguaccugacccuaaagguguauucagggaugcuugagacuaaucuggggucuguuccagcucugccaccuaccucaugucaugccggggcacguccuuccaucucccugugacuccagucuuccucugucuccugaggcaguugaacacaguccccaugcguccaucugagccucguggaaccuugagcacugaaggaaguucuuggaggcccaacucaguuugcaaauaaggcuuguccagaccccacaucagaguaaagggggcgucucuacaacugugugcuggaaaccuucacugaagaguauucucuaaccucaccgcucaucagccggcacugcagggcaccagcguucuaguaugugucaaggaguccaaacauccuagcaucagucugccaggaaccccggugcuuguuuucaagaaguaauuaaggcuggaggcggugcaaaguguguaggugguguccuaggcucagaaagaccugggcuagaauuccagucuuuuccagcugugugauugugagaagguuacuuaacugguuggauacucagccacccugucuguaaaauggggagaauacacuugcauaugaaguugccagggguauugaacauacacaguguggcaugguggcuggaucauggcauguuuagaaaaugagggcuuaaaucagauuaguguuggacucagggaugugggagcugguacaggaugcgaggauuccucauuccccucuuugguaaccaguucugcaggcugcgguagcacucagcugucuucugggcauuuguuucuggacaucuuucugacuuuuuauuauugcugagaaaacugggcacugacuuggcagcugaaucccaacucacucccucacucacucacuuacucacucacuuagucacucacuuacucacucacucacucacucacucaacgcaguggugaccgaauuccuucccugggcccagcacuucacuuaccagugaugaacaagaaagucaugguuccucuucccuugguagagggaagucuacaacuguggcugcaaauaaauagccagacacaaaccagacgcagcuuauguaccgcuuguaaacaggaugaagcaaacauccuauugcugaagaaucucauggagagagaauggcaacucccuucugccugcagcauaaacagacucucuuagccaggagagccgggugugccugguuucucucugaaauucccuuuaagcacaugcgguuugccagcagccagccagaguagccaacaugguaaacaggcacccaugguguagaggugccauucaggucagcuggccucagcaucacuguggauuucccaguccacuuuucuuggacaguaagaaauuguuauaccuucagguccacagaugacauuuccaacuggaaagauggaagauguaaagcauagugcuuuugaacucagggucugggaaaguacagagacgcaugaauuuucccuuuucagcaugcagucccugucuaccucagccugaccagccuggcugggcaguggcugucaccuauagaguuagguuuuaauucagcuaccugggccucacaccugcgauuugcauucacugcaccaugucaccuaagacccucugacuuucagugaguggauuucaagccuucugcugaauguugaagagcucucagaauaaaaacccagcugggagcuuccagcugaugugggaauuaacaagcgucauccugaaacuuaguaaaugugugaugguuuuaagcuaaaaucauuuagagcuaugguugaugaccuuggaaauggcagaaauguuuucauauauauacuuuuucauuuuauaaacaguuccugccagggcacacccagguuuuucaaccugaauagaucaaaggaagcuugaguugugugugcugugauucauucccugcugagucccaaggaccugcccugccuccuacuggagggggugagaggaaggaaagcuggauuacccagccugugugcacugccagccgggagcaccugcgaugggugugcccagcaggagccgggcaaggucccaggucugauggccucuuuagacuugugcagaaggccuacucuuuuuaaacugccacaugcaucugagucucagacucaaccacaugacaucugcacagauguuugagaaaggcauccccugcuugguaagcuaaugacuuuucacaaccgaguacagauguggaguccccacguaaauagcagccauucuuucccaggcugagccacucacaggcagaggaagccaggcguuuucuguuuugugcugugacuguguuagcugcaggauggugccugcguuuaacagaagccacacugaaagcacgaaacagacaauggggaacaagccuggucuaaaccugugcaggccauccacgugcacaggccauccacacacacaguccacccacacacacaguccacccacacucacagccugcccacaugcacgggccgcccccgcaugcacgggccgcccacacgcacaggucacccacaugcaggcggaucaccugaggucaggaguagccugaccaacaugguguaaccccaucucuacuaaaaauaccaaauuagccggguaugguggcaaauuugguagccggguaugccuguaaucccagcuacuugggaggcugaggcaggagaaucacuugaaccugggaggcagagguuacagugagccaagauugcgccauugccguccaucucaaaaaaagaaaaaauaauaauaaaauaaaaaacccagacaccguggugugcugucugucaguugucccuagcccgggcaugcuguuuuagcgucuucuccugugaugugcaguacagcauuuuuuuuuuuccuuuuucucuuuggggacuucuccuccugccccaggcuuugucucuuuuucucauauaugaaauuucugcucaucuuuaagacuguucaaggccaccucggcuaggguguuaggguggauacuccacuaaugagguccacacagguuuuuucucccucagaaagcuuggcucguuuggaacauuuauucugcaaucucuuuuucauuccuaucucaggcuuuuauaaguacgcaguguuucuuguaagcaggaacuauguauaauuuucagcagugucaauaucaucaucaucaauaagcauuuuuaaguacggucauacauagcuuaaugauaggggcgcacucugagaaauguauccuuaagggacuucauccuugggugaacaucacagaauguacccaacacauaccuacaugguagagccuacuacacaccuagcuguaugcuguagccuauuguuccugggcugcaaaccugugcggcauguuacugugcugaacacuguaggcaaguguaacacaauaguaagcauuuguaugucucaacauaucuaaccauaggaaagguauuacagucuuaggggacuaccuuuauauauguggucugucagugacugaagcauuaugugguagaugucugcacccacaaauaugaacuacauuaugcuacauauugagaauacaaauguccuugcugccuucuagaauuguuaaauaauaauugaauugguauucagauuuaauugguccaugauaggaccugggcauauuuuaagcuccccaagugcuuccagccacagugcagccaacguagauaucacugaucucagcuaugugugugcccaggccuggagcacccagaaauggguucucugacgacauaguuuugagccaugucuuugagagcagaacaagugaggcagagaguacagugaggccaaggcaguugggggacugguugguuuccuggaaacuggagcuguaggccaauugccagaagaguggaggauauugaagaaugguucaggucuagggcugguggagaucuucagacucucuggaaguuuggaugugaguuuauagcccuacagggcacagaugugugacgucacugagccaacagguccaguggucaauagguccagauggaaacacacagccguuuuuuacugugaagauguccaggcaucaucaaaccuuuuuuccccaaaagcagcccaaaauucauuuuguuagugugacauauuacaauuuuuuaaauguuggcuaacuuuaauguguacacgugcacacgcaggcacacacacaugcauguacacacuaaugcucacagcacucugcugggcaaacaaaccucccugccgcccuugcagccugcugguugcagcuuaggccacagccagugggcccugccaggcguguaagcagugcgugccccgagcaaagucaggccugagaagacaacagcccucgcaggcugcuccuagucacacuguggagggaaggguggaguacacaccguaugugauucacgugacuccaccuuugugugugcuguagagaugagggcuuggaccaggguguugacacuggacguggggagggaggguggauaaaauucuauuacaagggugccucuggguagcuggggacagauuauuuguuggggauaaguguggggcagucaaaaccucucccgacucucuccagccucucacucccauuguggugccggcuaaaugaauaaaugcugcuuccuauuugaacuggugaguucuaaaggaguccaagccagcuaaauuggaaaagauacucuuuuccuaaaaaugaaaaacacuuuuuuuuuuuuccccugaaaacaccuuugggagguaaugcuaaugucuccgagccugggccucuaccccuagaccaaagggugguuaaugaaagaauccauaagcuguuucucucugucuugauuuuuuccaucucugaaaugguauggaaucuguucuuucuaauaaugacugaauaacauagugguuaaaauuucaggcuuugaaaccaaauugucuucaguuugucaguuuuaccucucugugacauugggaaggugugcucacacuuucagcuauaaaauaggaauaucaguaauaccuccuuaaagugguauacugaggaauugaauaaauauuuaguccuuacaauggugccauauauguugacuauuuuauuuuuauuucuauaaauugaaagaaguauauaauggauaaagauauaacaaaaauuauaaauauuguaaguauaagccuuuuaauaagaaaaagagaauuuauaccuacuuauagcagaggaugagaucugaauguuauuuuauuauuauuauuauuauuuuugagacggaguuucacucuuguugcccaggcuggggugcaguggugcgaucucggcucacugcaaccucugcuucccagguucaagugauucuccugccugaggcucccaacuggcugggauuacaggcaucugccaccacgccuggcuaauuuuuuguauuuuuaguagagacagaauuucaccguguugaccaggcuggacuugagcuccugagucaggcagucuggcugccuuggccucccauaaaugcugggauuacaggcaugagccaccacaccuggccccugaauguuauuuuaaugacgugaaugugcguaacuuuacauuaaccagugacaugaaugucaguaaguuuacagccucaucuaaucacuuuugcugucguuuuaaaugaccucuuucauuuuauaaguaauacauauacaagugauaacuauggaacaauuaggaaauguguagaaauaaaaauagcaaaacauaugucauacuacccaucacccaaggucauuuuugccaauucuuuaucuuucuaaacugcuauaugauccauugcuauaauuaauguagaccucucuuuaaaaauagaauuuuccuaaacaaauaauauucugaaacuuguuauuuuaaaaagccuguauugagcauuuuugcacauaaaacaauauacuuuuaggauauguuugccuaguucugguauaacauaauuuauugacauugucuuucauugaugcaugauuagauuauuuguuugauguguuaauuuauuaauguaugguuggguuauuuguuugccauuagaauuuaugucgugaugaccaucuuugagccucccacaaugcugucuugugggauuguuuagaguaaauuucuaggaaaggaauuccugugucucugaucccucaugccaaaugccuuuggaagaccacucugagcagaggugaaggugugcugaggcucucacugccucucuguggacccucuaacuaggguauggccagagcgggagggaggcagcgggagcaaacccucuggagucagccaggucugaguuccaugucugugcaggcaccggauaauuguaugccuuuaggugagccacagaucucucaauaagguaaacuugguaagguuauuauuagcauagguccuaguggauguuaaguaucgaguaaguacucgaccugcuaccacgacaauaaaauaccagggccuauauaaaguaagguucuuaaaucaaaauauguacauacauauauauacacacauauauauguauucuauguauaaaauaagguaccuguauaaaacaaggccaguugcuuucccuggcuaaucuggcggaaacaagaauuucuaaaaauguucaucagaaccagggccuacuugagggcggaaggugggaggagggugaggauugaaaaaccgccuguuggguacugugcucacuaccugggugauggaauaaucuguacaccuaacccuggugacacgcaauuuaccugcacguggaccccugaaccuaaaauaaauguuaaaagaaaauguuccucagugugggugacucaucagguguuuagaaauaccccacgaggugaauugagcauuugaagcacagucugaaauaaggugaaaacaaaggcaaaggggguuaugcguuaguaaucccuuuaccaucacccgcauccuuucccugccaaacagccgcaucuguccacgguggccguguggacaggugguggugugaucgacuuucuggcuaauuuagcacaacacauccucgagaucauggauccauggacuccagauccucagaacuggccauagauuuggagcuggggcaagauuuaauaaagugucacauguguuagugagcccaccugauucauugugaucauuaauucgugugaugugucaucccugugacaauucagaaagggucgggcgaaacccugcugcacccacccuccccuugaccagauccugugaauacaggcuuguguaccucccugacagcaagcauguuuuuaagguguuucuuuccgggaaugcuuccuuuuaauaacccuuucucuauuuuguuuacuuuauuaguuuuuacuuguuugggggacauugauuuuaaaaaggccguggcacuuggaaggugcuccugaagacagaccugaguauguguaagaacgaauuauuccgaggcagguaggaacauugccacugacucugugccuuuguguuguuguuuuuaaggaggaagaugaaggcucgugcucccccaccuccuggaaaggcugccacucugcaugugcacagugaccagaagcccccccacgauggggcccucgggucgcagcagaacuugguucgcaugaaggaggcgcugagggccagcaccauggacgucaccgugguccugccuagugggcuggagaagaggagcgugcucaaugggaggugagagccggugcugcaggaggagucgcuguacucacuuugcgaguauagcggggagaauggaaaggcggauguugauguauugcauuuuccuccucaucaggucugaccucaggaaccucauggauauaaaucgggcuuagugacuacuuagagcaggcugaacugucugucuuaccuggggugggcuuaugcuaauugauccagccaugauggcucaccagaugcuuaggagagcuggggcuccagggcugccuccuaugaggaggcaggcucagaaacgagggcagguacagcggugaccuacaccccugggugggacagcagccacagugugccucagguauccucagcucugaagggacgcagccaggagggcagccuccuaaauuaaccauucccacaccuacuugcagcaauauguggagguguguguacaacuggcaaucaacuuucuaaagugaaaauauuucagguuuagaugaaggaauaaaccaacccaaucauggauuuccaauuuaagggcuugaauuugagacccucaguucccacaugcacucuucucaggacugaucugcccguggcugagugucucacugcacuucacucacaaaaggugcggcugaaacauuggcaaagucuccuucaucauagcauuuugaguuugugaccaauagauuugcacauuuuauguuugacagugaucaaaauaaucaugauuuuauuguuuaaauaguuuugugcuauucuuacugauacuuuuagugauaacccaauguauaauaaaaaaacuaacaaagucacagaaaaaaguuaacuauaauuuauacguuuuacugaagagaaguaugauagaaugauuaauuacaaaaacuuucaagcauucauacauauuuguaugauucugaugcagcagugaauugaagcagcauuuauaagaaaacaaggagaauaagaaaugauauaaaaugggcugggcacgguggccuguagucccaucacuuugggaggcugaggcaggcgaaucacuugaggucagaaguaugagaccagccuggccaaaauggugaaaccccauuucuacuaaaaaugcaaaauaauuagccaggcauagaggugcaugccuguagucccagcuacuugggaggcugaggcaggauaauugcuugaacccaggagacagagguugcagugaaccgagauugugccauugcacuccagccugggcaacgagugaaacuucaucuccagaaaaaaagaaaugauauaaaauguuuuauucuuaugaagcaguuugcuugaguaauuuuaauggauaacggugaaaauuaaaucacucuggguguuuuuauucucacagaugccuuuuaaaaagugauguaagcauuuuauuuuaaaauaccaguauuuagauuauaguugaaauuaccuaauccuuugcaacuauuuuguuacuuuaucaaauuaaccaguuuauaaucaaaauuccaggugacagucuaauuggcaaaggggugcauacauuuuucaaaaguauuuuaugagauaagugaauaaaaauuuggggagcauugcucgaggccucggaauauaccuaggauuggaacuguugagucaugggauacaguauuucagcugcaccaggugaggccagccugcucuccaguguggugccacugggcuagaaugggagguugcuccucagugggggcccuguggcugugaucauagcaggagggcucaggcgcaauuaacugucuacaguggaucaaggugggaggugccugggcucaaagccugguccaccggaagccacuaucucuugcggcaguucgauaggcuuuccccccaggguucaugcacaguggagagacaggaguuucugugaguuucuuuguuuuauaaaguagucauaggccaaaguacacuuuuccuauauaacuuuguaacguaagaaauuagucgcauuauuauaguuuuaaaaaacacuuuaguauaugcaugaaauuuucucaguggguauauuaggguuuacucgccauucuuauauuuuagcccaauuccuagguacauauuuuguuuagaaaauggcauugugggccaggcaugguggcucacgccuguaaucccagcacuuugggaggcugagguagguggaucaccugaugucaggaguuugagaccagccuggccaacauggugaaaccccgucucuaauaaaaauacaaaaaauuagccaggcgugguggcgcaugccuguaaucccagcuacucgggaggcugagguaggagaaucacuugaacccgggagauggagacuguggugagccgagaucacgccauugcauuacagccugggcaacaagagagaaacuccaucucaaaaaaaaaaaaaaaaaagaaaaagaaaagaaaauggcauuguggaucaugucuuaauucugcaguccauggauccaguuuuacaaaugcacaaggaaagaauagaaugcgcauucuaaaaguaaaaauauuauuuuaaaagaaugcuuucauuucuuuuauuucccuuauaaaguagagguugccaccaugaaguuuuguaauguagugacugagaauaggugcagccuuagagauggaguguuaaaauaauguuaucuuucuuaaguagugaauuauuaucccuucucaugguuuccugaagcaucagugaguuauagcagcagcugugagcugccuccagugggucuuuggugggauaacuauugcggaugcaguagcuccuugcuuugggaauugguuuuauguuaugcucuuuauuaauauaagagugggcugcaguuaaauuccugacccuugcuuaaaauagaucuacuuguuuuuugucauugugguuucucuucugucuuaaaaaguggguuuaguaaagaacaugcaaccuuuucauaggguaagcaaggaguuuguaauuuauagucagccccuuaacuguguuauuuccugacaugaaggauuccacaaaggaaacacauuaguaauuggaugcugauaaucccauauggaaaaucagugaauuuuuuuuuuuuagcuucccuugaauuaagaaacauaaauaaaaguugaagucuguucuuacagauuaagacaugagaauuggugcucugagccguucauaggggaaauguucuggccuaccuuaaggaugguauuaccagcaccccacacagcugcuggacagaggccacaaucccaucauuuuaauugaggcacaagaacagaagaucuuuuggucaggugcaguggcucaugccuguaaucccagcacuuugagaggcugaggugggcggaucaccugaggucaggaguuugagaccagccuggccaaccugucucuacuaaaaguaaagaaaauuagcugggugugguggugcuucccuguaaccccagcuacucggaaaguugaggcaggagaaucacuugaaccugggaggcagagguuacaaugagcugagauugugccugugcacuccggccugggcaacagaguugagacuccgucaaaaaaaagaaaagaucuucaaagagcccuuuacaaaagggugucagguauuuagugugcuaggcugugucauuaugauauggucagugccuuguguccaaacugguguucaaggccaagggcuagggcagaagaaggcaagccuuccuuuugcagaagagaggaaaucugccucauauucaguccugugauucugccuuuacaggccauugcauccccuuuacaacagacaagcuuagaccugugcagggaguuuuaggucccugucugugugaaacagcacaggacucuugcagcagcagguguugggucuccauguuccuucuguagagggcucaccuguucucaggugcaagggaagggaggcugggagggacccucaucccucucuguccugugaagguauugauggagcacauguacagccucugaaaggucauggccuuggccuugcacucuuggaugugagguccuggccccagaggcugaaggaaguaacuuucgagaggacagcuuugcugccaugcacuguugaguaggccccaagaaggcuguuccaaaagucacaagguuaaaagucaggugcaccuuggugugauuaugcuucuauucgaagacuacccauuacaauagaguaaauuccugugagccagagcccacuuugguaaccugagcuagaagugagucuugguauguucaguggguaugaucaucuggaucuucacucaucauuucuaaugcccgccuucccaaccucccugugauguuucugccucauuaaggcuuuauuugugugggcuuaauccaaacaaagcugaaaaaaacaaaaacaugccaaaaagcccacugugauuugcagaaugcuaucaacauccgauuucuaauauguuuucuuuacgaaaaucuuuuuuguggggaagugacaagguuaaggagcuggcuauaaacuaugaacugcuuaucuucacaaaagguggacacauucuuccuaaacguucacagaaggugcuguugguguuuuugacauugguguuauaccaguuauacguaagggaggucucauggugugagaucuugauggauuaaagcaugugaucaugcuuauuuauucaugggucaaaauauauacugaguuuauugcuaacuuucgugaggcacugugaagaagacuccucagcaaguagaaaaaaaaaauaacacuugcaaaaugccgguuuaugugagaagcagggcauucaauauugcuugaagcuaggcugagaagcaggagguauguuggccuggacacugguauggccuguacugaagaguauccuguaggccucccugcagcuccaccgaucucaaacaagacugcgugugccacugggaacagugcuaggcaagcaaugaggaagcuguugcaucgcaguauuaauuuucuucaaacacaggaaaaauaguuuuauaugaaaaguagcauacaaaauugacaugcauuuuuaagcccaacacuaacagaugauuuuaaggguaacugggcuaugucaggggcccccaggguacauguugauugaucugcugagugagaaucacauagaaaacaacuaacuugcuuauaaucuggacacagaaggcucuagauuaugaaguaaggugaccuccaagauguaggccaaaaaaugaggagaucagaauuaagaaaggucacaguuacuguggucagcaaagggauuccuucaaggcugaagccaaccagaaugcacuccaugucugagaucgccuguucacaccuguccagguaacacaucccaucuggacaggguaacuggugguuuucccagguucccagacucugcacaucaccucucuccaugucaaaggacacaaccagcauugucuuuauuuauuuauuuauuuauuuauuuauuuauuuauuuauuuauuuuuaauagaugaagucuugcucuguugcccaggcuacagugcaguggcggcacaaucucggcucacugcaaccucugccuccgagguucaagugauucucuugccucagccucccgaguagcugggauugcagaugcgugccaccacguccagcuaauauuugcauuuuuaguagagacgggguuucaccauguuggccaggcuggucuggaacuccugaccucaagugaucugccugccucggccucccaaagugcugggauuacaggcgugagccaccgugcccacagccagcauugucuuuuaacaguuuugaaaugcggaugccuuuauagaaggcauucccuuuccaguuagcagcaacccccgcccccacuaaauucacaucaugagagcccucacagacugguagcagcugcuuggccccaggagguguguggguuugugagggcuuggccaacucucugaggucugacaccguccuccucacuguggcucuguuguuagucauggguucuguuuccggcgauguggcuucugauuugcaucugcgagguaggccccuacucaccucaguugacaggcccgggacccaggccucucagaaacugcauccuuacagagaccucagccucacaccuagacuucccugguucugggcuuccucaggucaccugucuccacacugacccuuuuuguguucugcugaugugucccuuuguguagggccccgucagcacgaacugccuguagugcagugggccacaagcuuuuuggcaucagggacugguuuuguggaagacaguuuuuccacagaccaggcuggggauggcuucgggaugauucaagcgcauuauguguaucacuagguucucauaaggagcacauacgcaguucacaauaggguugacucuccuaugagaaucgaaugccacugcgguuggacgggagauggagcucagggggaaaugcuuacuuguucacugcucaccugcugugcgaccuggcuucuaacacaccguugacugguccucgucuguggcaggcgguuggggaccgcugcuguagaggacccauauuaagcugucagacuggacucucucccagggcuugacucuguuaugccagagucugccucauccagagcuuagggccacagaguggccuuggucccacacaagaaacuaggccacucuggaccaguuuaagauuugacaguucaugcaaauuaaauuuguuuuaacauuguguugggaaguagcuacagcuacuuuaaagugauuuguaaacuuggcacugaguuaccuauuuacuuaacacauacauacuaagugugcacguccuggguacuuagagucuagcaauucucaaagugggguuccagaccagcaacaauggccucacuugagaacuuguuagaaaugcaaauucccagcccuuccccagaccugaguagaaaugcuggggaggagcccagcaaucuguauuucagcaagcccugaagguucagauugcguguuaaaguuugcaaucccuugcuauggugcaugccacuagcucugcuagaugucagggauacucgaugaguacgcaguccuaagaaugagcccaaggucucacuggugggguggcaugaacagggggacuguaggaaugauuugugucagcggcucaagaacggcccuuggcagccucaucacagaguauuuuucaguccauuuccacacugaauggggucugaggaucugguaggacagcuggcuuguaauguagaucgaaguccccucaauuagagaaggguaauucauuaauuggccagggucugauggaaauggaaguaggacuuggcuucucugacauuguguguuccccaagcagucuuuugcuguugccuacuuucugaggggcaguggccccucugcacuaggacggguauuggcacaggcucuccguuucuugucuagggcucugcuaagauuucaaaaagaaccaccuacaaaagaaaaccaguuuuuuucuaauugaagucacugacucaaaaaaauuuuuugaagucuguacacauuuggaaaauauuauuuuuaaagaaguauaauaauucuauuaaguuuaaaaucagagaccacaacaaauacaaaaaaaauaacauuuaccucuaucuuaugagcacuuaaaaggcauuugggguaacagagguaaagacguuagagguaaaaaugaugucgcggaggaaggggagagaaaccugaaaggccugcucucauaacccccuccaccccugcucucuugauuuuaagguaaucauuccauuuuguuacugucuuuuauccuuccauugaaccugagauuuaaccugaauguagauagaugaugagagagagagaggagaggcagagagagaaggagagagaugagauuuuucuugaugucuguguagucaaugaaaauggcgauccuaugggaucaucccugaggccagggagagcccuagaccuagucacuuuccuaacauaccugacucuuuguuugacauucugagagggucugauugucuuaguuuuauucuuuguacaauuggagaaacucuauucugcauugcuucaaagauguugcuuugaaagggucuaauaucuugguauuugcugagagcaggaugguguuuggcaacauacagauaggugauccucugcccugagcuaggcgaaugccuuacuauguagaauccaaaauagaaaaggugggagcaaauuaacucauuuauuuagcaaguacugaccuugugccuaccacaugccuggcacugugcucggugccuuaaaaauguuacuucacguaaaacucuauccacccugugaggugggcacugucauucugcucucaccaguaauaaagcugaggcacagaggaugcagucagccccacccaggucagagaggcagugagcagugguaccaggauuccaucccaggcaggcuguucugagcgccaucacugcacccagugcugaugugggaaaucacgcccaaucccuaaucaaugggcaaagcugcagaucaggauggggcugcuccaucagagguggugaggaggagaggucagacccaggagguggugagaaugugugaguggccaggcagccucuuccacuugcccauggcccaguggcacagugaccuacugaggucuuguggagggaugcacuuguaacacccaauuagagaaucauuaauccuuuguccucaggagaugagaggcagguugggaucugaugagcguguaaggaaaacccacagagaguaggcagcagcugugccucucuguccauuguugggcacugccauugucccaaggguggccucucugggugaauucuccaguagcaucaaaggaggcuagaaagaacuggcuguuuggaguuuggcauuugaaaaugucagccaguagcaacuuaaagggcguggugcaaaguagcagaaacggcauucccucacaccuugcugugcaaagacgugcuccagaaaaguguguaguggaaaaguagucaaucgagcugaauuuuacaugagacugggaagggucacaccaaguuucaaacccugcaggaaacaucauaagacgaguuccugcuuuuggacccauguccucacaggguugagcuuguguguguccagguucuuuaaugccaccaagucaggucuuccuuagaaagcuguguuuaccugacacaaauagaggcagccccagagagagcaaagcaagagccaaagcuggagcuccuggcagcccccaaaccucccacuuucauguggaagccccgcuguccugggugcggguuccagcccugggaagggauggugucugagguuuccuccagguugagaggguaacugugcccugcaaguaacuuaagcaugucugauaacucaugucuguggggacuggguuuuaguaucauguccuuauaggguuuggggguggaguuuugccuccccccaauuuaaauuugggcagguggguuguugaugaucuacucccacccucgacugcugaagauaucauggcagcuuucacaugaggagcacuugcugggcagagcugccuucacaggguggggcagggguguaaaggcccacauuguggaguauugaccagcagauuguggagauccauuuggcacacaagguggagauuugggcacucaauuauuuauuuggcugcaauuaauauacuccucugugagcacacugcauacuggcuucugccguggccaggugggaucauucucugugcuggggaaaagcuguggagccccgggcuguccacucccuuucaccucucuagaugcuccaaaccugucaccaguuauuggacuaaaagaacagaggaucacaguaguugcauucguguaauuuuuguguuugacaacugauuuguaucuguuuacuggguagagacagccucuugguggggauuagagggaaagcaagucaggucagacaagaguggaccccagcucccuugccucauggaaauccagggacccacuccccauccucagaccgcaggaggacuggaggacaccaugggcagugcaugguguggccacaggcucaucacagauacacaggauguggucaggagccugugguguucgcauuuuuaagaagucuguucgcuaugcugaggguucucuguggacugucgugucugcaugugcauagugauguucucccuguuuuguuuccuggagcucuucauugaguugaagguuuuuacccaguaucugaaagaaucagaacucaugguaguuauuaaccugcacgccccgcugugggguucuggaggguuggggcugcccaggccgcaccaggugcucccacugccaccagcacccacuucccaggggugucuaguaucuuccuuacuggcaccugcucuuccuuaaucacuuccuggagaguggaugaggguaaauauugucauggagauagcuuugagcguuguuuguaucaaugagaacauuauugaugcucuuuucuuguagcauuggcaugagaaagagggcacuuuagggauucuuguaggauuggguuugccuguggguuuaugguucaguguuagggcccugcagcucaugcucagggucacggaggaaugaacgagugccucuggcugaucaggcaccuagggcuuugcaaauguuuuuuuuuuuuuuuuuuuuuuuuuuaauugaucauucuuggguguuucucacagagggggauuuggcagggucauaggacaauaguggagggaaggucagcagauaaacaagugaacaaaggucucugguuuuccuaggcagaggacccugcggccuucugcaguguuugugucccuggguacuugagauuagggaguggugaugacucugccuucaagcaucuguuuaacaaagcacaucuugcaccgcccuuaauccauuuaacccugaguggacacagcacauguuucagagagcacaggguuggggguaaggucacagaucaauaggaucccaaggcagaagaauuuuucuuaguacagaacaaaaugaaaagucucccaugucuacuucuuucuacacagacacggcaaccauccgauuucucagucuuuuccccaccuuuccccgcuuuccauugcacaaaaccgccacugucaucauggcccguucucaaugagccgcugggcacgccucccagauggggugguggccgggcagaggggcuccucacuucccagcaggggcagccgggcagaggcgccccucaccucccggaugggguggcuggccgggcggggggcugaccccccccaccucccucccggacggggcggcuggccgggcggggggcugaccccccccaccucccucccagacggggcggcuggccuggcggggggcugacccccuaccucccuccuggacgggguggcugccgggcggagacgcuccucacuucccagacgggguggcugccgggcggaggggcuccucacuucucagacggggcggcugccgggcggaggggcuccucacuucucagacggggcgguugccaggcagagggucuccucucuucucagacggggcggccaggcagagacgcuccucaccucccagacggggucacggccgggcagaggcgcuccucacauuccagacggggcggcggggcagaggcgcuccccacaucucagacaaugggcggccaggcagagaugcuccucacuuccuagaugggauggcggccgggaagaggcucuccucacuuccuagaugggauggcggccaggcagagacgcuccucacuuuccagacugggcagccaggcagaggggcuccucacaucccagacgaugggcggccaggcagagacgcuccucacuucccagacggggugguggccgggcagaggcugcaaucucggcacuuugggaggccaaggcaggcggcugggagguggagguuguagcgagcugagaucacgucacugcacuccagccugggcaccauugagcacugagugaacgagacuccgucugcaaucccggcaccucgggaggccgaggcuggcggaucacucgcgguuaggagcuggagaccagcccggccaacacagugaaaccccgucuccaccaaaaaaauacgaaaaccagucaggugugguggcgcuugccugcaaucgcaggcacucggcaggcugaggcaggagaaucaggcagggagguugcagugagccgagauggcagcaguaccguccugcuucggcucggcaucagagggagaccguggaaagagagggagagggagaccauggggcaagugcgagggagagggagagggagacugcaaauguuuugaguucagagacaaaauuuuauuuauuuuagagucuuccaauugaccuaguaacacauuguacccacuaggugaucuguaaucgcuuguuaaauuaaauguguacuuuuaugucaguuuccuuccauuuccuuaaccaaaaaaaaaaaaaaauguccgcuguaccaaguaccuauugggaaaagugauuuucuuuuuuuucuuguguuuuauuuucagcuuuauugggaguguaauugacagauagaaaugguauauacugaagguguauaacuugauguugauauacauauauauuugugaaauagccacaaaguaguuaacacauccuucacuuuacagacuuguguguguauguguguguguguagugagaacacugaagguugacucucuuagcacauuucaaguauacagugcaguauugucagcugcaguccucaugguggacauuagacaccagaucuccagagcuuacuuguccuucguaacagaaacugugugucuuugaccaccucccuauugcccagccccugcaaccacucuucuguucucugcuucugggaguucaacuauuuuagauuccacauauaagugaaucaggugguguguuugucuuucugucuggcuuuuacuuaguguaguguccuccagcuucauccauguugucacacguggcaggauuuccuucucuuuuaaggcuguguaauacuucauuguauauacguaaccacauuuucuuuauccauucauccauugauagucauuuagguuacuuccacuucuuggcuauugugaauacugcugcaauagauacugcgaauagcgcugcaauagauaugggagugcagauaucucuuaaaaauucugauuucauuuucuuucuuuuuuuuuuuuuuugagacagagucucgcucugucaaccaggcuggaauauaguggcgcgaucucggcucagugcaaucuuugccuccuggguucaagcaauucuccugccucagccuuccgaguagcugggauuacaggcaugugccaccacgccuggcuaauuuuuguauuuuuaguggagauaggguuuuguguuguuggccaggcuggucuugaacucuugaccucaggugauccacccaccuuggccucccaaagugcuaggauuacaggugugaaccaccgugccuggcccauuuucuuuagaaauauguacccagaacugggauugguggguuauaugguaauucuauuuuuaauuuuuugaagaaccaccagacuguuuuccauaauggcuguaccaauuuacauuccugccagcaauguucaagguuuuccuuuucuccacauucucaccaacacuugcuauuuuuugucuuuuugauaaaauugccauucuaacaggugugaggugauauugugguuuugaauugcacuuuccugauggugauguucaguauaccuguugaccauuuguaugucuuauuuugagaaauaucuauucagauccuuggcccauuuuaagggaguuauuugcuauugaguuguuugaguucuuuaucuauuuuggauauuaaccccuuaauuggauauguggcugucaaguauuuucucccauuccauagauugcacuucucucuguugacuguuccuuugcuggacagaaagaagccuuuuagcuugaugcaguccuauuugucuauuuuugcuuuugcucucuaugcuuuuagugucauaucuguaaaaaaaaaaaaaacaaaaaaccaaaaaacaaaaacaaacaaacaaaaaacugcccagaccaaugucaugaagcuuuuuccuguguuuucuucucacaguuuuauggcuucaaaucuuauauuuaaguguuuauaaucuauuuugaguuuuuuuuuuucuguauagagugagauaagggucagauuucauuuuucugcauauggauauucaguuuuccuggcacuauuuauugaagagaugguacuuuccccauugugacuucuuggcauccuuggcaaagaucugcugacucuuaaugcauggauuuauuuuugggcucucuauuuuguuccauuagucuacauguuugauuuucugcaaguaccaugcuguuuuguacacuauagcuguguaagauauuuugaagucaggauguuugauaccuccagguuuguucuucuuucuuaagauaucuuugaguauucaagaucuuuuguuguucuuuaugaguuuuugcauuguuucuucucuguuucuguaaagaaugccaaugggauuuugauagggauugcauugaaucuguagaucuuuuugugagauauggaaauuguaacaauauuaauucuucuaauccaugaacacaggacagcuuuacauuuaucugugucuccuuugauuucuuucaucaauguauuauaauguucaguguaccaaucuuucaccuguuugguuaaguuuauuucuaaguauuuuauuauuuauuauugcuauuuuccuacuuucuuaauuuccuuuuuaaaugguuuauguauagaaaugccacugauuuuuuuggcugggugugguggcucacaccuguaaucccagcacauugggaggccaaggcggauggaucacgaggucaagagaucgagaccauccuggccaacauggugaaucccugucucuacgaaaaauacaaaaauuagcugggcgugguggugcauaccuguaguccuagcuacuugggaggcugaggcagcagaauugcuugaacccgggaggcggagguugcagugagccgagauagcaccaugcacuccagccuggcgacagagugagacucugucuuaaaaaaaaaaaaaaaagccacugauuuuuuuguauugauuuuauaauaagcaacuuuaaauuguuuauuacuuuuaacgguuuuuucuuguuguugaguuuucagagcuuucuauguguaugaucauaucacuuguaacccgggauaauuucaguuauuuuuugauguaugugccuuuuauuuauuuuucuuguccaaugccucuggcuaggacuaccaguacuguauugaauagaaguugugagagcggacauccuugcuuuguauggaccuuaaaagcuuucaguuuuucuccauugauuauaauguuagcugugagcuuuuuguauaugguuuuuauaauguugaaguaaauuccuucucugccuuuuuuuggugagaguuucagcaugcauggauauugaguuuugucagaugcuuuuucuguauccauugagaugauuauguaguuucuauguuuccuuguguugauguguuguaucacauugauuaauuugcaaauguugaaccauccuugcaucucagggagaaauccuacuuaguuguggaguauaauccuuuaaaugugcuguugaauuuuguaugcuaguauuuuauugaggauuucugcauccauguucgucagggauauuagccuauaauauucuuuuauuuugggaucuuugacuuuggugucagcaugauucuagccucauaaaauuuguuuggaaauaggcccucuuuuucuauuuuuuuggaagaguuuaaaaagcacuaguaucaauuauuccuugacuguuugauaguguucuucauugaaucgauuugguccuggacuuuuccguuugugaugagauuuaauugcuaauauaaucucuguauuuguuauuggucucuucaggauuucuguuucuccuugacucaauuuugguacaugucgaggaauuuauccauuuuuuucuuuuuuuuuagggaugaugugauuuguuaguguauuuuuguaauacugccuagugaucuuuuuuauucauauuucuaagauauuuguuauaauagcuccucuuucagauuuuaagucuucucucuuuuuuuaaugcagccaagaguuuuuuuuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgccacuacacccggcuaauuuuuuguauuuuuaguagagacgggguuucaccguguuagccaggauggucucgaucuccugaccucgugauccgcccgccucggccucccaagaguuuuuuuuuuaauuuuucuguucucuauuucaguuaucuuugcuguaaucuuuauuauuaacuuccuuaugcuaacuuugggcucaguuuguuuuuauucuuguucccugaaguguaaaguuagguuguuuauuugagaucuuccuccuccuccuccucauuauucuuauuuuuccagacagagucucgcucugucacccaggcuggagugcaguggugcgaucgcggaucacugcaagcucugcccucuagguucaaacaauucuccugccucagccuuccaaguagcugggauuacaggcccgugccaccaugcucagcuaauuuuuauauuuuuaauagagaugggguuuuacuauguuggccaggcuggucucuaacuccugaccucaagugauccaccugccuuggccucccaaagugcugggauuacaggcgugagccacugugcccggcccuuccuucuuuuuaaauguaggaucuuacugcuauaaacuucccuauuaguauuaguuuuguuccaucccauaaguuuugacaacuuuuguuuccauguucauuugucucaagauauuuucuaaauucccuuuugauuucuccuuugacucagugguugcucaagauuguguuguguaguuuccauguaccguaguccucccuuucugugggggauuuguucuaaaaccucugguggaugcuugaaaccacagaucguacuaaaguuuauauauaccauguuuuuuccuaugcauacacaucuauaauaaaauuuaauuauaaauuggauauaguaaaagauugacaaugaaucaauuuaaaaauaaaauauaacaauuguaaccauauuguuauaauaguuaucauacaccguggcuauaacuuuugcagauugaggcacaacugcaaaacuagcaugaauaucuuuuuucuucuucacaauuuuagggauagaagauucauuuuuacccuagaucuuagcaaccucaguguacuuuuuuuucuuuccuuauuaagucaggaacuuuuaccuuuucacuuaauggaugcacuuuauggcuuuucuuuggcauccaaagaaccagcaucauuacucuugaggucugaggccauuauuaaguaaaguaagggugacugaaacacaagcacugcaauaccaugacaagcgaucugauaacggagauggccaugaagugacuaguagguggguagaguauacagugugaauacauuggacaaagggaugguugaugucccaggcaggaugaggcaggauggugcaagauuucaucacacugauuaaauuugugaguuguucauuuaugaaauuuuccauuuaauaucuucagacuguggguaaaaugauaucacagaaggugaauuccauguuuguauuuuuuuuucauucuuagaaauacuguuauugauugcuaaugucauuccauuauggcuggaaaaggcacuuggaagauuuugaucuuacuaaaauuuucagaccucuuuugacaccuaacuuguuauauacccugaagaauguuccacaugcucuugagaagaaucuguauucuucugauauuagauggacauuauauauauuaggucaauguggucuauaguguuuuucaguuauucuguuuacuuauugauugaucuuucuaccagaauggucuauccauuauagagaguaaaguuuugaagucucuucauauuauuguauuauuauuguauugcugucucuuucucccuucagauuuaugaauguuuacuuuacauauuuaggugcuuucauguuggugguuuaaguauuaauauuuauaacuauugggucuuucuguugaauugucccuuauaucauuauauaaugacguuugucacuugugagaguuuugacuuaaacccuauuuuauuuaaugacaauauagcuaccccugcucuccuuucuuuucuuucauucuuucuuucuuuuuuuuuuuuuuuuugagacggagucucacucugucacccaggcuggagugcaguggcaccaucucggcuuacugcaaucucugucuccuggguucaagcaauucuucugccucagccucccaaguagcagggauuaaaggcgcccaccaccacgcccagcuaauuuuugguauuuuuaguaaagaugggguuucaccauguuggccaggcuggucucgaacuccugacaucgugaucugcccgccucggccucccaaaguguugggauugcaggugugagccaccaugccgggcuccuuucuuuaaccuuuuucaugaaauaucauucuucauucuuuauuuucaaccucuauguguccuuaaaucuaaaaugagucucuuguagacagcauaguuuauuauuauuauuuuauuuguucaucuacgguauuucuuuugauuggagaguuuaguacauuugaauuucaaauaauuauuaauagguaaggacuuacucuugccauuuugucauuuguuuucuaccuuuauuauaguucucuuacuccucuugguaucuuucuuugugguuugauuaucguagcaguguacuuugauucuucucucuuaaucuuuuuugcaucuacuguacaucguguguguauuugugugugguuaccauagaguuuacacugaauaauuuauaguuacagcagucuguuugaagcugauauccacuucacuucaaucauauacaggcgcucuacaguuuacuucccccucccacagacacuuuauguaacugaugucagauuuuauuuuucuguguuguauuuccauuagcaaauuuauguggguauauuuauucugacaacuugccuucuaauuuguauacuaguguuuaaagagauuuguguguaccauuucaguauuacaauauucuguguuuaccuuuagcagugagauucauauuuucauaugcuuucaugaugcuguuuaucaucuuuucauuucagcuugaaaaacuaacuuuagcaggucuaguggugacaaacuuccuaguuuugacaggggaagacuuaucucuccuucauccuuaaacuacaguuuuucuggauaaaguauucuuguuuggcauuuuuuucuuucaguacuuugcuguaucaucccauugucuccuggccugcaagguuucugcugauaaaucuuacaauguuucccuugugugugacaaggugccuuucucuugcugcuuucaaaauugucucuuugucuuuuauuucugaaaaacucuuaauauuugagacaaacuauaaugugcuucagaguagugcucuuuuuguuuaauauauuugaagaucuuaggacuuuaugucaacuucccucuguagaguugggaagauuuuugccauuauuucuuuaaauaggcuuuccaccacuuugaugguguucuguaaguuucauaggcuuucuucacuuuuucuuuuuuuuuuuuucuucuaacugguuaauuucaaaugaccaggcuucagauuuacugauucuuuuuccuacacgaucagguuuucuguugaagcugucuauuggguuuuucaguucaaucauuguauucuucagcugcaagauuucuguuugguuucuucuugaugcuucuguuucauuauuaaauuucucauuuuguucauguauugauuuccugauuucauuuaguuuuaaaaucuguauucuccugaagcucauugagcuucuuuaagauggcuauuuuggauuccuuuucagguaauuuauggaucuccacuuuucugggguugguuacugggguuuuguuaguuaacuuuggugguguuauguuuaccuaaugcuuugugguccauguaaacgugugugugucugugcauuugaaggagcagacaucuccagucuuuacagacugguuuuggcaaguaaggaucuacuccuagcucaccagacugauguuauugccucugguaucucagucaagcugaguuuggagucagguaaguuggccguuucagggucugcaguugggacugagcuuggggaaccugucaccaaggguaugaauagacgugucucccagcaggccacaguggagaggggcugaagccaggucacaugacuacuuuaguaucugcaguugggucugaggucagcgagcauguuauuggggggauagguuggguauggccccucucaggaaauggaagaugggacuuuuggaagcaccacagcuccuugugguuggagcugaguucauaggaggacagggaugcuuucaguccauagcugguaccaaagccuaugagccugccagcaggcugugggccugauuucucaguguaucccuccucagucuggggcucuaccaggguuucacaaccuccuaucuggaucccaaagcucuuacaaaggaacuucugugcauggcaggcugccaaaucauuuuuuucuguugggguacaugagccagagacuuccuguucuacugucuuacugaugucacucgcaccuguguguuuaccagugcccugugaguucccaaucuucaauuuauuugguaacaucuggaaaccauaauuauguccugcaagaauuaugcaaguuacuuauuaaggaauagaucagaggaaaaaaaccugugcccaacuucuugggaaauucauaggaaaagagaguuuagcuuuaaauaaauagaaacauucugcuaggaaaauguaaaagaaauaaaugcagagaaucccaauaagacacuucacaagaagaucccuccuaagauacauaaucaucagauucuccaaggucaaaaugaaagaaaaaauguuaaaggcagcuagagagaaaaaucaggucaucuguaaagggaagcccaugagacuaaaaauggaccucuuagcagaaacccugcaagccaaaagagauugggggccaauauucaauauccuuaaagaaaagaaauuccaacccagaauuucauaucuggacaaacuaagcuucauaagcaaaggagaaauaagaucuguuucaaauaagcaaaugcugaaggaauuccuuaccuccaaaccugccuuacaggagcuccugaagcaagcacuaaauauggaaaggaaacaccauuaccagcuacuaacacuaaaguacacagacuacugacacuauaaagcaaccacuaaacaagucugcaaaauaaccagcuaacaucaugauaacaggaucaaauccacauauaucaauacuaaccuugaauguaaaugagcuaaaugccccaauuaaaaggcacagaguaguaagcuggauaaagaaccaagacccauugguaugcuaucuucaagaaaccugucuuacaugcagugacacacguaagcucaaaacaaaagggacugagaaaaaucuaccaagcaaauggaaaacagaagaaagcaggaggugcaauacuaauuucagacacaacagauuuuaaaucaacaacgauaaaaaaagacaaagaagggcauuacauaaugguaaaggguuaaauucagcaagaagacauaauuguuuuaaauauauaugcacauaauacaggagcacucugacucauaaagcaguuucuuaaugaccuucaaagaaacuuaaacucccacacauuaauagugggagacuuuaacaccccacugacaauauuagaccauaaagacaaaaaauuaacaaagauauucaggaccugaacucagcacuggaucagauggaccugguagacagcuacagaacuuuucauccuaaaacaacagaauauacauuuuuucauugccacauggcuuauacucuaaaaucgaucacauaaucagaaauaaaagacuccucagcaaaugcaaaacuuaaauaauaacaaccaaucucucagaccacagagaaucaaauuagaaaucaagacuaauaaauucacucaaaaccauacaauuacauggaaauugaauaaucugcuccugacuuacuuuugguuaaauaaugaaaggaaggggaaaaucaagaaguucuuuuaaacuaaugagaucaaagauacaacauaccagaaucucugggacacagcuaaggcaguuuuaagagagaaauuuauagcagcaaaugccuacaucaaaaaguuagaucucaguuuaacaaccuaacacuacaauugaaagagcuagauaacuaagagaaaaccaacccuaaagcuagcagaagacaagaaauaaccaaaaucagagcugaacugaaggagauugagacacgaaaaauuauucaaaggaucagugaauccuggagcuguuuuuuuuuugaaaaaauuaauaaaauagacugcuagcuaggcuaauaaagaagaaaagagaggagauguauauaaacacaaccagaaauagcaagugaggugucaccacugaccccauagaaauacaaauaaucaucaaaauauuaugaacacuucuaugcacauaaacuagaaaaucuggaagaaauggauaaauuccuggacacacacacacucucccaagacugaaccaggaagaaauugaaucucugaacagaccaguaacaagaucugaaauagaaucaguaauaaauagccuaccaaccaaaaaaaaagaaaagaaaaagcccaggagcaaacggauucacagcugaauucuaccagauauacaaagaagaacugguacuauuacuacugaaacuguuccaaauaaauaaauaaauaaauaaagaggaaggacuccucucuaacucauuuugugaggccaacaucauccugauaccaaaaacugacagggacaccacacacaaaaagaaaacuucaggccacuauccuugaugaacaucagcgcagaaauccucaacaaaauacuggcaaacugaauccagcagcacaucaaaaaucuuguccaccacgaucaaguagucuuuauuccugggauguaagguugguucaacauaugcaaaucaauaaauguauuucaucacauaaacagaacaaaagacaaacaccacaugauuauuucaaaagaugcagaagaggcuuuugauaaaauucaacaucccuucauguuaaaaacucugaauaaacuagguauugaaggaauauaccucaaaauaauaagagccauauaugacaaauucacagccaagaucauacugaaugggcaaaagcuggaaguauuucccuugaaaaccagcauaaaacaaggaugcccccucucaccacuccuauucaacauaguacuggaaauuuuggccagggcagucaggcaagaaaaagaaauaaagggcauacaaauaggaagagaggaagucaaacuaucuccauuugcagaugauaugauccuauaucuagaacacccuauagucuuggcccuaaagcuucuuaagcugguaaaacaauuucagcaaagucucaguauacaaaaucgauguacaaaaaccccuagcauuccuaaaaaccaauaacaguuaaacugagagccaaaucaggaaugcagucucauucacaauugccacaaaaaaauuauaaaauaccuaggaaugaagcuaaccagcgaggugaaagauuucuacaaggagacuacaaaacacugcucaaagaaaucagaaauguuacaaacaaauggaaaggaaggaucaauauuguuaaaaauggccauauugcccaaagcaauuuauagauuuaaugcuaugccuauuaaacuaucaaugacauucuucacagaacuagaaaaaacuauuuuaaaauucacaaagaaccaaaaaacaaacccaaauagccaaggccauccuaagcaaaagaacaaagcuggaggcaucaugcuacuugacuuaaaacuauacuauagggcuacaguaaccaaacagcaugcuauuuauacaaaaacagacacauagggcaauggaacagaauggagaacccaaaaauaagaucacacaccuacaacuaucugaucuuugaugaagcugacaaaaacaagcaauggggaaauaacucccuauucaauaaauggugcugggagaacuggcuagccauaugcagaagauugaaacuagaccccuuccacauaccauguacaaaagauaacucaagauggauuaaagacuuaaauuuaaaaccuaaacuauaaaaacccuggaagacaaccuaggcaauaccauucuggacauaggaacagucaaaauuuuaugacgaagacuccgaaaccaauugcaacaaaagcaaaaccugacaaauggaaucuaauuaaacuacagagcuucugcacagcaaaagaaacuaucaacagaguaaacagauaaccuacaaaauaggagaaaauguuuuccaacuaugcaucugacaaaggucuaauauccagcaucuaaaaggaacuuaaacaaauuuacaagaaaaaaaaacaaaacccauuaaaaaccugcacguugugcacauguacccuaaaacuuaaaguauaauaauaaaaaagaaaaagugggcaaaggacaugaacagacacuuuucaaaagaagacacacaugaggccaacaaacaugaaaaaaagcucaacaucagugaucauuagagaaaugcaaaucaaaaccgcaaugagauaccaucuuacaccagucagaagggcuaucaugaaaaagucaaaaaccaacagaugcugguaagguugcagagaaaaaggaacacuuauacacuguugaugggauuguaaauuaguucaaccauuguggaagagacaguguggcaauuccuccaagaccuaaaagcagaacuaccauucaacccagcaaucccauuacuggguguauacccaaaggaauauaaaucauucugucauaaagacacaugcauguguauguucauugcagcacuauucacaauagcaaagacauggaaucaaccuaaagacccaucaauaguauguuggauaaagaaaauguaguacagauacaccauggacuacuaugcauccauuaaaaaaaagaacaagaucauguccuuuguaaaaacauggauggagcuagaggucauuauccuuagcaaacuaaugcaacaacagagaaccaaauacugcauguucucacuuauaggugggagcuaaaugaugucaacacauggacacauagaggggaacaacaacaaacacuggagucucucagaggauggagggugggaggagggaaaggaucagaaaaaauaacuaauggguacuaggauuaauaccugguugauaaaauaagcuguacaacaagcccccaugacacaaguuuagcuguguaacaaaccugcacauguaccccugaacuuaaaaguuaaaucaaaaagauacauuauauuucugaauaacugaaaauuuagugucuuguaugcaugaaaaauauuugugcuaacagaccuuagaugauccaacucaacauacccuuggauuuaacuaaaaauauaacuauuuuccaagcuauuaauuaugauuuuucucuuucaauaguguuguuuguuagugcugaaaauguuaacauauugcucuacaaccaugcagaaggaauuaaugagcuucuguugucuuuuuucauaagcauaucuaauuugcucauucauccacuuguucauuuguucuacccuuauuuagccaggcaaaagagagagugcagucauuccuaauaaucaugauuuguuuuccuuuuuucagccaugcgaugauggaccuacugguugaacuuugccuucagaaccaccugaauccaucccaccaugcccuugaaauucggucuucagaaacccaacaaccuuugaguuuuaagccaaauacuuugauugggacccugaaugugcauacuguguuucugaaagaaaaaguuccugaagagaagguuaagccuggucccccuaaggugccugagguuaguagguaccuacauggaaauaccugugucugaauguguggcagguccugaguaggggccaguguggcucuucuuaucaaaguacagugcagagagcuguggcugaggcugcuacuuucaugccaggcaaagcuaggcacuaaacagaguuuguuuuaggagacaaaauguacacaauugaauaauguuuauuguuguaacauugcuucuuuauauauuauagaagaggaauugaucuacaguggagcuauccauuagaccuucauucaaagaggggcauggucuuuaauucuguacuuucuuauaugauagccacuggcugcaugcagcuuuuuuaaaaauuugguauguuuauuauaacuuaaauaucuaaaauauucauguagauuuuucuuuuuucauuuuaauugacacagcuuuugaacacuugaaauguggcagguaugauugagaaacugaauuuuuaauuuaauuuuaacuuuaaauuuaaauugccacuagcuaauggcuaccugauuggacaguguaguucuagaauucuuccugacucaggaagcaguugguauccauagaagauuuaaacaucuucccagaggaagagaaaagaaagggaaaaaaacuuuuuugaaaaacugaugucagaaauauuuauucauugcauuuggagaauaucuuauauacauagcuauauuccaggcuuuuguuuauuaauuaaaauuaauucuaguagcuuauuauauacuuuuauuguuuuuguuguuguuguuuugagacggagcuucacucuuguugcccaggcuggaaugcaguggugugaucuuggcucacugcuaccucugccucccagguucaagcaguucuucugccucagccuccugaguagcugggacuacaggugcaugccaccacacccggcuaauuuguguauuuaguagagacaagguuucaccauguuggccagucuggucuugaacuccugaccucaggugauccacccaccucagccucccaaagugcugggauuacaggccugaaccaccauacccagcuuuauuguacuuuuaaauaaggcuuugauauuaaucuuuuagcuaaaauuaaaagcaauguuacuuucauauucuuagcagaccuucuaaauuuuccugcuuuuaaaaaugguaaugcagccaacauuaaucuccuauuaauuucuaggauugauugguuagugcauucucacuguuaucuggaacacucugaccagagauuuccccuuauuccucaaguaaacaguguuugaggcagagcaucucuguauauaccuugcgucuucccuugacuuccugcuucucagggcaggugagcccaggcaucugcaugauuccacuuguuagggcaggagaggaccaguaaaggagcaguagguuccgucuuuucucccaaaaugcauuguuaucccagccacugggcccugguacgcaggcuggaagagagcgugaggccuuccuuugcugcucuuuuguucaaucuacauuuacuguguccagcucuacagugucuuagcacaauuagagugaucaguaaaagcggaagaaaaauaaucaaaaagugggagaaaaaugacuaccacuuuaucugcagucauuuagaauuagcauuagucaacugaguguuuuucuuccugauuauuauauaugccugguguuuuuuaaaauauauuuauagcuuaaauacguguguguaguguguauacauaaauacauguaggucuguguacacacuguauauguuucauauauguguguauauaguacauauauacaguauauauguauuuauauauauauauaucuauguacauauauagauauuccuguauuuauguggauauuuugacuccuuaaaacuuugaugucauguuuuuggaggguuuuucuuuaaauuauucauacugcuuccaaacuuuuuuuuuuagaaaaugcauauaagugccauguguucacaucuggccagaacccuuggaagacaguaaaguauauguguuggauuuuaaauguagagucuucccugauguuuauuucgcuguguuguuagcagcuuguucacuagcaagagauucuaaaccagauuuauuauucuagacauuuguuuuucaauauucauuaugcuguuuucccccauuacucacucaauuuguggaagaaggauucaggcuacacacaauccugccacacccaauugucaaauugacacaagaguugaaggcuugugggaggauaucuuacugaauucuuuuugccuguguguucuuccagaaaucugugcguuuggucgugaauuaccugcggacacaaaaagcuguugugcgugugagcccugagguuccucuccagaauauucucccagucauuugugcaaagugugaggucagcccagagcacgugguucuccucagggacaacauugccggagaggagcuggagcuguccaagucccugaacgagcucgggauaaaggagcucuacgcgugggacaacagaagaggugaggccccgcugcgucucacgcaccugcccauaaucacacggaugcgcggcguguacauguccccuguuggcucuccccagcacucucaguagcgccagggagagauggguacaugaaguuccaggcaagucaaguugaaguaggcaaaaaagaaaucuggccuguuuucauuccucuggauugagcugugccuccuuucucccagcccugaacauguccuuuauccuuugucucccugcaaacuuccacgacauaaguaaaaggggaaaaggugaggugagauuagagcuuaugcucugaaguaacuacuccaaaccaucuauaauacuuucuuguggguugguggcucacacuuguaauccuggcacuuugagaggcugaggcaggagaauggcuugagcucaggaguucaagaccagccuggacaaaauagugagaccccgucucuacaaaaaaauuuuaaaauuagccagacgugguggugcauccccauuccuguagucccaucuacuggagaggcugaggcuggaggauugguugaacccaggagguugaagcugcacugagcuaugauugcaccauugcccucagccuaggugacagagugagacccugucucuuuaaaaaaaaaauuaucuugauuuucuuuuucaguugccauuaacugcuguucccagguuucaaacauugcucaugucuaaaaccaguggcagaaauucauuuagcuguucucuaaaacugaacaauuacagugcgugagauccauuccugaagauaacuuuagggccaccuuaggccuccucacuguguugccagugucauccugcuugcucaucaugugaaacuggcuuuuaguaugaggccacaguuagagccacuggugagaguggcagcccagaggccuugcuggugcagagacuguuauguuguguaagcacauguuucugauugauauagagugcuaacugcuacugucaggccaaaggaaauguuauauuccuugaccuuagaaugaucaaaauggacuucguaaaaguuucucuucuaauaagccucauuugaugucuguugucucuguuucauuauuccacaaauauugaauagguugaguuuaaaaaauauauacauauucaaguuuuuccuguuuuucuaugacuuuuuuuucuaauuuuuuccaacaaaaauguauuuuuucucuuuuuuuuauuuuuugagauggaauuucacucuuauagcccaggcuguagugcaauggugcaauaucggcucacugcaaccuccaccucccagguucaagugauucuccugccucagccuccugaguagcugggauuacaggcaccucccaccaugcccggcuaauuuuuguguuuuuaguagagacgggguuucaccacguuggccaggcuggucucgaacuccugaccucaggugauccgccugccuuggccucccaaaaugcugggauuacaggccugagccacugcgccuggccauauuuuuucuuaauaccaaguuuauugugaaauccaugaucauaguggaaucucuguccagccuuccucuccccgccaaguccgcccuugucuuccuggguaucuggcaucuagaucugauuugacauucaagagaggguuuuggcucaguugaguauaagauacauggacuguuuauuucuucaaaaaaaguacucugacauuugagaauaaugcaucuuguguuuuauccagugucuuuuuuaaaacacagacagaaauagucucaguauugcugcaaaggccugguggcacugaguauaucagcacuauuuaaauuugguuuacaugacucuuuggaaacagcuuccauuuguuaagauaaaaagaaaaauaaagggaaaacuguuucacguucagguaucugaaauaaaaaggcuuacaaguguuucuguuacaugcuaccacuuggauguaucuugaaagguagauguugaaccuggcacuugggagaagugauauaaaaccugccugucugugaaggagaggacccaggauagcccauggucauugggaauguaggagcugaaguguucauguggucaggggcccagagcaucucuucugauccucauaugggacagagcagaacaagccggugcggucagcuuggccguucagauuuggaagcacuucugcccuugguuggaacuagcugcucccaaaccuccaagucccccucucuacuccuuuggacauuuuggcccuuuccaccccacccccaaggcaccacgagcuuccccaccaugggggcucugcuccagccuuguggccagcaccccuuucgucuggaccaugccugugccaugccagcugugacauuugauuaccgucccugccaaaugccugccuccugcucacugucaaauauucgaaaagaaaagacacuuguccagaggccaucuccgaggcucccuuucuccccuacaaccgcccugggcaggccugcuggguacugcuggaggagcccuuacuuucaauccucuugguaggcacuuggaggggacagacguccacuccugagcccuaccacugcuggagaacagaagggcagcuggcaggaggugaggcauugcuacgcagaggccugcccuccccuggaauccccggugggagcaucuugauaaagccaagggcucugcugccaccugcguccucagcggugcuuagcaggcuaugcagcuguggcccugagagggccagcccagagaggcaagcugacccagcaagagaccuucucacugcugcagcaggacagccccccucugaggcuugugagggccaaggccugggucagggacucccacacaucucaaagcuggaccucacucucucauugccugccuuuuccaguucgucugagcaaaacucaguccgagccuucccugagcugucaagguacagugaaccuggggcuucccgcucccgcugugaggcugcacuaugcauggcucuggggucagagcugcacagaggugauguuuuugugccagacuccaaggaauggaaguuuggcuuggggcccuccugaaggugcaugcgaggcugacaugagauuuugguuugguuucuugauucccugguugguucagauaagaaugcuucuuaggagaauuugcuguguggcucuaauugaugagaaaugagggaggcuguuacagaaaacaaauucuguugcccaauaauucagggcagaucagaaguggugugcgcaggaaaggcacccuuuccuuuucaccucugccugcccaugcuuaccugccccugaaggccauccugcaugcuacagaauuugggacaguauggauuuuaaaauuuaaccuuuucugucauagacaaguaugcaaaugauuaguccagauuuugcauuuauuccaacaucuauuuaaguuucauagagauauuucuauacagaaagagauguuuauauguauauauaggcagauauagauauauguguguguguguguguguguguguauauauauauauauauauauacuuaaacauauacauauauguauauacauauguagaaugcccauuguacauuugcagauguugaccuggucccccgcuuccauuuacuccuuauggccuuguucuggucacugagucuccuccucuagacaagugagugguuuggacucguuggucuuuaaggguccuucauccuucucugccacucugcaauucaucuuuaacauuuuucaaaucauuguaaugcuucagaaaguaaaacuuucuugcagacugugugaguucccacacuuuucuuaauauuuaauuacguguaaauuagaguaaauucaaacaaaauaaaugccacccucagcuuaucauaccauaggcaccauggguucuagagcucacuugcguguguucgagggcuggcuaugcaucaguuguucauuguugcucugcuuuauagcugggcagccucuggaaauuuuggcugaugggaacacugaguucuccuacuuugcucccaaaccaguucuucuucagugucugccaagccucuagaggccucauaggaggccccuaucagucagugacugagaccaaagccucaccucuaaaaauagaccaucaguguuaggcgcagcucagcacugugagucacaggccccuggugccuccagacagcugcaggcuguagcugcaugagaaagugucucucccacuauugaggggcauucuggugccggggcuguccuggacccuucgucagggagccgaccucaguccuuagaggugaugaucagccacuguccucauucaagaagagaaacaacaggcuagaucucauugcaguuuucugaugcagucuguccuuucuguggucgguguaauacagcuuguguacuaggaaaaugcucuacuucucgauuaucaguaggauacuaugaugucaucuguuucaacauagacaauuucucaacuuaagauuuuucaacuuuaccauggugugaaagugcuaugcauucaauaugcuccuggacuuacgauggggucacaucuggauaaagccgucgugaacugaaaguguaaccccaucgucaguucgugagcauccguugguccaugucacauaccacucaauucuagaaacauccuugguuauaaacauacauauuaaagcauauaauaguuuagaugcagucuuaacugugugcucuguuuuccucuuuauagcucuguaccuaauagagggcuugcugcaacuaacuuuacagcgcguuugcacacaugcauuggugcugcugcaccauguugcagugggcccucugauuuggguacugugcgauguggagccugcucagugccuccacuggagccuccugcauguaaccaaguguccuggcccugcccugguggcuaggaugugcaccuuugcuccuacagcgugauaucaggagcgugugugcuggguuuuugcuuugcuguguggacgcuaucaguguucacgccuguguuauuaaugcacugacugcuguguguguucucuaacucaaaugugaaaucauauauuagcaggucaagaaguuaauugaggguuaccuuguuugcauuaauagucugauggcagaauuuguaaaaucccaguccaugauucugccaccaaugguauagagcucuugcuaucaguuggcagugauaugggaaaaaucauuuuucuauccuccaggaacaccuccacuuuccuucuucuugucauaucuguaugcccuggcagagaagaauggaaugaaguaaugacaaaggccuuuccugagcaaaucaugacacuagugagcagugugcugagcugugugagugccgucugcgugcuugaugcacucacccucaaccugcagaugaagcugcugaggcuuggaggagcuaagugguuuuccgaagugugccucacacaugggcgcucuuaaucucucagcaccacucccaagcguguucuccagacccucagcuuaagccuccuuaggggcuaguuugacuguguagugcugggcccugcacccagcguuucuuauucugggggucuggagugggcccaagcauucgcaucucucauaaguucccagcgaugcugaugcugcagguuccaucucgcuuugggaaccacaucccauggcugucuugucagcugacagacacaucugggcuucagugugcuugucuggaauuuggaagguuccaaccuggcucuagaauccugaugaagaaaaauucaagagggguugaggauuuagagcuucaggaaaaagaaagaagaaaacaauugcuccccuagagaauguaauuugaaaggaaaacguucuggaugcagcagaggaaggaaaaucuggaaaggugguuccugggagauuugaugcaguuguuucaaauaccaccuggggagcccauagcuguuacuccauuuucuggaaaugagcaggaaagcugcugauuuauuucauuuaguuaaaguuuguaccucacucauaauucuuaaagcagguguauugcacugaugucgcagucuuagagcugugcugauuuggcagccacaggccucauguggcucuugcauguaccgaguccacacugauaugcuguaagccuaaagggcugcuggauugugaagacuuagcaccaaaaccaauguaaaauaucucaucaauacuuuuuauauggacugcaugauagaaugacaauauuuuagauguauuggauuaaaugaaauuauuacaauuaauuuuacuugguucuuuuuaauguagccacuaggaaauguaaaauuacauguguggucugguuuagcuuucuguuggacagcucugcccuagaacuuuauuuauuuugucauucuccaaaagggcacaaccacacccagagaaaaugccuccaucauuccuaaaagacuguguaagaaccuguagugauuucccaaauggaccugaggacuugaaguggcucggacagcuuugaaagaaauaguugauggcuuucccucucuuacaagaacuaaaaguuuaagaguagaggauucauuuauuaagauuuuuuaaguaaaguauugaaucucuuguuucagaugcugaaaaauaacuuagugcuuuuuuuuuccagaaaccuuuaggaaaucaucacuuggcaaugaugagacagauaaagagaagaaaaaauuucugggauuuuucaaaguuaauaaaagaagcaauaguaagguaauggauuaaauacacauaugauuuuguaucauguaaaaaaaauagucucuugaaauacaugcauucaaccuguccuggaacuuuucuaaacaauucuauuuaagaauacuaauuccuucagguaaaagagagcuuauuaguaugcacuggaaugacaggcugugcuuccacacuugauuccaaaaggaguaaucuugggugauggugguuuauucacuagggggacaggaagccugugggcuccugaugaccggggccaugagcccuucugccuguggguguuccgguacuuccacagaacucugccuguggcugaaacucaguaaaucuuguuuagauuaaugaaugagugaauggauguuauaguuaaguguaaauagccaauauugcuaucagugaacuguagcuuaugccucguggcagagaagaguaucagucauugaacuugucuucuugcuaguaauuuuuagauguucuuugguccuccugauaugaucugggaauguacuaugugauaaguuaauuuuauugauuuuguugguguuuaugaaacacaucucagagucauauuuuggauacaguauucuagaguaauuaagucauaguacccagaauaaaaaugaagauuuuuauaauuaauuauaagauuaucaaacccauaaaugccuucugacuaccaagaaaagaaaaugcucauuauccguauuuauauuugcuucacaaguauauuuuacuaauaucuaguauuuuauccuuacuaauaaguaagacuaaaaaagacaaaacuguuccagugaauguuagguuuuaauuccacuagcucaguuuggaagugugcuccaucuguauauuucuacaagagaugugaagacuggggacucaaguuugugugcagaccuucucagugccauggugcagauaggugcauguagcccaaggccggacaccugauuuccugcccuucaguggccuguggugcagccucugcuguuagaauugugguuuacccagguuugcugaugaggauaccagggcucagagaaauaaaguaaccuucuuagugucccaggcuuagacacagaugugucugcgugcagagccagcacgucccuguagcccugugguguuugggaagggaggaggagagugagagccagaugagaacagaagguccaguggagcucggccgaacuggcagacuuccugucuuuaagaguuuuucacaaaccucagauucaccucugcugaagcuucgguaaugguuuugugauucucuuguacuuaagagauugagcuuuuccccauguugugcuuuucuccauguuucugcauguccuuugaaaaaucuguacuccaugcaugucuauguaagaccuuuggcucccugacauuuucuauccccucccacucuccaacuaucccuuccucucccccucucuuccccccuacucucccuccuccucuccuagcuuccuuuccugucagaauuacuugaaaucacagaagcagaauuuuguggccgggcgcgguggcucacaacuguaaucccagcacuuugggaggcugaggugggcaggucaccugaggucaggaguucgagaccagccuggccaaugcagugaaaccccgucucugcuaaaaauacaaaaaguagccaggugugguggcagguaccuguaaccccagcuacuugagaggcugaggcaggagaaucgcuugaauccgggaggcagagguugcagugagaugagaacaugcuagcgcacuccagccugggcgacagagcgagacuccaucucaaaaaaaaaaaaaagagaaucagaauuuuguauuugaauuuuugcucacucuuugaauguugucuuguugguuuuuuuuuccugacguuuuugagauaaguuggcugggacuguguucacccuuguccuccuugauccugaggacaccaguucacaguaaaauccaccauuccucauuccucauuccucacccuuagaccucaaguaguuguucucuuugugucuucuuccuuguaaaagaugaaauggccagaaaaaccaaguaaaaaaucuagaaagacuuucguuuuuagcaaaguaaggucaccuaaaaagcuggagauguggagacugacucagcuucugauaguucaggguguggggagacaccacaucuggcaacacagcagugaaggcgcagucagugauccagucccguccguggauugcaagggacuuucugucuuucaccauuucgauacagcagugaaggcgcagucagugauccagucccguucguggauugcaagggacuuucuguuuuucaccauugucgacacagcagugaaggcgcagucagugaucgaguccucucuguggauugcaaggggcuguuuuucaccauugucaaccuaaagaaagaaacugacucaaaauuaauauagauaguuuaucugggccaagguugaggacuguagccugggacacacuucguuugccuuggggaaugcuccauucagccguaguuacaagaagguuuuuuagggcaaaaaggaagaagguguggcugacacaaaguuguuugacaaggauucucacuaguuuacagaaauaacgcugauuggugauugacuguacacuccugaacugcggcagaugaguuauggcauccaguguauggcauuuuguagcuacuuggcaaaaaauucacucaguguuacagcucaaguagcaauuggcuuuaagagcuaauuauuuagcucaggcgggugugggacaugaccaccacugcauuucaaugcuucccugggccugauaauuaaaaggagcucacauucuguggauaaaaaguguauuuauuucauuucccucuuuugauacaaaauauuucuucuugaaagcauugaugauuaaacgcugagugucaaggggucccuugucacugggaagggugauucucagauagcccugucccauguuagggaggaaagaaaagauguuuuagugaggaauuuuaagggaaccccaaagccaaauuaggauggcauuacagaguggcaagaaugaaaccucagucacgucagaaauuuauuagcugcuguugcuuguugaaucaucucuagucuuuggaauaccauuuuaguuuucucagaagaaauaaaaccacaagcaauauauaguauuaauaaucugaacaguaaaagcguaaugcacacaggauuggauuauagucagaaagauaauuuauaugccagaucaaacaaaccugaauuccauuagggaacaacugaaaacaucaggcagaacauuacauccugcuucuucuuuagagacuuguagccaggagguaauucaggauucaguccaaauugugggcaaauaauaauaucacaaaaacaauagucugcuagaacugaauaacagguggguuauugaaaaauaauuuuuccaguuccuccaguuuuaccaaagauaaaucauaguagaaccaguuuauuuguaaaauuaguuuuacacuuauuauacuuggcaugauuauuugcauaagaugcagcaauaagaguggccauacugacucauuuuaguuggcuuugcuggaacuuuuugguuaaggaaucucagauuagauuuuuaaaagccucuuguggcuaggaagccaaguuaaggauuuaccaucuaacugugccgguaauaccuguaugaauucagugaauuucuuucuucucgagaucucaaaauaucuugagauuacugggccugucagaaagugacaugcuuuuacuuacugcaaggucagcaaccuuguaagggaaccaugucgacaaggaaccgggccagccauuuucuaaguccacuggcuauaaagucaacuucagcccuucaaaccagucuggucauaucugaaaaucugucauuccagucuaagccuuguaaaauaaccagugcuuucaaugugucuuguuaaaaaagaaaacagauccuuguugaacuuaugcaaguaaguauauugccauaaaaugaaaauacaaauaguuucugaauuuuggagaaaucagguagaaugaaagauaaaugucucaguuugcccaccauaguguacuuuacccaauugcuguaagcuauaaauagcucaaaaagaaaaguuuucuugaugcuagaaaacaaaacaugaaaagaaccuacuguguuucaaacaaaaagaagucacaaaaaucauuucagugcucugucacuucagugccauguacuuagcuuuuauucugcuugaaguuggguuagcgaucuuuaugaacucaucagguuugaaauuagauuacuggauuuuuucuuuuugcguuguucaacggcaugaucuccaaaauuaucagaaacuuguauucagagugcuuuuugugaucuucuucauaagguuccuugaagauacaaugcuuuggcauuuacaaagaacuuuuaggaaaagagagcaucagaauaaagcaauuuacuguuuaugucaagacacaucaaauuuuucgguaucuuuuauaauuauagaaugcauauuaauagcauauucauauaaaaauaaccugaagaaaguuaagcaccaucucuuggcugggcgcgguggcucacaccuguauucccagcacuuugggaggccgaggcagguggaucaccugaggucaggaguuugagaccagccuggccaacauggugaaaccccaucucuacugaggaguacuaaauacaaaaauacaaaauacuaaaauacaaaaauugcuugaaccugggaggcgaagguugcagcgagccaagauugugccacugcacuccagccugggugaaagagcaagacucuguccccaaaaaaaccaaccaaccaaacaaacaaaaaagaaaguuaaacacucuuauuuaacaaugcuuccaguaugauuuucacauaccaaauaugccuaauaugccgcuuuuggaguuccagggucccuguuuggauuuccaggagcccuaaucuccaaaaguuaguucaaugugagaaagacucauuagaauuugaaguuucauuuuaggaaguuugucaaaugucaaaggcuugaaacacuugauuucaaaaugagaucacaguaaaauaauauucauuuagucaaagugauuuuuuucaaagauuucaaaaagcaaaaacauuuacucuuugauuaagaggagacuuggcugggcacaguaggucaugccuguaaucccagcacuuugggaggccaaggcggguggaucgccugaggucgggaguuggagaccagccugaccagcuuggagaaaccccgucucuacuaaaaauacaaaaauuagccgggcaugguggcaggcaccuguauucccagcuacucgggaaacugaggcaggagacuagguugaacccagggggcggagguugcagugagccaagaucauauccagccugggcaacagagcgagacugucucaaaaaaaaagaagagagacucaguuuucagaccuaauaaagacacggugagugugucuuccucucucuucuuuuuuuauugcagcuuauucaaaagguaaauaaaaccuuuuauuauuuuuuaucaauacuauaugaaaacccuguucaaaagagaaaaacaaguuuugccuuuguauuaauguauuauuaccaauaaaccuaauuuuaauaaaaccuuauaaacaaauccauccaaccucauucagcuuugaccacacagauaaguuuucuauaaaucuuuuauaaccuuuugcaauauuuuucauuuuuuucuaacuuccuauacccauuuaguuuuaucuaucauuuuuguauuucauuaauuuaaaacagcuuuuaaauaaccuuuaagccaugcaaaauuguuguuccuuuagcaaaaaccacauaaaaccacauguauauauauauauauagagagagagagggagagagagagacagagagugagagaguguguuucacucuuguugcccagccuggaaugcaauggcaugaucuuggcucacugcaaccuccauaucccagauucaagugauucuccugcuccagccuccgcaguagcugagaugacaggcacgaaccaccaugcccagcuaauuuuuguauuuuuaguagagaccggguuucaccauauuggccaggcucgucucaaacuccugacucucaugugauccacccaccucaaccucucaaagugcugggauuacaggcaugagccaccgugcccggccaacaaaaacuauauuuuuaugucuuuuuuauaaccuuuuaaauuuuuauuuauuuauuuauuuauuuauuuauuuauuuauuuauuuuuuugagacagaguccucucugucgcccagacuggagugcaguggcaugaucucagcucacugcaaccucugccuccuggguucaagugauucuccugccucagccucucaaguagcugggaucacaggcgccugcuaccauggcuggcuaauuuuuguauuuuuaguagaggugggguuucacaugucagccaggcuggucucgaacuccugaccucaggugaucugcccgccucagccccccagagugcugggauuacaggcgugagccacugcaccuggcuauaaucuucuuuaaaaccaaaaaugcauuuuacuuuucuugugcucuuuggauacaaauuguuucucuuuuaucuaguagauuuaauuacauauauuaauuucaauguuaacucuuaguaucccaaauauuugugaaaagucuuaagaaguaagcaauuuuaauuauguaucuugauacagagcccagaaaaaaggacagaguuaugaaagcaaugccuggagaaccaaccccucccagcauuuucaggaggcacaagugagccagggaagacauguagcguagcucugccccacagcucuuggccuaggugcugcagacauccacguguccccaggccuucccguggccacuugucuauaccccagaaucaaacagguaucaacaauaucacagaagcaacaguuuuaugaccuuaaacaccuaccagaaauaggcuaaaccuauuugacuaguagacccaggcaaaaaucucuaaauuaaauucugaaaauauuucuauuuuauuuuaccaacaauuuuaaaacuagccucauuuaccaaagauuacugaagucacaugaacuugaaaagcauuugggcuuauuuacuaaauuuaugagaacugauuuacuuauaagucaguuugguaccauguagacaauauacaaacacagacguguacacauguauacauacaaacauagacaaaaauaaagauuucauagcuuugauuuuaagauuuuagccacgagucaggugaaauucacuaguucaaaaggacauuuggauucaaacugugccuuuguaaauggaacaaguuaaaguuuaucugucucauaugccuaaagcccucacaaaauuuaacaagguagcaaauuuacauuucaaagcagagagagaauuuaagcuuuuguaaauaccaaugaauuuuacauuaucuuuggcaaaaaucauguccucaaaagggaagcagaccaagggaguauauuugguuagcagggguuuaagaagaaagagauucaaucaacugagaaacuuuuauagagagaacagaggacucaaaaaauaugggugcauauaugugugugugugugugugugucuguguguguauacauauauaucccaaauaucaguuauucauuaaguuaccuuuugacuagagagcuccugaaucuuuucagucucuuaucagauuuuagccaggacaaaucagccaauauccuugcuuuuguauuuuuuaauuuuuuccucuuuuaaaccaaagguaccuuuccaagugacucaccaaaacuaacacgacuuaaccaagguuaugauuuaaccagagacuugccaaguaucuccaaagaggugcaacacaguccucacaagacccagagccaccagaaaaacuucaaaauaaggaagguuuugcuagcugcaaaugggguacaagccccaucuguccugucuagcguauucccuagggucucagcuucucagcugaccgucuguauacaagguccagacugaggauuuaaagagacagugggaaagacaggaaaacaaaagcugcccguggggguagugccaaaaggcaggaaaacgugggaagguaaauuuaugggaugaauaaagacugcaccuagauucccuggcacugcugucucugagcccauaagcaagucuuauaauggagccuaucuuuaggugagaauggcaggcaggaaaaccuuugucuuucuaaauugccucucugccaucaggcaagccagaggaaggggcagugucucccuggauguuaaccuucuucagcuaccaaucaccaguacuuaggagaggaauauuuugguuuccuucaguagauaggauuauaaaugaguauccgagacaaauaauucaaauuaauuucuuauaaauguuucuuuccugagcaagagauacccacugaggaaauaaauguugugguaugucccaagaacauuaacgauguaucaaaccuguucucagcuggaaugcugcuuagcuaauacaaugcauguuaacauuuccaagacaugguaagauuuacaucuccaagggacugagaaaggucugcaggcaguuuaggcauuuaaagaguuuuucuggggguuuaaggagcggucucuaaaaaaauucucaaaucucuuaauaugggggugagagaacucacguucaugcaccuuuugguauaaaacuaauaggaauuggucacaaauuuuuuaaaguccaaauuauaaacaguagaaagcagcugcaguuuuaaaagcgugcuauguaaagugauaucagcagugcaaaacugccaauaccuugaccuaccugcuccaagguggaaaagguaguuuuccucuuuaaucacugaugccugaaucacuugccugcaaggcaaagauagaaccuccauuccagaaagggagcaguggaaagggcagcccaggugaaaaucauagggugguccggauucaggaggucucacccuuugcaccccgggauccucuggagcuggggacccaauauguugcugguaccaagagcugggucugagagaaaacgcugggugcuguugugaggagcacucugaaugcugccgacuuagaccagauaugucggccuaaaaaaagaaacugaggcaagauuaauguagagaguuuguugggcaaaaggugagccucacugccuaggacacacuuucagguugccuuggagagauucagccaugguuauaagaagguuuuuaaaggcaaagggggacaaggagugggcugauacaaaguuguuccacaggaauugucacugguuuacagagaugacauugguuagugauuggcuaucccuuguugggcuauaggguaggaguuaugguguccaguguguggcauuuuauggcuccuuggcaucaguuagacuggagcccacauagcagauggccucaagaagucaccauuugguucaaggguagagugagacaugacugaugugcauuucacugccucuuauuuuucauuucucuauaccuuaucuuucauuuaucacuuuccuucucauuuauuuuacuauauuuuucucuagacaucccuucuucagucuuaucuuuauuggauaauuuguuauuguuuuguguuaaauuuuagcuucuuguuucucuugauuuuuaugguuugagguaccgugcuaaaugcagccucauuuaguuuaucuagaaaccuggugagagaggcauuaucagcuccauuuugcagggaagaaacuuaggcugagcagcuccaagccgagcauagugcggguaaaugccggaauucauaaacaccagaauucaaacccaagccugucuuuccaaaguccuugccauuaaucacugguuuacauuguauggugugguaucaauuucuuuaucaagaaaaaggauuggaaacaaauaauuuuuuaaaauaauuuguaaaauccugugaugucagucugcagaggucucagugaacagaugcuaagaauggagaauuauugaggcauuuaaaacuuaaggugacucuuuacuacaucaccuuaaaggaaaaaaaauuauagguauguguguauauguguaugugucauaugugugugaauguguguauaaaauauuaauaggaaauauacuuaaaggaauaugauacuggcuaaaauaaaggauagcaaauaucuuuuuuguuuuaaagcuuuuguguuuuaaaguuuuaaaagcauuauaguuuuauaucaucuugacauuauuuauucuccuaacacagcaguucucaaaaguaccuaagaaucaccuugagaccuaguuuaaacauuggauuguugggucauguacccaaauauucucauuugagaggccagguuggggucuagaaauugaauuuuccaauugcaccagaugauuuugguacaauagaaagaaauauuaccauuuuucuuuucuggaucauauggagugagauauuuggugaaauuuuucuguguacacccaaugaauuagcugggcagugauuaaaacugaaguccuugggccaggagcgguggccaacaccuguaauccuagcacuuuuggaggcugaggugggcagauugccugagcucagggguuugagaacagccugggcaacaaggugaaacccugccucuacuaaaauacaaaaaaauuuauccuggugugguggcaugugccuguagucccagcuacucgggaggcugaggcaggagaaugcuugaaccugggagguagagguugcagugagccaagauagcaccacugcacuccaaccugggcaacagagugagacucugcucaaaacaaaaaacaaaaaacaaaaaacuuugaaguccucaaaaccuaauuaauuugcuugcugaccuaacuccaucacuucaggcccacuacuguuuuaaaauugcauauuuuugcugggugagguggcucacaccuguaauccuagcauuuugggaggccaaggugggcagaucacccaaggucaggaguucgagaacagccuggccaacauggugaaacccugucucuacuaaaaauacaaaaauuagcuggguguggugauacacacuuguaaucccagcuacuugggaggcugaggcaggagaaucacucaaacccaggagguggagauugcagugaacugagaucaugccacuacacuccagcccgggcgacacagcaagacacugucaaaaaaaaaggaaagagagaaagaaaagaaagaaaaaaagaaagaaagaaaacucauuccuaugaguguggauuucaaaauugugauuuccgaaucagggagcacuuugguucaggucuguucauaaacuggcagaagugguaaagauuacaccuauuaagugaaggguuugcugccuuguggccacacuggcauuuuugccuuaaugaucgcuaaggacuauguuuucugucugaacuuucaccuggagaugauguggccuggugcuuguguuccaggcugagcagcucgugcugucgggugcagacagcgaugaggacaccuccagggcugccccaggaagggguuugaacgugaguacuaaugccccagcaggugcuuccgcuaauugcuuggaacuucuugcuuugcgcgaccuuccagauagugaaaucacagacugguuuaguuuggugauuuguuuuuuguagucuagauagagucgaaagccgccuauugauucuuuuuuaguugcccaugcuacuuuuggaauacguggaauauuuuaguuucuacuuuucuauuugccagucagugugaucaggagaagccuucauuaggguaauugaauucaugcuucccgaaacuaccaucauaaggaguagccuggugguuuuggagcuacucaguccuguuuuccaacccuauagcucucagcugcuaaacucugagccuacgcucuguucacggagccuuugaaaggauuucugaaaacuaccugugcccucacauugcacaguuggcaucuauaaaguuucuucauaguuucaaauacucaagagaauguaauucaugacaucuuauaaauauugacauuuuaaauguaucuaauaaaaguuggaucuuuacuaucaccuauuaaaaauuacauggaaagacucuucuguaucaguaagaaaguuuauauuuucuugauuucacauuuccaggucaguccccauguaaaauuuuauucuauucaauucauauuuuaugcuugaaagucuuuaauacggacuuuaaguaaaauauguuauaaaauuaaaauaucuaaguuauauuuuuuauuugaugugauuauaaaacuguaaguagaagaauauuuuucugggaugaguucucauaaaaauuacaaaauaaaucaaaacaguauaaauauauuacaacuauugacauaauuguuaaacauggaaaguaaauuuuucuugaaaagacauuaauaagaugaaagacaauuaaaaaauuucauguauccauuguguuugaacgugauuuacugauaagaaaagguucaacauuaauuaugugacucuucauuuuuauugaaguaagcccccaggaaacacuuuacauagauaguauauaaggauaaaaguucucuuauagcagugcuuuuuaauuccucaaguucucaggaucuaacaugccaaaaaucacauagagaccuguccucaaaaauuaucuugaaugauccuuugaugauccuugaaugauaccugauuagauuaucuuucaaauuugucaauagcuaaaauuugggagccauccgacuugcaaagugauuuguuacucauucacacuggauauuaacuucuggcagguauaagaaaaaaaugccuuauuaagacuuauaaaaugacaauuauacuuaaggcucuuuugcucauaggcacucuuuuggagaaaagaggguguggcaauggcucuuuaaaauuuucuuaaauuugauuuuauuuuuaauugauucauaaucauuguacauauuuaugggguaaaguaugaugguuuugauacauguucacauuguguagucaucaucaggauaaguagcaaauccauuaccucaaacauuaauuauuuccuugugguaagaacauucagaacccuuucuucuagcuguuuugaaauguguaauacauuauuauuaacuguagucacacaacuguaugauagaauaccagagaguauuccucuugucuaacuguaacauuguaccuguugaccaaucucuccccauccuucuacuccgcucuccagcuucucucuacuucugugagaucaacuuuuuagauuccacauaugggagcauggaauauuuuucuuucuaugucuggauaauuucacuuaacauaauguccuccaguuucauccacgcugacacaaaugacaggauuguuuucuuuuuuaaggcuaaauuauauuucauuauauauauaugugauacauaugugacauauauauauguaugugauauauauuuauauauauauauauauauauauaucacagugucagguuuuguuucagagcuaaguuaauuauaaaguuuucuuggaaaaauaagcaagaauaaggaaaaccccgaaaagcaugaggaauggguaagccuuaccaguuuuaaaaauagguuuuagcaccuuuauaauuacaguaauuauaauuacaauuauacuagcucaaugaagcagaauagaacauguagagcuaauuguauaucgaagcaugguauacaacagggucaacacaucaaauuuguggggggaaauaaacugauaaguagaguugugaucaucgaauagccauaaggaaaaaagaaaaguguagauguuuucauuguauacaguaggaaaaaaaaucgaaugaaucagaaaucuaagugugcaaauggaaaccauauaaauacuagcagaagauauaagugaauucaucuauauaaugagaguggguaaugcuuuuccaauuaugacuaaaaauccaaaugugauaauggaaaacauugauaaauuuguuuuuuuaauccauuuuuaauuguggguauagacuagguauauauauuuaugggguacaggagauacuuugaugccuccaugccaugugaaauaauaacaucauguagaauggaguauccauccccucaagcauuuauauuuuguguuacaaacaauucaguuacacucuuaguuauuuaaaaauguacaaguaaguaauuauugacuauagacacccugucgugcuauuaaauaguaggccuuauucauucuuuauauacuuuuuuguacccauuaaccauccccaccuccccagugaguuccccacuaccugugccauccuucuacucucugucaaugaguucagucacuuugacuuucagaucucacaaauaagugagaacaugugguauuugucuuucugugucugccuuauuucacuuaacaagaugaucucuaguuccacuccuguuguugcaaaugacaagaucucauucuuuuucauaguugacuagcacuccauuguguauauuggaaaccaaaaaguaacugaaauaagucucaaucaauuuagaaaguuuauuuugcuaagguuaaggaugcacucaugacacagccucaggagguccugacgacaugugccugaggggguugggguacagcuugcuuuuauacauuuuggggggacauaauacaucaaucaguacacguaagauucacauugguucaaucuggaagggcagaacaacucaaaccaggguguugggggacuuccagcucauagguagauuuaaacauauucugauuggcagucuguugaaagcauuauuaucaguagaaaggaaugucuggauuaaaauaagggguuguggauaccaagguuuuaugcagaugaagccuccggguagcaggcuucagagagaauauauuguaaauguuuccuagcagacuuaaggucugaguugauguuaaugcuggaggguguaaugaggcauguccaacccccucuucugucauggccugaacuagauuuuuaaguuaacucuggaauccccuuggcugagaagagggguccauucagaugguuagggagccuuagaauuucauuuuugguuuacaauauguaccacauuuucuuuauccauucaucugcugauggacacuuaggucuuagcuauugugaacagugcugcaacaaacaugggagaaugcagauaucucuucaauauacuaauuuccuuucuuuuggguauguacccaguagugggauugcuggaucauaugcuagcuuuauuuuagguuuuugaggaaccaccaaacaguucuccauaauaguuaugccaauuuacauucucaccaacaguguaugaggguucccuuuucuccacaucuucaccagcauuuguuuuugccugucuuuuggauauaagccauuuuaacugaggugaaaggauaucucauuguaauuuugauuugcauuucucugaugaucauugauguugaccaucuuuucauaugccuguuugccauuuguaugucuucuuuugagaaaugucuauuuaaaucuuuugcccauuuuuuuuuuuugaaacggagucucgcucugucacuggugcuggagugcaguggugcgaucucggcucacugcagccuccaccuucuggauucaagugauucuccugccucagccucucaaguagcugggacuacaggcauguaccagcaugcccaaagugcugggaguacaggcguaagcuacagcgcccggccuuuugcccauuuuuugauaggauuauuagacuuuuuccuguggaguuguuugagcuccuuauauauucugguuauuaaucccuugucagaugaguaguuugcaaguguuuucuccuauuaucuggguugucucuucauuuuguggguuguuuccuuugccguguagaagcuuuuaaacuugaugugaucccacuuguucauauuugcuuugguugccuauacuugugggguacugcucaagaaauuuuugcccagaccaauauccuggagauuuuccccaauuuuuuuuguaguaguuucauagcuucaggucuuagauuuaagucuuaaaucaauuuugauuugauuuuuguauauggcaagagguaggagucuaguuuuauucuucugcauaugaauauccagaccauuuauuaaagagacgcuguuauccccaguguauguucuuggcaccuuuguugaaaaugacuucgcuguaaguauguggauuuguuucugaguucucucuucuguuggugugugugucuguuuuuaugccaguaccaugcuguuuugguuauaauaauucuguaguauaauuugaagucagguaaugugauuccuucaguuuuguuauuuuugcuuaggauagcuuugacuauucucgcucuuuuauaguuccauauaaauuuuaggauuuuuuuuucuauuucugugaagaaugucauugguauuuugauagacauugcauugaauuuguagaaugcuuacgguaguauggaaauuuuagcaauacauaagcauggaauauuuuucaauuuuuugguauccucuuuaauuucuuucaucaguauuuuauaguuuaaauuauagagaucuuucacuucuuuaguuaauuccuaaguauuuaauauuauuuuugacuacuguaaaugggauuacuuuuuaauuucuuuuucaaauuguucacuguuggcauauagaaaugcuacugauuuuuguagguugauuuuguauccugcaacauuacugaauuuauuaguucuaauagguuuuuugugaaacuuuagguuuuuccaaauguaagauccuaucaucugcaaacaaggauaauuugacuucuuccuuuccaauuugaaugcccuuuauaucuuucucuugucugguugccuagccaggacuuccaguauuauguugaauuacaguggugaaagugggcauccuugucauguuccagaucuuaggggaaaggcuuucaguuuuucuccauucaguaagauacuagcugugggucuauuguauauggcuuuuauuauguuaagauauguuacuucuauccccaguuuuuugagaauuuuuaucaugaagggauguugaauguuaucaaaugcuuuucaauaucgauugaaaugaucauaugguuuuuauccuucauucuguugauguaauguaucacacugauugauuugcauauguugaacuauccuugcauccccagggauaaaugucucuugaccacaaugaaugaucuuucuaauguauuguugaauucaguuugcuaguauuuuguugaggauuuuugcauuuauauucaucagagauauuggccuguaguuuucuuuuguugaugugucauugucugguuuugguaucaggguaauacuggccucauagaaugaguuuggaaguauucauccuccccuguuuuuuggaauaguuugaauaggauugguauuaguucuuguuuaaauguuugggagaauuuagcagugaagacaccaggccucaggcuuuucuuuacugggagacuuuuuauuauggcuucaauauuguuacuuguuauuaauuuguuuuaguuuuaaauuucucccugauucaaucuugguacacuguaugugucuaggaauuucuccuuuucuucuagauuuuucaauuuauuggcauauuguugcucauaguagccaccaaugauccuuugaauuucugcgguguuaguuguaaugucucccuuuucauuucugauuuuauuuguaucuucucucuuuuuuucuucaucuggcugaagguuugucaauuuuguuuaacuuuuaaaaaaucaacguuuuguuucauugaucuuuuguauuauugucuucauuuuaauuucauuuauuucugcucugauuauuauuucuuuuuccuacuaauuuuggguuugauuugcucuugcuuuucuaauucuuuaagaugcauaguuagauuguuuguuugagguuuuucuucuuuuuugacauaggcauauaugacuauaaacuucccucuuaguacuccuuuugcuguaucccauagguuuugguauguuguguuuucauuauuauuuguuccaagaagguuuuuaauuuccuucuuaauugcuuccuugacccagugguaauucaggagcauguuguuuaauucccauuauuuguauaguuuccaaaauuccucuuauuacugauauguaguuuuauuccauuguggucagagaagaugcuugauauuauuucaguuuuuaaaaauguuuuaagacuuguuuugugacuuaacauauggucuguccuugagaaugauccauguacugaggaaaauaauguguauucugcagccauuagaugaaauauucuguacauaucuauuagauccauucgaucuacacuguagauuaagucugauguuucuuuguugcuuuuuguuuggaagaucuguccagugcugaaauugggguguugaaaucuccagauauuauuuuauuggguccuaucucucucuuuagcucuaauaauauuugcuuuauauaucuggaugcuucaguguuuggugccuguauauuuaaaauuguuauaugcucuugcugaauuaaccccuuuaucauuacauaaugacuuucuuaaucucuucuuacaguuuuggucuugaaaucuauuuugucuaaguauagcuacuccugcucuuuuuuugguuuccauuggcauggaauaucuuuuuccaucccuuuauuuucaguugagguguauuuuuauaggugaaguguguuucuuguaggcaacagaucagugggucuuguuuuuucauucauacagccagucuguuuuuugagaguuuaguauauuuacauucaauguuauugauaaguaaggacucaauccuguuauuuuguuaucuguuuucugguccucucucccucccucccuuccugucuuccuuuagugaagguguuuuucucuggugguaugauucaauuucuuccuuuuuauuuuuguguaaccauuguauguuauuucguuggaaguuaccaugaggcuugcaaauacuauuuuagaacauaacgcugcauaaacaaauaagcaaaaagaaaaugaauaaaaauuaugcuuuaacuucaucuccccacuuuuuuacuuuucguuguuucuauuuauaucuuauuguacugucuaugucuuuaaaaguugcuguaguuaucauuuuugauugauucauuguuuagucuuucuacuuaggauaagaguaguuuauacaccauaguuacaguguuaucauauucuguguuuuucuguguucuuacuauuacccgugaguuuuguaccuucaaguaauuacuuauugcucauuaaugucuguuuuuuucugauuaaaguauucccuuuagcauuucuuguaggucagauuugagaaauuccccagcuuuuguuugagggaagucuuuauuucuccuuuauguccgaaggauauuuucgccgaauauacuauucuaggguaaaaguauuuuuucauucagaacuuuaaauauguuaugucacucucuccuggccuguaagguuuucccuugaaaagucugcugccagacauauuguagcuucauuguauauuauuccuuuucucuuccugcuuuuaggauccuuucuuuauccuugacuuuugggaguuucauuaguaacugccuugcaguaguauuuggguuaaaucuacuugguauucuauuaccuucuuuggauaucgguaacuuucucuagguuuaagauguucucugauauuauccuuuucaauacauugauaaauuugaccucagagaaaauauuaauaaauuugauuuuagggaaaacaaacaaaaaacccucuugaaugacaaaaaagagaaaaugaaaauaaauaaaggaaagagauaaaacucuuacucauaaugagaaauguaaaugaacuacagugaacacuguucaucaccuaugggauuggcaaaagcccaaaaguuuguuacuacaccuuuuucauuaaacuguggggcccuuaaaugcauugcugagcaaaaugcaaagugcuagcuuuaugguggugaauuuggcaguaucuagccaaauuacacauacauuuaguuuuugacacagaaauccuaguuuuagaaaucuacccugaagacucacuggcaaaaaucuaaaaugauucauguguaaggcuguuuauuguggcauuauuuguaacaacaggagaugaaagcaauguucaugcccaucaggaggggauugguagaugaagcuaugguacaugaagaugugguauagcuacaugauugaauacuaugaaucugugaaagaaggaagaaguuuguuauauuauugauaugagguguuuucugggauauauuuuuuccacuuuuaaaaaucaagggugacuuuuccuaugaaucaaaguaauaaggcuucaaugugauagauuaauauuaacucauaaauaagaauauacuggguuucaagcccuagggcaguacagcacuuaaaauaauaauggcucccagugaugaccaugccugcugcuucaguccugucuguucuaggcacugugcuuaguugugugggcuuauuugaucuuccuuauauagacacagaaaauauccaaaugccagaggugaauugguugaucagauuuauugauaucuacuuauguuggcuaugaugcucucuucaauuaaggauguuagugacguaauauuucugaagagcacucugccguuguuuuuacauauuuuuuccacgccauugauccuagucugcacauuuugaugccagugcuugcuuaaucuuaccagaagaggggaucaaacggaggcaugagucacaucauccuuuugcugcuuugaauguccucuauuuuaagggauuuugcagcucuuccuucccuuaguucacugucugggcugugagaggcacuccuuuuguguauauccggugauaaaauguaacacugauccaucuccuugugaauuccuuccuuccuuagcuuagcgcuuagcuuagcacuucuugcuuuacaggaaacauugcagugaguauuggcuuuauuggugcucccccugcuggcuguuucuaugucuuugugcaaacaggguaacagcuucagcuucaagucauagugaaucucugaugagcacagaggcuuagccuggcggaggccgagggcaagccuacaucauugggguguuaaagccgagcuuucaauucuggcccagcaugcagaaccuaucuucacuuuccucaucugcuaaacugcccacuuuguagguucauuguagcgauuagaaauuauauagcucaucugacacucauaggaaauguucugaaauggugaguaaaccugaccggagcccuccagaaaguuugcagauacuauuauguauuauuuuuucuugagaaaauguaagugguuuauuaugucuguaacuugaagacucuaugagaauagauuugcauuaaaaaaauccuaauguagauggucaaagaaauuugaucuucucuggaaaaguuagugaauuucuuagaaacugaaguuuacucuguuccaagauauaucuucacugucuuaaucaaagggcgcuugaaucauagcaaauauucucaucuuucaacuaacuuuaaguaguuuuccuggaauuuuacauuuuccagaaaacacuccuuucuguaucugugaaagaaagugugccucaggcuguaaacugggcugcacuggacaccugcgggggacucuggcuuaguggggacauggucaguauugauuuuccucaaacucagccuguguagcugugaaagcauggaacagauuacacugcaguuaacgucaucccacacaucuggacuccaagacacggggaggucacauagucaguuguggaugccgguuaaugauaaggugugaguuagcucucgggucucuguuuccuaagucacacaaacagcagugauaaacugugcuaacggaugagacaagguaccugaguuaauuugcaauucagcacacaaaaauggaaaagaaauuauuauaucagucugauaaagugcaaauguucugauguaggaguaaagugacguggguucuaauccugguucuguuauucaccaggacaacagaccagucauuagcaggccuuucucugaagaaugaacuuuugaaaguaacuggccuuuuaugggcccugcuucuugguuucuugguuuuuuaaaaaauccaaauucuauaaauuugaccaaucuaaagguauuacuacaugcuucaucagauaucucugcauuucuugauaccauaaaguuaaaguucuucugguaaaagaguuaaaaaucacugccuuauaaaacaagcaaacaacaaaauaaaccugucuggagacauuuuguccauuugcccuguucaggcagugacagaaauagugucauuauaguguuucacagauggacggagcuuacauuugaagugauuuccauagcaaaagcccuaaaaaaguuuccagaauucguguugaguggcguuguuucugauggaagccucugcaguauuggaggcaggcauuuacagggaagcccaccaguaaaauaaaauuuucagaaaaaguuauuaaaagcuacauuuuaaaggaaacuccauaauuucagcugcccugaguccuaugcuuacagagagccugcauuuccacccagcugauccgggucuccagggggauuacagagaacuugcaaaugcggcccaaagcauguguggagcugugcugccacaggguggcaguguugucacacacacagcaaauccccucgcgagcuuuucugggccuggaaaagcucaaaucuguucuguuuuuggaguguucaucaguugagaacaggaaaauguguuccgagggcugagccacguguuuaugagguagaacuaauuuuuguuauacaucaguuguguagagauauuuuuaaaauuuagcuuguaccuuuagaaaaugcuuuauaaggcagagguugcagugagccucgauugcgccacugcacuccagccugggcgacagagugagacuccaucucaaaaaaaaaaaagcuuuauauucaaaacaaaauaaauugcauauggcagguuuuaagaguagaguaggagaaucauguccagugccuacaagucuaacagaguuucuuguuccuuguucuccugagccuuucucaguaucugcauaguucuuuuaaagguuguaugaucuucuguguaaagggaaaagcguggcuuuuguuuuuguuugcuugaauuuggauucugaauuauucacauacaguuugugaccucuuagagccuugucuucccguguguaccgugagcucauaaucaccagcacccagcauucuuaugaggauuaaaugagugccaagcacaggaaggagcucacagcuagcacucgaugaagguuggcucggcccuguugcucauugcuucuuuuauucugguauaaguaaugugaaagucacuuuaucccaaaagccuuuuuucauuugggagguuuucuuuaugaaagacaccugcaaauguauucgugaaucaaaggauaugacaacuuuauggcauuacugcauuguuucccuugaugacugugucaucaacaacaaauaacaauauguuauuauggccacucaacucuccauuucugauucagagccuuguguauauaaaacuccuaucaacuauuggaaaguaaauagaccuuaauguguaaucuagaaaaaucauucuaagguucuuuccauaccuauuugaccauuaaaaauaggccagacaugguggcucaugccuguaaucccagcacuuugggaggccgagguggguggaucaccugaggucaggaguuugagaccagccugaccaauauggcaaaaccccaucuguacuaaaaauacaaaauuagcuggacgugguggcaggugucuguagucccagcuacucaggaggcugaggcaggagaaucacuugaacucgggaggcggagguuguagugagcugagaucgugccauugcacuccagccugggcaacaauagugaaacugucucaaaacaacaacaaaaaaauaguuuuaaaaauauucuuaucauaugaucucuaaugcaaaccuggaacccaucagaggaggguuuugguuuuaaagcuuugaugaauuuuuuucccagaguguucgauucuuacaaugggaguaguauacacauagauccugaagaguugauaaacagggccuaaugccaguaccaguucucggagggaaaaaaauaaauguagauuuuucaccacuuggcugaaaaugugauguuuguaaggauacugagguagaaaacgucccuuucaaauacugguuuuccguauguuccccuaaaacaugacuauuauuuccacugucuauguuuccuuucuggccuuccccugcucuuugucagacaaguauaaaacaagaaucucacuugccugcacauggauuuaaguugcuucagagaccagagaaggugagaagcagagcucucugucccucgguauccuuuccugucuaggagaugacaucuccgccaucacagugccucgggccagaacccugggguccucuuugcccccuuugcucucccacuccaccugcaacccucauagcgucugucgccuucaagauacaucuaggaucucaccacuucacacagccuggccuugucaccuggcccaggccuccuggcggcuccacuucccagcaccuguggucuccaaagccuccuccccaccucccugcuuugcgcccugcgguuucacgcggcauccagagcgcagcgcgcgcggccgccaggugcgcgcggccgggggcugcagagagccugcaacgccgcccccgcugcccuccuccaagcuccuggccagcucuucgugugucuugauccagguucuuaaaaaaaggaaguggacuauagacagggugucccacacacuggcagucccagggucggcccuuggggcugcuguuucucagcucgccucccugcccacacagccccugcacccccgcgcugugccuucccuguccccggcgcugugccuucccugucccccacgccuucccugucucccaccccgugccucgcuuucccugucccccgcccuauggacaccccuggcucaggccagugugcuugucccagcaucgcgcucaucuccuguuuuuauuugauguuacagauuucauuucauuaggaaugaguguuuccuccccgacuuuugccugcauucuuuuccagcuccucccuggaaaagggcaggggcggacacuuucccagccucccaccgugcucuguuccuaguggcaccugccccagggucugggccccuagggaugcguccucuacccuggagacugggaucuucuuaaauccccacugcucccuuguugucuccucagcuagcaccaccuuugcuuccucuuccaggguugucacauuuucuugauuucugcaucuuaaauaugucccaggcggaccuauaguccuucccuuuucuuccuguugagcgaugguuacaggcuguggacgcgugugagugaggaggcuccuccccgacccugcccuuccgccauccgguagguuuggguccauucuucuccauucuuucaacauaaacugcaccuugagggucucuucuccuuuuugaaauuuugcaugguaccaauucauaguagauuacagaguaaaauaaauaaaauaaacaaauagaaaauacauagaaauaguaaaauaaaaagaauaauaaauaaacagucccauaucaaucauccaccauuaacaaauguuaauguguguuuagcuacauuugcugcauugucuuuuuguuaacgacuaagaaacacagcagacacagaugacacugccucucuaacacaacaacuggcucucuucuuccuuccccaggggcagcaacccuuuuaaaaguuuuauauuuuaagaaguauagugaaaggcugucuguccauuaacaacacagagcauauuuuguauguuuuaacaaugugugugaugauugucuguauuuuguuuauuucaauugacaaauaaaaauuauauaucagugcauugugcaacagcuaaaucaagcuaauuaccauauccaugaccucacauacuuauauuuuugugguaacauuuaaagucuaccguuuuaguaauuuucaaguauauaauacauucuuaguaguuauagucaccauauaguacaauaaauagacuuccugaagugauuauuuauuuuccaaagucugaauuuugacuuagagaauaagaacaaugaauauugagggggaaaaaauaaggaaagaaagaaggagaaaagaaaagggagaagagagcagagugccuccacuaaaaucccuccccacauagacacucgccucuccaaccacuugcccugggcacacuuugagucugucccaucagcagaccagggggcacuggagacacacagaggagccaggccaacccccugcccucagaagacaccaaggaaccccuugccggugcuacugaaacuccaaauucucuggcauugccaggggccuuguuuauuuuuuuugaggcggagucuugcuguguugcccaggcuggagugcaguggcaugaucuugacucacugcaaccucugccuccuggguuuaagcaguucuccugccucagccucccagguagcugggauuacaggcccacaccaccacgccuggcuaauuuuuuuguauuuuuaguagagaugggguuucaccauguuggccaggcugguuuugaacuccugaccuuaagugauccgccugccucggccuuucaaagcgcuaggauuacaggcgugagccaccgugucuggcuagcccuggccuuguuaaaacucugauuugagguauuggggcagaugaggcaauaggagaaucaagccugaggcccuggcgaggagguagagucagagggcucgguucuccuugugagaagggcgaaggaaggucuguacagagaaggcaaagccucagcuaagcugcggaugcagcuguguggcucccucucugagaggggaauccagcuuaggggcaccuguguuucuauuuuaaguacagaacaguuuaagggggagaggaaggagaaggguuaagaaaugaaaguucccauucuucagcaguuccauuuagugauuugaaagugcaccuuaacuacaguucauugugugugugugugugugugugugugugugugugugugugugugaagggugguuuuuuauugacuguacauuggaaauguguguuuaaaaauagccugaacaaaugacuagcuauuucucaauauuugacccuccauguggggugagaaggaucagagaauucuuuuauuugcuuggcuaagaauguuugccauccgagaugauauauucuggaucuguaauuauauggugagcguaacuccuuugaaugacagccuccaauaaaacugaauaauucugggugaugcuuccugcugggugauuccuggggaaccugaugucuccuucagaagagacacuucggugagcuuucagaaagggacauuucggaaguauuggcucugagcuucaaacugagauaauuugauaaacuuggacaagaauaacuacugucuggacaucauggggagauaaaaaagaggaaaagaaccacaacaagaaaaauaaaaggguaagaaaggaauuaauuugccuucuuggcuuguaaauuuugugugugugugugugugugcagaguauuuugguugaacuacaaaaaucaacauuuagugauauauccuaaguggacugucuuugauauuuguuuucuuuuagcacaaugaauuucuguucuaugucgucuggaugauuuucuagcuuuauagcaaaaacuauaagcaaauuauaaauacagguguuuaugaagcuuauuucuuugaaaauacagugguuuauggagaaacuaugauucccaguugcauuugaauuuccuugaucucucuguguuuugcuugguugcauggagauuggcagaagucaauguugauauuuucauuacugaugaugcaggcucccuuccguaagaaccaucacaaugggaccuagaguagaugcuucaggucaguucuaagcaauucacacaggagggcuuaaauaguccugagcagauaacguuuuucuguuuagguuuacugacuuggauaccacucuguuuaacacacacuaccccauagguguagagcuucugaguguuccuucauuuaugguuaggggaguugaaaucuguagaaaugaaaccagggcuauauaggaacugugcagucuucuuuuuuuuuuuuuuuuuuuuuuuuuuuuugagauggagucuugcucugucaccuaggcuggagugcaguggcaugaucucagcucacugcaaccuccgccucccagguucaaaugauucuccugccucagccuccugaguagcugggauuacaggugugugccaccaugcccagcuaauuuuuuuguauuuuuaguagagaugggguuucaccauguuggccaggcuggucugaaaucccugaccucgugauucacccaucucagccucccaaagugcugggauuacaggugugagccacugcucccggcuggaacuguacagucuuucuauuaccaaguaaaacucuuuauuguccuaaauauugcauauuuuaugucccaggcagaguggcuucugauccugucuuugcagccauauauugguaauugguuuggcuguguccaaaaccauuucugccccuucuuccagagguuaucuucugaccucaacaaccauuuauagcugaauuuuguuaaaacauuggaguuaauuggaagcaaacaggugaagugaauuuaagcucuaugaggacagagucauuuauuauuaauauuauugcuauuauuucugauuguucaacuaaugcagugccuggaaacaagaguaggaacuuagauguguucauugaacgcaugccugcuuuggucagaaguauagccaaugagaauugaucucuggcgcaguuuguuaauacuuuauaucccaugucagagacagucuccaguaguguaagcaaaaguuacacacggaaaaaggaaaauggugaaugcugaagcagauggccugguugcccagaacucucaauuuugaugcagagauuuugaaugauauuuucuugaguguuuugugaaaauugcccaugcccauuccucuccucuuaccugcuggcuccacaccuuuagguugggauugggaugugugccagugacgcagacccuaaugauacccauggcccagccacggauucucagagaggaggggaggugcccacaucccaccgggaguuauucguacagaggcugaugaaagagaagccucauuuuaaugcuuuugcugggauauaaugacaucuauuguuuuauugaaguacagucaugccccagaucaggauuugcugccuccauuagaauccuauuugcucccauggaacugugagugaugucagcucuguggcacccuugcucuaagccucucaaagccccuuugugccuuggcccuccgugcccugaccauguucucugcuucaguuugcgcucauagcacauuggucugugccuguucuuaugagguccagcagccagccuuagggcuguagcuuaaaaccacccucaugguuuuuccucuggcuuccuucuauguguggagaauaugcauggaacucugacucccuugacuguggccaacauguuaguaagccugggcuaagcugcucucauaaaggaaauccccagaauucagaagcuuggauucagaggcuguuggugacucucaggguacuuggaagguugcaucugccaagguuggaggcacucaucuuucagcgacacgggccuccacgaugaacacggccaucugcuucuccaucaguuggaggggacgccauggaaggacacaucugugaggucucuacaggccagucuggaaguuacauguaccucccauccagucucauuuuauuggcgagaacuuaaggacauggcucuauauugcugcaaaggagucugggaaauaaaaacguuagcuggccgcugcgugacagcacugauauuggaaucacugaaagggagaauagaggugcuacucagcuggcuguccugacguuacccaccaagcagggccagagacccugcggccuccuuaccacagcagcuuccauggucuuguccccauuuccuugaugacaaggaagggaaggauguaaagaagucgugugaguucacuggcuaucagcagucauauugcccaucuacuguguaaaagaagagaagagaagccuaucuaugagauuguaggucacggagcaugcuguucacagcaaauagcagucacaaugaaaucuucagcaauguuauuuaaauaacacauaccugcaggcagcuucucaguaaugaaacauuaauauacaaaugcauuaggaaugauuacauuuaugguugcuuuuuagcauagaauagggaugacuucuuguuuuuacuuuauucuaguuauuuuaaaauuauuugcuaaccaucuuaauuauuagcuagauaucuuuaauuaucaguaauaauuaauugguaacaauaaagcaaaauuaacaguacuauauuauugagaaacaagagucauagcauuuuaaagccuaagaccaacuuuuguaugaugccagugaugugcuaauaaaaaaguaucuuuuuuuuaugcuaugagcuucucaccggagugugcacacauuugauaagaucuuuacaaucccccauggcagcugggacccacagaagaggacaaaauuagaauccagaguaaauucuaacuauguaugaauuuaaccuuacgauauacaauaguaggcuagugauaaguagcucuuagccauauguaaaaaugaaaaucuucauaacaaaggauugugguuugguucaguucauugcuugcucuuucagaggauucuugaucugggggccauggauggcagaucuaaguuagagaaugccugggcugaaccguuggagcauucccauucaggcaugagaaacagaaaugucccuaagaccaucgccagccucugccccaacagggcccugaauccaccagacaaaucauacaacaaggaugagaaaagaugcugcuuucaagccuguuuauauugucaauuaacuuguauaugaaaccacuuuuaguuuuggaauuauuuucugccuuugccaacucuuagcaacagaaaacauagguaggguuguaggaagcaacagagaaagcucacagcaguggauuuaacugaaggagaagaauaccugggaaaccuugaaaauguuaauagcuuauugccauuuuuuucucuugcuuuaggucugacaaaugugccaacagaaggggcuggacagagaugguuucuauaaaaaugcaaucagcccuguaaauguaaaugugggagucggcagcuuggggguuucaugaggcuuaggaggaugggacaaaagugaaccaugguaccaacuaaauuugacuggagugggauucaggguagcuaagaaacaagcuacagaugugagaacuuuccuaguauugcaaaauaauugauuuuuauuugacuuaugguuaaaugguccccucuuccuaaauuuugucuuaccuuaaaucagaauugaacagcugucucuggagcgcuggucaucucugcucauuugucuugggccugucccuugugcguagccagaguguuccuuuucuggucuuggaguauuagucuaucuuggcacuuuccuguaaugccauaguccuuaaaccuuuaaggcaucguuauggaaugugugcaucacaaagugugacuuuuugaauaagagcagaguuuguccugagaucauaugauuugugagcaggaaauggcuauuaagccaaaaucagaucauuaaagagauguuuugcuaauacacugaguuaaggaauggccacaggcggcugagggugcuggccauuggugaacagcuggugggcgacccuggcuuguccguggggucucccaggaggacgcugugugucuagccugagccaggcacacagagcccuuucugcucuugaagaaaugauucaaagcucuguccuaaccaaggaagcugggaaauauuccuuuuaguauuugcugguaugauuguuuuucaguuuguccuaaagccugagcuuccucuugaccaggaaauuacagggcuuacuggacuuugaugcaggccagcuguaauuacccuaaauguuuauuccgccucucuuuguaugcuuuugugaagcuaccaggucaugaaggauauacucugaaugguuaacaaggcucaaaucucuuuuuuaaaaaaucagaacguuaguuuuucaccuucuucuacauucuuagccacaccagucacuuguuaauaucuuauggggagacucuggaagggcaggugcgacgccagagugggggcagauuucuuccagugggcauuuuuuccugaucugugaaagccuagaggagagauguccacuugcaucccagggcacgggaacucaacauacuuccaggccgcagguuguagauaaagcagaacugggugggauagcugcugagcugacauacagcguuuauacagaucuuaguugccugugaugcaaggccagaggacuugaacauaaaucagugcaucaaggcugaaaauguuucgccuauguacagcagcugaacugagauaggauuugacaauaguaugggaaagagccgaggauuuucaguggcagaaagauccacaucugaaagagcuguguuuuugucugcuucaugcaagcacagggugcuuacugacucauuuucuugcccugaccauggucagaggucagaacaauauugggaggaguugucagugcugauuuggggcggggaggggggcaggugacucuugcuccugaagaaggggcucucugcgacuagaaagaaccaacugagcaucugaaaagaguuuaagcgugggcccauaucuggguaagaacaugacaucccagcuauaauuuugugcuaagaaaaauagagcacucuccccaagaucuaguaccucuuggccagaagcagacacuucccuuugaguugugcagccuguggucucugcccaaucuugagcagccauagguggucuucaucuggacaaugaacucaacuagaaucaucuacugaaaguggcgaaguaguugugucaaccuggucucauugcuguaggcugaaagaaggucaguuauaguuucuguuuucuccuggaggauuggagaauugccugacucccauaguuucuccaggaaaccaagagaaauguugccauuuauguugaggacaaucaaaaugugagaagaggaguauagccauguaauaauaaugaugaugauucacggcagcucuguguauugggggagcuuccugaaacacugaauggagaagguugcugggguugacuagugaugucucucuuggugugggaugaguaugagaggcaugccgagugacuucucuuccuuuccuaacaccuacguucaaucaugagcacuaucagaaauguaggaagcugucuaggcugcaggccuucugaguaagagcaguagacacuggacuaucagagacuguaguggaccagaagguugggcuacucugcuaaggcacuucugggauacacaagucacuuagcugaugagugagcccaagguguacccaucguucuguagcucagaggggcucggcuccucucccuuccccuugcaguguuuuuuguguguguguuuucuguggaagggagacuuaccuuguuuucuguaugagaacuugugcaugcaugccuggaaguaucucccuggaaaaugccagcugccaggguuuaauggaaguaaagaaaacaugagaaguuccaaaggaagugaucauuuuuguauucuuauuuuagacauucugggcugguugcaguggcucaugccuguaaucccagcacuuucggaggcugaggugggcggaucaccugaggucaggaguucaagaccagccuggccaacaaaggugcuauuuacaaagaugcugaaaccgcagcucuacgaagaauacaauaauuagccaggcgugguggugggcacauguaaucccagcuacucagaggcugaggcaggagaaucucucgaacuugggaggaggagguagcagugagcugagguugcgccacugcacuccagccugggcgacacagugagacucugucucaaaaacaaaauacaaaacaaaaagacauucugagacaaauagugaaauaauaaauuuggaacuggguuaaauccauguaagaguaaguucaccaaacacucuaaaagcaaugagaaaaucaguuuauuugcuuauuuuugcaaguguaccagccaguuuaaaaguugcucagaaagugggagauaaaauuguagacaaaguagggaugggguuuugcuuguagugugaagauagguucaggaacacauggcccuugaagaaagugugacuggggaggaagccuggagccuggacagaccugucuuugaccacagguggggaaagcaccacagacgccaguuccuguccuuucaggagaagugaugugccccugugguauucagaaaaugggugucugcagcccuccggcaagcaucaggagaugacucuguucaugagaagugacagacacuugcacuucacauugccucacagaaauggaaacaaaaucaagccaagcagcagagcaguguagcuguggggccauauggggaagauaaaugccccuucgggcuugggguuuauagcaaaccuugacauagaggaugucucaggaacuuggaaaaccacaccacccagaaauagggagguguggucccuguauuaaaauuggaauugugggcucgaguguuuacaaagauaagagauuuuuuugugguggggugaaguuauauauguguauacauguuuacacacacacagaguaaaugauaaggggguuggggaugccuggagcagugguccuccggggggugucugaauggccagcccuggcuugccucugcuacagcccccgcugccagcaccccaccucccuucccacaccuuggccuggcucugaagggguauucaggggaguggaucucagacaggugaggucagaaugccaagagccauggucauggagggauaugcauuuccaguugguaggauucccaggaaagggagcuaaggaaauucaggaaugagccacggaaagucaagaaaauuugggaguaagucaagggcauuuauggcagcuaggcaggagaggggccaggacaagaccuuagcgacauggacagcauccaugggccaaggccuuggaagccgcugugucagagagaagauggagggcaacaggacccagugggccgcugagggguaccugcaacuuggggagagggagacauugaauagcaccuauaguuuugcuuaaaagccaguagaguuguaccuuagaaaccaaccaaaagagaaucuaacaggagcugagguggagcgugagcugugagagaaagacaaagcgagggaagaugaggggaaauggguccccuucccuuuguagcccaccccccagucacucuggcugccucccaccugcccugugcacaaacguguaaauaguaaaauagagguuccucuucaaagagacucuccucuccgucuaauuaggaauaaauaguaacuucucuuagaagcaauauuuauucaaagaccugugcuaacauucuuaaauaucugcuagccguaauaaaucaauguggcugggugugguggcucacaccuguaaucccagcacuuucggaggccaaggugggcggaucacgagauccggagaucgugaccauccuggcuaacacgguaaaaccccgucuauacuaaaaauaaaauaaaaaugcaaaaaacuuagcugggugugguggcgggugccuguauucccagcuacuugggaggcugaggcaggagacuagugugaaccugggaggcggagcuugcagugagccgagaucgcgccacugcacuccagccuggaugacagagugagacucuguaucaaaaaaaaaaaaaaagaaaagaaaaaucaacguacuuuauguucuuaggucccgcaauuucgccuaaauauuugcccuggcaugcuuauacuaguccaagcgggcguuaggucauagccuauuccucuuccuuauuuggagguguuuucaccuuucucagcauuccacaaguuacuuccuccucccuuuguucuccucuaccuuugcucuuuuaaaaaguucuaaguugcuagccaaucaggacaaauacagaaagcgagguccuguucuggccaguggaaaccagauacagcaguaaggugaacgcgucagguuauaaaugacccugucuccuuuguucgguguacucuccuggcaaaacugcuggugaguguacccuuucugcagaaaguaaaaaugaccuugcugagaaaauuaaauuuauguucaagugcuauuucuuuacagcaccaaguaacaagcauuucuaacaaaugugacccauacaaggcugagggaccuuuuugugagcuaggacaaggaagggcuuaguggauggccaugggcagguucucagugcgcuggcucccagcuguucucuagagagggaaggccacacccagccacaugcaaguccagggcugacacagcuuggaggucacagcugccccagggcugcggaguccugacuggauucugagaggaaagccauuccccuccccucugcagugccuucugcugucccuaugcagggacccuggccugcagaacacuuccugcagguuaaugagcaacccccugcuggcuccccaucaccaugcccaagguggggagcugagaaugucacaccccuccuggggcugccaggggaucagcagccguaucugcucuccaacuucccaauggaucacagcccuccuauuaaguaacuuuuguaggucuuggguuuuccuccugacugcucugaccugcucaucuugaguuggaaagaagugagggaauaucccguauuccuugcgacucccccucugcaccaccugccuuuauaugagaaaaugcacagcucuucaucaggccuuauuucuaacucucccagcuuccuagaaaucugggcuauugccccccuccccccgcccccacauuccugcacuagcagcuccacagcggucaccuuccucugucuccucuuuuuauuuccaacaagagauaauaucuuaaugggagaacggaguggggcauggcagaagcgcuacagaaucugagucccacaggucaugcuagaaaauaggaaaggacugagguuaaaugacaagauugccaagagaaccucaaggaaacugccgaucgcuuugaaggugaacuucaugggugaccuugagaugaguaugccuggcagccccucccugcagucauggggaugugcacuugaccagccguuaugcuuugcagcaauucuaaaaggagguggcaagggagccccaaggaggggcugauuaauuauuuguuaauuaauaauagaguacccaaauuugugagugauuuacuuaaacagacaaaagccauucaguuucaccuggaaaacaugauuauucccucucugauacacuuuuugaagaagacagaaggauggaguugcagcucuugcacagaugcugcucagaggcuggcaccuugcaugugaaacccaugcauaugaaaucauggggcuuggggccaguaaaaauauugauggcugaugcucuaaggcacuguuccuuaagagagaauaaaaaugagccaccuccagccugggcagugugcugugauggucaggagcaaaggugagagcgguggggcccacucuugauucccaaacacagaugccuagugggaguaaacaaacggaaagaugccuccaccucauuaguagugggggaagugcaguucaaaaccauagugagacaccgcuucacacacacgaaagacggcuguucaaacaaaaggaaaacaaauguuggccaggacguggauaaacuggaacccuuguucauugcuggugagaauguaaaaugguacagccacuguggaaagcacuuuggcuguuccucaguaaguuaaacagaggaauaacaggccagguguggcggcucacuccuguuaucccagcacuuugggaggccgaggugggcagaucaccugaggucaggaguuugacaccagccuagccaacauggcgaaaccccaucucuacuaaaagcacaaaaauuagcugggcaugguggcggguaccuguaaucccagcuacucaggaagcggaggcaggagaagcuugaacccgggagguagagguugcagugaacugaguucgugccacugcacuccagccugggcgacaggagugacacuccaucucggaaaaaaaagaaaaaaaaaagaaaaggaauaacauaugagccacaauucuccuaggaauauacccaaaagaauuaaaaacaggccgggcaugguggcucacaccuaugaucccagcacuuugggaggcugaggcgggcugaucacuugaggucaagaguucaagaccagccuggccaacauggugaaacccugucucuacugaaaauacaaaaaauuaguugggcgugauggugggcaccuauaaucccagcuacucaggaggcugaggcaggagaaucgcuugaaccugggaggcagagguuucaguaagcugagaucgcaccacugcacuccagccugggcgacaagagcaagacucugucuagaaaaaaagaauuaaaaacaagugaauaguacacaaaugcuuguagcagcucuguucacaguagccaaaaaguagaaacaauucuaaugcccaugaacagaugaguggauaagaaugugguauauacaucaaacauucggccuuaacaaggaaugaaauacugaugcaugcugcaaugugagcaaaccuucaaaacauuaugcuaagugaaagccaaacacaaagaucauauauuguuugauuucauuuauaugaaacauauggaacagguaaauccauagagucuaaaagcaaacugggguuuguccaggacugggguggggaaaggggauuggggagugucugcuuaauggguacaaggucuccuuuugggaugaugaaaacauucugaaacuagauaguggugaugucuggaugauagugucaauguacuuaacaccacggauuguaugcuuuaaaauggcuaacacgguuaauuuuauguuauuacacacauuuuguuaucauaauuuaaaaaaggaaaacagccaaugcuugaucuggcuccgggguuucggauaugcuuggauuggugugcagccugggugugugcaucauuaaagcuccagggaguuccgugcagcugaguuuucgaaccucugccccagagccagccugucuggcuccaccacuuccuagugugugaccuugggcaaccaguaacucgcuguaccugaguuuccuuagcugugaaaugaggaccauguaauuaccuuccuauagagcugguaugagggucaaguggguucauauauguaaaauacaugucugcacacgaaucuaucaccauuuucugagccuggaguuuagauuuccucccuaaccggcuuaguuguucucuuugcaccuggcaggugucagcucacaugccgcccagguggagagaccacacuucugcuagccugggacagucccagcaaugcugaugucacugcauucuuucccauuaggcuuacuuuagaucacuugaaaaauaguucuauuuuggauaauaaauuauguggccacccucuuaacccucuucuauagcaugcuacauauagguagugaugaaugguaagucccuuagaagauuagagagggcaacauuauaaacagugcaucagagaauuagucugcucccccagaagagaggcucuugaaccacacagcuacuuuuccugcuucuuaaaaaauaaauccuacuuuucuugaaaagaaguuuugccaaggaagaaaucugaucagcuuuuuuccuccacucaugacucaguuaccuggaguuacagggaagccuuccugauuugguacacguuuuagaaacaaucauauuuauugcacaggaauuguucccuuuuuuguuuuguuucuguguccuguaguggugcccuuucagucggcacccagaccugccccaugcacaucuacagccgaguuucucauuccuuuccugaucuaguccaugguauuauuaaaaugcucauuaacagaaugcccacuuaacacgaaauacuugguuucguuuggagaaauccauuuaucuggaggagggcuacacauaaaguaucacucuugaugaaguauagaaaacugaacuuauaagucaguuauucaaaaugugucaccacauaaauuauggcaaauuuuacaugugcauuugagagggaaaaaccuucccuuuuucauuaggauuguauuauuuuuauaaguuggaaccucauuuuucccugaaacuguaucuaauugaguuugccucagcugaaaucucgcaucugaccgcaagcagucacacagacacacacacacgcaugcagauugaggcaugcccugugaacauccuuucccugaugcucuucucugcugcugccaagcccccacuccuugcuuuuuaauucuggucagucacuaugcugcacauuaugacuuaacuuuucauaacauucucuugccuuauccuuccccuuugaugcccuuccucuuacuuuuccuccuccaccugcccugaugaaguuugcaccaugcacugcaucucucccucccccuggcuuggcuggaaaugagcuucugcggucugcuguggccacugucacaggauccugccugccugaggacacacaucgcaugucauccaucuuugaagcaccccggggcucauuuccuuuuaauuuacaagcuuuucagaaacuucugccuuucugaaauugucauuguuaagcauucuaaacauucaaaugccuggcagaugguccugcuucauaagacugaaauacugucugauagcucaccuucaaucaugucuuccaguuauguuaagggaaaauaaaauaccagcucgggcgcuguagcucaugccugcaaucccagcacuuugggaggccaaggcggguggaucacuugaguucagcaguucgagaccagccuuuccaagauggcaaaacccugucucuaguaaaaauacaaaaauuagccgggcgugguggcacgcuccuguaaucccaguuacucaggaggcugaggcaggagaaucccuugaaccagggaggcagagguugcagugagcccagaccacaccauugcacuccggccugggugacagauucugucucaaaaaaaaaaaaaaaaaaaaaaaaucaaauaccaguuggauacucuuuguuugcucauuuuaagaaaaugucuugccaggcgagaaaccaucagagagcuugugugacacgguauuuuguuggcugaaguaugcauccagaccaaauagcuucugccacuuuucuucuucuaaauacuuaaaaugccaucccccaggcauuccaugggguacuuggccaaaaaagagcgaucauuuccuacucgccucacccucuagaaaugagauuccuaaguuccauuguccugcccauucauggugaucaguucacaugaagcuggcaugcuucaugguucuuucuuugccgcuuccucggaaucagugcaggauuuccaggaugccagaagacagcucaggauuuggcucagggauucagcuuaaggagugucugucaggaaggcugugcccugaggauaaggaaaugcaaagacaaagacagagaacacccucuugggaaggaaaguuggccuugcccuuacccaagacugugccagccaccacagaugagaagcagcauucuccccauucucaccucaccaggagcuuugacagaccugagcugcucugcccaacagaccccagggagugcccguucgccucaucugguuuaugucacauuguucugccuugaguccugucaacaccuguaucugaagaaaagccaguguggauaacagguucuggaaucuucccucccacucgauucuuuaacaaagccuuaaaaaaaaaaaaaaaaguuguaaagccuuucaaaagggggcagcaucgucuaaggagaggaggcugcaggcagcaacaggaacauauuucuaguuucaucuuucuaguuuauucuaucacuagggagcugagccauccugaguagcucugucugggccucaguuuuucuaauuuauuauaucacuagggcacagagccaucuugaguagcucugucugggccucaguuuuucucaccaucaaaacagcaaacaucauguccuucuaagaggaucugaucccauuuagaagagccucugcugagaggauuguugauugccagcucagaguauacuuauuguaaccaaaacauaucccuuaaccuugaaacagaaaucaacaucugaauuccucaauagccaugucaaaagaucuacucaggcuuuuaguagacuugauuaaaugagucaagguauaauuguauuuguaggauggacaccuuugagaaauggaaacaaaaugaccauuucucuuuuuuuuuuuuuaaaucgauuuaaacagaaagauuucagguacagcaucuccuguuugucccuggaaguguauugugcaguacaguaagggguugaaguacaccaagccccuuuuuguuguaugaacagauugauccaucuuaggcugugugaugggugugcucgugaggcagcucugugaggauaucuucaagaauuuuggcaaagggaaauggaccauggcagucugugcugacucgaaauagggauguuuacguugaacaugcucagcuucuugucugguacugaucucugaucaauuauaagucaaugagcgagggagacaacguguucucugcgguaccugugagcccugaaaguauuccaggaacacccugcacucucagugcccuaucagguucuauggggcacuugugcugucagggccgugccccugcugccuggugcuagaucugcauagcuccuugucccugucaguggaguaguguuuugucgucacaaugaaagucaaauaaaaggaaaauaagcuuugcugagaugaguacauuuuaaacagaagcaaucaaauauguacauauauauauacgcacacacacacccaugcauacauaaauguuuguguguguguaaauuuaaaauuaggacccaugucaaaagcacuuguggcagaugauacugguuuuauuuugagcuggcacucagaucuggaaacgguuagcuuccucuucuuccugucuucucuccccagaugcgcguaugagagucaaaucacugauguuuuacacugaauguaaggaguuaauuggcuaucagugguguggugacauggacacagagaguuuugcauugucuuuggugggcgccauugaauucgacuauccauugaaugacagcagcuggccuggaggaaguuuaaaucccaccaaccuaagucccaugaagccugagauagaagguucuguuugcuuaguuuucuuuucuguuauucauugcuuuuucuuaaugauuuaucugguugcacuugcaacuccugagaaaauuugauaagaucaugacugccaacaucuguggauuuuggugccaaccuuuggugagagcuaugacucacuucccuacaaaaaaagaacuugauauuaaaaacauguauauauugacaagcuuggacaggaaaucaaaccucucuugcaggcaagcaguggccugucccucaugaacuuugccacuuuguagcaggagacaaccaaggaaacugggauaauagggggggccaagcuguuuugacuccagacugcaugcauuaagcucuugguuuucccuuugacuucguauugauaugagucaggacuuuaaaggacucaauacuucacaauguuuuccucccacauuauucuguggauugcuuucuaaauucugcgcacaaauuccaaaaguagggaaagaagauagaaaugaagcacaaguauucgcuggacaacauaaaguuuuuggcuucccauggguugaagguugagaaacacuguugaguagcagaacugagaagagggucugguggcucaggaccacuggacccugcaaucgaccuccuugggagcauugugggaggugggaagagauauuuguuaauuguguagagcaaauuaggggagaaaaaucaucuguucuauugaaauucaguuaaguuccagagucacagaugaaggccucaugaggagcccauugucugaagauaaucaauaucagaacuucuaggaggacugggauggggugcacuuccgccuucugacuuucugccauucaaggucaucucaguguggcccucaugaggucauggccacccaaaauagguaucagagaagaaggaaaccacauauauuagacacuucuaaugugcuuuaucuaaauuacuucauuuaaugcuuguaacaacuuugaaggaaauggauuuuuccccauuuuaaagauggggauguaccuacuuuauggggucuauucccauuccuuaccuuaaaaaauagauaaugcaaaauguccaggaugcuuaugacagcaaaaaaaauuaugaauuaaaaccugaaaucaauaugaaauggaagggggcuguaaaguucuuuuaagggaguauucugcacagaccuuccuuaagugcucagggcacuuacaggacagagguggauucacagcaguauugauugaucagucaggcaggcauaguuguggugaggaccgaggacaagaggaacugggaguuccaugucuagacaggguggaaugaagacaagcaauuagauaugugguuguggaaugcacugccauggacaucguguuucugggacgucagauggggcaugugugcuuuagagauagcagguggcauggguacagguguguaguucuuugacuaccacagcuuuaagcauccuccaaaauguguguucacaugugugagugcacguuugugagugugugcacaugugcgugagugugugcaugugcagucacugucagcagacguuauggaugaggaaacagaacaguguggaaggucccaguguccaugcucuggccauaugcuaagugacuacugaugaggaaagaugggguuugcauucccccuggaucuggggguguuuguacaaaccagccauccagcaaaacaccuuuccagcuccagaacugugaauagcaaaaucccuucucugguuugcuuccugugcuucauuuagucuucuagauccugcaggguuaaauaaaucuugaguugcaucucccugaguccucccuguugccauggagguggauguaaggcagaguuuauuuugcauggcuuauuugcuuaguaaugacuaugauggcugcagaacucaaggacucaagggaacaauuuacauuuuucuguaggagccuaaauaggcauugacgaguguucuggguguuaguuucuuuucuguuauaucaccgucaccuguuuccuaugggaacucugcaccugauagccaaagcaucgggcaucguugauauucagugucugcagggaagcacuaauggcguaaaaagcagccuucauggagugcuuuguccuuuggcuuuaauauuuaagcacaagaaaaucugugacucaauuuuuuuucaggaaaacaaaugauaguauaacugguagagcaacagcauuugugucugagcacaaauaauacugggcuauuguuuaauaugauggauuuccuuuauaucuucauuuuaaauauggagaacuaguuguucaaaugaaaucuuacccacaagcuuauuauguaaaauaugaaagcauagugacccagagggucaucugucuauucauugucucaggaagguugacugaagggcccuccaccuaccaggaacuguuuggagcugggauuacauacaguucucaguaaaaaucagugauaauuacugucuucauugaguucacaucuuaaugggagacaaagauacaaacaagcaaguguaauaaucauaauagcuaacacauauuggguacuuacuuugugccaagaacuccuuuuuuuuuuuuuaaagaagugggaucucacucugucuuccaaugacaccagcauggcucacuacagccucaaacucaggcucaagagauccucccaccuuagcaucccaaguagcuagcacuaaaggugagcaugaccacacccagccaaugugccaagaacucuuucaagcucuuuuacauccagucacucauuugauucacaugauagcuuuguaaugcaggaacuauuauuuaccccaguuuuacaggagauaaacugggguagggagaaauuaaaaauuugcccaagguuuguaucuuacuccugacaccaaaaaauaccucgucuaaggucaaaagaaggaaucaaacccagguagugucuccaaggucugugggcuuaaccccuauacugcauuggcucucaguguugacuguguccaugguaacagguggaagaucugccagggcuaggagagaagaggcaccaggacacagcaugguaccaucuuguuuucaguuugaaguuagagugcugguucugcugguuccccgaaugcuuucugcacuagcacuuacaugauucuauuaagcagaccuuagggagaaaaaagauucaaaaaguuuguguguccuguagccugcuccgccugguguagaaauugucccuugagagcaauuaguguguuggcuuguauuucuuucagcuuauuggguaucugucacuaaguacgguacugaugguccuagacagucuucacagcauacugcuuauaccacauugucaguuuucauaacuucugaaaauuagaagaaacauaagcccccuccuggcaacaaguggaguacuucccaagaugaccaagacuguuggugucuuccucaugaagauguauuucuugaucaguuccuuccucuuuuuagugucuaagagcucauucugacaauggguuaaaguuuuaaggaggccaguucacaccugcagguuggucaagaaguuuaaaugauucuagcugcuaaguguucucuuaauggcuuaaagagucugccauggccuucaugauuaagaaagggagccucacagcaugagucuguccugcagcaucuucuccaguuuucccuggaaagcuacaggcagggcuugcucagaccauucaagcugacuguagaaacagcugccguucaagcucagguggacggauuggaacuuugucuucaugugagcauucauacggggagaagucaucucauacugauuugguuuucuguuugucucuuccccaacagggcuguuuaacgacccccaacuccccauccaugcacucacguucucuuacgcuggguccaucccucucgcugggcagcaucucagggguguccgugaagucggagaugaagaagcgccgagccccuccuccuccagguucagggccaccugugcaagacaaggcaucggaaaagguagggcagugggcuguucucacaaccaaagcaucuuuucagugacacaguugauuguuccaaagcucccugggaacacaguaauccuucauguuuguggcuguagcgacuggaguguugggggcaaguauuuaagcuuuauuuaaaaguaaaggcaagaugccaggaagggcucaugauuuuaacucugagaagcugaguuccccaaggcagucaggauacacccagcagcccaguccugcuccccacauacccuaauaugucagauccaccaugcagcuguaaagauaaggaugcagucuucuucccuggacugagauuuuucugacugacugcaucccagcuuccuguggaggcagcaugccacaaaugccaacauuuacagaaagcaaauucagaguccauucauucuguggcagaacuuuauuuccuaacucuugccgcaugugucauguggccuagcccaguugcauaguuugagagugucacgccccugcuagucuuuagguucaaagccccuuuuugcucauuugcucucaaaauacccuaaaaacuaagucugugccuccugaaugugaggcuuggucccuggaucuugauaaaaaguuauagcagcagauaccaaauggcgggguccugacaugucauguaauuuccuuaucagccugcuugucguucuguccagguauguccgucuguccaucuauuuuugcaagucgguccucuggucauccaucucuguuccuucaugguuguucuuuaucccugggucucagagaccauccugcuuccauccuuaguccuucauaucccuaaaaaucuaucugaaaagccuguaguggaacacauuuucaaagaaaauauuuuuauuuuugcaucucuuaaauauuuucuaggccgggugcaguagcucacgccuguaaucccggcgcuuugggaggccaaggcaggaggaucaccugaggucaggaguucaagaccaaccauggccaacauggugaaaucccgucucuacuaaaaauacaaaauuagccaggcaugguggugcacgccuauugucccagcuacucagaaggcugaggcaggagaauugcuugaacccaggaggcagagguugcagugagccaagaucacgccacugcacucuagccugggugacaagagagaaacucugucucaaaaauaaaaaauaaaaaaaaaaggaauguauacauauauccuaauguaacugacuuauuuugaguucuucaugauauauuagcuguguuuucauaaaaauaaauuuaggcacaaaugguaccuuuuuguuguaugcauccaugauaagaugaugcaaauggaaaacacaaagcuauuucuucugauuuucugcagugugucucauuaauuugcuuggauguagauucugaacuuuuuuauaauaugcagaccauauugauagcauuggccuuucccagcuacaugccccugggaauaucuuuuugcuuuggcuuaggauagguuucuuuaguuaguaauaaaaaguaugacuuccaggaucaauauuaugucagcuuuuuucuuuuaauaagaauuguauuuuguuaaugcgauaaaauguagauggugaacuguaccagcauuuuaaaaauuucuuccacccagaagagauguuguauuuuucugcauuuaaugugcuuacccacaguggauaaagccugcuugagugggaaaaugugcaguaaguagagaauugggaauucugaaugaaaaauaaauaguacuuuauacccuguagaaugaacagaguuuccucugaggcaguaaaagcuuuuugcugaaaucuguuuuauuuggcacagaaugcguggagaaauuggcucauggaaaccaucuuccuuuuuaagcauaugaguggcauauggauuagauuuaagcauuugcuaugaacaugcuuuuuuaaacugaaagguauuuuguuauuuacuaauuucuggaaaaggaacccaaaaauguauugucgucguuguuggggaagaacgucaauuccuucuucaugaacuuccuuccauauaaagauaagauguuuguuugggaagccuuauuuauaugcaacuguuacuaacaccaguguccugaacaaggaggaaagguucauuuucagggacaugacuaguuuguaagaaaaugagaaugccuacauuuguauauuuuaaaauauuauuuuguaucaacuaguuuaaaaaauucaauauuugcuucuucaaguccuaacggugggauaauauuagccauccuccaguucaucugaaaauuuucuaaaauuuguaaccauaguuaguauuugucaccugauuauguauucauaauuugaucauguguguuuauuauuucuaaagguauuuuuugaagagguuuucccagagguguuagagccuggaggugaccgaaugcucuucucagaucccauggcucuucccacaguacugugaaugcagcuuuuauuauguggaaacuucagaccagaaugauugauuguacacauuaaggcaccuuaugcucucaggauuucugagacuugagcgggcaucagaucacccaaagggcuuguuaaaacacauuuuccugggccccaccugagcgcugauucaguaggucuggauggggccugaacauuugcaucuuaagugcugccgcuccggugaaccccacuuugagaaccaccccuucauagcaaacuaccucccucagcugcuggcucugaauuuugacuacucaaaggcaacagaucugcuaagagauucuucaguaggaaaguuaccucaaaaugaauccaucugugcuguagaauaauaauuauaugcaguuuuccauaaaguuagcuuaggccuaaaguuauguguuaaaacacaucaguagcguccacuccuucucacugggacccagggaacccucaucugggaggacagacgaauugucuguucugcacaggauuuucuuccugcuucaucuccuggggcccacacuguccucucaccaucgugcuguguagagacggugaacucucccuuuguccuggacccuaggcagcugcuggaauucuugcucgcugcucuugcauuuggguuagagcccccuuccuauacugagugauaugguuuggauguuuguccccuccaaaucucauguugaaaugugaucccaguuggagguggggccuggugggagguguuugggucauggagauggaucccucaugaauggcuuggugccauccccauggggaugagugaguucucucucugguaguuuaccugagaucugauuguuuaaaaguguguggcagccccuccguccuugcucccucucucaccaugugacaugccuaauccgccuuugccuuucaccaugaguaaaagcuuccugaggccucaccagaaggugagcagaugcuggcaucugcuucccguacagucuauggaaccaugagccaauuaaacccuuuuucuuuguaaauuacccagucucagguguuucuuuagagcaacacagacugacuaacacaccaagucuuuaguaacccaucccgaaggagaguuuguuuuccucuuauuugcucaugguuuccucacuuguucugcucuugagccaggauuaagauugugaguaggggcugucaacacagaugccugggugggcaucccucugcuuaucuccaguccucaguuuccucuguaaaaugggaacaguaagaacagcacuagccagugauugcuguagugaucagacauagaucucauggcauuugccuggguuccgaucccagcuuggccagcaguagaaaugggagcuuggaugagaucacccuucucugugccuuguguccuuaggugugugcucugcauaaagcugggagaugagagcuggccacagugcagugggggacagaaguagccagcaugccuaaagcagggagggcugggcagagggaaugaaggguccauggccccagccgggguucuguguuaaccaaguagcagauuauauuuaaaaaucaaauuugcuguugcugcaaauaccaaauguacaauuaaaaaaucaccaaggcgcugcagcagguucauucuguuaaacaauaccagcauccucuccucuguuggugguauuuucccuucucagccacaaacuacaaacacccuacucacuauuccauaccuucugaggauucuagagaagagaguugcucaucccuuucaguccugauagcuucuguuuaagaagaaaaaucaccgggcaugguggcucaugccuguaaucccagcacuuugggaggccaaggugggcagaucacaaggucaggaguuugaguuaagcccagccaacauggugaaaccucaucccuacuaaaaauacaaaaauuagcugggcgugguggcggaugccuguaaucccagcugcuugggaggcugaggcgggagaaucacuugaaacuggaagguggggguugcagugggccgagaucgugccacugcacucuagccugggcgaaagagugaaacuccauuucagaaaaaaaaaaaaaaaagaagaagaaucaauuacugucaagacacccuuguguaggggacucaguuuaccuauuaaagauugacacaauacucuauauuauucuugcuggcaucuuucuuuguauaauaccuggcauguuacagagcagguuuuuaaaacuuuuuugguauuucauuuaagugauuaaaaauaaguaacuuguggaaguuuacuaaucuguguuaucuaauuuuaguuuucauuauccacaaauauauaauacauaguuauucauuuauucagucaauauacaguuauaugcuuacuuuugugcagauacaacuauaaauccauuuuuauuguaauugacaaguaauucaaaaauauuuuaaaguuauuccagcuuucuuuuuucacuauuauuugaauuauugcuuuuauuauguucaacacuauaaaauuccaacuugagaagucuguuucucugugaucucaagauuauugcauugggacugaaauugcuagugaugguuggccauuaaaauaagugaugauggaggcuguguuaugaucaguuauuaguauaacccaaaauagacuuuucuaugaaaaauuugcuuguguauucaaugaauauugaauaacugcuaugcacaaggccuugcacuugaaagcaugaauugguauuuauuacucuaauaucucagcacaguguauacauaaaaagauaguauuucacacugugugaagacugaggacgaucuguguauguuagacauuuaauggaaagcauuauuacuugaaguuccauuuccuggaucugguaacuagaauaauacaggaagugauaaaacuaugcugaccagacucccaaagacacguuucaucaagaacugaaguguccauuugaucaucaucagucacucugguguguucuugauccuguuccgcagagaggacacccagggggaggcagguccuggcagccccuguacugggaaggcccugagagcugggcugcagaccacuuggccaauggaugccagacucaaguguccucucugcauuuaggccugauauuuuuugcuuauuaaaaugagcauucuuauuucccaucucugugagcugugguguugaggucauugcaauacucaucuuugcagacuucuuccugcuguccuucuccuggagugaagucugccuucuguuucuuaucacauggcuuguggugguggugaauugguuacugauaaaguggaugaugcuuggagacauugaaaaauuacuuuucacacuaauuagagggcucugaucuuugccgggugugucucauggccacuccucagccaguuggccuccuggagugcuuuguucggaaggaaggacucaggucggcugaggcucagcaaaguagagagaguccuucaguuuaccaugcgcucaggaggggaggaucaucugggcucacccagaguaugagaugaugaggacagacucuuuagacccaccuugauggugucucuucuuguacacaucaaccacaucaaccugucagggaauccugccuguuuuccuuugaaguguauccagaauccagccauuucccuuugcucccaccugcacucccgggcucaagcacucccaugccccucugagauguuuccuggugcacuggcuuccuaacuagacccugcuucugcucaugcuccucuacccuggagaaucuucuuuacaccuucgcuagagcaacagguaucuaaacagagacagggucaugucaugcuuuaaagccucugcuggccucacgucacaguugacugugccagcugcaucucuccugcuucuccccacacccagcagagccuuucaccugccucucccuagcauccuguucaccuccucacugcaccagacccugcuuggcagucacugcauccaugaagucucgcuggccaccuccacccucugguaacugcccccuucccugguuucagguuucuuucagacccugccagacuaagcucaggaagccaggaauucuguguucccugacacaccuacagugucuaacacugugcucauuaaaccaguaaauauuuauaugaacuuacuuuacguguacaugauuuauuuaccaaacaugugugggucaucucugcugugcucuaaauguuggcguccuccaaaacucagaugucagaauccuaacuccaaacaugauaauguuuggggagugaugaggucaugaggguugaaccucaugaugggauuaguguccuuauaaaagagagcccagagagcucccccgccccuuccaccaugugagcgcaaagcaagaaggcgcccucugaagcaggaagccggcccuccagacacaagucuguccacaccaugaucuuggacuucagccuccagaacugugagaaaucagcgucuguuguuuauaagccucccaaucuaugguauuuuguuauggcagccugaagggacuaacacaguuucucagugaaaaaagcaugauuucaaaaugugcgcaaauagcgaaagaauugcuuuccucaaggaugugacagaauuuaaggaauaagucauggcaacuuugaugaggacuuggaauauuuacuccucacuaagaaaaagaguuguaaaugggccaugaaaagugcgagugccagagcuagagaacgaucuuauuucccucagugcgaggucgggcagggacagucugucugggcacagguaggaguaagggcacaagcaggcccauuugcaguuugcaugccaccucucagaccagagcugcugcugcugcugcuggaauggccagggaggcaccugcccacccgcccuuaggagggccagagcacaugggggugcauggcacagcacugucuuauggagccuccuugaggggcuugaggggcacaggacccuggcagcagaggggaggccgcaggagcagccgugugggcuggaggcugacauugccacuuaucacacagugagcggccgagcuucugcuuucuguaaaugggugcaauggccacacaaaauaugaagauaaggugggaggauucuucagcaccugcuccccgccccucccucucauuucucuccccuccccgcucuguguuuggugcuuuucugcaucugagauuuuuuuucucuuagcuaucuggcugucuuuuuaaauucccuucacucaguuuggucuuccaaugucucuuaaccaugucucuuuaaaauacacacacacacauacacgcacacauaucccacuuacuuugcugugcauaaaaugucuccccaugacuuguuagaucuaacccucacagccauccuggcauccuugcuaauuaugaugucuguuguuaucugaguuguggaaacugagucucagaccaggcugagcugcaugucagagaugccugcaaaagaagagcaaagaaguaaaucuggguuuagagcagggacacuuucccucuacaacuuuguaugggaugaauaaaaaccuuagggaggaagaaggugucgccaucaaggugggguuucuauguauccagggacccaucuuagaguuuaacauacuucagaucauauacacaaacuagcugccaagacuuucuuucagauguggcagaaguuuucccacuuccuccacugugaacugaauaacccagcuucauauucuggaauaccgugggagcacucuguuuccuuuuaauguuauaguguccauccuccagugaaggucaagaacaaugagugguauuaccauuuuguguuuugccagcgguugguaacucaauggcacauuguucugucccccaaaagagcugagggaguccggaucaccccuuugcucucugggacugcucuuaaguaaaacacccccagccuucacacacccagccuucaggccagagggagguuuccuuuauagccacgccccccagacuuuucagcuucuuuuguguguuuguuccuaugucuuuuggggccuauugugaaugcuuuagucuuucagaaagucaaaagucugccuugaacacaaggccaccguacacucuguucccacaacaacauccuuuccccgaccucauacauuuuuguccaaagcaaaaugcagccagugacuucuguacaggaaccugcacccuccccaguugcgucugucccuguagcagagggaaaaauacucuugguuuguucccuguucuucuggguuccagaauucuuuccaaagucauaagucaugcuccgcuguuuaguugugggcagcagccuaacaagcuggggacuugggugucugucacaucaguggccccguccccccugcuggcaugaugagcucuuucaagaaaccggacucuggguguagcucacguuugugacuuuccaguucugugucuuuguagcagccacccauguugucacucaucucguaguacuccuuggagaagguagugauagacggauaugaggugggaccacaagcgacgagguugagacagauccagggcccuccacgucccacggccuugagcacacagcuuguauuugccauccacuuggcugacuccccagcuugggaccgugacuuguuccccgugguguccccagucauaagcauaugccuggugugugguggacccucaguagacauuuaugagcgggugaacauggccucaaugucagacagcuaaggaggcucaugcgagacgaaugggccauugucuuucuggagggaggucucuggugacacugaagagggggagcaccuugaauuaaccagcgacuuggaugauguucugcuacagcugcaggguuuggugaauggagagcaaauagggcagcauuaggguccagagugguucccuaagccaggcagauccucugggagaugacauuugggaggggugagugacucagacucucagggucucugacgacguccagaucagucacuuccuugcuacacaugccauggacugugaaugagaggagucccacguccagguccaacccaggcuccuccauguaccucaguccaaggcugaccccagaagcccuucaauuucaagucuaagaaugagggugcccugauaaauggcacacccaagaagggcacucaggcaguuugguggggcuaggagccagugaaggcugugaaagggguacaguggcccagccuguccuaacagaagcaugaagaucaggaugagggugggguggugccgcucuauucggugcuggccacaucuguuccuucagugaguaggucucugaacacuuuuuuuuuugagacggagucucgcucuguugcccaggcuggagugcaguggcacuauccuggcucacugcaagcuccaccucccagguucaagcgauucuccugccucagccucccauacugcugggauugcaggcgcaugcuaccacggcuggcuaauuuuuauauuucuaguugagaugggguuucgccauguuggcaaagcuggucuugaacuccugaccucaaguaaucuguucaccucggccucccagagugcugggauuacagugugagccaccacacucagccugaacaccauauuuuaagagaaaaaaacuaaaaggcauucagaggagaacauucuuggaaucgaagcgucuagaaguuaccaucccuuacuuaaacgauauagaaauuacaaaauuuuagcugaaaaauggaaagauucacugggaaacaaucgcuacauccagauguuuaauuucugucccaagacaguggggugacgucucagugccccagaagacaggacuugaaugaguacgcggauguucugaaaacauuuguuuuaguugacuauagaaaaaaaauuucucucaggccauauuggggcaagagagcuaugaauauguggggaaagugccacguggcaguuauauuuaguguuuuccuauaguaucuuauuuaauccuucccaaauccccacaagauagggacugucaucucuguuuuauaggugauagggcacagagaggcugagugauugcccggcuccaugacaguuuguaaaacagaagaccaagucuaaaacauagucuggaggaguagaucauaguuugaauuuuuacaagcauaauuacugccuuaacauuuaagugaaaggguguguaaguuuucuagggcugccaaaaccuaaauaccgccgacugggugguuucaacagaaauuuauuucucacaguccuggaggcuggaaguucaagaccaaggugucagcaagguugguuccuccugaggcuccuccuuggcuugcagacagcugucuugcugccguggccuugcagggccuuugugguaccugugcaucccaggugucccuuccucuucuuauaaguacagucauauuggauuagagccuaccuuaaugaccucauuuuaauuuaguuacuucuuuagaggccccaucuccaaauauagucacacacuggggauuagggcuucaacacacaaauuuuggugggagaggccaggcaccguggcucacgccuguaaucccagcacuuugggagccugaggcugauagaucacuuaaggucaggaguucaagaccagccuggccaaaugggaaaaccuugucucuacuaaaaauacgaagaaauuagcuggaugugguggcauaugccuguaaucccagcuacucaggaagcugagacacgagaaucaccugaacagagguugcaaugagcugaggucacgccgcugcacucuagccuaggcaauagagugagacucugucaaagaaaaaacaaaaauaaagaaagaaagaaagaaaaaaaauuggaaacaaauucagaucauaacaaaggaaaaugggguuccugucuacaggcagaauaguuuccaugaggaacugaaggguguguaagacucagcccuuugaaggcacucagcacugaauuggagcacuuuauguccccaaaauacagagaacgcuugucuuuuggguagauuacgacauagguguccaggacaguggcagcagccgucgccaugggaaguucccacuagcaacauuaguuuguaugguuccagucuaauucccaucccagagaagccaucaguguuggaaaggccaucucauuccaguugggagccagagauacacugggugagggugucacuuccaaauucuuucuugguaaguggcaugcaacucauggaagaaguccaagcagacagaaguuauucaucucugcuggucauauuuuaauugcuaaaucaauuggagauugcuaaucuccaauugcuaaugaauuagauugcuaaugaaaggccauugugccagacaaauugcauguggaaguacacuggccagcaggaagacagcaaaggcaccgucauccagucgucggccaacuggucccaugaugcaggucccaaguuaagcacaauagcaauuagagagacccagcaacaguucaguucuucuugcaucccaggcacucugcuaggacuuuuaugcacaucaucucauauaacuucaucuuuacaauauccuuauaaggcagguucuguuaucuucauuuuaccaaugaggacacugagguuuacaaagggaaagugaggucccagggcugcuacuacugccaguaagcaacagaauaugggccugucugaugucuuuucugcauggagccaucaugcauugaugcugauucaauccaagagaguuguguaacacuuggcagaggggggugcagggugacuguggcucugcagccucugccuggggugaugugggugaggagguggcauggugcugucacauggcguagcacugcaaugagucacuucaacaugaucuuguuagacauagagauucugaaaugaagaaaauguuugacucauuuacucgucauugacagggaagucaugcauuugcugguugagaaucaaaacucaaagauuuaaaaacaauuguaugcaucuucuugaaggaaaaauguaccccugcuccaucauucacagccuccuugaauuuuucacuggaguguuuucuuagcacugucuguucauggugcucuuucucagcagccuguucugcuugugcagaaaguccuacugcaguugaaacauccuggcagaaaaugaaagaauugguucaccuccacacauggccucuugucaaaaaaauuaagcaaaacuggcaaguuagcgacaagggauacaaggcucuuguucuguagaacucuguucccuugauggaacuacuuaguaaaugggguuaacuucaucaggcuagccagcuccaaauauacauaaacucaagaagucuggaacccaugucaaauucauguuaaaaggcaugaacugccaagccauuacuguaggcauagccaaauacauuguaaauauaucugucaguuuugcucagauacggauaucugccuguuuuuugagaugcuuccuuuuguuuuggcuuuacccaacuuccaaaaaucugucugucugcucauacaguauguuaugagacuuuaaaagucuugauagggacaacaaauaaaacaaguaggauucuuucaggccuaacuaaacugucuuugagucuacauuuuacaaaaauaauuaugucauucaauuuuuuuuuuuuuuuugagauggagucucgcucugucgcccaggcuggagugcagucaguggugcgaucucagccuacugcagccuccuccuccuggguucaagcgauucuccugcaucagccuccugagucgcugggauuauagccaugcgccaccaugcccugcuaauuuuuguguuuguaguagagacaggguuuugccauguugcacaggcuggucucgaacuccugaccucaggugauccaccaaccucggcuucccaaagggcugggauuacaggugugagccacugugccuggccugacauuuaaauguuaaaugugccagauguaaagcauaucugccauuuuaguaaauuaacaaaacuagcaaagagcuaaauaacugaauugauacuaaugcauuuuguaauaaacagccaaguauagguuguauuuauauucuacaauguggagacgaaaaaacaacacuuaugaugguacaaaacaaccuuucuaaaaauacuggggaaauagaagugcugcagagaucaucucuggcguccagcugccuccucccauccuggagauggugaagaugaggacagcauuguguucagaggcacaaaggaagccgaguuccuguccgacacaaacaucccugggaaccuguggcaccucccacugcagagccugugaaaacagccaggcugcaaggauccuccuugguggaaauagccgggcagcuaacgccagugugcagagaaaggaagcuggagcuauuuuaguugcuuaacgucuaccuuuuguuuguggaucguuuccucucugacacuuguggcuaaagaagcaaguguuguuugaaggagauuagagucuuaaguauuuuuaacacucacuagagugugacauuguaugggagcucucugugauaaaaucaaaaugaaaggugagcucgccacucuccugcacguugacaguuuagcaacauggaggaagugggaagcuggcuuuguguuagagaguuaugcuguucaaauauccaucauuuaaguaugcuguucuuauccuuguacuucgucauacuuugucacuuugguuuugccugucagucacgucaacagucaguauguuuuucacuaugaagggaaacugcuggaagagugaguucauuauuucucucaccuuuacauuuugcaacuuuauauguauauucaugauucuguccagccaccuugauaauccacaaucagaaaaguggguuuucaaauauaaaucaggauuuuaaauuugcagcaguguaaaaagauccaauuccugucuuugaggcacuguucaggauuuggaaacugaagcugggugcagagccuccuaggcaccaucucgucuugaacuuacauucugaacucagccuugacugcucuggguucauugugguuaacuaaccuucagcuucaaagacauuugauuuacuccucaaccaaacuuacaaaauuuuaguaucugcaaagcuuuuacuuuugugcaccaaaggacacagucaacagauuaaaaaggcaacccgcagaaugggagaagauauuugcaaauuauguaugugauaagggauguguuguauggagaacuccuucaacucaacaacaaaaaacaaacaacucaauuaaaaaaugagcaaagggcuuaaauagacauuucuccaaagaaaauauacaagucagcaagcacaugaaaagaugcucagcaucacuaaucguaagagaaaugcaaaucaaaaccacaaugagauaccaucucauacccauuaggauggcugcuaugagaaaaaacacaaaagaaaagaugcguuggcggggauguagagaaauuggaacccuugugcauuguuggugggaguguaaaauggugcagccacuguggaaaacaguaugacagguccucagaaaauccaaaauagaauuccccauaggaucuagcaauuucacuuccgggcauauauccaaaauaauugaaagcagggccucagacagauaccuguacacccauguucaucgcagcaugauucauaauagcugaaacauggagguaacacagguguccaucgauggaugaauagauaaacugugguuuguucauuuguuuacaaugaaauauuauucuguaauaauacaaaaauaaauacuuaaacauuuaaaaggaaggaaauuuugauacaugcaucaucauggauguaccuugaagacaucaugcuaagugaaacaagccugucacaaaaagacaaauacacaaaugccaugugauuccacuuagaugaggcacuuacaguagucagauucauggagacaaaaaguaggaugaugguugccagggccuggggggugggaauuggggaguuauugugggauggguagaguuucaguuuuacaagaugaaaagaguuuuggagauugguggcacaacaaugugaauguacuuaacacuacugaacuguacaauuaaaagugguuaagaugguaaauuuuauaguauguguauuuaccauaauuaaugauaaaauuuaaaaaauuauuuaaccacuuccuuuaaaagguauaaccuuaaguaagaucuuuuuacuuaaauaugguaaauauaguuucuccaaaugccuuacguguguuauauuuuugaguaaaauauuuucagugaaccuaagaagguucacugaugccugaaacauuuuuaguggguaaauuuauuugacagugaaauaacuuauauuuuaggccauuuacccucccucuccauguauuuucuuucuccuuuguauguuauaccauuugacaacacuguuuugacccccuuguuugauccuugcaagcuagaguuauaaaggauucuguuguuuucuauuuuuucuauacuaccauauuuauuauauuuacuuauuucaauauauuaagauugccaaacaggacuguggccaaaaaucugaaagcauguagcauaucuuugcugagggagccaacaauuaagaacagacaucuuguauuuaaugagaucuacugguuuagaggcuguguggucugucucauccuuucacaacuucuguacaacuuugggcaagucacucaaaaggacuugccaaucaacuuuucugaguucuauuuccuuagaagucaaauaauauccuuaccuaucuacuuaacuaagguuuugaagaguuaauguauuaauagaauuuguaauaguacuuacaaaaauaguaaagauuuucaaauauuuuaaguccuauauugaugaauauuuuuaagugaaugguuuugucaugggaauaauuuggugaacaucuaaauaauauuugacccguugauguggaggaccacacaggcuuacuauaaagacuugaauuccacagacauuugaccuguauuugugauacaaaaaucuuguuuuuccucuuaaaaacuuuacuuacuacccaguuuccauauuagagaagcucguggugcagugucuaauuuuagaggaaaagggccuugaaucaugaacacagcuucgcucccuccuccuuuuacuuuacaaacacaggcccaagguaaauggacuucccucacaagccagcugugaguuuguuugucaaaaauaauuugguucccuugguucuuagaggaugaugguuuuauagcuguuacuuacaaaaccaauguuucccuuaguauugagcuaccucuuuauuuaaacuauuagaaaaugugucgccauauauaucacuaggauauauaugguaaugagaaccuagauuagguagccuaaauacuaugguaccuuagaagagguaauaauaucaccagggaaacuuaguuuauaaccaaacugacagaaucucuguauuugucagauaaugucccuguaacuuugguagguauguuuuaaccuuuuuaugugucugaauuaaacugugucauuuguaaaacuuuccuaugugauguaaucucuggugacuuuaauuguauauuagaaaauaagauguuuucaagugacucugggacugaggaaacuaauuuuauauuuggguauuuugagcugcagacaugggucugacaucccacauggcugcaggaaagcuggacagcaucgauuugcagauacugugcucuggcuguggauuccucucuguggcuggguccagccugcuccagcaguguagagcguaguuugcuuguugaauguaggagggauauuuggaggacauaggcuuugccuggauuugaauccaucccagacuccaccaacacuaaccuauacaaccuuggggaaguuauugaaccuccaagggccccagauuauagaagcguaaaacauacuuuuggucuucgugaccaacacacccuaaugugacaccccucccccucucccccccagugauucacauccuuguaugagcccuucuccuugagugaauuggaauuuggaacuugcuucuaacuuacaagauauggcaaagaugaugggaugucacucccugugauuauaaaagauugugaaaugcagguggccccuaggaugcgaggauugucucugcuuaacagucaguaaaaggccaagucucucagucuugaacccgccagagaagcaauuuucaacaaccccacugagccuucccaaucaaaccuccagauagaaacacagccugcugacaccuugauugcagccuugugagacccugagcagaggacccggcuaagccaugcuuggacucccaaccgcuggaaacugagauaacaaauguguguguuuguguuuaaacuaccaagcuaaugguaaugugauaugcagcaacagaaaauuaauacaguagucaauagauuauauguaaacucaggaaaguaacuuguggugcccauuuguucuagccuaauucagaacuauguggccagaauucaggacagccaccgcccucuggaaagugaggaaagaauacuagaaaggagaaagccagagagggacagccauaaauucuguggauaaauucuggcuaaaucucuggcucagccuugaaccaugcaugaaaaggacagauaccaagcagccuggcuaagaacuaaagagcugaacugagauuugauugcugcucaagaaacaggacuuaaagugaauccagucagcuuauuauugcccgugaagacaaaguaauuuacagucuccugaggaauaugagggaaucuagaaccuccuaagcauaacacucaacaauguccaggaugcaggccaaaauuauuuaacauaugaagaaccaggaaaaugcgaccuauucgaaaaugugaaaaagauagucaauagaaaccaaucuguagaugacugagauguuggaauuagcagauaagaauuuuacgacugcuuguaacugugguaacaacauaaugggaaauaugcucauaaugaaugaaaaaaagaaaaaaucucauaugguuaauaagaacuauaaauaagaaccaaguagaaauucuagaauggaagaacacaauagccaauauaaaaauuucacugaugggcccaacaacagaaugaagguaacaaaagaaaaaggcagugaaguugaaaauaaaucaauuugaaauauccaguuucaagaagaagagaaaaauuuuggaaaaaaaaguagauccccaaagauuuauuuuuucuauuuauuuauuuuuucuuuuuauucugggacucuauugacuccagaauaagaagagaaaaaaauauuugaaaaaacaagggccaaaaguuuuuuacauuuugugagacaaaauuuacaaauuaaagagguuuggugaauccaaaucaaaauaaauaagaagaaaacugugcauagcuacauagguacuuuauaaugaaauuacuuaaaaauagacuuaaggagaaaaucuuauacacaaguagagaaaaaugccauauuuugugcagggggaggggggagggauagcauuaggagauauaccuaauguaaaugacgaguuaauggguguagcacaccaacauggcacauguguacauauguaacaaaccugcacguugugcacauguacccuagaacuuaaaguauuauuaaaaauauauauauaaaagaaagugaaucacuuuaucaucagaaacaguagaaucuggguaacaaugggacaucuuuaaagugcugaagagacaaaacaacugguaauucagaauuaccuacccagcaaaaauauccuucaaggauaaggcaaaauaaagacauuuucaaauaaaauauaaagaauugccauuagaccuccauaaaagaaacacuuaacagaaauucuucaggcugaagauaaaugauaucagauggaaacuuggacucuuagaaagacauaaagagugucagaaaugguacauagcuagauaaacauaaaaaaacuauuuuuucucuuaauuucuuuccaauauaugugauauauuucuuuccaaaauauauaagauuacuuccaauauaugugauugcuuaaaaauuauaauauugucuuugggguuuauaaucucuauaaguguaauacauaagacaacuauagcauaaagcauggaagggcuggguaaauggaccuaugugauuguaaguuauccacauuugaugugaaggguuauaauacuuaaucuaauuugacuguaaaaguugagcacacauauuauaauuguuggaacaaccauuaaaccaaauaaugcaaagagguacaacuaauccagugguuaaauuuuuaaaacccaaaaguaaaguaagaacagagaaacaauaaacaggagcaacaacaggaaacaaacugguuuaucuaaauucagccauaucaauaauuacauuaaauguuaacagacuaaacacuccaguuaaaagguagagauugucagaauggauaagaauguugucuauaagaaccuauuuugaauaaaaagacagauacugauuaaaagugaauggguagaaaaggauaccauuuaaacaguaagcaugagaaaacuggagugacuagauggguagcagguaaaauagccuuacauauuacuagaguuuaagauggacauuucauaaugauuaaagaaucaauacaucaggaagauuucauacucauauauauguguauguaccuaauaacagaacuucaaaauacaugaagauuugacaaaauuaggagaaauagacacauccaccaucauauuggagaacagcaugacugagaacaaucucucagauagaacaacuagacaaaaaaaaugagugaagagauagaggaucugaccaacacuaccaacuauccauauaaaugauauuuauagaacacuauauccaaccacuacagaguacacauuguuuucuaguacaaugugguauguuuaccaacacaucucaauauacuuaaaaggauuuauaucauguggaguauuacauuagaaaucaacaguaacaauaugucuaggacaacccucaaauauuuggcaaacaacauacuuuuaaguaaucuaagucaaaaaagaaaucacaaaggaaauuagaaacuauuuugaacugaaggaaaaaauauacaauauauuaaaauuugugggaucuagcuacagcaguccuuagaggaaaauuuauaacuuuaaaugucauauagaaaaaacuaaagguuaagaaucaaagacuuaagauuccaucuuaagaugcuaaaaaaaaguagaacaaaauaaauccaagaaagagagauauaauaaaaauaaaagcagagaucagugaaaucgaaagcaguaguagagaaaaugcauaaaaucagagcucuuucugucuuucacaugaucaaccauaugaucaacauaucuagauugauccagggaaaaaagaacauaaauuaauaucaauuuuaaaagauggcuuauuaauaugauucuauagacauuaagaugaggaaaugugaacuuuuuaccaaaaauuuugaaaacuuagaugaaauggagaaauuccuugaaaaaugcaacuuaccauuugacacaagcugaaacaaaaaucugaaucacacauuuacugugguggugaugguaauugcagugaauauuuaucauuaguguaugcauucauccauucagcugaauaauuuaagugccugcuuugugcuacaggagauagcuaaaauuggagcuaguguugggauguagaaaauaaacaaguaaacaaauccauacaauacuucagauaucaguaaguuaucacaaggaauauguuggggacaugauuaagagugacguaacaggguaguuaguuucaauuccaacuugaggaacucugcucugugcuaaggaauaaaugcuuaggaggaacuggccuugugacaaucugggggaagaaaaucccaagcaagggaccccuauugcaaaggccugaggucaggacaaacuucugaucaaggacagagaauggcagauacaucauuucuguaagaaaacuuccagguuagucuuuucucucaucucucuccagauuuacugucuuauagaaacaguauuaggaugagauucuggcuaacugugauuucuuuccuuuuuuaaaguuuuauucuaaguaugagauuuuuguuuuaguaaauguuucuuauguuaaauacccaauuugaaacacuuauuaucucuggauuuuuuuuuuuucuggaguacguaagaaccagcccucagaauuugaccguguauaacagugaggaaggggcagcacgguagagagacaggggacuccucacacugauuugccuuugauggguggagcugagaaaaaagucaucccuggggguucugcuguuguguuaggagucacccccuccugacuguguuggaggggccgccccagcuuccagccuuguggcaagcguagacuuguguuagaccuccccagcaggcucccugcacauauaaagguggagaucgcuuauguagacccaaagucuagguuuuggaucuuucacagcaguucagaguguuggccacauuuuaaaauaucuaauugucaguacugagaggaucacacggaauaaccuagaaaacacgcacauuucccaaggccaccauuuggccuguaacuauagagggcaaggagugauuugugucuauagauugaggucaguuggaaaucuuucagcgcaaucacaggccuugauuauuuuuagacaaugaauauaaaacagacaaccuuagguuaugugaagagaaccacacuuaauuccaucaaauucaaguuuguuucauauuucucauaaacuaaaccauuaagugcugagaacagcaaauaacacauuucugauauggaagagaaauuuauuccaaauaauauugaaaaggacugauuucuuuaaaaagcacucauucagacauauuuuuuuuccaaaaucuauuguuuugguagaaauaauuauaauaaaagaagcacaauauuuuuguguuuuucuauuuagccuucuacauuugccaaggaauaaauguuaaggaaccacuuuaguaauuuuaagccguggaauugagugacaguaaaagcuuccagugacuaaaaacuuucuuaacaauguuuuuuaagagaggauagaauauuauuggagagagauuagacaaaaugaagagucagauuucuuaauggacacuuuauaaacaauagccaugguagcucauaaaagcuuuuacuuuucauuauacaguucuaacaguugauagaacaguaagccugguaagucuuccuuauuuaugugguuuguauuuuauuuccuucauauauucugaguaguacuuugcaccuuugcacuugacacaucugcuuuugccauucucuuaagaauauugccagaauccugcuagaaacuugugaugaagcauagaugcuccaaaugagcugucauccuggguggaagucuauucccuggaugugugggaccaguaccucuccaagagauguuacugugcagagggagugcauuucacacccuagaccugugccaaaggauuuuuaucauuuccggaagguuaagaugucugcagcuuccacgucuuaugggagcacaucaccauuaauaaauuuauuuucgguuguaggaguuuuuauauuuuguuugugguugccacauaugggaagaagaugauacuugaguaugcuugucuaagaagugucugaagcuguuggcaucaagagcacaauuauuauguucaaaacagaucuagauggggcaacugaagcuaaugagaaaccugauugugccuuccugccugcagcguugaccuaagcccuaggcaccagcauucuuaugcaaggaccccaagggccccuccucuguggacugcaaagcaaggccagacuaguuuuacuucugaugagacccaaaggugcaaaggacagccgaccccaugcaaggccuaaaugaggggaggauuucagcuauuagucaaauacuggugcucaggaaagagaucuguagaaacucccugaaagaucugugugcagaagugaauauuguaaccuaugcaucugcagggacaccccaacaugaaugggagcuuagaaaggaaacagugcucauugaucaugaagcacugcuugcuucuggagguaacauuguguuaauaaguaguuuuuaaguuacauauuaaucauaaacuauauauuuuuaaaugguccauaucuuagaaguucucugugguccuuugcuuccaauguuucuuuagggcaaaaaauaaaaauaauccacaggacacugaggagagcaauacaauuuccaucagugaugaauuggaauagaaaugcugauguauagcaaagauacuuacucuauguacagaaucuacuuuguaaucccacuucauggcauucuaguuucuccucucuuaugcuuuugcaaccauuaaauuguuuccaagccuuguacaguugacuguuaugugugugggagucuuuaguaaaaauagaaauagacauccaccugaaaauugccuggacuuguucuuagugguccccgugccaugcaagugaacuggauuccuuugaugauauugaugaggauauuaccuaaucuucaccucuuccuaggaacacacuuuaccauaugucccugugaaguaaguguuaagagaguaaaauaaauaaaucgcauuauguacacaggcccuuucugcccagucuugccauucagaaaugcacucauuuaaucuccuaguugugaacacuugcuggggcccaucacaugcccuggcuggcacugcacagugcugagcagcacagauggauacagcuccuccugguauugaggaggccccgucuaagaagauacacagauguuaccaugaagucaaggagcaugcaggggcccaggcacgggggagaggcagcuguuucuuuucugugacauguaguauugagaugggccuugaaggauggaugggucgugaggacaggacaguucagcgagagaggacacuccgugcugaggcugagguggggccggcggggagaaucagggccacuggaagagcaggaugccacacugcacacaccauuugaguaggauccugcuuacaauuaugcagcuagugacagugaauacaaaccaagcuucuuuccaaugccaauaaugccauacuggccucccaucuguuccucuuguaguauguaaaaggccaaguuagaagggcuuguuaucaaagagagaaaaagcaaaugcuggcaaggauauggagaaaggggaugcuuaugcacucuuggugggaauguaaguuaguauagccauuaugaaaaauaguauggggguuccucaaaaaccuaaaugaugcagcaaucccaccacuagguauuuauccaaaagaaaugaaauuaguauguugaagagaugucugcacccccauguuuauugcagcauuauucacaguagucaagauaugguaucaccuuaaagaacuaaaaguagaacuaccauuugauccagcaaucccacuacugggcaucuacccagaggaaaagaagucauuauucgaaaaagauacuugcacacgcauguuuauagcagcacaauucacaauugcaaaaucguggaaccaacccaaaugcccaucgaucaaugaguggauaaagaaacugugcuauauacauaugauggaauacuaugcagucauaaaaaggaauaaauuaacagcauuugcagugaccuggaugagauuggagacuaugauuguaagugaaguaacucaggaauggaaaaccaaacaucguauguucucacugauaugugggagcuaagcuaugaggacacaaaggcauaagaaugauacaguggacuuuggggacuugugggcaagaguggaagguugguuaagggauaaaagacaacaaauauggugcaguauauaccgcuugggugauggguguaccaaaaccucacagaucacaacugaagaacuuauguaaccaaauaccaccuguaccccgauaacuuauugaaaaauaaaauaaagauauggaaucaaccuaaguguccgucagcggaugaaugguuagagaagaugugguauauauacacaauagaguacuauucugcuauaaaggaaaaaaugaaauccugucauuuacagcgacauggauggaacuggaggccauuauauuaagugaaauaaaccaggcacagaaggagaaauaaugcagguucucacucuuacgugggagcuaaaaaaguggaucucaugaagguagagaguagauuggugguuaccagaggcugcgcaggguggaggggagagggaggaagagggaaugcuuaauggauauaaaaguucaauuaggucgaaggaauaaguucuaguguuugguagcauagucggaugacuauuguuaacaauaacuauuguauaguuugaaauagaaaagauuuuaaauguuuacaauacaaagaaaugcuaaauguuugagguuaaagauaucccaauuacccugguuugauuauuacacauuguaagcuuguaucaaaauaccacauguaccccauaaauauguacaauuauuauguaucaauuuuuuuaaagaaaaaagaagaggccaagcaguuuccauccccuugcucucgccugugucauucuuccucguaccuuugcacagguggccuguuucuuucacugccucagcgcuccauccucagccacggaaacauguggcugccuuucguuucuguggaagguggcacuacuaacaugaugcagugguuucuuucugucuuccccucacgagacauacauucugugagugcagggaaggaguuugcugucuuuuuugaggcuccccuuccuuuguggagaacagugccuggcauguagucaguuuuuuuaguaaaauuuuugagaaauaaaugagugaucgagccugguagcacagugguaacugacucugagagacagaacgacagagagggaagaagcauuuaagauaacucaggcaggaaaugcaaagggccugaauaaaagcagggguagccagggguggggggcaaggagggagaugggauuuuaggacugucacagcaagaacugaggugcuucaggagcagugcagugaagguggcgagcgagauggaaguggcaaagaauccaaccuuuaaagauuauccagaaggguccgcagaugcagaugaugaugcagaaccaguuggagcugaaaugucuacaggaaccgcacuggcaguugucuggagcucacaggguggugcauucacacaggugguuugaaaaugaccaccaguaggugguaguuggggaaauaagaauggaugaaaaccagagaugaagagaagaggcagcccugcggagcaccaugcccaggauggggagcagcccgagagugugcagaaacucgcauagugcaaggagggaagaggcugccuggugggaacucacaggaccuuuggaugugaccaucagaacacugggccauucacacaggugccacacuaggcaggaggccaguggcaaggaagguggggugaccgagacuaaggaaaaggaaguugaaguggaaccaguucuuucaguaaacuucauggggcagggggugugugugugugugugugugugugugugugugugugugucuaugugucaguguguguaucuuugugugacggcuccaugaugggagaaguaggcaggugucuuugauaaggagguacuggagagcuauacaagagcucagggugaccuccccaaggcuggcuccagcgccccagggagggcugaguuugggggaagcagcuuuccuuuggagaauggggcccagugucugagagcuggcuccugccugggaccuccacuuuuucugaguuaugggguaagaucaucugcuaacagggaagggaacgaagguggaguaacccaggaggccacaggaugggaauacauguuuggaauuugcagaugggaaaagcaaacagaaggaaugagaauaaggauuucuaaacaaucacuuugcaaaacuguuugccagcgacuucaauagcuggucacacaccccaugacccaagcaccuccaacugugugcaccuccaacaguugcaccaagccaugcacgugaguauucacagcagcacuguugacagcauccccaggcucaccccaaccgaaucccuuuccacaguccagcacauaaagcgugguguauucacaccgagugccacugcacagcaacgagccacacagcagcggaugagccucagagcaaaagaagccagauaucaugauacaaagccccaaaacaggcagagccagccuccacucaugccaccaggagaguggcugcugucaggagaggguggggaaucagaauguuggcccgaggauccuuggugagcuuggcccacaguggcagggaagaggaacagaguuaggagugcuggaggcuggaagcguggccucugggugagcccuggaucugacuuagaggcaccaggcaggauggaaacauguaggcaguggaauauucucuuuuccucugaagacauacuccagguuucugcugagggagagggugggcugcaggaaggaugacacugcaggaggaggaagaaucagugggaagugguggcugcuagcaggacacccauucucuuggacugggggauauuuugcugcaaguggcagaugcuauuaaaucucuuggcuugauuuacauaucuuccuuccuguuuauuaaggagauucccugcugcuuuggcaucuuguauuccccaggggacugugagguggauccuguccugugccucuaagggccucuuuggguucugcucucucuggguccugagugcagcccggguacggagaggugagaggucugcccaugguauguugguacuggugauuggcaacuuguauacaugcaccaguguacaauuuuaaaagaagcaguaucuucccacauuauuuuaaaaaaguaaaaagauuauaaacgucugcacauauuucuagcuaaaacaauuuuagcagaaaaauuaauccuuaacaaauauugauauuuacugaagugggaauaugaaaccauguaguuguauaauauuuacugaacugggauauacauauuggaaaauaugaagagaucuccauguuaaaaccucuauuuaaaaauacuagggcugggugugguggcucacaccuguaaucccagcacuuugggaggugggcaaaucacgaggucaggaguuccagaccagccugaccaauauggugaaaccccgucucuacuaaaaauacaaauauuagcugggcaugguggcgugcgccuguagucccagcuacucaggaggcugaggcaggagaaucacuugaaccugggagguggagguugcagugagccaagaucacaccacugcaguccagccugggugacagagugagauucugucucaaaaaaaaaaaaaaaaaaaacaaacaaacuaggaucacaaaaaaaguguuaaguauuugaggugagggauauguaagcuugcuugauuuaauuauucuacauuguauuuacagaucauaacaucaacuuuguaucauaaauuuauacgauuauaagcugucaauuuguaaugaaaauaaacuaggagcacauuaguauucuguuucagggcauuuuguucucagucagguagaaaaaaaaaggacuuaaacagcaacuuuuguuucuccucauaacuuuccaugaagcaugcccaguauuuuucuuucuguaauuaacaagaaugaugaugauagaaacuguuuucccugccagcaugccugugcccaccugugaagaggccuuucauuuuaccaaguggaacaucaagaacugcagggaaucauuugguugaccuaaggcaucagcauuugaugggagucuuuucaaccuugcuuaggagccucaagaauaaagcagaaucgauggcagaaaauauagugauuuuauauuuaucuaacagcaaaugacuaguaaaaacuuccuauaccuuggguacaggccuaugaugugugguuugugcagucccugggagaacucuuuucuuguuucggauuugggauugaaauggcgacaugucacuuaaauuagaauuuuccuccuccaucugccaggaugacaccagccgggauacugcuuccagcaaacaugccccuuacacacaggggucggcacugcuuuauuacagugaccaaauaaaagcauagcuuguucucgacaggaagauucacuuuugaaauuaagacuauacaggaacauguaagguucagaauccccagguuucauauuucacagaugacugggguggauguauuuuuuuuuuuuuuuuuuuuugagacaucucgcucugucacccaggcuggagugcgauggcacgaucucggcucacugcaaccuccaccacccugguucaagcaauuccccugccucagccuccugaguagcugggauuacaggugcgugccaccacccccgacaauuuuuuuuuuuuuuuuuguauuuuuaguagagacaggguuucaccauguuggccagacuggucucgaacuccugaccucaggcagugggguggauguauucuuucuggugugauuuggcaaaccuugcaaggugccaggugcucccaaauuauuccuguaagaucaggaugucaccauuuccuucacuccuccugaaauucugcggaauuaaagucguucuuuuguauuaguacuuaagccuuguuuucccaggccucucucagccuaggagggaacccaggaggacagaggguggaucugagauggggucuuguucuguugcccaggcuggagugcagugcaguagaacgaucacagcucacugcagccucgaacuacugggcucaaucaauccuccugccucagccuccuguguagcugggaccacaggugcaugucaccacacccagcuaauuuguuuguauuuuuaguagagaugggguuuugcuauguugcccaggcuggucucaaauuccugggcucaagugauuugcuugccucagccucccaaagugcugggguuacaggugugagccaccccacccagccaacucauuuaauucuuacaccaacccugcaguaggcaugcuaucauuaucccauuuaaaaugagggaaccaaggcacagagagguuugguauuugagcaaguucgcgcagcaggugguggguagcagggcaggcaggcugcugcagagccugugcguccuugucuuucuguagggugguacugacugugagaaacacgcauucacccguccaaacccaaagaaugggcucggagacacgaaaaacagcagaagcgagacuuuuaauggcggucuuggaagaucgggcgucuuguaggcaggcacacccggggcagguacagcagguaauuuaucuccuagcauggaagucccuccccaguuucucaguggucgaguaauaugggguuacaauuuuccuugacgucaccuaaguuucauuaccuuccuuuaagguuauaccccguccccuucccugcuuaaguuucgauuucccaauaacaaaauuuucuucccuuuuaugggcugacccccacucuacauuguguucgcuuauugugacuuucuagacgcaugaacuugcgguugguuacauucucaggcuggcugcucauacuuagauuuaucaugccuugaaaauggaccauuuaaaauguuuucuuacaugucaaugcauuuagccucaagaaacuuaaccaggugacagaggaugacugaauucucucaggacccuggugugcccuacaggagugagaccaagaucuagguaguucauaucuguuucugggggugaugucagggucuccaggcuccccuuagacugccgacuguugguuaggggagugauuagggugauggugagaagaaaacuucagaauaaccugcccaccagugagggcacugguuucuguacuuuucauguuauuacuuacuuaauccuaacaguaaacaagggaggcagguaguauuuuuguccacguuuuacagauggagaaauugaggcacagagagguuaagcaacuuauccaccaucacacagcuaaugguggacaccagacucuaagcccugcaaucuggcuccagggugugaguggggccaccacgcugugcucucaucucuugcucugcuuuucuaggcuguucuggcucauaaucuuuuuggucaucaucuuaaaaauacaaguauauuuagaggaaauuacauauaaucaucauguaaaagauuaauagguuaaaauguagguuuaaaaauuuaauucagaguagcuucauuauacuaaaauguuagccuccuggugucucuggaaaaugagaauaugauaaagaaauaacuacauuagguauugaggauuuauccuguuauguacaaaucucuuuuaagaaauuacuuaagcacuuuagagggaacucuuucuagaaugaaucacaaaacuuuucugaauucucagacuugacccugacucucucaggaaacuuugggcuuauugauuaguggaaagggaauuagauaacuuuggugacaaaguuaggcaggcgcugcaaaguggccgccaaggccuggguugaggcuggggccgaggccaggugcgggcaggccugucgggaagggcaccccucugauuugaguuagauauuccagcucugcaugguuugagucuguguucugaauagguaagauuuccagcaagccagauucuccauggaugagaugccacuuuauacuuuaguuagugaaggaaaugucaaaaguuguaauauuauuguaauguguuuuauuguuguacagguaucugcagguuuauaaaauaaacaucuucauuguaagcuaaucauuuggaggaaauguagagcacauagcaaaauuaaauccagguuuauuuaaaguaaaaugguaaaaaaaacuaaaucauaaagccacuuuaaaauaguacgaauuuuaaaaacuucgaaucaagucccuuucuuaguaugccacauggugagaaaccaaaaaagggcggagagaacccugacagauugaaucagauaaaauuuuaccuucugaaaaaguaaaauuuagaaaauucaaggccaugacaaacuagggaaaauauuuacaauauauaugcuauuuagaggauauugcuaagagcacauggacaccacaguaggaaaaaaaauugaugugaacaaccaauucucucucuuucucacacacaaacacauaaauaauaagcauuaaacauugcuaauccuaauaugugaaaaaauguaaauuuuuaaaguauucagaacacuuacacuuugauaaaaaaacaagcauggucauugauacucuguguuguugaaugggggauaggggcugcugaugacuuaaacuaauagccuuucugaaagccuguuuacagcaugaaucacaguuuuuaagaauguuauuuuuuugugguaggaacacugaacaugagaucuucccucugaacaaagugugaaaugcacaagaguguugucacucugagcacagccugugcagcggaucucuagagcuuauucauccugcaucaguggaacuuuguaccccuucaacagcaacucccauuucccucuuccccucaucgccuggcaaccaccuuuccacucuuugguucuaugauuugacuauauuagaagaaauccaccugguuuuccuucgcuuguguguauuauuugcccaugggccuuggcacugaggagacccacaugugaaugaaugaacaaaucaacaaacaagcgaacaaaugaauauguaaauggaugcaaggugcugaauccugcucauuuucuuauuauacagaccaaggcucuguggaugucugucuucuuuagcuaaacaagugagaccuuaaggagugucuucacuuccccuaagaauaacgugaaccuaauguauguguacagaugaaaggcauaaagggacauggaagauaaacacaccagcauuuaaucaccuuuuacuaaguuccuaugaagugccacucccagagugagguauagaaccaaggucgggagugggagcgugaggcugugucugguggugagaguucuuaucuguccucuuuaaguuagaacuucccucccccuuaaacacuucugaccucgaggaugauguacauaauuggcacaaugagauuaugagaccaaagaaaccaaaguggagcaaaugcuuccaaaaaugacccagaaauccgucacuguuucugcuauuggggaaaguuuccuuccuaccauaugccagacgggaggcauuuaaaaaucaguccugaccaagcaaaagaggugucuuagcucacacugcuauagaaaauauaaacuggauggguuaaacaaccauuauuucucacaguuuuggaggcuagaaaguccacgaucauggcgccagaagacucggugacugaugagugaucucuuccugguuuucugacaacucuuuuuuugcuguguccucauauggcagaaaaagagcuagagagcuuuuuguggucccuuguaagggcucuaaugccauucaugaaggcuucaccaacuuaccacuucccaaaggcuccaccuucuaauaucaccuuggagguuaggauuuccacaccugaauuuugggggaacacacacauucaguccauaacgagaaggcacuagauuuccugguugcgggaaggaaaagggcuagcugcaugcuuuggaaaucaggcaggacuagauauuaaguguuccucauagaauaugcuaaagauagacuuuuaaaguauuuucuaaagcaacacuuugaagcacaaacugguuucuaauaugcccaguaggugggugcuuuacuaggugagaaauccaugggcuuuagucacuaugguaucauaaaaauaaacauuuccauucaaaacugcagcaguuauuucuuccugaccuaucagccugaggcugggaaggcaagguaaggacagugguuaaagaggaugggcuuagagucaaaccaaagcuaaauccucacucugcucacuuauuacuuguaugaucuuggacaaguuaucuuucguaaucuucaguuucuuccuuuauaaaaauagauauaguaaaauuaccucccuuuggggggauuugagucauaugagauacaauuaacacccugaguaaauguuuaauaaauauuuauggcugacaauguuaauauuugcuugaagucucuaaauacaucuaccagaauccuuuuguuuaagcaccuuaaacuaacacaaacucccauuagaccuugucuuuauugaagggucucugacuuugccagacauuuuucaagcauguuaucuuaauuuaccaggaguagcaccaugacugggaaauacaugguauucaauaauuguuuguugaauagauguuauuaacuuugggagaagaacuuccagaggcaaagcuaggcaauuuuggcaaagccucaaggaguuuaaugcuucuccaaauuguguaacaaugagugagccagaaccaucuuucaacaggugaaauugcuuuuucaaguuggguaaacaauuugaaaaagagcugcugcugcguuuuuuuuuguuguuguuuuuuuuuuguuucuuauugaagacggagucuugcugugucacccaggcuggagugcaguggcaggaucucagcucacugcaaacucugcugcccggguucaagugauucuugugccucagccucuugaguagcugggacuacaggugugggccaccaugcccugauaauuuuuuuguauuuuuaguagagaugggguuucaccauguuggucaggcuggucucaaacuccugaccucaugugaucugccugccucagccucccaaagugcugggauuacuggcgugagccacugcacucagccaaaagagcugcuucuaugcccuccuuuucuaauuaauuaccuucagcuuaauguggacccuuaagagaauucuggaauaugucguuauuauuacagccaucagugagagcuuagagggcuucagcuaaccaauguggauucauagaacaaagcaaguccccaaguaggauacaaaugguaguuuuugguaguguuuccaaccugguagauugugugaaugcuauagaauuaucucuccuccauuagacuuugaacagcuugaggucaggaacguuuuacaucuuugaauccacuacaguuccuaucacagagaaaggacucagcagccccuugcuaguuaauugaaggaguaagugaaaucguggcauuuaacaaagucucucaauauuuuaaggagagaaugagaaauagagacuagaaaauaauacgugggcaaaccuauaacauuugaacaaucaccauuaguuaauagauugaugucaacucugaaggaagaagucuaguaacuaaagccaagguguuauggcuuucaguguuaucaacaaauaggguggaaauaauaggcaggauuaccacaguggaggugguggcaaggccaggcaucucaucucuuccuaagaacucuugaauacucagguauaaggucgagucagggcuucuaaaagacuagaacaccacaucacaccagccucuaggccuagaaaagucuuacaaguuagaacagugggcuaaagugauaaguagguauuaacagaaaaaauggaaagguuucauauccauuuauuugaaagaauucuggugauauuaucacaaaccgaaugugagcuaaccagaugacaaggacucuuuauuauuaauaauaauggugguuaaaaaauugugguuaaaaaaaccacauagcaugaaauguauaaucuuaaucauuuuuaagugucauguuuaauauaggcaccucuagaucacuagaacuuuuucauauugcauaacugaaauuuuauacccauugaaaaauaauucaucuuuucccccucccucaagcuccuggcaaccaccauucuacuuucuaaaguuugacuacuuuauauagcucauguaaauggaauuaugcgauuauuugucuuuuugugacuggcuuauuucacuuagcauaaccuuuucaaaguuucucuaaguuacagcaugugucagaauuuccuugauaauguuccacucuguguauagaccacauuuucuuuaugcauucauccaucaauagauauuuauguugcuuccaccucuugguuauugugaacugugcugcagugaacaagaacacaucucuuugaaauucuguuugcuguucuuuuggauguauauccagaagugggauugcuagauuaugugguaauucuauuuuuaauuuuuugagguacuuuauacuuauuccauaguacuuguaucauuccacauuccuacuaacaaugcauaagaauucuaauuucuccgcauccucaccaacacuuguuuucucucuuuuuuuuuuuuuuugauaguggccauccuaguggaagugaggugauaucuuauuguaauuuugauuugcauuucccagaugauuagugauguugagcaucuuuucauaugcuuuguggccauuuguauaucuuccuuggagaaacgucucuucaaauucuuugccucuuuguaaaucagauuguuugcuuauugucauuguugacuugaugcucuuuauauagucuauauauuaacccccuuucagacauaugguuuauagauauuuucucucauucuauagguucccucuucacucuguugauuguuuccuuuguugcacaauagcuuuuaaguaugauauacucacauuagucuauuuuugcuuuuguugucuguacuuuuggugccauaucuaagaaaccauugccaaauagaaugucauaaagauuucccucuauguuuucuucuaggaacuuuauaauuucaggucuuacauuuggauguuuaauccauuuuaauuuuuuuauaugguuaacgguaagggcccaauuucauucuuuuguauuugaauauuuugcauuuuccaaacaccauuuguugaagaaacuaucuuccacauuguguuaacaccuuuaucaaagaucauuagauuauauacaugaaaguuuauuuuugagcuccuuauucuguuucauugauuuacacauuguucucuaugucaguaccauacuguuuucauuauaguagcuuuguaauauguuuugaaaccagaaagugugaggcuuccagcuauguuuuauuguuuucuuccccucaagauugcuuugguuauuuggaguacuuugagauuccaucaugaccuuuaggauuuguuuuuccuauuucuccaaaaaaaaaaaagaaacugcuauugggauuuugguagugauugcuuugaauguauagauuguuuuggguagcauggacauuuuaacauuauuaauacuuucaugaaaauauuuauugugucuucucuaauuccagcaauguuuuguaguuuucagugugcaagucuuuuuuaucuccuugauuaagcuuauugcuuuuuuuuuuuuuuuuuuugagauggagucucgcucuguuguccaggcuggagugcaguggcgcaaucuuggcucacugcaaucuccgccugccggguucaugccauucuccugccucagccuccugaguagcugggacuacaggugcccgccaccaugcccggauaauuuuuuuguauuuuuaguagagacaggguuucacuguguuagccaggauggucucgaucugcugaccuugugauccacccgccucggccucccaaagugcugggauuacaggugugagccacugcacccagccugauuaagcuuauuucuaaguauuuuauuauuuuuaaugcaacugcaaauuaaauuauuuucuuaauuuccuuuuuagauuguuuauuguuaguguauaaaaacaaaacugauuuuuuggaauugauuuuguauccugcaacuuugcugaauguauguauuaguucuaacagcauuuuugucaaaucuuuaggauuuucuacauauaaaaucauguauaugcaaaaggaauaauuucacuucuuccguuuucaauuuagaugccuuauauuucuuuuucuugccuaauuguuauggcuaggacucccaacacuauuuucaauagaaaugggaagagaagguauucuuuccuucuuccucgucuuaaagagaaagcuuucaguuuuucacaauugaguaugaugucagcugugggauuuuuauguguggacuuuguuaaguuuagguaauuuccuuugauuccuaguuguugaguguuuuuuuaaaucauaaaaggguguugaguuuuguaugguuuuugucuuucacuguggcauauuacauugauugauguuuuuauauugaagcauucuuaccuuccaggaauaaaucccgugugauuguaguguauaauccuuuuauugugauguugaauucuguuugcuagugcuugguugagaauuuuuauaccaauguuucaucagggauacuggucuguaauuuucuuauacuaucuuugucuuauuuuuggugucaggguccugcuggcaucauaaaaugagucuggaagucuuccuccucaucaauauuuggaaagauuuugaaaagaauuuguauuuguucuuuaaguauuugguagaauucuccauugaagccaucugguugugggcuuuucuuuguuggaagguuuuugguuacugauucgauuuccugacugcuuauagguuauguccagaauuuuuguuucuuuauaacucagucuuaguaggauauauguuuguagaaaucuauccauuucuucuagguuauccaauugguugguguguaauuauucacaauagccuccuaugaucuuuuuuguuuuuguagcaucacuuguaaugucucuuucuaauuuuuaaaauaugagucuucucucauuuuuuacuuacuguaacuaaggguagucaauuuuguugaucuuuuaaaaaaacugaaauucuguuaauauuuuaaccaaaguucuuuuuuccuuuuucuauuuucuauuucauuuauuucugccuuaaucuuucuauuaaauguugguuuaauuuguucuuucaguuuccugagguacaaagucauauugcugaugagcucuuucguuguuuuucauauggguguuuauuauuacaagcuuuccucuuagaauugcuuugccugaaucccaugaguuuuggcauauuaugguuuuauuuucauuugucucaauauauuuucugacuacccuugugauuucuucuuugaaccauugguuguucaagauuguauuauucaguuuccacauauuugugacuuuuucacuuuucguuuuacuauugauuucuagcuucauuccauuauuuauagucagaaaagauauuugauaugauuuucauauuuuuaaucuuguuaagacuucuuuuguggcuuuaaaugugaucuaucauagagaauguucuauauaacauagagacagagaaagagacagagauagguaucuguuagaucccauuggucuauauuguuguucaaguccucuauuacuuauggaucucucugguuaaucuauucauuauugaaaguggagcauugaaauauccuacuuuaauuguguuucugucuauuucuacuuucaauuaugucaauguuugcuuuauguauuugaauacacugcugguagaugcgcauguauuuauaguuuuuauaccuuccuagugaguagaucguuuaucauuauauaagguccuucuuuguuuuaugacaguuuuugacuugaagucuaucuuauuugauguaauuauggccauauucacucuuuuaguuacuauuugcauggaauaucuuuuucccuccuuuuacuuccagccuauuuauguccuuauauccagagugaaucuuuuguagacaguguauaguuggaucuuguuuuuuaauccauucagccaugaauggauuaaauauuuugauuauauauuuugauuggggaguuuaauccauuuacauuuaauuauuuacuaauagagaaggacuuguuacuauuuuguuaauugguuuccguauaucuuguaguuuuguugcucuuuuauucuguuggcacucuccuuuguauuuuguugacguuuguaguuacauaguaauaugguuuggcugugucccccacucaaaucucaucuucaguuuuagcucccauaguucucacgugucgugagagggacccaaugggaggucauugaaucauggugguggaucugucccuugcuguucucaugauagugaauaagucccaugagaucugaugguuuuauaaaggggaguuccccugcacaugcugucuuugccugccgccauguaagacaugauuuugcuccucauucaccuuccacugugauugugaggccuccccacccauguggaacuguaaguuaauuaaaccuccuuccuuuauaaauugcccauucuuugguaugccuuuauuaauuagcagcaugagaacagacuaauacacagacuuugauuccuuuucauuucuccugugcaucuuuuguagguauuuucuuugugcuuaccaugaggauuacauaaaaaucuuauaacaaucucuuuuaaauugauaacaauuuaacuucaguaacauacaaaagcuguuuuccuuugcauuucacccuauacacaucauauuuugaugucacaaaguacauauuuucauacuuuguauuuauucacaguuuuauacuuauauuuuuaugcuuuuauuuuuuaaauucucuaccagaauuaaaaauuauucacacacuauugugaacauauuauauuccaggauuauguauuugucuauauaguuacuccaucagagaguaacuuuauauauucauaugcuuucauguugcuaacuaguguccuuuccuuucaacuugacagacuuccuuuaccaauucuuguaaugcaggucuagagaugaucaacuucaucagcuuuuauuuaucuagcuaggucuuuauuucuccuuuauuuuaaaaauuuauuuacuuuuaauugauaaauaauaauuguuuauauuuaugggguacaaugugauuuuuaaucuauguaugcauugucaaaauauucaaucaagcuaauuaauguauauauauuaccucacuaacuuuuuuuuguggugagauuauuaaaauuauauucuuuaagcaauuaugggauauacaacacauuguuauuaacuauggucaccaugcagggcacugaaacuuauuccuccaguuuaacugaaacuuggcacccuuuaaccaaugucuccucuuuuccucucucuccucuacuccucagcuucugguugccaccuuucuauuauguuucuaugagaucaacuguuuuagauuccacauauaagugagaacauacaguauuugucucuuugugcugucuuauuuuacuuagcauaauguccuccaguuccacccaugaugucacaaaucacagaauuuucuucuuuuuaaaggcuguguauuguuacauauauauguaauauaaauauauguguuuuauauacauauauauauauguauauaaaaaacaauuuauccaaguaucuguugauugccacuuaggguaauucuauaucuugacuauacuuuuuuuuuuuuucuuuuggugucagggccuggugccaucgcccaggcuggaaugcagugauaucaucauggccuccugcagccuucaaucccugggcucaggcaauccuccugacucagccuccugaguagcugaaauuacaggcacaugccaccauaccuggcuaaacuuuaaaacauuuuuuguagugacagggucuugcaguguugcccaggcuggucucaaacuccuggcuucaagagaucucccugcucaaccucccaaagugcuaggauuacaggugugagccauugugcccugcuguggggauaguuggcucauacagcccugcuguggcauucauaauaauguugaaaugaacauagaagugcagaugucuuuugauguacuaauuucaauuuuuuuggauaguacucagaaguggggaugguuggaucccacgguaguucuauuuuuaguuuuuuggggaaccuucaacauauuuuccaaaauggcuguacuaauuuacauuuucaccaacaauacacaaggguucauucaucuuuuuuugucauagccauucuaacaagugugaggugauaccucacuguagauuuuacuuugcauuucucauaugguuagcgauauugaacauuuuuucauauguauguuggucauucguaucucucuuuuuuuugcaaaaugucuguucacauucuuugcccacuuuuuaauucaguuauuuaguuuuuugcuauugaguuucaguuucuuacauauuuugguuauuagccuuuuaucagcuauaugguuugcaaauauuuucuaacaaauccauggauugucucuucacucuguucauuguuuucuuugcugugcaggagcuauuuaguuuaaugcauuccuauuuaugaauuuuuguauguguuaauuuaaacaaggaggugaaagaucuguacacugaaaacuauauagcaugcugaaaaauuggaaagggcacacaaaaauggaaagauguuucauguucauggauuaaaauaauuaauauuguuaaaauguccguacuacccaaagugauccuacacauuuaaugcaauuuuuaucaaaauuccaaugucuuuuuucaaagaaauagaaaaaaacaauucuuaaauuacuguggaaccagaaaagaauccaaaucuugagcaaaaagaacaaagguggaggcaucacacucccugauuucgaaauguaaagcuauuguagucaauagcuuugacuacagcaugguacuggcuaaaaaacagacauaucaaccaauggaacaguacagaaagcccagaaauaaacccaaguguuuauggucaauugauuuuugacaaagguaucaagaacacacaauggggaaagaacagucucuucaguaaaugauguugguaaaguuugauauccacauauggaagaaugaaauuggggccuuauuucaggccauauacaaaaaucuacuuaaaaugguuuuuaaaaaguuaaauguaaggccugcaacuauaaagcuacuagaagaaaacauagagggaagcucuaugacauuggccucggcauugauuuauugaaugagucgacuucacuuuugaaauauaguuuugccagaugaagcaguaguccccacccuuuguggcaccagggaccaguuuuguggaagacaauuuuuccacggaccaguggggcagggaugguuucgggauaaaacuguuccaccucagaucaucagacauuagauucccauaaggagugcacaaucuagaucccaugcaugcacaguucacaauaggguuugcgcuccuaagagaaucuaacguggccacucaugugaugugaggcagagcucaggcaguaaugcuuguucacuuaccacucaccucuugcugugcagcuugguuccuaucaagccacgaauugguacuggucuguggcccaggguuugggaaccccugagauaaacuauucuugguuggaaguuuuuaaguauccuugauuggcagguggcguuuuuuuucuccguuuuuagcacuuugaauaugucauuccacccucuucuggcuugcaaaguuuuuacugagaaaccuacugauaauauuauaagacucccuugaaagugaugaaucaauuucucuugcuguuuucaaguuucuuucuuugucuuugacuauugauagcuugauuuuaaugaauugugguaugguccucuuuggguuuauucuaguuggaguccuuugagcuuuuaaaauuuuguaugucuauuuccuuccuccaauuuggagaauugucagacauuacuucuccagaucaacucucugccccuuucucucuucuccuucucugauccccauaaugcauauuuucauccccuuggcauugucccauaaaguccuuaaggcuguguucaauuuuugaauuuuuuuuuauuccuuuacucaauaauuucaacugaccugucuuuuaguucacugauuauuucuucuucuucuuaauacagccugcuguugaacuccuccagugaacuuuuuaguucgguuauuuuauuuuucagcuucagaacuucuguuuuuuauaguuucugucucuuuauugauaugauucuauucaugcauaguuuugcugauuuuguuuagcugucuuucugaguauucucuuguagugcacugaacuuuaauuuuuuugucuuuucuggccauagauuuccauuuauuguuauuucucucuagauguuuauuuuguuccuuuaauugggccauguuucccuguuucuucauguaccuuguuauuuuuuaauguaauuugugcauuugacaaaauagccaccucuuccagccuuuacggacuggcuucuuacaguguaauaacaugucagucagcucagcuagagauucuuggggccucucaacccuuuucuggauauccaucuucccugggcuuguugguguauuuuccaauuagaagguuugcugauuucuucuuuaugagcuuguaaucucgugcucucucuugcaucugucuaugguacugcagauuuucuggcacugcggccagcuucugagcucucuuauuuucuaaagccuucagucauccauaguauuucaguuuugucuguauuccuggucaacugagacagaaaucagucccugaacaagccuccccacaaauccagaacauugcauguacuuuuuacucauuuccucccgagggauaagcagugagcugggugcuuucucuugauugcacugagcugugcuggccuuugccuguggcacuggcagaucucugcuguugcaaccagccucugagcuccuuuuuucucaguagcucccaggcauucaaagugugccaguuucccaucagugcucccagucagucgagacauaaacuagucccucaggcagccccccugaaaagcuggaauguuagauguacauuccauucuucucuuuucuucccaagggaaaagccaugaauugggcuuuucuccugcagacacugagcgauacuggguuaggggaagggcugucacaguugaggugaaauggcuuuucuuacccauuucagcauggccauucuuggcauuaagcuugccuaugguccugugccuucuuaacugguuucuggaguucucauaaaagcuucuggauuacaaauugcuguuaaguugaugucuuuguggggaaacugaggugcggggcuuccuuuucugcuaucuagucaacaucacuucuucaugacaaggagucuuaaaauugagauagcaauuuuaggaucuugucucuucacugaauuuuauguguuguauaccugaggaguuuuaguaaauggauuuauugaaaacucgaaaaauaaagagagaaaaagaaaugugaggaaaagauaaaauuacagaguguuuuaagaaguuuaauuuguuauugccaaaaccaaauaauuuuaauauuuagcuaaaggcaauaggggcuaauuuaguuaauuauggcucaucaauucuguggaguacuaggcagccauuaaaaaauaguugaaauucugcuaagaggguugauuuuaaguguuuuuaccacaaaggaaaaaaaaaaagauaaaugguaaugaugugaacugauagauauguuaauuagcuugcuugugauuauuucacuauagauauguauaucagaucaucaguuguauaccauacacacacacaauguuuacuuguuuguuccucaguaaagcugaaaaauuacaggaaaauauauggcuaacaaaacaaaucuaugucucucccucugaaacuccacuaaaaaaaaguauuacuucacugugacaaagacgagagaagcaauggccacugaugacaguuuucaguagacacuuuggggacuacaguguuuuguuuuuuguuuuuuuuuaagacggagucuugcccuguugcccaggcuggagugcacuggcaugaucucggcucacugcaaccuccaucucccagguucaaauuauccucccgccucagcuucccgaguagcugggcuuauaggugcccgccaccacgccuggcuaauuuuuauauauucaguagagacaagguuuugccauguugaccaggcuggucucaaaacuccucaccucaaguaauccacccgccucagccucccaaagugcugggauuacaggcaugagucacugugcccagccugcgguguauuuagauugugauaaauaccuaguaaagcagaagaagcugaaacuugacugcugggugaaagaggcccagcagaagacgccagauccuaggacacucaggaauuuggggcacauguuuguuugcacaugaccguggaacgagcugaugaugaaggaauggcugaaugccugcaugugaaacaguaagaucuccauaccccugccugcccaccacaaccagaugucugcacugccacccccugcaguggcagaacuaagaggcucugacuucaggacaucaggcacaaccaagucugcaccgacacagggauaagcgaaaacccacaugccacaggagagcuucaaggcccucucaccagaguacucgggaaggccuaguuucccucaggcaggagcugggcuuccccugugcagaagauggccgagcuagcagacaauccugcagguaugaauaucuggggaucucucagcuacugcauuucugcccagauccccacugggaaucccauuacugugugaacagacucuagacacagaaacauacauauuauaaacaaucagucaugaauuugaggaagacucaaaauaugauaagcagaggccaagacagagagcagaaaggaugcuggaggaaagugcgaugcauauggcugaagaaaauggaaauuaaaauguggucuugaaaaagauauaaagcauaaagcauagcuucugagaggaaagagaagcuaugguauccaggaaacaagaccaugaugcuauuuuuaaaauacauaacaagaaggggcucuuggaaauuaaaaacaaaaaacaaaaaaaaaacaguaacuaauuuaaaaauucaugagucuuacaauggagaaaauuuccaagagggggggaaaucagaaaaaauuuaggcaagaguacucaagaaaaaaauagacaauugaauuagaauccucaguguugaauuaauugaaaucccagagagaaagaaacagaggaaagaaaaaguugaaaagaauaacacuaaaaaauucugcagaauuaaggauauucagauugcaggggucagugaaugccccagacaaugaaugaaaagagccccacccagcacuugccaucaugaaacuucccagcaggaaggacucagaagccccugagccugcagaggaaaagcagauacuaugcagaagauugagccccacucuggauccgggugucucagcugaacaguuccaaacuaggagacaguggaguaauggcuuagcauuuugagggacaauucuuuucauccuagguuccuguaggcaucuauacugacuguccaguauaguagaauaaaaacauucuuacauuuugaaggucucaaaaaucuuccucauacgcaucuugugucagaaaguugcuggaaacugggaaccacuaagaugcagagaauuaaaaaaaaaaaaaaaaaaaaggcggggccgggcacaguggcucauaccuguaaucccagcaauucgggaggccgaggcgggugcaucacuggagcccaggaguucaagaccagucuggccaacauggcaaaaccccaucuccacugaaaauacaaaaauuagcccggcgugguggcagugccuguagucccagcuacucaggaggcugaggcaggagaaucacuggaacccgagaucgcgccacugcacuucagccugggcgacagagugagacucugucucaaaaaaaacaagcaacaacaacaaccaaaaaaaccccacacaaaacagguggaauauccauaaggaucagaacugaauagagggaaugggaauuuccaggaaaugcaauuaaagaaaaaagcuagaaaacaaaucaguuaucagguucagggaaaacaaaaagguaauuuagaaauuguaauuaugauauacauuauacaucucaggaggagaaaauuccugcugaagaaaacuuauauuuuucauaauuuugauaucuacuauaacuaaauauauauaacuaaauaguaaauauuaauuuaaaucuuuugcuauaauuuuuuggaaaauggagaggaaaaguaugagucugugcguguguguguguguguaugucucuguguguguguguguguguuuguguguaugugugugucuuaaagaaccaaauccucaucuucuggaguagaugccaauaccuaacauggaaaaaucaagaaacaguacaauaagcuucuuauuuagaaaaacggaauaaaugccaaaaaaaaaaugugaaaugcuuacugcuggagagggggugguggacaauaaauugcugguuuugacucaucuuuaugggguuauuuacuuucuguuauguccauguuuuauguaaaauauauuacagaauuuuagagguauaggaggugguuauaauauacuauaacagaaggaaagaaaaaaauauuuuuagaagaaaaaauagucuagaaaaacaugccaauuguuaguaguuugaguauuaauaaagugauuauguucuuccuuuuacauauauuuuuuaacuuuuuugcaauaaauguguacugcugauaaaaauuaaaaggagacuuuuuacacacacacacucucucucucucucucucccucucauugucucucucccccuuucucucucccauauacgugguacacauggugcaagcaugaguuaauaaaccagagagcaccaaggucagaguugaaguggcagaggcaggguguugcaggcaccauuccuaugaugagcccuuggaaggccaggaaguacuuggacuggagguacagacuuggcucugagcuacuagagagcaggacagcucuugucauaugauagucaccauguucauucuuuuuuuuuuuuuuuuuuuuuuuuuucugagacacagucuugcuacaucacccaggcuggagugcaguggcgugaucucggcucacugcaaccuccaccuccuggguucaagcgauucuccugccucagccuccugaguagcugagacuacaaguguccaccaccaugccuggcccauucuuugcacauacucugcacugcucuauacacaauguucuuuaaucaaugaauuuuaaucaaugagagugaacgaauaaaaacuuucgcccuaaugaggaggagaggagaguaggauuauguaguccuucagaaacaaagaaauggaaucagugaauucaauuuuacagacaaaacagauuucacauucagcaauuagaccugcccaguauucaugagcugccuuuagaagcugugugucuuucacuguugaaagcugugagcaggagcuggauuucugcugugguugggggcuaaugucccauacaccgaucuaauaacccauauacuaagaaacuucauugcgauucuggaucaagauguguccaccuguggaccauuagauagucuuggcugcagcugcucuggaacgugaacaugcagucagggaaacaaaccuaagucagagcagggugaggucugagcugcccccaucagcucuuccucugugugaucacaauucacggcagcccauccuguuccagaaggaauuguucuccuuacauuuaaugaaggacuaugggucucauucucuugugugacagggaaguuuaccaacucuccagacuugccuggagucccuagaaaauaugagcucccugcucauaggggucuuuggggugucuaugagcaacacugugccaccuccaggccacuccuuggacauccgcuggucucucgccucauggccuccccugccugugugggaggaccuggaaagggaacuggccaucuaacaacccuccuggagcaccaccuuccggugcaggucccugccccagcacaaucacccuaauacugccuucuuuguacuucauagguacaaaguacuuugauuguacuuuccuucuuuguacuucauagguaucucuugggucacagauugauuuacagaagaagaagcggcgagcgccagcucccccuccaccacagccaccaccaccgaguccccugauccccaaccgcacugaggauaaggaggagaacaggaagagcacgaugggugagugaggcucggccugccgucugcaugcggggaugcuugcucuguccuggaaugucagcucugaugugaacuccugcaguggccucauccauaaugacauuaacccaaaaaauauuaaugcuaaagaaagaagggcuggaaagaaauaauugcaaguucacuucauaucuuacuagcaguauuuggugggcauuaugugagcauuuaggaggcgggggacgguggaaggggagaaacggcugcaggagccgggagagggugaaaauggaaagccugugagugugagugugcgacgugugucucugauggcaaaaggagaaguuccuagggugacaucguggaaacugcuuugaaggacauuuggcauuucaaagagaucuuaggccacaggugauguauagacaaguugacaucagcucaguaauuuuuggaccauccuguuugaaauugaucuccacuuauauuaccugguacacauuuagcaaagacccugauuuucuuugagggaaagagagcccagaggaaagaagauggaauuauacuaucugugagcagaaagagaccuauuagaucaucauagcccaccccucgugcuacaggcgagguggagagaagcugaaugauggcgcuguccagguccaggggagucaaggguucauuuucuuuuuaaaucauucagcauuuguuauuucacuuauguuggaacagaaauggcucuuccauggagugguuggaaaauggcagccuaggagucacaccuuccugagcugagagccccaagaauggcgugugucagugcucacgacgaagccaccagcacucacaggccacucaccaugcccuuuaacccacccaggcagccccgcguuuugccuuugcccuaaggucugcagcugcaggagggaaaguccuucugagauaaguggcugccuuggcaguuucuggaccuuuagugagagcuccguggcaguuugucagcgucuuuccccuuagucaguuccucgcuuuuaauguguuagcauuucagccugggagucaguuaccuuaagaagcaauaaccuguauuccaugucagcucauccucuuucccaaaggacugaaagaaaacauuaucaguggaucauuaaaauaaaccugguuuucuccuguuucgugaagagccccccauucucccuuccaagcucucuccccauuuuucauaaauggacaaaagccccugguuuaaauuuuaaguggcauccacuguaaauggcuguaugugguuggaucgugccaaucccuaggccagucacuucaacccagggcaggacccccugauuccgcccuggaggccugaguccuugugucccaugugcuugggacaacauccccacccucucuacaacucaggacauucuucaaaacaaacuuggagaacuauuauucuaaacaaccaaagggguugaaaaguauaaauggacucaggagauaagcuaaaugaaugcuuaaucuagccagaauaggucaguggcucuagaaaagcaacaagaguaggcuaaaaacagaucugugaaccugaaaaagacuaacauuaauaaaaggaguuccuuuaaacuugacaaagcucugucgaggguguugaagaauaguuuucaagcccagcauuuauguaguugugucuguuaaaaagaaauugcaaccaggcacaucuuuccaaacugcuccaaugauagaacacuacguauguaaaauguuaaagugugagugugguuggaugugguuggugccagaugagaauggauuaggugcuggauaugacuggaucugguguuagguguggcuggaucugguguugaguguggcuggaucuggugcccagugagguuggauuuggugccuagugagugacggcuugguuuaaccugcugaaguaacucccuguugauuccauauaggugguggacggcaggugccacaaaagccucccagaggcacugcucgggguccaccccaguuagugcuucccccacccccgcccuacccuccucccgacacagacgugguggagccucucagcuuucccggggaaggcgcugguuccgaggccucagacccgauacccaaacguauguuccucuugcuucauuccgacuguguuaacuguucaucucucugagcacugcgaugucagggcuggguuuccagauuuuccauucuugucuuuggaugugugugccuuuccuucucagcucuuguuucccaaugcugaaugcagugugucugauuucacagagaacacacucuggagaauuuaaccagguaaucaugccuaucuguggucagacuucagcuaaacacacaccuugugguuguagagaugucagcuaggagccaguguucucauauuagaaugaaccucagagugucuguagagagagacagcuguccggcacagccgucgugugaucuggauggugggcuaacucaggcaggcugugggcacaccuguagagaucgcacucaagagcugggaggacguccuucguaaguuagcuguggaacucugucgccagcggccaagcaugagcacugcuucucuauggaaaaggaaacugagguguacgagaaggggaagcagcucacuuugaguguacuaauaagccagaauugaaguccugcuuugcuucuguuuccuggcacacccuguuugagauggggcucucuuuguuuccugggguucuuuuggacuuuaguaaguagagauagcauucccaccuccggacaggcauaguuuuauacacuuacucucuacacuccauggcauuaugggcacgucgggccugcgcuuggaccgcuucaguaugucucagcugggcggcgacacuucugauaaagcaagugccauccugggcuguguacacggagcagcgcaauaucacugugcaugcggccaggagcccugcuggugcccacaugagugugcacagcccucuaguuaggaaguucauacuuuucugccacuggacugcuuuaucuuuuucugucuucuuuggaaguguugacuagcugccugccagcuucuggguaaagaagauaauuguuggauuacuuauugacuuucucuaggcaaaauaauccugauucauuuuaucuuucuucacaaguacuucuuuuccacccuuaaaauacauuugaucaucuugacauuagacaugcuuccgaaugcaaaugaauuuuuuagggcauucaaaaaggaaggguuaggcuuaucaaucagaaagacugcagccguggcguggauggcuccagagccauuucaucucugaagacaguggguuuuaagccccacacaccaaggccaugagagucggugcucucuccuguggccgcugugcucaccuacagaauuuccuuccugcaggaaaaagugagggaaagauagcuggaugaaagcuauaaagccaaguacagccuguuggcagucacagaacgggcccagcaccaguggcucuguggcagccugcacaggaugggagagcugggugcaaacuugcagacccucgcuuucuccugggcucccuguguguugggggcacucacuguucaggugcagcaucugcuggggcaacgggcagacaagaugugggagggguacuuaccaaggcagcaucaggcuuccuccugcaucucugcagagcaguggaaccuccccaccugcugcccuuagaccuuuggacaggucugagccggaaggagagcgaaguggcggagagaaaaccagacucaccuucgucuugccuuguggcuccauuuccuccuugugcccucuugccaacuccauaccaguucauucccccagguacaggcaccugggacuuccuuugcccucagcgucauaauucaccuucucccucucuuccccucucaugcccacagcaauggaguugggggaagaggagguugggauggggaggccccaggagguguuagauggagugcacugauuucaacuccaccuccccuucagaccaggcaagcgccuugcccuucuugggacucagagucuccccucccucuccugccccgcuccugccccgcgcuccuggcugccagcgcaccacauguucaagcaucucggagcuuuuauguugcuaauuagcagaaccagccugcccauuguuuauggcuuuacaaacuaggauuccccgccuaagcaggcagaaugcaacuugccuucaggacuuaaaaaaguuaaggaaaaugaaucuuuucauuuguuguaucguuuuucauaauguugaaaucugggugcuccuuccacccauccccagugaggcacaggcuguuggcgccugagugcugggugugaaugugcgucccuguggcccauguucaccccugggcuccugagcaaacuuccggcuauuuuuggcuguguggaagcucaguggagacauuuuaaugccagcuacaagcacuugccuaucuccucuugaguucaguuuuaaaacuauguuccucacauaacaaacgcuguguuuauaggggagcuuacccugaguacauaugaggcccagccgguccaccaggcaucucacagaagcucucucacugcuucguaggguaugcacagacaccauggggaaaccgaggcaggaggccuuaccaccauaagcgguacagagggguuucucuuuaugggaucucggacucucaaucuuugcuucauccaucacccugcacuucucuucugccacugcaggaacucccaggggacacuguggcuuucacauccauugugauugcuacagcagaugguauacuccacuuagguuguuaaaaaggagaaauacacuuuuuugaaaaccaguguccacuaaccuaaauaagauuaaaagauucaaaaagcuaauggauaauggauuugugcgcagauuuaagagggugaggagaagacauaaauaaguccuauacaacuucacccuuuauuuuaucucuucaacucugagccauucuguuccagccauuccccugucuccucccugaccucuguaaggucuugacccacucauaggccugauggcuuugcuggggucccaguaggccuacugccagccucccuuccacagccagccuccugccagccugccuggaacucagcccaagcacaaagcccucacuccaauuuugaugcugaaacuguuauuaguacuugauauuuggucaugaaaaccacauuuaccuggaacaaaggccaaauggagaaaacugugugcucagauguucagugccauguauauguggggcuucugaacucuuuugaacaaauacaugguuuguaucaagaguucagaagagguggagcaaccaccuuccccggguguauguggcucuaagaggccaccucucggcagccggcucugcagcucacccagcccaugugcagauugcucugagcugcgugccugcucaagccacagcugcacagggcaaguucucugugcacacccuguggccaccucaggugccugucucuggcaagccucucacucccuccagugggaauuccucccacugcccucuaggcauuuauccuuuacuguacucacuauaccauauuacacacaccuguuaugugccuccucuacuaguuuaagcuauuaauacuuggaggcuuaacuguuuuauucauauuuauauccguccuucagauaggugccugacacauagcauaaauuuaauaaagaaauauaccagaauuuaucucaccaugugaauuacaaguaucaaauuauaguggaaugugcuauucuauucagcuucauuaaacauguuuuccaggcuaaagagcaucuaguacccagcauuuuaggucugucuguaggacaucccucaagagucaacagugcaucaaagaccuguugcaguuauacuugagaaagaugugaaaaucuccguggauuucagcauccagccuuggcaccuucucgagugguuucuuggucuggccuugcugcuggaugccuucaguuguguguuggccucucugaaguggcucucagugauccccaccuccuguguucacccccuagccucuuguagccucuugccacgaaugcugacuguacuuagugacuccuaucuaaggaauagaauauggcaaagguagugggaugucacuucuuacauccaagauuaggguugaaaaggacuguggucuccaucuugggcacccucgcucacuugcucacucugaggaaagccagccaccacgcugugagcugcucuacggagacccacauggcaaggagcugagggagacuucagccaacugccagcgaggcgcugaggcccuuuguccacugaucaugagccuagaaaccugccaacagccacuugagugaaguugggggcagauccuuccccaguagagccuacagaugagaccauaguccugauccacaccugcacuguagccuggugagaggccaugagucagaggcacccagcaaagccaugcuuagauucuagacucacagaaacuauggaauagucaaugcuuacuguuuuaagccucuacauuuuaggauaauuuguucugcagcaauagauaacuaaaacaaguuucaaguaagugaaacccaucucaaaccuacuucaacaguuagggaaugucuuaucucauggaacaggaaucccagaguggaguagcauucaguauuaguugaaucugaagcccaaguugucaucaaggaucuuaguucuuccuaauucuucucuguaucaucuuuggggucagcuucccccuaaggcugggagcaaugggucuguggcuguuccauguaucauauccagacacuagaauuuucauaagaggaagagagacuaucucuuuuaauaguuuuguaggagaaaggaaaccuuucccagaaagcccccacuaaagaguuccucucauauuucauugacuacaauugaguaauacacugacccaauucuuuggcaagaauggaaugaccuuagaugagccaggcccaucuggcagacggggauggggucagcuuucucugagguacguggaagucacuggucaauacuggaguucuguuaacuuggaaguaugggcaacauaugcuaugugaacagccagcagugcgcacuacacauggguugcagccuucaguuugauuuuagucuggagcauguaggaugugugaugaguagguacagagaggauggugaaucacuguugaagagcaagugggugauuuggcucaaaaacaguaaggccaagcaucugaaagucaaaagucaccaaggaaccauccuccuugagggacgauuucagugcagaacuggccacuucaaaucuagccuccaccuacacuucucauuuucugcuuuucuggagcagaggaacuauuagaaaugcuccuagcaguagaauaugccuauucagcguucaggaacuaaagcaucugcuuucuugauagucuuuguaguaagagguguguucaucacaugaaucugaagaauacuggaucucacuuaaaauuacuuccugcuguagaaagcauaaucuugucucuuccagaguuaguuuacaguggacaaagugcagccuuuuuaaaggcaacauagggcaagugugaagguguguguggccaaagaacaaacucgugcucccugcugucaccuuguauagaacugagauuucuguugccugauccaggcuguccaugucuuccuggcugucauggucaggacaacuugcagagucugaguugauaaauaucacacauauaggagaagggcuacuaagcuauguaaccucucaaagcugcaugucacaaagggcaucacuaguaggguuuugguguguguuugauguuucccagcaugguuuuaagaacaauggaagacuggcucccaggucuguggucuuuaaucauguuuuuucuuauuaauaagauuuugcauuaaacuucagauaucuaaucauguacacagaugcuuuaugugcaugucuaaaccaauacaguugugugcauacggauuuuucaucauaacuuucgaaucagcuugcuuucugccgccauuugauuucaguugaaccuucauugugaaucaccauaauggagccuauucccuuagugcauugaauuguuuauuuacaagauuugcagugcugauuauaauuagguuauuaacaaguuaugaauuaucuauuuuaauuagcagaccuuggagauuuaaagaucaaugcauauggagcucaaauuacagauccucaauuuacuuuacauuuuuaaaaugaaaauauucagugacugucauuuucuuacacauuuuucuacaccaggcuuaagcaaauaaaucuuuccuugggcauacauuuacaggguaauugacaaaagaucaaaaggcauaaagggaagauaggucauugucuccuguucuaagcaaccccccccaacaagggauacuauuucuagcuaauugauuuuaaauuugugaccaaguauccaauucuaaagaacuuuaaggaaauucuaaaacaaggaaauaaaaugagaggaaugaacuaucuauuuugaauuagaagagaguaucuugaguuugaucaaugcagaaauaauaauaauaaugauuuacauuuuaagcaagugaucgagcagaggaacugcgaauugcgaaucuagaaauacuuguggcacagcuugaaauauuugguggcuacaauccuaucucuacacuuggggaccagaugcucacuaagggcugcuggcucggugaacagccaugugcugcuugagcagagggcguggaacuggagaagguaggacgggaauuuggcugauggcccuuagguugggaccaguccucauuagaguccccuaaugccuuauucucaaauuugagcccaaacuaaguacuuuuccuauuucaaaacgaagcaguuaguucuaaagcuugugacacaaacacaguucugugaguccuguuuguugugggaaacacccaugaaacacuacagguguggagcucagagcaagcccugggaagcauucuugcccuuggcugguguuuauuugccacuuuccuucccuggcaggagagccagccacacagcuguuccugcugccacggggcaggcauggcauccaggaaaacaggaagugggucgugagcaaaugggccuuuucauaaaauggaaggaaaucgucaacugugggagcagaaucugucccuacucaaaaguacauuagaaaaaaacggaacugaacuuuuaaccuguuacuauuguaccuugaaaaccauuaagucaacccaacauagacugaagauuggauguagcuuagaagugaaguagugagaaucaaaauagaucuauauauagcuuuucaaaaaaaccuuaugagccuauuucuuuuugcuaauuacuucuuagucuuuuauuuacaagguacaaugucccuaacuugagagaauuaaagaacuuagugacaacucaguggaacagaacagcacuuugccagcucauaaaagcagaucguuaaaauuucaggaauuuugcaaaccaauggcugaacagauccacuauuaaaaaguaaauuauauagacauacaauuaaauaaauaauauuaaaaacagagguaacaaauacuaaaaacucaucacuuccuaauuauuuuaguacauuucauuacuauuucaguguucuugagguuguuuacauguaucggaucuguaggauuuaaugcuuuagaauaguaaaaauauaucauagugugcuacuacacaucucuucacagcaccgcauucagugacugaugucaauagcaggaaaucaaccaucaagaaacuauuuauagcauaggaauuagcaaauguuacaaaucagauauugauuggucuuguuaauugucuagauauaagacagugauugggaaauguaauaauacagauuaaauagaaaaguaugucauaucuguagccaauacauugugaauagcagaaaaaauugaguuguacauccauuuuccaaaaaccaugaucaauucagccaagucauucaugggauugacaaaugaguaaaauuccaacauauaucuuucugguuuuauucucaucuuacugucugaugccaucauguugaaguuauacuucuuuguuaacgguaauaauugacuggcuacagguuaaagaaucugggaaaaauuaaugaaagcauucuaugagaaucaacugguaauacagaauuuacaaaaaauaguauuaugcauuuuauuauuacuuauaaauuuugugcuacuuauccuuuauauaaguaaaacugauuauaacuauuuauaccuuuuuccuccaaagagcugguuacuaaccauuuaccaaaauaccacugcaaaguaguaacaaauaugaauagaaauggugaaaagaaguaauauuauuuaguuaagaaaccugagaacagauuucuuugauuuucaugagugcucaagcccuaagcugaugcaaauaaucacaacuguauuuuguuuccuugagcuuuaacuaguagcauguacucagguuacguauaaaaaccauguugaagaacuucucuuuggguuuauauaaauuugaguccuucccagaaauaaggcauaaacaucuugauuuuucaacaaugguuugaaguuguuauuaaauaucauuaccuucacgccuguaaucccagcacuuugggaggcugaggcggguggaucacgaggucaggagaucgagaccauccuggccaauauagugaaaccccaucucuacuaaaaauacaaaaauuagccaggcauggcggugcaugccuauaaucccagcuacucuggaggcaaaggcaggagaaucccuugaaucagggaguuggagguugcagugagccgagaucgcgccacagcacucuagccuggcaacagagcgagacucugucucaaaaaaaaaaaaaaaaaaaaaaaucauuaccuuguuuuacuaguuaagaaguaaauagagauuaugaaucaggcauucucuuaugacaauagucuucuaaacuguuugucucaggagguuuugggugcugaugugcacucaggcauggcccuucuuuauuuuaaucccuuucccccaaggccuucagagauuuaaagcuacucucauguaauagcccuuugcaccacaggucagucucccacuagagaaaacagcagcacucaagaggaguuugcuccacagguacuuggaguugauauccaucuccaacucaguaaaucaaccaguauucucuaaguuuauauguggggccugcccagugucaccauuaucaagaugggauacacugaaauugagggcaucacaaagccauauggucuguuuuccucuggaguucuacaaguaacuuagacuguuuuucaagagguaagaaauaaaugacuugccuaccagcugcuucgugucucggcuuguaaggaccuuagguuucauaccaaauccaaauaauuuuauguggcaaccugaaagaccaaccaugagggaagugaugcuuaugauaugguucuuacaggaggcagaaucauaucuguuggaucaauaggcccuuuccacagcuggcauacaaaaagacuaaauggaaaggaagaaaacaauaacaauaugcuuuggcugauagaacgcuugcuaugcaguguuaaaucuccaggggcuggaaaaugaaugauaauggcagauauuuauuucaccgcaagugugcguucacauuuugccauuuauuuuccccccgcaguuuauugcugugcgucauucccuacucaggccaagcgcuucugauggacgggccucuuccugaccucggaccuuucccagugucucuucugcccuggcucugauuuuccuguuguucuuccuccuuucaggauaaaagggcucauuguauacccagaauuuacuuccuuugggguuuacauauaaaugcauuaauaacagagauuuguuugauugagguuuauauuuuuuugaaggagguaaauuauaugcaaauuuuagguugauaauauucaccugucugaaauucacugauacuuggaaauguuccugugaagaacucugcuuuauuuuaauucauuauuaauucauguuuuucuuauuggauauucaguuccagaauuuauugccaauuuuucuuaaaacuagauuguauccauaaauugaccaguauagucaauuuggauagaacugaaacuuucugucuaccugguaaaacuaagugccuaaaaacaugaacuauaaauguaguuacuaggaacucacaacuuauauauacuauccauucaaugauacauaggacccaaugucuuuguguuuuugagguuuuccuguuacuguguacuuugccauuuuacauaguucacuaaaaagaaagaagugggagaagaaggguguucuauucauuauucuauauuaugauucucuucauuauucuguucucuucauuauucuauucauuucuucacccauuuauucacuaaacagugacauaguacuuacuugaugcuagguauuacaccaguuuugugggcuauaagagugaauaacaagcacgugaccucuggccuuggauuuuacuaccuguggcuccccaggcacaugaaaagaaguaaagaugguuccauuugauaaguacuagucacaaggguuguacaugugauaaagaugccagagguugugaccaccaugucugugcagaggugcugcuggcuccucuuugagugugagaucccucugcagucacacaaccucacccaguuacgaagagcuagucaccucaacugcauugucccaagacaggcagaguagguaaaaauagucauauguuaaaauucaagguuuagauaaaaagacaacuaguucuugcuugcuuugauuaacuuuuauuaugcagaugcauuugaacuggagaagcuugucauguuucucucuaaaagauguuuuuaaauguuauugcucaaaauggaaaaaaaaaaaaagaaucaguaaguauuccugacauguaggauuguugccuggcugaucacaaugaaaauguuagcuaugacuaaugaaggaauuaucacaacuuacauugguauuaauaauaaacaaauauaagccaaagcuauauauaaccaauuuagugcuauguauuggugaaaaaaacagaaaguuacagaaauuacucacaaugaaacauagaacaaguuagaaagggccuuuuuuuuuuuugaaauaaaggacuuuugucugauaaguagcagucauuugaccucaaaucauuaaauggggaaagucuaaacaagaaaagguaauguuuaccugaauguuggggaaagcauuaggauuuauggcccagacuuaaagauuguagaagauuguauauaauuacagcaauaagcauuuguguaagaaguagcuauuaugcugaagaaagaugggcacacaaaaucucuaggcaaauccuuggaacaggggaaagugauacugcucauagaauuauugguucgagaggcagcaaauaugaugcaauaaguauaucaaacucaauuaaaaauagaggacagagguauguggugggggaaaacaaaugcaauagggcuaagucagcuuacagggggugaauauaauuugaacauggcacccccaauuuacuugaucauaaaguuagccaaagacaugaguggucgaucuuugacaauacucuagugaucuccaugagagauggccugauagauguuggauagaaugaagggccauuugaugaacaaguuuuguagauuuacaugugacuuggcacugugcugacauuagagccuucuaagaaucagauaaauuaauuaggugaaacauuuuuucccaaagcacuugcauuucagaaaguuucucauuucugacucagcuuagaacccaucccuuguuacaggucauuucuccuccuuauaagccaugucuguuucuuuuuuccaucaugucauacacccuauccacaaaagaugguagcucacguuuucuaacuagagacgugcaggcaaguugagagcaugaagaaucccuugggaauaccaauucuguagcaaaugcuaagguaaaagaaaaacuaugcauuauuuuucaacuauaguuggcuuaaauucuuaguuucacccuggagaccauguugccaguggacaauugagcaugcugugauuuauaaaaugcaagcuaguuuauaugauaauguuugccaucucacuuuaccaguacuguugaccuuuucauaugauucuaaaaucacuuacuuguaaauaaauacuccuaguucuguagaugaaacaauuuggaaaagucguuacuguuuacucacugacauuuuauuuuagcacccauuauaaucagucacacaucgcaucuguguuugugaugcuuaucaacuguuaauuuucacaguuuucaugcuaauuuggauccauaaaaugauacaguuuguucacaacuuccauagcucauguaauguaauucaaaacguuuccacgugcagacuaacauuucccauaacaaaacaaacuuuucuaccauagggauaagagugcaucuuccaaaaauuacaagagaaagugagggccuuucaaacaaguauucaagaugucuugagucaucauaaccaauuacagauuauccagacccagaaauuaauccacauacagagcacuugcuuccucuggcuucucggaauuuuguguguguguguguguguguguguguguguguuuuaacuguuucauccuucauacccaaggaauguggagcaggagaaaaacccaaaauagcuuuugcaccuuauuagucaccaugguaaaaugacaacaagcaaacuucaaacacuucagugaagacagagguucaaguauuaaauaaaaugaggcucaggaguuaucuguauauuuuugguuucuuugcuuuauuugucaccaauagcaacgcauaauugguaacccuuuugccgaauaacucccuuugcuggaaguuuugugauuuaaauuuacuguuacuucuguguugauuuuacccuuaaaggcuuuauguuauaacccuucuuuuuccuucuuauuaagaaaauaacaaacuuuuauuacgugaacgaagcugcauaaaauaaggcucugaguauauuuuucaguaaagggaaaaagaaacccccccaaaagagauuagaucuauugagauuauuuagacuggacacacuguuuccugguugauaaaucugcuacagggcuucagggcaggaagugaggagaaaaaauaaccaaaacauaaaacccaaacgcaaauggaauagucaguaucuaucauacuuucuucuuuggcccauaagggacaagauuuaaagaguggaugcauccuuuccuuguauguuuugugugaauaagaagugguagggaggaauauaaagacauccugaaucacacaaaucaucaaccacaggauggaaauggauggcagauugccaugucuagcccacacacacauccucucugccagguaaaguugccaauauuaaaagucagauuuggcuugaaauucugguucuuccuggaauguguaaagagccuucccaaagggcucacauccuucaaguaagccuugagcauagcuuggcagcaggugcucccugagcacaggccggcacuugccaugcacugcggagcccaccaaucccacagcuaacacccaggcuaagaauccaguauuuucaggcucauguuuuuccaaaaagaaauuuaaagggaaagugauuauguccuauagucaggagccugagaggaccagagaggcagaugcagcacaaacuuacagaguugcuguuccaacaagagaaguguaguuggugguggaaguaagcauauuuguaucucuggccuguuucugccucaucccugcgcccuucgcuuggcccuucucucucaaucauuucucucuccuaccuggucucucauaugggcaaaccccgaaucugcacccacagugguguauuggcagagcugugcagggaaugccccagaaggcaaauuaccuuucaugucugcuggcuccauucugccccuuuacauugucauugucauauuagugaggauugggugcgaucaggccgagggcaacguuuugaugagcuggaacugucacucacugcacaaguggccuacauuuggagucuucaggcuccauagcagaaaccuuagaugugaagagugaguuacuuaaguucaauaaauauaaaauaauaguaaaugguuauaaauugagacguuuagcuucuaguaggaaaacuacaagucuccauuuaauauugcaaagugaaguguaggaagaacauugauggggauuucuggguuuuaugcuauuuuuuauauuucacagcuuuauaggaguguaauugacacacaaaaaacugcauauguacaaagaaaguauauaauauaaucaguuucgacucuuguauacaccaugaaaccaucacucaccaucgaguaauaaacauccaucacccucaaguuuccuugcaucccuuagucaucauuuuuaaucugcguauguguauguauauguguauauguacauaagacaugcacacaacuauauauauuacuuuaugacaguacuguacaucgaaugggaaaguuagcaaaauauagguuuuaauaacaaauccuaaauuaauugagaaguaaaacuucauucuagcuaauugggaaauuguuuaaaaggagaacauuaaguguuaaaauugaugacccuaaugauaaagcgaguauuugaucugaggagaaagaaagcuggucgcagcauuuuaauagucaucugaaugcauccuuugugaagugaaaauguggggaugugagugcacauacaaccuuuggaacuauuucuccccuauccaaguuuucaagaggaaacaaagguaauuucuccacuuaauuuucuucugcuaaagaagcaugaguguguucuuuaaaccauguuuaccaaaaguagcugagaggaggucagcccaccgccucugccgcucaagccuggcuugagaaccgcugaccaggauugcuggcucuagucaggagcccagcugccaggcuggggcuaggcagcggcaggcaccagggcagcaucugucuugggcuccacugcaguggccagcugcccacugacccucacuccgucucugccagguuagcaagcagucgaaggggcugcuuauuuaagagacaagagauucuuggaugacuuuacccgcacauuucagccaccagggggaacccugauuaucccauugauagacagaguugaagagaauggaaagaaacauacaagaaguuaacauuggggcuuugcugcauuuaugccaauauuauguugcagcuagucacacaacaauuuagugacuguaauuauaggauugaguucucucauuuacaaagaggggaaagugagucaagaagagucuaguaacuugccuaagaucaugcagcuaagaagggucugugcucagauggcugacuccccauccucuguuacagugugacuagugguucuaaaaagggauguguguguauguguauacaugcacacauacaugugcauacaugcaugugcacccauggugcaugcauaucuagacucauguacaugugcauagauguauauacagugcauguaugcauacccacacaauacaugugcacauuguguaucuuaaacaucuaugcauacauacacaaguguguacaaaauauuuguguauauauacacaugcauacauauaugccuacacaugguguacauauucauguuuguauauauucaugcauacaugcacaucuauauacauuuguaacuugugugcaaauauacauaacacgugcgugcacucauacauccauguguauacacugugugugugugccugcacgugugugaagauaugaggccaaggacaguauguggcuauauuagcuuguugcugccaguaugcuuccccacccccacgccaccccacacacaauauaucucugagccuggugcuucggucacuggcaggcuuugcaaggauucugaacuuguccacuuuggccucccagaaguuauugucaggccucuuguuuggugccuaauuuaugacuuggaagagauuuaaagauuaaagagaauauggccaguuaguuguuuaaaugaauagucuuccauaguuagauagggcagaaauccaaaucaaccauguuaguaaacucaaaccucaucuuucgucucugcccuugcacuuaugucugccuccaucuggcuauuuauuagccaggaggcaccuugccaugaaggagguggccucugcuugagugcagacugcacagugggacuacaggaagguacagcccauggaggggugggggucuuagucuucauagauucgcugccagcggggucggggcaggaagugaugauggcuaaaguggcacccccuucccaugcacuuuuccuggaguaacccuuaaaucuauaccacagcccuaugaggucacugcuguuguuaucauccucauuuuacaaauaagaaaacagcacguagaugauaagaaacuugucugcaaccaaaagcaaguuaauauuuaagccaggacuugaaccuugccagucuggucccaagcaccugcuuaacuuccauaucccuccucccuacucuguguccuguuagucuguagggagggcuacaaggcucuaacccugcucauaucuccccaggaagccauucccuguguccacagaggaaggagaaaguggaggagguggugcgugcuguuugagcuuuaugggaggaucucucaugugcaagcccaccuaagcccacagccaacaacaaguauggggcugcacaaaaauaccaggaaggaggggcuugacuccagaggaaggaagaucagaggacaccacagagacugagacagucaccaugugugggccugucaagccacagacacugucguggacuucaauuacuuuaauauuuucaucacagugcgcagcaacacagugcacugauauguuagucugcuagggcugccaugauaucauaccacagaauggguggaaauuuauucucucacuguccuggaggcuggaaguccgagaucaaagugucggcaggguugguuucuccugaggccucuuuccuuggcuugcagauggcugccuuaucccugggucuucccuuguugugugucuguguccuaacauucucuuauaaggacaccaguccuguuggaugaggccuccacccgaauggcuucauuuuaacuuaaacaucguuuaaaagaccuuauccuaauaauguuacauucugaaguacuggagguuccgacuucaacauauaaauuuuuagggaacacaguucagcccauagcaccuggugugcauuagccugugugcugaugacgacagaggcuggagagcuucuguuguacccagguggaugcacaggggagacccggacucugacuccagggcuuggcccuguuggaggccugggcccugccaccuuucuggcaagcugugcugauuuugcccaaagcuggcuguagcccacccuagcccaacacuguaugugaaccaccauuccugcgugcauucggccucugcccugacuuugaauuuccuccuugccccuacaguuuauggagcagcugaagcugugauaagacuucugagcuugcuucugaauaccacagccccgggcacagcaaagccaagaacccuguggaugagugagggccgcaguucucuacacaauccugaaaucaaguguuccuguuucucuuccuccuccccauuuccccagucacugcucagccuucucuugggucuuucaagcauuugugaaugcaugugcacacuuagacacacacacgcacacacacacaacccaucuugugucuuaccuaccucugaaauauuggcauuugggagacaaucccuaaucagcuaacacuuguuuuuuucuauccucugugugcuuguuagaauacugugaagguguuuucuauggaccgacuucuaaauguuccuccugaaaucaguguuauucacacaguucuaauguaaugaauucugucugucugaaagcuugccauauugucccugguuucucccagcuaauagagaggaaaaugagccugaauaugaacccgucaccacagaccgcacugcauccuuuccaggcagcagggcccuggagacugugcucaggccuggcagccucuguguuucacuuaggcuuguuuugcucaacccaggcaagacuuuuaaaauuguuugaauaagcugcagcaucaguaugcuuuuuuaaauugugauuuaaaaaaaaauauaaaaugucccauuccuuccauuuucaaaugcauacuucaguagauuuaaguauauucacaaugcugugaaaccgaucuccaggaccucaucguccugcaaaucugauacucuacucacugaacagcaacuccccuuugccugcuugucuuuuugcgccuggcuuauuucacuuagcacaauuuccucgaaguuuauccauauuguagcauauaacagaauucccuucccuuuuaaagcuaaauaucuuucaaguauauguauagaccacauuuucuuuauccauccauugucaguggacauuuaaguuguucccgcuucaugguuauugugaaugaugcugcacagguaugcaaauaucugagacucugcuuucauuucuuggggauauauaccuagaagugggauugcuggugaauccagcauaucuuugccugaaaaaaaaaaaaaagccacucaagcugaguuaaugcacagggauauauaugggauccuauacugcaccuauagggguugugucagcucacuuaccccacaucagccacaugcgaguuccugaaccaaucacaguagccaagggagugccacacacccauuggcuuaggccagaaugcacugaucaauugucagggagaacaggauuacuguguuugauuggauaaucaggguucaucucccagacaaccagguugcuccacaaaggggauggggcagaaagggugcugagggucuugcacuguccagagaaguacauagcauggggcuagagccaggcugcauggacucaggguuugggucuguuacugggugauuucaggcaacuugcuuaacuucucugugccugaguuucuucauauugaaagaaaaagugcuuuugagaauuacacauacaaauacauguagaacauuuagaaauguuucgggggcugcuggguuggagucaacagauccuaauuauuaugaaaauagccauaauuuaaaaugcagaagaucgugcauuaaaaucuugauuucuucuuuuuaaaaaaaguuagagauaaggcaacaccaguuuuacugcaugaaaggaagugugggaugcauacuagcugcuucuugcaggcacauguaggcaccagguuuccucagggucuucguggggccacaccuggcccucagccugccuccuacugcugucugcagaccucuguagauggaucagugcagguucccugauucagucauacuggagaaaugaagucacucaaacccucauuuuuaaaaagucagaaauauaaagauuauguugucaaauacugcacaacccuuaaagaaaauguuaggccgggcacaguggcucacgccuguaaucccagcacuuugggaggccgaggcaggcggaucaccugaggucaggaguucgaagccagccuggccaauauggcaaaaccccaucucuacugaaaauacaaaaauuagccgggcgcgguggugggugccuguaaucccagcuacucaggaggcugaggcaggagaauugcuugaacccgggagguggagguugcagugcgccaagaucacgccauuguacuccagccuaggugacagagugagacuucaucuaaaaaaaaaaaaaaagagagagaaaauguuuaauuuucuacuucauacagucacacaagugauguagagcaauuucugucuuccuuuuucuuaggaaguuuaauaacugugcguauugccuuugacagagugcugaaggugugcccccuacagcuuauaaaaaugaagugccugcccugcagugcagagcgucucacuguuuugggggcugcuggguuggaguccugagcaaaugcaugucaaggacucaggacuucaccgugguugcuccugugugugccccagcgcucuccacgggugucucacagccucuuccaggacagcugagccgggaccagcagccuugcucaugccacccccugcagacgcagucccuggugcuggcaggcacgacuccugggauggcaggcugagagcuuccucagauggcacauugagccaugccccuggcugacaagggaaagaucauuuucuccuccagccccugcagaucagcaagcgcccacguuuccaugcaaugaugaaacacacaaguaaauaagccaugauguugucugggaaugcuucagccaguguggcuggucuuaaacuggucuaguuuaguugagacacuuggaguggccacuuguuggccacuucagagaaaccagcaguguuaauuggaagccucucuccaagucucagcaggccagccgagcgccgggacaccauggcucugacuuaagccuuugcccugaagucaugcugugacucaggggcugacccagagcuugggauuauggaggcuuuggagaagcagcugcaccuucaagcaaguuuccuuggauguaucuccugccaccucucacagacgcaaauuaaagagagagagagagagagagagagacaugaacuguuguuacugcagcaaacauccacacuguaucugcugucaggguugcauccugggaaagcuaauuuuguagacuuaaaguaaugaauaauuagaccauugcuaaauguauguuuuauuuucugaacaaauucaaagcauuagaaagauaaugaagauuuucuuaaaauuaggccuauuuuaacccucccuacuguuuagcccuaauggaauauuuauuccaaaaucucuauuagucaggcuucuccagagauacagaacaauaggauauauuuaugaguguguguguguguguguguguguguguguguaucuaugguggggagagauuuuuuuuuauagggauggccuuguguaauuauagaaaccaagaaguuugaccauuugccaucuguaagcuggagaccccggaaagcuggugaugagauucuauccaagucucaaggccccacaaccuggagcucugaugcucaagcacaggagaagaugggugucccagcucaaacacagagaacacauucacccuucccugccuuuuuguucuguucagacccucagcagauaggaugccugcccacagcgguaagggcacaucuuccuuacugucugucaauucagaugcugaucacucugguaaacagccucacagacacacccagaaauaacguuucaccacguacccgaacaccccuugcuuagccauugcaaauucaccccuugccaacucgcccccuauaugcaugucuuuuucuccagagaaagacaaaacaaggucacaauuccaacuggcaugacacugcuguccuguauacaaccgaaaaugcacucaucccuuccagaagagaagguaaaguccuugaguugauguuuacucucuccugauauccuguaacuuaaaauacuaugauguaaaauuaucaacaauuagacacugcuauggaagucgcguaugucccauguuaagggaauaaggggaaagaaaacaaagauauuuauauguauauauacauauauacacacacacacacacaaacauauucuuaacaaaaugagaaggaaauacucauugacaauuacuguuuucauuucuaaaacuagucacaucacagcugguauuuauaaugucuucuacccauucuguauuccccuugccuucagcaagcaccucagcugguugugguucuuuaccugguggugugaugcaaaccaucauuccugaagggucugggccauuagugguacuaccuggauugggucaggguaguuuucauugaccuucaucgcagggcuuacuaagggaaguccuaagggaucuccuacaucccauacuguuccuuaccuccauucuagagcaguagucuauuuuccccuggauagucugggucagucacccagccaacaccauaaaccccuucuucgccuguugacucaaaagccugaggagcccagacugaccauguggcaucuuaacuuccaguucgguggaaucauuguugugcccccugguggaauaauuuguuucucuggaccuaagacccaucggccaauagaacauaaaagucaugaggaaaacguuuugcuagugggucacuagggauaaugauggugccacucccuuuuuaaccucuugauuccuggacccuaugggagaaacagcaccauauauuggacaucauucagagcauacacagccuucuggagaacaucacccgagcccucuaagguacugcuaccucucugacccuguaacugaguuuucaaaaggccacucuacuguucuaucaaaccagcugcuucaagguaguggggaacuugguaagaccagugaguuccaugcacaggcucauugcugcacuccuuuggcugggaagcgaguuccuugaucagaagcaaugcucucuggaauaccaugacaauggauaaggccuacuguaagucaagcuacugauaguaguuuuggcagaacuuacauucuguaagcuacugauggagaagcaagugggaaacuuuucuucccaagaaguaguuuccugcagagauugcuuugauaacugugaagaaaaugcaaccuguuaagaccuuucauugugagaucugggcugguguucaugugcucagagaccuguggaguguuggaaaacaccuggaggaggcacugcugucagacagccagggugaagcgugugcacugaagacgagaucagaucgacucauggaggcauccggcagagcuuacggcaggacccaugaugaagggagggccuguggaggguuuauucaagacaaaucaggagcagaugucuccauuucaauccuacacaggcauggaggaccacaugcucccugugaggggugagaugaggauugaacaguuagcaaaaaacaggccacguuggguaaugcuaagaaguagaaaaacuucagaucccacugggacuagagaauagcacauagaaggcaaucaucuuggcuguauuucuggguggaguuagugcaaacagcaggaugagggaacaguggcgggguagcugggagacagugcccucaccaacuccucccugccuggcucggacucauuuaugcgaacagggccagcccucacccucccacccaccccuaccugaccaggcuuguuugaucuacaaacaaucccaaggcuuccugggacucccuccuagaaacccauguguuucaggcccccccuucucccuguucucucccauuccugggaaaguuccccaaagccuuaagauugcaguuucugcagcccccacauaaucacauuuguucuuuaauuuccagucuuucuaaagaucaugaccacuaaugaaugauuauacaguaaguccucacuuaccaucaucaauagguuagguuuuuggaaaccgcagcuuuaugcagaacaauagauaaugaaagcaguuuuaccauaggccaacugauaaaaaugaguuaaguuccuagcauauauuucuggucaccaaaacaucgaaauaaagaccaaaacacuucuaaauaaagaccaaacacuacuaauauuaaacauugaaauaaauacgagcuauacauacauuuaagaaagauuaauaaaagcaaguaaugugaugauuuacccaguuuuuccaguucagggucacagguggccgcagccuaccguggcagcacagggggcaagguagaagccagcccuggacuggcccccaucccauugcaggugcacuuauacucacccacauggggacaauucggacaccccagugacccuaacaugugcagucuggggacaugggaggacaugagcgcagccagagaaaacccaugcagaccugccgagaagguguaaucugcacagacaguagccccggccugggauaauaagaugacgcugaacgaaagucguuggaggaccugccauuaucagccuguaggcugaaaacagaugggaaucucagcaaucagacucgcucuaacagcccacgcucagaggcuccggcuguccaugcucugucaggcuuucccugccucaucacgccucuccaugaagcuccugagugaaugaauacuguuauucuuauccccguuuuacagaugagaagccauagccuguaagcacugauuugcuggaggccacaguugaauccgcacagugucauguaauuguuuugggggguuguguuguuguuguuguuguuguuguuguuguuguuuugagacauggucuugcucugucacccagguuggagugcauuagugcaaucauaguucacugcagccucgauuucccaggcucaagcaguccuccugccucagccucccaaguagcuaggacuacaagaacgcucuaccaugccuggauaauuuuuaaaacuuuuuguagagacagacagggucucgcuuuguugcugaggcuggucucacauuccugggcucaagugauccucccaccucggccucccaaagugcugggauuacagaugcgagucacgguacccauaauuguuuaaauugacacaaaagauggagaaaaaugugucuuuaaucuguugaguacaaagugcauacauaaacauagaagggcaauguaucugauuuucuucaaacauuuaagaaauuuuguuacguuuauccaaaaagcuucuaaaaaaaaaagauuaccaaaaaaagcaaccuaauguaaaccaugguuaucuuggggauaagugauuauuuucuuuccaaauguuuguguuuuccuuacuuucuauaugaaagaaaaagaaaacaaacuucauuuuaaaaacuaaaauaauccuaauuuaaaaacucugguagaauguggucauaggaggguauccguaauaagaggaauggaagaggugagguguggccaucuauccuuucagggcauggaggggaaaauggggucccugccucgcaaggggacagcauccaacuuccagucccugggacagacccugaaacccuaaggcuggagccccagcaucucauguagguuauuuugaguguugguggguuuugcugaggugaguguuuucuggccaauaaagccaaguuauuuugggccaccauaauugugaguuagacaggugguuugugugugaaacauuuaauuugcuggcuguguagucuguugacuuuggauaaggcuagaaacaauucuauacuaguuucccaaaaugaugggcccugaugcugaucuuaucacuguuacaagcagacgcacagugccaaggcaggcuggacuacgggaggggagcucuagagaaaaaucuuguuacuauucauugcuuuuaugcugacuacucuacuguauuugaguaccuuuuaaguauaguaguccccugcuuauucacagggggauauguuucaggaccuuccauggaugccugaaaccucagcacugaauauauguguguguguguguguguaugugugugcgugcacgcauauauauauacuguuuuuuuccuaugcauacauaccugugauaaaguuuaauuucugcauuaggcacagugagcaacaaugacuagcaaugaaauaggacaauuauaacaauaugccaacaucaguacucuugugcuuugggccauuauuaaguacaguaagggccccugaacacaaucucugcaaccuugagacaguccgucugagaaccaagaccacugcuaagugacucacaggcaggggaggagacaguguggauccacuggaaaaagggaagauucccauucauggugggacaggacaggauggcagauuucaccaggcuacucagaaggacacgugauucaaaacugaccaaguguuuauuucugcaauuguucauuuaauaucuugguugaucacaaguaacaaacugcagaaagcaaaaccuccaacaaggagggacuacuaugaugguuuuugccguguguguguguguguguguguguguguguguguguguugggagagcacuguauacaagcauaguuauuagucauuucgcuuuucuccacucacuuuuaaugguauguuagcauugugugauuucuaaaaauacucagaagagaacucaucuuggaacaagccccgauuagaguaucuuuucaauauuaaaagauauguuuuauuccuuaguccagaaccagguaacaguuuaaauuagucaucuucacagucuuugcuauuuaaucugacccaaacuucaggcaauugauacaaauaacuaauaaggcaaaaauaacccagcuggccaggaaacugaugcccugagguugcagauggaggcacugaugcagagacaccagacaggucauccuuggagacucagguuucaaugcugccauugaugagggcucauuucccccggugacgauacaggcaccucucacuagccuuuugacagccuuuugacaccugggauguagaggcucuuugcugccucuccucuguuuucuccagcaucucggggucccauuugcucacacucaggcugugccaccccuacccugcucagcucuccucccccugcucuuccucaugcccccacuucaucaugcacccccccauauuguuucuuugcucuuuguuuuugacguaguuuacaaacauuuggaauguguuuuauuuuuguaaguaauuuccucauucugucuuucugaaacuauucuauuauaguuuccgcaaguaauuauuucagcucuacuucugucugaagaaaaaugacauuuguaacuuuguugagggcauuuugggacaaguucccaugaaacaggagacaugugaagagcacugagaugggaaauggaaucugcuaauuuuagaaaaaggcaaauacuccugccuuuugagagcagggacugaaugugacuuuuuaaaacuggucguccguuaacuccagcgccuguuguuggagacagcugucuuugaacuauugcagggaauagguuucaguaagaugacaacagaaagcuacauggggauacaaagcuuaaauguaggugguucucaccugcagcccagugaggggagaaagccggcuggccaggaacucugggggagguacgaaggaagcccucccaugugucgcccaggccggccggccggcagcagcaacaccugggaacaugcaccccugggcccaccccagccccacugaaucagaaacucauggggguauggggucuggacaaucucuauuuuaacaagcccuccagggcguucugacacgggccaagugcaagaccaucaucuucucagagaacuuaggauguuuauggacagccaggcagcuaggcccagcgccugugauaauuuuagcuaccauuacugagcauugacccugugcccugcuagcuccuucauaagugcugucucguuuaaucuucacuaaguccuuagagagaggaauucggccuuguggaugaggacguuaagagaugaguuugaguuucccgcagcccuugaggggcugagcgccaagcuggaaggacaugcuauuagugcaacaggaaagaguggcaguagcgugggcuuugcgaguccaggaaggaugcgcgcuggggccccuggagacaccaaccucauggaggagggagggccugagccgcccuugcgggaagauaaggacuuucaagaggaaagagaaggacuuguucugagaacuccggcuggggaugcgugcaguagccaacccuggggucauaucugcaaguccucuucucucugaaccugcucccuuggcuccuaaaaggcacccccugucuccuggcuccccaucuguccccucaacucuccaggcugcuccagggaagaaagguuuggauccuggauagcggaccaccuucucugcugaaacgaggaaggcuguggaaaggaaacgauguuuuacauugaaagcaaguuccguuuucuuauauuuccagccauaucaugggugaugugccccgaaaaccccuccugcuaccaagcaucuugaaaggcuggguuuucugucguggacaucauuguaaaugcguagccaagcuuuguguugcacagaaaaugagaaggaaaucauaaaacagaagcgugagggagagcugagaugcugggggcuucugaggaggcuggggcuggucuuagucaucuggggccucccuuagggguuccgagggccccuggccaagcggcagagaggaacggggcccacagcaguccccagugcagggagaugccauggagaaaaaacaucagaaagucacuccucuccaggccaggcagucagaaaggaaaaaaaguuacaguagcuucaguucaccugaaacauggccaucucccaacaagcccagcacacauacgaggaaggcccaugaagaguccuucaccuucaaggagcgugaagaggccugcacagcaaaacgggaacuguggggccaacccaguggaaaucucacaaacucaguagauuuuauagauggcaaaauuuaaaaagccguccauaaggaaauaaaagaacuggccaagaaagaaguuuguaauuuaugugaaaagaaaaaaaaagcgaaaaguuuccuuuuuauguguucuuuguuuguuuguuuguuugauugauugagacagagucucacucuguccccuaggcuggagugcaguugcagcacgaucccagcucacugcaaccucugucuccuggguucaagcaauucuucugccucagccucccgaguagcugggauuacaggcacacaccaccacuuccagcuaauuuuuauauuuuuuguaaagacaggguuucaccauguuggccaggcuggucucgaaauccugaccucaagucauccacccaccucggccucccaaagugcugggauuacaggcguaagccacugcgcccagcccuuuuuauguuguaauuuuucuuuaaaacagcuaauaaaauguugcauugcagaggaacagugacaauuuugucuguuaccaccaaccuccacuuuuagguacaagggaaggaggagcagagacacaaagacgagaagcuaagauuggccgggcccggccgaggggcccugugccagguggggaggcaccucucaggggcaggcgaggcacagggacgggcgcuugggaugacugacauuacaggguggcauuacagcacacccggacaucuucucugaguuauagaaagugaccuguaauauugucuguucuucagcaugcaagagacgaggcucagauaucuggauucuuagcuuuugucaaagaaugcucuuuucuguuauugcacacuaaacguugauuauauuauugagaauuuacauugcacagugugccagcuugaggaggccuuccugacugggugagaugcccugaacuccaagugcccauuugaacggggucagccugggucccugagggcagcacagggcagggcacacagcuugcccagaagaugccaucugccugucaggcaagaggauggucugacuccuuuccucucuuaucauccguagagaucuauuuuauuucuuauuuaaaucacagugaauuucaaaggggauuguaggcagcuuuuugugucaguauuauucaaauuagaaaagucuagaaaaaggaauaauuuuuauuuuaaaugauuggaaauaaaaauauguuaauuaaugcuauuuuugaaaucuacauuuuccuuaagugguuagaaguaaacacuaggagagcucagaaauauaugugcugggaagggagagggagaaggaaaugcaguuaaaggcagccacaaaggcacagcucgguccugccuucuugggaaacaaggccaaagggaucagagaggaugcugugucaaacagcacucauuuauuuaauaauuuggucauuuuuauaucaaauuuacauccagagugauagaugaacaguguguuauggaaagcuaaguaaaaguaggccacauacuuuauucucuagaguucugaugauaaaaggauagaaguuggaagaaagcagcagaaggagggauggcauuuuucuuagguugcccaucucagaugguggcugccucaccuuugcuucauaauagacccaaagcauagucaauuugagauugagucccuuggcaccuuggcaggucccugaaccucucuuucugaggcauugauuaaauaaaauuuauguguuuuaauagauagacaaccuggagacagaguuucuauuuugacaaugaaaacuaagacaccagcuuuguucuugccagcagggauggccauccacugccccacacuucccucaaaggugaggccccagaaauguguaaaaaaggacugaagguuuuugccucaagaaaugguuucaaauauguugagauucccagauaaauggauccaagauuuguuccauagaacauggaagaaaaucuuuuggcuuagaaaagucuaaaugcagauauacucaguaggauucauguaacacguugguuaaagaaccuuaauuugacuccugcccaccauguggguuuuuuaugagguuugaaugaacuugcccuuuuuauaagcugagcagaguguuucugcaacacacacccucagggauaggugacauaauuuguugguuggggcuucuuguauaauuugcaaaauaggaauaauaauaauauccacacuacagggggcauguggacuaaauaaggagguagguaaauauuauccauuugaacacugcagaaugucaaaacccaauuaccguuaugugguuugcaaauaucaguguugagcuguacugucugauaguaaauuagccaauaguguaauacuuuagacuacucuuaaagcccaugacaguggcauagagaaggaauccuguuuaacuauuggcuuaaaaacaacaacaacaaaaagcacauuacaauaaaaugaaacuucaguuucaggguagcugaacugauucuaagcaucaucagccaaagccagcauuguggcuacagagaaaaacuggccacccuauccagauggaauccuugccccggaaugcaagcguccgucucugucccuguggaacuucacuuaguccaguccugguucaugcaccgcacccaugacuguuguugauaggcuuucugauccauaguaaggaaacaggaauauucacgugcggcaaagaaauucacuccguaccaucgcugauacccccauuuaaacacaggaaagacagccaagaguugguagacaauuuuguuuuuaaugcaugaaagaaggacaacaaaguggucagagaaauuuacuccaaaggaaguagaguuaaguuaggaaauagaacagaacuuuaaaauaaauacuuuuagucauugccucagaaaauuucaguagaucaucacauaaaacaagagcaggcuauuauugaaaaacaaauaagcaucaaaacauucuuggaaauuaaauacacaucuuuagaaaugugcacauuuagacacauucagguaaaaauuuuaaaaauccacagauaaaauuuuacuagcuucuagagagggauuauauauagcuauaaacaaaucaugugaacauaugccuucucaucuaugacacaagaugcuagaaaacagagaagcggagaagacagucuuaaagaagaaggauuuucaucugaaucuuccuuugguuuagccauauacugguagucaaggauaacaaguaaauggagccagccuucagacgcaagagagcuucgagaguauacccuccuaaguuagauuauacucaaguguauaauccaaauaacggaaaauaaaucuaggaaagggaaagacauauauguagcuguccaauuuaauauguaauuuaauauaaaauaaugguuccuauaauagaaauaccauaauguuacauagauauaugugcaaaauaaaggaaauuuagacauuuauuagacaagacuccucaguucucagaaacagaaguaugucuugaccaguuaugcauaauuggguuuuguggcgauuuuuuagcucacauaacuggcacuuccaagagacuaaucuuuauuaugggcaugguuggggccaggagcugaaacauugucuuagaacuauguuccucugcaguccguggauaaguucuucccugugcugguuaaaauggcagccauuuauccaaaacuuguacccaauccauuuauuccagcccgauuggaccaucuuccugaacaccucugguggaaagguucugagaaggacuuugauugguccagcauggaacacauacucaucuuuggauauaacauuguccuagggaaauaguuaggggcagauagucucacccagauaugauaaauugguuaccugcaagaggacagaauucuuuuaacacaaacagagugagaguggugggcagagaaaaacagcagcuguuuauuauauguuuuuaaaagaacagcaguuggaacacagcucuguguuacaguggaauaacuuggaauuuucucugcccagggacucuaauaggcacguuaagauucuaggacuagaguuugguucagguagugaagaaauaggagcugacugauaccaagaauacaucacuugacucuuaagagaauccaggucuaauuuuagauccauaaauguuuuucaguccuucauuaucuugccuucuugaaaagauaaaaauguguguguguguauauaguagugcucuggagucaacugauuaccuucaucaugcagugucuuugaggagcccaggucuaugggauuuuugacaagagcauuaauauaaaacguuauuaaauagugcccaucaaacuaaagaggcugugauuuugacaaggaaugaacaggcaaacuucacuuggaggaaacugugccuaggaaaucaauuagagaaaaagaggggaacaaaguuugaggugccuacucagagcagaaucuauauaaugcugguggcagagggucucucaaaggcgaauccuaaacccagccucuccaaaccgugccuccugaacauuugcacacccgugugugcacacagacacuagggauuccaaccacucaacaguauuugauguuucucaugcagccuggcauuucucugcuuuuucccaucuuuugacccaacuguccucuaccugccaaaaucaugcuuguguucagacgcaguccaauggucacuuuccuguguccucuaauuagaaugagugaccccacuucuguauuccugugguauuguccaugaaucccaccuucgcaacucuuaaauugacugaaauguauuguguacauugguggguuuaaacuggguacacguucuucugggagaaucaggacuuuccaagggaauccacuuccaaauguuauaccuccacauguauucuuuccuggaauucaugugccugagaacucaccugugaccagcaucauuccaagucuuuuuccccaaugccaguuuuacagaugcccuccuucuccuucauaaaagacagacauaccccucacccaucaggaaacucacuggggugcacuuuccugagaugggcaaaccuuauuccugaucucaaacaaaagaacaaauggaaauauugguauaagaucaagcagauaaauuaaugaguugguggcgaaucuuuuugaacaucaggugguuucccaauuuuucuuuccaaccaaauugacaaaggaucuaacugaguugucagauuauagaucauuaagcauaauuuuugugacagauuaaugaagugauuuuugacauauauuagaggaaaaguuuuagaaaccuaauggaaugauguaaccauaacaaaagucccuuaauuuaccuucguaugugacaagcuuugccuagugcuuauaucuauaagaggaaaaguagaccugaauuuaugccaaacccugccucaugcuagcaauaaguaauccagucauuuuuaaggaauuaauugaaaaagccucacucacuuaugaaaugcaguuccaaaugauauuuuaccauuuugcuuaagaaaugucaaaguuucuaagaacauuuauguaauuuugguuggcuguuuucuauuagcacaaggauaaacaauauaaaaaggaauuuaauacaacuugcuuauggugagggaaaaugaaaauuacauuuuaacuuagauacauauucuauacaaagaggcuugaugaauaaaaaaaaaaacucaagcauaaaguacauucaguuaggauaagauucuguuagguagugaaauggaaauaaguucaaggaagaagagacaugcucuaaaauucugccuguuaaaggaagaacucauuuacuaauuuuuacguggaggggccugggcaugaaaauacuaugauauccagauuccuuuguuuauauuuuuaaauggcaaaauauuuuugccauuguaaauggcaauuuacaauuaauuuaguuguaaauggcauauuaaacaguaauacaauuuaaaaaauuacaauauuuuuaaauuguaaaauauuaguauuuauaacacaauuaaaauguacaucuguugcaaccaacugaacucaugauggaaauuuucagacgucaaugaaaaauggaaggagaugcaugauuguucaaaauuauuuggagggauaugccaaaaaauuauuucuauuuauuuauuuauuuauuuuugagauggagucuugcucugucgcccaggcuggagugcaguggugugaucucggcucacugcagccuccgccucucagguucaagcaauucucugccucaacuucccgaguagcugggauuacaggugugcaccaccacaccucgcuauuuuuuguauuuuuaguagagacaagguuuugccauguuggccacgcuggucucgaacuccuggccucaagugauccgcccacgucagccucccaacgugcugggauuacaggugugagccacugcaccuggcccccacaaaauuauugaaaugcuuuaugucaguuuguaucacuaguucagaagcacuuuaccuuguaauuuuucccuuucuuccaagugccuagaacauagagaacaaagucaacacagguuaagaugaagugcagcuuugcuuguugguugugaguggccgugggacccacaggcagcagugugagguggcgagguagcuuuucuuucauugaaacauuuucucugggccauauaaauuugguggaacuggcuuuugagaaauccucuuucuuaaugaaccacaaaaaaagcaauaucauaggacacaagaucuuuaauuugcguuuaauaaaacaauaaaaugaauccauuccaaaauuacuuggaagauacuuacauuuagugauggaauuaucuuugcugacucuguaaaagaaaaacuaguaccgaacugagaauaauuguguucaacuugaggaacuaguagcccuaaguuagcauuuucuucuuuauacuugagcugaagaauuuaccaaagcucauucagagauauguaauggccucugaaccaugggauuauauaauuuagguggaggacaauagaaggguuaauauuccuuacucaggcucuguggcuauucauuuagaagagaauuaaaucaugaauuuauauuaggcuucugcgaaagacaaaguaagugugcuuuuucacauuugcaaaaauccugcaguaauaacuuuuuaguucaaagagauuguucaugccuuaagagaauagcaaaguugccagugcauuaauuaacucaaaaauaaugacuuacccucucagggaagacagaauauagcagaaaggacaaagccaauguuguauuccuuuuaaagauuccuaauuagucacuggucaguuguaaaaaugaguguuuacauccuauauuuugauuuggcauuucaaagacuguuaacaguuccacucuagaagggauuuuagagcccgucagagccaacugcuuauuuuacagaaaggggaaaggggauuguucagagugcaauuugggcuuucaauucagcccuccuccugcugccccuggguuucaggcuggggucccuggaucgcuggcucuagggaagccccucagaggcuggacagagggugggaaaugggacacacacaggaucuggaggacaggaccugggcccccaaccucgaugcagcccaagcagcuccacguuuuccuuuuauguucugaguuuccguuuagcauugaugaagaaaaaaaaagucuccugcaccauuaucucauucagaaauugucaaaacauguuacaguucaugggguuaaucaucggaaccagcugaaggaagaaaagagauguggggugggggcaggaugagugagaugggcaugucugauuccaaacaaaagaugcccaggacagagcagaccucggaaaggagggaucagaaauugccugaaaacucacaccaacacagguuggggcuucacaggaauaucugcccuucucuucagaucugugcucucucugacagcucaccaggaagcuucucuggaaaguuccccacucagccuccaucacccuccucaaagccuuugcaggugcucccccuuggccacacccugccccacccuauacuccgagcaggugccggcaucacuguggggaggucugccuggucuuuccuggacgggucccaccccuuuggcagaaggccuuucacccauguucccucuccucccagcauuuagacaguugucuuuucaauuccugugccacucuucucccuagacgcagauaaaccuccugagagcaggcccccccacccccaccugcuucugcaccaauggcaugaauggugucgcagggcuguggccaggccacacgggccaugggaagauuauccacauggagagcaggagggcuggccugggcaaaaggggagcucugguaauagcacucgcauuagucauuuuguaaaugguuuaacacgugugugcaccaaauaugugaccucucacuccauguugauuuaaggcuuugcagguggcuuaauuuagaccacaggcucucaacuuuuuuuuauugccucaaaacuucugaggaauauauauguaucacccgacaagcauuccugaucuuauaacuggcuagagaagggguggagguggguuagagucccucugcccugcgauguguucugugccuccagagggcauguaccaggugcucugagggccuccuccaaggggccuggcagcagacagcuaguggggacacauuuguuaaggucacuuugcgccucagcgauaaucccuggagagggaagaggguaagccaggcuaaaccagcauuuguguggccccuacugugugccaccaccucgcucaguccagccugccacacucugccuaugggagcacaccgagaguuggugugaccauacagcacugucauucuuugcguacgugucugucccuucagaagcugugagugccagagagcccacaugcuuggauuggaaauauguguccccaggcccugucacagggccguucacauucaggcacccacuuagcaacagggacccugugggcagcagcauuaccuuacuccaccagggugugaauccaggucucugugaccugagaguuuuacucuugucauacuuuuuauauacaacauagacagaaaaaacgugcugguuuuauuguucagugauggcagcaaaagggaaggcaagagaggagugaugggaaacagggagcuacagcgacguuucuucucaauauuugucuugaacaagagucuagccccaaaagcuggggagagaacuagaagagcgaggucgcagcagaccagcaucacugcauucagcauaucuccucguacguuuacacugcucuaaacuauuccuuuuuuucguucuauucuuuaccuuggagcucuuuagugaaauguauauucuuuaaacuguuguucuuucauuuguuuuauuguuuggaaucucaaauauaccaucaccugaugggauuuucuuuugguuucguggugauaaguuguuagucuccuguccaguuaaaauguuggugauguugagugcaauugugaugucacuucacucucagugcaugauuuuguggagugagcacucccagaggagucuuaauucacuuugggcauccagugacuauuuaggggaagaaugacuuuaaaacaaaauacacugggacugcaacaaaacacagugcuuguuuucuggacuguuauaaauagugcuuagaucauauguccugaagugucuugaaguuuaaaaucuauuuuuauuaaaaaacaauaacaacucuaauauacaucugggcuagacuuguguguuuuuguccuucaaauuucaucucuuugcauagaggcuucugugauuuuagagaaucuagaagcucaguaagagaaaaauaaugaccucccauuacuuacacuuaauguauugcuaucuacaaauagcuagguaguugcgcagaauagccauagugcuacccaucauuaguauuaaggcuugacagaacuuggcuuggagagcaaguugccacucuaugcaucucaccaaacuccugcagcgaaucacauuuagugcauaggagccagguaaccucaaccacagaaacuggccucacauguaaaaauuaagggagagccaaaagcuggggaguagggccgugaaucuuccaggccagauuucaaauaugaaauacacgucagauguguccaaacugauacuuaugucugcuuauuuauauuuccaaaaacucuaauugucuuaauguuuuucuaaagaucucacauuaaacaaguuccauuaagccaaaggccagccuagaaacaauugcauucaacaugucauuaguuugaauuuuuaaaugugcuugcccauagccauagagaggagaccaauguaaaaggcuaauuaaucaaauacugauuuuugagggaaaauuuugcccucaaucuuacacaaaugacucccugugaguuaaaauguuucaggaguauucagcaguauuugaaugagguucuuccuuuacuuugagcacccugaaucccaaauuuuagagcggggccgacagacugaugucacacuuguuaggcaguauggacgccagagugguuugggcugaccuguccuugccgugucuuguccaguaagccugccccuggggucuggcagccacugcagcccggauggagccccgcaggugcugucagaggcggaggagaccgugucaguuggcagcuguuuugcgucggaggacacgaccgaggacucaggagugaugaguucccccucagacaucgucucucuggacucgcagcaggacagcaugaaauacaaagacaagugggccacagaccaggaagacugcagugaccaggaccucgcuggaaccccagaccuggguccccagaagagccccuugugggagaagaauggcucugagaacucacaucugaggugagucacgggaaggauggguggguacggaagucacagccacaucugugucucuaaagagggucuuuugucaugggauccaacacgugcuaucacaaccugcucugcaccaggggccccgacccugauucacagcagcugcucucaggcaugucucugugcugucuauacaucugcaguaacuuacaaagacuguguaagaguggcuuguuugcuuugguaccauacccuuaaguauauuuuucuacucaauaucauguuuguaagauuuauccaugaugauaucuguguuguucauucauuuauuuaccuguuuuccugauaaugaacacuuagauuguucuaguuuuucagggcuagaaacaaugagcaagaaacauaugucucuauuuacauguagagacuuuucuagaagaggaaagugacaggaaagagacucaucuucagcuuuaugggauaccugaaaugcuuaugcaguuggcgggccccccagugucugcaagguccccuuguugcacaccgaugccagugauuaaggucaguagacaucuugagcuuugccagcauguaggcgucagauggcaucucauguagcuuucauuuacauuucucugauuaggaaggaugagcaucuugucauauauucauuagcaauuugggccuuauauuggauuaauugccguuucauagccuuugcucuuuuaaaaaacaugccacguuuggccuggcaugguggcucaugcccguaaucccaacauuuugagaggcugaaacaggaggauugcuugagcccaggaguucaagaccagcauggucaauauagugagaccuuuucucuacaaaaaaaauuuaaaaauuagcugagugugguagcaugugccuguagucccagcuacucuggaggcugagaugggaggauugcuugagcccaggaggugaagguugcagugaguugagauuguaccacuauacuccauccugggcaauagaacaagacucagucucaaaaagaauugaauuaaauuaaacauuguuauguuuacuuuuuuugauuauuaaauucuccuuugucaguuauuuacacauggaacauuucuaagccuguggcuugaacuuaauuaauguuuucuuuucuuguacaaugauugucuuuacauucuaauauuauuuaauuuuuccuuuuucucucagauguauauaaucuuugccuauuuaagagauccuucccguacccuaaaagacuaaagauagucugaauuucuuguaaaacugcucucucacauuugggcccucuuguaccugggguuuauuuuugggugugauaugaagaaggaucuauuuuuucccacugauuccuguccccacuauggucagacaucaaguguccaugugcacguuguucuguuccagugcucuuuuuguagcacugguguauuuguccaucucuguaccaacaccacacugucaggauuccuuucuuuauuauauagaaaggcauauugauucucuucagcccgccaauguuuuucgucuuuuagauaaguguaagaacucaucaaauaaauauuauggaaauguuaacagaaauaagguaaaaugggcugggugcagcggcucaagccuauaaucccagcacuuugggaggcucaggugggcggaucaccugaggucaggaguucaagaccugccuggccaacauggugaaaccucaucucuacuaaaaauacaaaaauuggcugggugugguggcacuugccuguagucccagcugcuugggaggcugaggcaagagaaucgcuugaacacuggaggcagagguugcagugaaccgagaucgcgccauugcauuccugccugggugacagagugagacucugucucaaaaaaaaaaaaaaaaaaaaaaaggaaagaaauaagguaaacugauuuaaagaaauaguucauaagccagucaccaaaaugaaugaaugcuuuuauaauauauuuuucagguuuuguuccaacccuauucauaugaacucacaaaucuguaucugguuaguguaauugucuuaucaauaauacuuuauauuucuuuguaccuaacaguuugucaugagcacuuccccauguuguuauacacaucccuaauaauguuaaaguauagcucuucaauucuuaggaugacuccaagaccaaguuuauauuucaucagaaaggaaauucaaaggcagcaacugguuccuuccugccuaccccacacaagaugcauuuugcugagguuggccuguguuguuuacaucugugagaacagagcaaaauuauggcauuuuuccuuuuagucauuuaacauaaagaaaaaccacuuucuacuguaaucuccacgucuguucugcaguuugcauggggauugcacagguuugcauuccacaucugaaacuaaucagacaugcguuacucugcaccccgcgggaugcugcgcauaggacucauuguuugcuuugcuggugcugaccguugauguaaaaucuugcugauuucuauccaaauaaugaggguuaauauugacuauggccacagccagaauaaucauugagucuuuggaaccugaugcuuuaugcaaacagggaauauggcguguuuuccugcccucaucucuggggugccacugaauuugagaguacugugguggggagggagggaguucgggaaccugauagaccuacaauggaaucuuaccaccacuaacuagcuguuuggccuuuaagaguccacuuaauuuugccaaacauuaccuuuugaucauacacagugcagauaugccaccuaucuaucagaguugucaugagccugggaaaagcccagcacagaugauaccaugcauguugcauauauaauaaguaguacccauugucagaacuacugcccuuaguuuuuaggaaaugggggcaccaugaauugcccuggacaaucacuuuccuucacugggauguggucagcucaucagucagaugaggaugaagaugcucuuugagucccucagcccugucugugaugcuggguuauuugccaaagaguugggauugacucugcccuugcauggaauuacuauaguuuuguguguguguguguguguuuuugaggggaggggggauuucauagaaugaaucuaguuuuuugggcaccauuuugagguuuuuuuuuuuuuuuuaacagaaauuaucucaacugacaaauuagacauauucagagauuucagcaugguauaucacauuuuuucccaaauacaugauuuucaauaaauuucaggauuacuuaaaagcagugccucccaugcaaugcagggguugcaaauauggaugcuuuagggguaaggcagggguuaggcgagguugagggaggcucagcuggugagagaucacaggcaguguggaaaacacaugcuuucucuaaagagagcagcccugcucccucuguccaacugucacccuguggguuacagacccaguguggccaguuuuugaagagaagccagaaaucuagauuuuuaugugaugucucucaaauuguaaauguuggcaaccaauucaggcacucagggugaaacggaacacauaugcaagcuggauguggccuguucccagacuuacacccuccugaggacugaaggcugcaucgauuguugcacuucucuuugggagaaacaagauuacuuugcuugccuauuugucagcuuuggaauacacuugucgcuacugaaguauucccugugcuauauugcuugaaaaauaucgauucacacauaagguugggaacguagagagaaucugccucuuuugaugaaaauaguguguuccagggacaggcuuggcauucacaucuggagugaacccugucgaaagccuaggcagcacaggggugguaaaggcagggcuggcagggagcugcccaggcagcagaacucagguguggcccgauggagcaggccugucagguggucacgaucccuacagugaggacccaugccugggggcugacagcccagacucaaggugaacuugugagagcgcagaacccaccacuguucacagggauguggcccuaaccuuggccaccugcacagaggaacccuauuagaacacuaaacagcagcauccauguucagacucuggcgguugagagaaacaauagcaaagaggagguuuucugacaggcagugugagcaaaagccuggcagagcgucccuaguuggcaccucaagcuccucuuucauugugccccugaaacauauacccaacaccaccuugaucaagaggaggcugcccagagagggcaugaucaccguuccuggugcccugugccuggucccugagucgagccuccuggcccuacccuggaugacccccuauaccugguuuccacaacucauccugagcugcccauuugugcucccagaacccguguuugucuuacauggcaaacgacaaagauguaggaccuagcugugacaugagcccucuccauccccucugaaugacaggccuuggggcucaggcaaagcagaagucacccucugucuggcuggcaaggccaggccucuaggcugagaguggaguuggauagguugugaagcugucccugauagccccagacaucuucagcuugcagaaagucucugcaguagucccagucaucaagaaaaugaggauuucucauaguuuaucaacuuggccaagguggugucuucuauugcuaccccucuguuacuuggguauucacuaaacacgguuugggaacagccuuaagacccuucaucaccuggaaagacccaaguguguaaggucuaccucgcuauguucuaguuuucuuagcuauuucuccuuucccugcacccuaugaaggucaaaaucaucuagacuccuuuggcuagggaugccuggguucacacauugacaagcuggaggcaaacaccauuuccucaagagcucugccaccuguccaaggagagagccauguugggcuggccacagcuaaaaacuguccuggcccaguggcaucuucacugcuuggguugugugcaguuguauuuagagguucgacuggccucgcugcugcugcagcaccugcuucauacauggcagcauuggugggcuccauucgguguccuuggagccaaggcauuaaauugaagagucucaagaauaccaugcuucuaagaagagcaagugugaaugcuugguaauaauuagaauauguuacacguugggcucacgccuguacucccagcacuuugagaggccgaggcagguggaucaccuaaggucaggaguucaagaccagccuggccaacgcagugaaaccccaucucuacuaaaauuacaaaaaauagccaggcgugcuguugggcgccuguaaucccagcuacuagggaggcugaggcaggagaaucacuugaacccaggaggcagagguugcagugagcugagaucacaccacugcacuccagccugggugacaagaguaaaacuccaucucaaaaaauaauaauuauuagaauauguuauaugugcugcugcaauuugaaaagcguauguuuucauccagucaugugaugguauccgauuauaauuuuucacugcagaauaaaucucaguugaaauuugaccuuguaaagggaacaucagagucccagagucuuccucucaacauaguacagccagugaagaaacuccuaaggaagagcucagcccaagaucugaacaggaauaauagaaaugugcauguggugguugcauuucauucuggggacaccugggcauggcccucagggaagguccugugugccucacacacagcucugcccuggacuucauggacucacagacucuuccgaaaggcaucugucccuuacauaugaccccagccaaugcuccuaauaguuaaagaaucacuuaaucugaagauugaagagucugcauuuagacugcuuagggaaggaacugcccauggcuggcaguggugugcccagugacuucaccucuugguucaauuuccuggucaguaaaauugagauaugcacuaccuccuccuuacaauagugccugauacauugcuagccuucaacaauugguagcugguguuauuguugcugguauuguuauguacaacugacugaggaaggggagaaauuugauuugcuagguaaucuuuguaacuuguaucuagcucugaucaucuuccucuuuauuuauaacauguuugaaaaauagauaaauagacacauauauaugugugcaugcguauaugugcauguauguguauauaagagagagagagacagagagagagagauggauggggaaguagaggagacuguaucuccuccuaccugcagggaaggaacaguggaacuagcacugauuauaaacucuugaauucugaaagcaaccuugcuauaaccaggcaauaucuaacuguguauaauuauugugaaaaucugaguucuaggguuccuuuugggaacaucaauuccacaggaaugcugugagaaguaaaagagagagaucgaauaagugggugucaggcuuuuucuuuuuuaacaguaaggccaaacugaaaucauaugcagagccaccaaagguagagaguguagcuucuccaguugaagggagccucccuggagugcccgaugucccauuucagccuggcagccuguacauuuccuucucagcccccacuuguuggugccugcuggggaugauggcugcagaagcacuuugugaggagcugugcuguuaccugcaggcuuguggcuaugaggauccuuaugggacugagggccuguagugagaggugcagagggacccagaucacaccagccaaccucugaaaccugcugacugcagaaacuuugugacacaggagcauuuagaaacauuuggcaccaccuagaaccuugaaacuucauuguugacugaaagaugaguaugcagcucaugacuguguaagagugcauagauuauaugcaaauacuaugcuuuuuuuuuuuuuuuuuuuuuuuuuuuuuugagacggagucucacucugucacccaggcuguagugcaguggugcgaucuuggcucacugcauccucccccuccuggguucaggcgauuuuccugccucagccuccugaguagcugggauuacaggcacacgccaccaugcuaauuuuuguauuuuuaguagagaugggguuucgcccuguuggccaggcuggucucaaacuccugaccucaagugaucugcccaccuuggccucccaaagugcuaggauuacaggcgugagccaccgcacccagcuacuaugccauuuuauacaaaggaguugagcauccgcagaauuugguaucuaugggggauccuggaaccaaucccccuuuccucagauacagagagaggauugcauaagaacuuugugacugcggaaucauugagaaacauuuucuacauuccagaccgcuucuagaacucugaaacuuugugacugcauuuacaaaggaguguuuaaaacacaugugagaccuuggagagcugcaccguccaguauguguguggcugccgagcgcuugccaagugucugguccaaauugacaugugcuguuaaguguaaaauauacaucaaaucugguacagaaagaaauaauuuuauauuaauuauuggcagaaaucacuaaauuguuuuauuaaaauucuaccuauuucuuuauacauuuucaauguuauuauaaaaauauuuuaaauuauacauguggcucauguuauauugggcaccauuguucuaggacucugaagcuuugcuaauacaggaacauuuacaaauggaagggggagguuaagcacauacgacuaucaucaacugcauauuuucccaggcuucuugccuuuaguuaaucaaguaaucacuuugaaaucacaggaguugguuugguugucauuagcaaauuggauugcuaccuaaaagcaacaucucucuccucucagacuuuuuuuuuuuuucauuaauucugccacuguacuagccucaucaaaaagaaaaagugaccucaugugcuaugaacccaucuuguacauuucggauuggucagauucagcccauucucccucauagcaaaugaaaacaacaaaucaaaaagcgcuuuuggcuccuggcacuaacugaauuugacugucccuaguucucguuuuugcuggaggcugggguaugaaugcagaggcucagcaagcccugcacacacccggcuggguggaucggucagccugccacccuccgaccaucccaagaggcugggcccaaggacgcagguccacuuccugggcagacucugguuugaaacuugccggugcugagcugugucccucauauugcaugccccaguagccuaaacauucacauucccugcagaguccccaacuccgugugagaaaauaacugcaauacuuauucaacacaugcagccugauaucaaaaugucuucccuguguuuguuugcauuuauuuccuugaucuuaagccagaacaaacugucaauaaggaacguuucuaaagauugagguauguguuggugggggggaaggaagcccgggagaaaaacaucugggcagguuuacuuuaagcuaacagaggcugauguuucuugcugacugcuaacucuucagggacacauaccuagggcuccccugcuaagcccacagggaacuggccuccaagcccagugacuaagggcauaaaucuggugguuuugcaaagagagaggaauguuuauaauccauuaguaacccuuuggagagaaguagaugggaguuaguaaggaaggaaaauacugcugucucucccuccugcuuucuuacacuggaaaguaaaaucacuacauugccauuggcucuggcuuuugcuagauaauccauucauacaugcucagaacacagccgcccuguuuugcaucaaaagaagagcaggcugcuccucuuuccucucucagagaugccaggagcuuggcagccucaggaggaacaccaaacaagguccugggcugcgugguggccagaccuucccucacuccacggugcacacaggcugggagcuccuagcucauguccacucuuucuuucagggcaagcagggccccaaggagccagccccacacugaagugugggggagcaaagcuggagcagaggugggaugcagagguaccagcauugccuggaaccaagcagcagcguccggggcaaccucuauagagugccaagugaggccaguggugggagggagcuggacaggaaaaaacacagggaugaaggacuagggcugagcacaggguccccagacuccagaaaggcagcuguaacugguggauaggggagaaaccagcucagaagcagccccaagcgccuggagcugggcuccugcuguuucuagagggcagggagcccggagccugggaggaggaagguguugaagggcugagacuguucagaccuuguacagccucucuguuacaguuucaggcugacagccacgcacuaagauugcuaggcacucaguaacaaaauaaagugcuuacugugugcaguguaagaagaaugcagacuccuuugcaggaaagaauucuuguucacuaaaggacaaaauuauccuuuuaaauuuugcuggcuaaaaauuugcucugucacucaagcugcuuugaacucaaccaagcacaguucuaaagaaaaaggguaaaauauucauccuaauucauccuuuuccuuaagucaugcugguugguuucuuguuagauuucugucuccgccuuguccaaagguauuugcuauuuuuaaaucaucacaguguuucuauauaugugugugcugauuucuucacauaacaugcuaacauaagcauggauguguguuucuacauagacuuaaugaucaucauauuuacugauuuuaaugcccuuugaaauauauauguaauaauuuagguaacugccuagugcuggacauuucuagaauucuuacaugaacuuuguuguauuuauauuuuuccuucuauaggguuuccuuaaagcagauuauuaaaaaagagauuaaugggccaaaguucuuacaaagauaacgugauuuuuguuuguguguuuuuugauauguauuuccacauugcuuuccaauuaaaaccuguagcaacaagugugggucugucagauucaucacaucuucaucagcuugggguggguuuuuguuuuguuuuguuuuguuuugcuauuuugcaaaaugguagaaucaguggaguuuuuaucuuauuauuuuuuuuaauucuuauugauaucauuauguuccaugucucauagugacgugaucaagcauacuuuaaaauaaaggcaaauacuuugaaguaaaaguaugucuguaauuuuguuuggcugggcuuuaagcauccuaaacuaagagcaagcauuuaaaaaguuuuccaucuuuccaaguauuuaaaucucuuuuccauuucagauugcucuuuuauauggcaauuuccauuuuucucugccauauauuuuauuaaaaauuuaaauguauuuaaaccaucucauuccaugaaagagaaaagcagaacuuuaguaaagugcauucaaauaauuaaaguccauggcaaaagcaauagggaagacagucaugcaccucuugugguccuuauuaauggguccacaugcacacacaucuccaaccagcccccuuuguguagcuugucagaggacauuagcugagacuaaucuggaagccacuuccuggcucccaaauggacauagucaccaaaucagaaagacucauuuaucagaauaaaaacuuugcuacgugaggauugugcaaagcuuauuucaugcaucauuaucugggccugauuagcagugauggaaauugguccucaauuuuuaacaaucagcggaaaacaaaccuucagcuuucacugaagauagacaauugccauagacaugucucuguguuuucugcacaauaggaaaauagaggcaagagcccuugcaaagacaguuuuuaaauuguuuuggcagcaguugucucacagaugccauugucccugugacgcaaaugaagccagaucccgcucucugagcagacggguugacaucuuccuggaugccccgugccacaggggccacauuauuauguguuguggccccagaugcagcugguccuucuugggcuuugggggcaggcaggccugguuccagaugccagugugaccugggcagcucuguagucucuccguacauaguuucaucacuguacaacagugacaacaacacuaccugccugaaaaacugugaggguuauaauaagauaauuuaugcaaaagagcucugugcgggggcuggcacaaaggcaugcagacaggccucacacugcuaggagcuuccuccuguuaagucugagaggaggcccuugggaagggucuugcggagucaaggguggagcaguuacuccugcuacuguugcugugagguuuuuuggccauccuuauuguccuuaugucccaguucaagauucuagggaguacagcucuucaaguggcauuaucaggcccccaagcccugccccugcaaguggcauuaucaggcucccugucacccaccaaggguaggaauuaagccaaaguaaacauagagucuguaaaagucauuuauaguagaggagugaaauuucucguuuucugagucuggcagggugggcuacugcuaggguggacacagauggaggcugagcuuaugaaguuggugggacuucugggaacacucccccaugcagcccugcacaacccuccccacggaccuccuaacagcaggcagauccugcaccagagguauguagccuuuaucacugggaccuugaacgacgcugcacucaaauccgcaagugccaaggaacagccgggcugugcaguguugaggugagguggaccagccuccagccacgugcacaugcuuggccuccagauggcuucacuccuucuugccaggugccaggugcaggggacugcuguagcgcaaggcacagaugcaagcaaauccuggaucacgugaaccgucuuuugugcgguggaauuaaaacuuugacuucagucugcagagugaaugaaagcugugugugguuugguuacuguaacacuuuggggccccacacacacaccauauaucacauguccaccacauacaagacauauacuccacacaugcacacacgcuacacgcaucccacacauaccugugcacacacaugggggacacacacacccaugaacaaucugcgucuccguaguucugaggacaacagcaguacagugaguaugugacugcuugaauuugaguaugagcuguucuauccucagauauuccuggaaaggaguacauuaaaucaauaguaagagaaaugagugcuccuuucucuuuggucuucccuagaacugaaaaagcugucacagccucaaaugaugaagaagaccuauuaauugcuggagaguuccguaaaacccuugcagaacuugaugaagaccuggaagguaagaaccaccugauccgcuacucugauauuaugcugcaugaaaguaggugccaacaguaacuuccucugagcauacuuugauguaucuaugugaggaaacagccuucagaaggaauuccaggucaguuuggugaaagucuggaugugaggcgcacacagguuuccgguagacugcuuuuuaucugggcugccaagcaguaccuggaaacauccagacaacugcuuacagugugcucugaauaauacuaauucagugcauuaaaaaaguaugccacacauguuaaagaauaaaaaggguggcgcaaaaaauaaacagauuuccucauuaagacuucucuuaauuuguugauauauggcauaucugucaaugagaaauacucagccuuuugaccacaaugaagccauuuauaauggagcaucucauggcacugcuauuauauugauauauuuuggggaaauaauacuggaaggccaaagcagauggcaaauaguugcaguaaacagcuagggaaucuuucaaacaaagcagcuauguuauuuucuccaaugcacauguugaaaauaaacuaaaaauuagauauuuaucaugccuuagagagaagauaacagacugcaaaacugacgaguaguuuuugucugacucacuuuucaguuuccuguccugagaauguauaguugacagagcuaaaaauuugaaucagccauagugugucccgcagguucugaccccaugaccauugcauaauuuggugcuuggaagagccaugguaauucugagauacucaagauuuagucaucugcuuccuuaagaaguuaaagcuacagcccgugguccucuggauuuuguugugcuucuaguggacaugagaaacauggaggucaaaacccaaaacucauuuucauguuucuguguugagacaguuuuuccagaggcuuggaucuacaaaucaguuuuuuaagugaaggauguuggcagcacauuguaacugaauaccuugccuugaaacaucauggaucugcaaacagcuguguugaguaaugaaaguugagcuucuggccccaggcauauuauguagauuacaaacccaaauaacauuuuaaaacguauauaaauaauguauucaaaaguaaccucagggaaaucaaagucauggcugcaguuacacuaaguaauuggugugggaaacaucugugauuuguguuugucccucuuugcagaaauggaagacagcuaugaaacagacaccagcucccucaccagcuccauccauggugcauccaaccacugcccacaggaugccaugaucccucacggcgacacagaugcaaucccaguaacauucauaggggaaguuucagaugauccuguggauucgggguuguuuuccaauagaaacaacaaugcugggucuuucgacucggaggguguugccagcaggagagacucccuggcgccacuucaagcugagcacagccagccccaugaaaaggcaagggaggaaguaccugcccugcaccccgcuucccaugacgucggaaaaggaauccguguggccuuaucuaacaucucuaaagaugggaaucuaauggaaacggcgcccagggugacuucuuuugcuucgaaucuucacacagacaaccuaaaugcaaaagugaaagacaaaguguauggcugugcugacggggagaggacucaagccacagagagagugaauucccaaccggugaaugaaaaggacagcaacgauaaaaacgcugccuuggcaccaacaucauggcaccaacgaggccaaaacccagggaaaagcuacagacuuaagcacggccucacaacguauaaaaucauuccuccaaagucagagaugcgauguuacgacagagaugugucccucuccaccggagccauuaagauugacgagcuggggaacuuggugaguccucacgccaccggcaucaggaucauuucccugucuucgucugugccugaagcagaaucucagcccauugggaaagucagagaguucuggaggugcaacucuguggaaaaacaccugggccgacccucagagagcucugccaggggaccccccuccaccccugugcccacgcagacgcagaauccagagagcagacuccaagcagaccccaagccaauaucgccccagcagaagucugcccaccaugagggccggaacccccuaggggaggggagaaaccagccccccaccaugggcaugggucacgugagggugccagcagcucacaccacagaagucacauuucucaagccucagagaagaacguccagccaguauguggccucugccauugccaagcgcauaggagccccaaaaguccaugcugauguggugaggccacacgguuaugccgagaaggguuaugcaggcaaggcgccagugcuggcugcaccaccugucacugugaaagaugacaggacauccagcccacacucagagacacaaggauggaaggauggugcccaguggcccugugucacuccucccaacaaccacggggaagauuuggcagugggagccccuccuaggggggaggucauuggcccacacaggaaguugucuacucaggacagaccugcugcuauccacagaagcuccuguuucucacugguucagucuucccagagggaucguguuucugugggacagagcugugguuucaguggaaagcaaagcacaaguagccaggaggccagcucagcaucugagcccagacgcgcaccugaugguacagacccacccccuccacacacaucugacacucaggccugcagcagggagcuggucaauggcucugugcgcgccccaggccacggcgagccuucccacccuccaggagggucuggcacagaaagccacauucuccuagaaagagaggaaaagcccaguguguucucuacagauggaaaugaaacagacaguauuuggccacccagcauuuuugggccgaagaaaaaauucaaaccuguuguccagagaccagucccaaaagacacaucccugcacucugcccugauggaagccauccacucugcgggagggaaggacagacuacgcaaggugaggauggcggcuuccggggcaggccuuccacaccugcccacuucagugcacuggucucagagucucagaauaaagcggaggagagagagagacgggauuaggauaacagugaggcuuaccacacagguuucauuuuaacuagaauucccaucauacugccuccagauauuuguacugaacuauuaaagggacaaaauggaugggugugaggcuaguccacacugacuucaggccccuggcugcccugugggaaagguaacagccagugauguccauccacagggccagaggaauggagaggccaggggcaggcccauccauaugguuauccuugaacaauggaacagaggagaaaauucaggcagggccacuucuuucccauaugcauuuguagcagcagcgaacugucauucuucaguaacacaggaguaauuguaggacacgccuugcccauugucuaggcacuuaacacaccacaaguauuaucucauuugcaugcuacaccaaugcuaauaaugagauauuucuuccauuuugcagaugaaacugaggcacagugaggccaaggggccucguccaaggucaggcacuaguuagugggggccauggauucucuucugggucugcaagauguaaacacacacaucggcucuggaacacugggaugaauagcaggaguggucugccauuaagaggcaguuugaaacuacguagccuuugauucuuaugugugccuucucauagacaggguguaaaacugacccuauaggccucggcugacaugaguggauuuucuuucuuuuuuuuuccugagacggagacucacucuguggcccaggcuggaguacaguggcacaaucuuggcucacugcaaccucugccucccggguucaaacaauucuggugccacagccucccgaguagaugggauuacaggcaugagccaccgugccuggcccaugaguggguuuucucaugagcugcauuacaguucacauuucuccauguucucagugaaaugugugacacuguuaauauucuagacggcagaacacaccggggagggcaggccagcgaaacuguccuacacggaggcagagggcgaacgaucugcacugcuggcagcuauccgcgggcacagcggcaccugcagccugaggaagguaagaggugaagggccuuccauggcgccaggagcucaaacccacccaccccuucuuccgaggcacuugggugguggcugcagaagcuucuguccuuccgauuggauggugaaccaucugucuuuagaguggccaucccagccugugugagacacugggguggacacccugcuccaagagccuggggcagccauggcaaggagcagcaagagcuuccagacacucucucagccuuugcugaagcacaguuccuuccugugccuagaacugagcacuuuuccaaauucacuuggacaccuagggugguuuccaggcuucacuaacuggacaaccagaacugaagccauugcacaccuggaaaaaaguuguugcaugaauauagcgcugguuuuugcacauccuugggagccaguauggacucgaguuuagggcagaauggucucaucuuaguuuccaugcacagaaauugaggagcaaugugauuuguacauuacucauuagguucugacugcaugucuugcccccaguaauggguuggauguauguguccagccucuaugucuauucuuauaugccaagaaaagucaugaggucagagaguucucaguaaggcaggacugccaacuucuagucucugggaucaguuacuuggcugccaacagagcaugggggcagaugucucggccguggaguggacaaacuuccugggcuuauugcaaaagaacugucucagguccagggguaagauaaucagcugugugcugcucucucagaaccuuuggggacagugucacugccuuagucuguuugggcugcuauaccagaaucugacagacuggguggcuuguaaaugacagaauuuuauugcucacaguucuggaugcucaaagucuaagaucaaggcaccagcagauucaguaucuugugagggcccacauucugguucauagacagugccuucucucugcauccucauauaguagcagaggugagagagcucccuggagccuuuuuuguauaagagcacuaaucccauucaugagggcuccaccucaugaccuagucacccccaauccucaucuccucaugccacuaccuugggcguugggauuucacagcugaauuuugggagacauucacucuauagcagucauuuaaucaucucauugccagguggcauccucugcuucugaggagcuccagagcuuccgagaugccgcacucucugcucagggcucggaaaguccucugcuagaagaccuuggucuucuguccccaccagccauucccccaccacccccuccacccucccaggcucucucugcaccaaggacggccuccagguucagcacgggcacccucagcaacaccgcagacgcaaggcaagccuugauggacgccauccgcuccggcacaggggcugcgagacugagaaaggugauggcgacugugugugcgcauuucaauggggccagaggguuggaggugcagcguagauccagggacacgcuugccugugggcaggagcugcgaggcggucacaugggaguggguugagagagagccggcgucacugugucucucacaugugcugaccagaguggcagaugaaggcuccaguccacaggugagaaagucagccuccugcaugguaggugccagcuccaguccucagcuccuuggugaugaugacagguggaaucuaaaccccacuguaacccaagcucaguuccacccuaacccacaguuucuacugguccauggagaggauggaagaucauccauuuggggccccacagagcacacaucacaaacucauggcccucagcuggcacggaagccgccagucuuauucauucauucauucauucauucauucauucauucauucacucguacaugcuugcauuccagccuaauguuggacaguuacggaaucugaagucccuugggcagagcaugcacuuucuggauuuccccggcuucuccauuuuggucuugugcuggucugcacauuacugcccaccuggccccugcaauggaauuccuagauuaaagggcugcuugggccagauggcuucugagacguguuucaauucugacaugauucaguaauggauugacccuccgucccugcccauuccuaguggguguggggaguuaugcuaauaauugggagguuggaaaaagauuuuauuuuauuuuauuauuuuauuuauuuauuuauuuauuuaucugagacggagucucacucugucgcccagguuggagugcagugacgcgaucucggcucacugcaagcuccgccucccggguucaugccauucuccugccucagccuccugaguagcugggacuacaggcgcccgccaccacgcccggcuaauuuuuugugguuuuagucgagauggaguuucacuguguuagccaggauggucucgaucuccugaccucaugauccgccugucucggccucccaaagugcugggauuacaggcgugagccacugcgcccggcaaagauuuuauuuucugagugauuauuuccagauccuaagcuuauguuuucacuuguacccaagcauucggugcuaaagauuauccucacuuucuauauaaagugggccaggcucagaggagugagucgcuuggcuuggucacacagggccuggacuuagacacggaucaguuugggcacaagaagugcucauccccaggucacaagcugugugcuccguagagagcagguaacccaggagacgcuggguaagcuacucucauguaggacugcuggcacaauggagaagggagacagcucuccagaucucccacucagaagccucggggcacugagaauggaggaggccccacacccggccggcagccuugcugugaaaggcacugccuggagggaugagucccuguggacacccagaggucacaacuuuguugcccugugcaagaacagccugagcgcccacugauucgguggcucucugagcuccccaggggccauuugugauggcucuugggucagcuccccagagcuugucccagugugaggguggggcauucauagcugugugauguggcccugagacaucagccagcaaagaugcuagccagucaucauugaaugcacagcccacccauggaugcuggggagaaaagucuccuuacccagauggcaagggauauggcaaguuuuaugccaucuccucaggauaggggcaauuagaaauuacuuaaggcucuuugguuuucuuuaugcuuuuuuauuccuguggaauuuauguguugaugaauguguguacuuauguaaaaugagggaaaagugaagaaauuggggugaauggcuaaauaggggucauaaaaaugagcacaaauucuguugaagauggcucuugaagugcagcuccgaggcauccugucugccccacacacaugacagccaccgauuucaagggcugaucaucggaaggcucucuggaggagucugaagcagugcgauugggaucagcucugucacucuacugaucccaggguacauuucugagauucuaaagcuguuucucaauguagguccauaggacaucuguaucuugaaucacauuuuucagccuaugaaucugcaauuuuccauugcuauccaagugacuuuacauuaagguuggagacgauugucuaucucauuugagccuuucaugcauuuugaauugcaccgacugggauccugugaaggccaugaccacacucuguacucacugcuuuauaaaagucaucucagugacugguuucuguaucuuuuucuuuuacccucuccaucuugugcagagucaugaagggccuggggcccagagaugcugaaagcuggcccgagguccacaaccagcaagcggaggagauaauaacauugggacuuuuggcuucugagaaugcguuccucugccuuacagaaaggaaaaaaaaaauaaguuuugacuagcccgaaagaacagaggaaguugugcugugagaaagaaaguggggagaaaugcacaggccacggagagagagaggccgggccuggaugaagccgugggcguuggugccgugcgaggcccaggcaugcuuggaggaaaggucaccguggcuguaaagugcuagccagggcgggagccgggcuuguguuucucgcacagucucagccaucugucagcugcuucaaagggcauucaaaaguccagguuuugauuguuucuuggauuagucugagucguguggccugccuuauccacccuggaaaguucuaggcaauuaauauuuauguggcauuucugagguuuugaugccccgagccguuuacaagaugcucccgggcugaaagcugggcccugaguuccuuggcugaguccuacguuggaaaccacguuccccucagucucauuaucacuaccaugcccggugaucccagagccuuccuacacuugacgcuuuaucacagaaccacaacaaaucugaagaaagccugcccuaggagggcaggaauugggugaucgaccugcccuccuggccucuguucagcauucaucagggagacucaggugcagggggccaagguggccucaccuggaccaaugauucauucuuuugaaggcauuaaccaacugcauuuccuagaaguuugcccugucuacucauuuguguugagaguagaccuguggucacaggagacauuugcgauuugggaaaugaauuacaauuuuucuaauaagccugguuagauggcacuuuucugcuaugcauggauccuggagguuauauugucuucauagcaaauacacuuucguguauauuauggcaugcgaacaucaaauuauauggacuuugccucuuaugauuuaguuuuauuucaccuuuuggacuuuuaaagcuaugcuggcugggcauaguggcucacagcuguaauccuaacacuuugggaggcugaggcaagaggauugcuugaggccaggaguuugagaccagucugggcaacauaacaagacccccaucucuacaauacagaaaugagccaggugugguggcacgggccuguagucccagcuccuugggaggugaagguaggaggauuguuugagcucaggaguucaaggcuguagugagcuaugaucauaccacugagcuugcaucagccugggugacaaagcaagauccuuucucuuuaaaaaauaauaaaagaaauuuuuuuaaaaaaguaaaauguuaaaagcuauguuaaccuugaggaaaauacaauaaauucaggggcucccagugcgugcaguguugguuguuucuccauagguucucaguagauguagaguuuccugggucuucuuuuggguguucagcaacggcuccagaacagcauugcugggagcacauccugcaauggagggguguccuuggcuuucccagcaaggcagugcaugaaucuguaggugcuccuccuccccuuagcagugcagccuccuccuuucaaugagggugcccagcuaugcugggaagguuuucugggacagucgcaggcaaauugggugauuggucacccaaccuguaauacacaaauuucacauuggcaguaagcugcccaugaucaaauacaaaaggguaaauuugauguaggaggaauaauuaccuuaacagugacguugccauuuuucaaggcaauugaaauuacauuugccuucacggugugaauccaaugaugucucugccucuguauuuguggcugccagagaaacuuccagcuguguuucuccuccagcuccaaauaagagcauuugcagcucggcugcaugugcacccacuuccucaguggaacacccacuccuccugaaggcaguguucagaucugcccccaccccacacucagugcuugcuuccacucagcccugcguucuuauuaaaggcaaagcuguaugcgucugacugucuuugucgaucuguuuuaaaugcauuauuucagaaggccuggaauguacaaguacccuccuaauccauguguauauuuaaaacauucaugucuagugcuucauucuacaagcauuuccggagaaccuacuaggguccgggcacugucggagcugcuugugauagacgaaagaagcuucaucugugcccucaggaccucucagccagaggaagggggcaggggugcggggucugcuauugaccuuaggaacuuuuccaaagaagcugggacaggcuaaucccgaugacuuguggaucuuuccucccaggagggcagcggggcaagcaucuaccccgacaccuuccuggaagucaaggucguagcuccccuuugacaggugcgaaaauggggcacagacaucauaagugacuucucccagcccuuccguguguccugcugcugcugggcccagacaccuuaucagcuccuagccgcuuugggaaacguccuauugaacugaguuccagucucuugucugggcccucaggugccuguuuucccacggcaggaauuaauugaugcgggccacacgcgucaugacacuuggccuugaccacagaccuuguaagaaaugauuagacaugugacaguaacaggaggccccaaaccaggaaagagaaaaaacacaccaacucucuuuucaucuaagcccuagguccucauaugugcauuagagaacuccaaguugcugugacgagggaauagcaauuucuaucaggaugugaaugugacccacaauacaauugcaucaccccugguuuaguugcucguaauguaaaccuguggugugcuuugguuaaugugaaauuguucugaggccuaggggucaguucugucuuugcagacucuuugcgugugacuguucugcuuauugcagcucuacugagucagcugccucuucugcagguagaacggggaggagccuccugggagaagcacaccuaccacagugaccauccucagggccagcaaaugcuguucuccacuccuccagagcuguuccccacauuugaccagcucauuccugacucaucccuuuguuccuuuauuaaccucacgucuucagaaagccucccucagucuagauuagguucccaauacagcgucacauaauuuuuccuucauaaugcaaaccacagcucuaauuucucuagcaguuggugugguuuuuguuggaugcuugccuucccuuccacaucacaaguuccaugagucuugcccaucgugucaugugauggaaggguagacacgcucccuggugccuccuugauaaggccaccaaucccuucaugagguucaacccccaugaccucaucaaauuccagagucccaccuccuaauaccaccaucuuggagguugggauuucagcaugugaauuugggagcacacaagcauucagacuguaacacucccccuauuaauaaguggggcccucaggaaacaucuggcuaaguggagcacuguguuuguacaaguagaucagaggugucugaucuuuugccuucccuaggccacacuggaagacaaauuguguuguaccacauauaaaaaacacuaacgauagcuggugagcuuaaaaaaaauugcaaaaaaaaucauauauauauauauauauauauauauauauauauauauauauauauauuuuuuuuuuuuuuugagauggaguuucucucuuguugcccaggcuggagugcaauggugcgaucucagcucaugcaaccucuaccucccggguucaagcuauucucuugccucagccuucugaguagcuggcauuacaggcaugugccaucaugcccagcuaauuuuuuauuuuuaguagagacgggauuucuccauguuggucaggcugguuucgaacucccgaccucaggugaucugcccgccuuggccucccaaagugcugggauuucaggugugagccacuaugcccacccucauaauguuuuaagaaaguugacgaauuuguauugggauacauuuaaaguggucccaggccaugaguuggacaggcuugaaguagauguuaaauccccaccaugggaguucaggaagagggcccgagagaaccuagagaagagagggauauggaggagcaucaggaaaagggcaggugcgcccagugucaagacagacccggguggugucgauccucccaguucuucugggccuuggggcuucacuuccucaucuguaagauugaugcgagggaugugugagagagcaugcacagggcagggucugcaucaccaccaccaucaccaucaccaucaccaucaccaccaccaccaccaucgucaccaccacaguuaccaccaccaucaccacugccacaaccaccgccaucaccaccaccacgauuaccauaaccaccguuaccacugccaccaccaccacaauuaaccaccaucaccacauggaaaguaccuagaauacuuccugugugcuuaccaugugccagacaccauuuaaagugugacacaaguccacucauuaaaacaucagcuuaaccaaacaagcaguuuauuauugucauuauuauggguaugucuccaauauaaagaugaagaaacugaaguuauagaggguaacucgucccacaucaaauguuagucacgauccucucaggcacaccugagcagagggcaaggccucagaugcguacccacacagcccaagaggcaguguccucugucuggaccaggaccccagggcccaccucccaguucccuugaccucgggccucugcauccugcuagucguccuucccuggcagcuuuuacgaggaagcuggagcgugagaaggucugugaggacagcccugaucacagccuccuuucugcaggucaaaggaacugggaaggggguuccaggaguacuauugcaagaguggcugugcacagagcucucuagcaccagaagaucugcauccugggcuuauugacauaccaaauaacugugaaucucucuucccugcaggugcccuugcucgugugaaugaacagaggccagagaauugcagaaacccaccuguaauaugcccacaggcgucacucaaggagucugcauagccaggaacaucaaguuuugguguuacuuucuugucuacaggccaaaugcgcacaguugauuuucgguguguuccuguauaacggcuugaaaggaaaggagaagaugcugugucgcugcgcagcucgugugccaaggaaauguguuuugccucugaauaucuuaaguugcuaauaaacgauucuuguuggcagguuaaugggacuauaaaugcuggagcccagcacucacacuuaauuauauuuaugggcaaaguaaaaagaaucaugccuuagacugauuuuggaccuuugagacuuuuaccacauacagauggaugaaacuacuuacugauuuaagaucuuuugaauuuuagaaaaaacauaugaaucagauggaacaaucugaaugugauaugcuccaugaugcuguguguuuugguaguaagaaaaaaaaauugggaggcuuuucaaagguggcuuuguuagguaguaaaacugcuggauucuucuuccucaaauauuuggggcuaacacuucacagagggucacaguccaugaucugaccaacuaagcuuuuaaaaaucaacuauuaccacccagaaaacaguccuacgugaucauguggccagggcaugcccgaguccugcaaggguggcggguggcugaggucacaccaccacuggaguggaugggcagugccccacauggacagccauuccccaggcuaugaagugacauaggccucccccacggugccuguguacggagccugaugacuucacugggagccuucuggaauccugcagagggucaaggagcagggauguuggaugcccaccugucaagaguucagaucaaaguugcgcugagagcaucacaauuuugguucagccuugacgcguuuguccaacagcucauuggcucccuuuguaugauaucguggucuucucacauggugcccagucaccaauauuuauaaugaggucuaacuacagcaguaguuuuucauauauaucucuaaaacauuuuguuauauugaaaaaaguaauagaaaucaagauguguugaugaaauaaaauguguaucugagugagaaaacaaguauggugaggucacuuuaauguuucacagcgaucucagaucuaggccucagguagaauggaagcuguucugcauucacugauuaacguugcuaaacucuuggugaggcacgagcuaccagccaauugcucuucaucacagcuaucugucuuuuagugccacaaauaaaagaaaaucaaaucuua

SEQ ID NO: 192216 - RNA, 43562 nt, Homo sapiens
gagcucaccgcugccagucgcgcugccugcccgucccacccuuuucgugcaggcauucagcuaaaugacgggcggagcccggcggcggcuuccggucgggggaaaaaaguugggccgaaggaggggccgggaagacgcaagaggaagaagagaaaacggccgggcggcgguggcuguagguugugcggcugcagcggcucuucccugggcggacgauggacagccagggcaggaaggugguggugugcgacaacggcaccgggguaagggccgcgcgaggaggccuuggcggccacagacgccggcggggacgagcagcuggcgcacgggcccucggcccccagggcugcaccuccgggcccucggggcgaaggggcgcggggcggugccucccaccuccgcgggcgugggagcgagccggccguucccuggucucccuugagccugccacccauuuagccugccacccccucacccuuccgggugggggcggcgggcgagaccggcacuggacauggagccuacugaccgcccggcagggaccugcuccgcgcuaaugcgggggcaauugggcuaaagcggacggaagcguaaaaggcucgguuuguguguuccgagaagggcucuuuuccccagggccaccgguuuguaaaaaggagaaagaccuagaggccuuccucuuccuguauaguugaagauacaccaaacgagaagcaggaagcggguuuacuuaaaaaaaaaaaaaaaaaaagggaagugcugucauggaguguggaccucagcccuuucgcuguguuuguugggcuuuuuauuaguuuuuucgagggaagggguccagaucggcagcgcaucguucacuuuuuguuuuacauacuaguauuuggcccaggaguaggcccacggagaccagcauguuccauugagugguuuugggugaccuaggaucccgcaagacucaaguguuaauuccacuagccuuaggggaaguuaauuaguguugauuaucccacccccagcccccuuuuuucccuucguuucaguauacagguaauguuagccuuuaagauucaaaaauuguaaaaucugacuaaagcacugauuuagaaacuauuugaaaauuguuucuguaaucccagcacuuugggaggcccaggcgggcagaucaccagagguuaggaguucgagaccagcccagccaacguggugaaaccccggucucuacuaaaaauacaaaaauuagccggccgugguggugcuugccuguaaucccagcuacuugggaggcugaggcaggagaaucccuugaagccaggaagcggagguugcagugagccgagauugcgccacugcacuccagccugggcgacaagagugaaacuccgucucaauuauaaaaaaaaaaaauuguuucauucagaccucccucuugccagauuaaaaaaaaauguauuuuggguagcaaagucagcaaauuagaagauggaaauauuauuuauucuggaugacuucuauagugauuucuaaccauuuugauguugcaacauuuugugaguuuucuccccucccucccauaaauaugauguaugaauuaaaguucauuuuacuugaacaaaacacuuuggaaucugaauuguugagggggaaaagagcugguauuuacugccauaauacugcccuugauuagauuuguuacacaauuuuacaagcaauaauuaugguagcuucaucugaacuguguuaaaaauggacuagaguaaaaagaguguuaacguacauugaggccaggcgcgguggcucaugccuguaaucccagcacuuugggaggucuaggcgggcggaucaccugaagucaggaguuugagaccaggcuggccaacauagugaaaccccgucucuacuaaaaauacaaaaauuagccgggcaugguggugggcgucuguaaucccagcuacucgguaggcugaggcaggagaaucgcuugaacccgguaggcggagguugcagugagccgagaucgcaccacuccagccugggcgacagagcaagacuccgucucaaaaaaaaaaaaaaaaaaaaagaaaaacaaaacauauuaaugugacgguuuuuaagaauguaauauuuuuaaaaaggcagauccacugcuauggaaacgucuaagauuuuaaguugaaaaagguuuuagaaugauucaguuuaaguguguguuccuuauuaaagauguauguccacaaacuuguauccgcauaugaaaguuuuggagggauacauaagaaauguucauaaugguuaccuaugagacagaggauaagggagugagggaagauggagaggacuucaugaccuuucugaauuauuggaaaaauguucuuuauuugaacaaagcaaguauuauuaaacuauauuuaaacuaaauuaaccauaaacgcauguuacaugugcggcuaaaauucaguuaaaugugcuuuuuaaaaaaguauuagccugauuuccacuauaguuucaaauuggccucuaaauaaauaaaaaacuuuaaaaauugaauuuaaaauuuuuuguuuugugauugugucagauacucuuuuuagaaagucaagccaguuauauuuuaaugaauucuuuuagggguucaagguaaugagcccuguauuuguaguauauaugaguuuuuaaauauuaaauuagaaugggaauguuaaccgaagcugauuuuuuuuuuuuuuuuuuuuuuuuuggacacaggaucuagcucuguugcccaggcuggagagcgauggcgugaucucggcucucugcaaccucugccuccugggcucaagcgguucuccugcuucagccucccgaguagcugggacuacaggcuugugccaccacacccaguuaauuuuuuuauuuuuguagagacugggucucccuauguuacccaggcuggucuugaacuccugggguuaaaagaucugcccacugcggccuccuaaagugcuaggauuacaggcuugagccacugcacccugcugucagaagcuaauguuauguuacuauuccauuaguuagcuaacauuagaaggcugauuuuaggcugggcguuguggcucaugccuguaaucccagcacuuugggaggccgagguaggagguucacuugaggucaggaguuugagaccagcauggccaucauggugaaaccccgugucuacuaaaaauacaaaaauuagccgggugugguuucugaugccugaaaucccagcuacuugggaggcugaggcaggagaauuacuuguaccugggaggcagagguugcagugagccaagaucacgccacugcacuccagccugggcgacagagugagacugucacaaaaaaaaaaaaaagcugauuguaguauguuauugauuagucuugugucuaauccauguuuuuaagauucuuuuccuuaagacaagugaucaauuccugucauaaaugaaaaaagugaguguaauuaauucaaauaaaauuuaucuguucuuaugcuucuaguuauuuuaaaauuuuaugcagauuuucuauggacaugauugguuucaaaugaagaaacagugcuguuaaaauacaugaaucauauaacaggaaugcuguaauaguucugaguauguagaggacuaggaaccgcuuagauuguguauucuguuucuuaccauuuguagacaugaauaaucaucuugauuuuauuuagauaccugaaguuauaaugauuccuuuauaauuaaauauuaaagaagauauucagauguaauuuugcaaauuuauggaaauaguuguuauccuaagguguuuucauuugcuccuuacaugccuuagguuuuaaaauuguaggcuggcugggugugguuccucaugccuguauuuccagcauuuugggaggccgaggugagaggauuucuugaggccaagaguuugagacuagccuggguuaguauaacaagaccccauaucuaguaaaaauaaaaauaaaauuacaggcuuuuuaaaaaguuacgauucuuuuaaccucucuggcagacccaaauuaaauauucuaggacaggaguguccagucuuuuggcuucccugggccacauuggaagaggaauugucuugggccacacaugaaauacacuaacaauagcugaugaacuaaaaaaaucaccaaaaaaauuucauaauguuuuaagaaaguuugugaauuuguguugggccucaugcagcccgugggccauggguuggacaaguuugccuggaaacaaguuuguacuuacgaucacaugaccaauguuggucccgcuugauuuucuaucucccagcuugaccagugucucaguaggguugcccagaggaggaaaacucauuugauccaauaauuuauguggauuuuaaccauucaaaccuccuucugaaaucaagccacuuaaaguggcccagauaggugaaaaucuggaggucugugaaacucuagguuuagguccucuucacgagcuaggcccaggccccugguguuacgugucuuguuaccagacuagggugauuucaucagcauugaguuagaucaccaacaaaaugaagguuucuccagugcgugcuauguugcuggcacagugcuuaauaagguccagucguacagagaagcuuauagugcuagaauaauugcauuugcauuuauguaauugacauuuguaguugauuguggccugcuuuaucgggcuuaugcuacuuuauauguugaauuuaggaguguuugaaacagaaacaaaccaaaaccaaauuugguuucaucuugcaaaaugcuuugguauaaguagaauaaauauuuugguggccuaagaucagaacagucacugugcaguuaacuuacuaaagaacaucaguaccaugagauaaaauuaguaaggggaaaauaaauauuaaauaagcccaaauggggcuuuauaaaucccagguuauuauuuuuuugaagagaaaaaaaaaauguacuuuuagagcagauguagauagaauuuuucauuuuugcuugaaagaacauuauacuguucauauucuuaccauuugaugacucagugggaaguaagggaacuaguuuaaaccacacugcugugaagaggaaacuauauaugguaaaaucuauuucuuaaacacagccuuacugcacacaaugaaagaacgaagucaccaagucuuaaaaugauugacaugggggaggaauuucaaggauuaagaugauaccaaugauaccaaaugauaguuuagaaaggaauguuuucuuuguauuuuaucacaucaugguuuaguuuuuuuuuuuuuuuuagacagagucuugcuccguugcccaggccagagugcaguggcaugauuuuggcuuacugcagccuccaucucccggguucaagcaauucuccugccucagccuccccaguagcugggaucacaggugugcaccaccacgccaggcuaauuuuuguauuuuuaguagagaugugguuucuccauguucgucaggcuggucuccaacuccugacgucaggugaucugccugccucagccucccaaagugcugggauuauaggcgugagcacugcgcccagucuagauuuuuuuuaauacugauuauuauuauuauuugcagaaguaaucagauugucaguuuuauauuauugaaaaauuggggccaggcacagugguugaugccuauaaucccagcacuuugggagguaaaggugggaggauugcuugaggcugggaguucaagaccauccugagcaacagcgagaccccugucuccacaaaaaauaauauaauuuaaaaauuauaauuuuuauuuuuucuuuacugcuucuugcagagcaggacuaccccauaggcagugugcccagaguagccaguauaauuuuuuuuuuaauuauuuuauuuuauuauuguuuuugagacagagucucacucugucucccaggcuggaguguauucauguuaucucggcucacugcaaccuccgccucccagguucaagugauucuucugccccagccucucaaguagcugggauuacaggcaugcaccaccacgcccagccaauuuuguacuuuuaguagagaugggguuucaccauauuggccaggcugguuucgaacuccugaccucaaaugauccuccugccuuggccuccuaaagugcugggauuacaggugugagcccccacacucagccuuuuuuuuuccugacagggucucacucuguugccuaggugggagugcagugguacaaucauggcucaaggcucaacguagccucaaccucccugggcucaggugauccucccaccucagccucccgaguuucuggggcuacaggugugugucaccacgccuggcuaauuuuuguauuuuuuguagaaaugggguuuugcucuguagcuucaggcuggucucgaacuccugggcccaagcaauccacccacuuuggcuuccuacagugccaagauuacaggugugagccaccauucccagccaauuauuuuaguucuuguuauuauaacuguuaauguuuucacuuuugaaguaaugugaaauagugcaauuuuugcuaucuugauggaugaauauauacccuguaugaaaacuggugcugaguucuauggcaacaucugcuuccaauaaacuacugcucaagcagaauaguuuuauuaauaagugauugauaaucuuuaauuugaaugaaaagucuuuuuuuuuguuaggcaguaauaguagguuuacaguuguuuuuauaguuucagggauuucaguuuuugucuucuaacuugggaaauguuuguugcuuaaaauauacucauaagaauguuaagauacgaacuacccaucugaacgauuauaauuggaagacuuugagugaugugauuauuugccacuuugccauguuguauguccaguguguguagcucugaaggagaggggagacgugucaaccuuagcagccucuucccugcacuaggaucagaccuaugcuccaucccaggcuccuccugccaccuccagcuucucuuacgauuucucacuuaguaaacuuauuuauuugcauucagcaugccaaaaaugaaccuuacaaacugguagguucucuuuucauucauucauucauucuauaauuuuuuugagauaauuuauacgcauauaagugagcauuuucauccggauaaauggauacuuuugacuauaucuguuuauuacuuggagguaggcauaauaauuuaauaucaaaauaguauuuaauucccauauuugagauauuuguguaaauuaugacugacauuaggcuggcgaucaugacagauguuauacagaaaugugggaacaauagggauaaugaugagaacagauucucuuccauaucauuuaaguuuguaucaaguaaacuggauuuugacuuaaaagagaguuugugauuugggagagaagagugugugagaggugugugugugugugugugugcacgugguguguguguuauguuuuaguuugaaaauacuaaaaaauacuagauguuauucuuuuccucugagguaguuuuuccuccaugucuuaggucacauuauuuaagaagacacugagaaaaaaugaacuacuacuccugaauucuguucauuuuaagggugggaaguguauuccaguucaucacuaucaaccacugccaaggggaaauagcugugagcaaguggguuaucuauugcauaugcuaucauaucaugcuaacuucugccuuaaaaaguaauccaggcugggugccguggcucacgccuguaaucccagcacuuugagaggcugaggcgaguggaucacgaggucaggagauugagaccaucuugaccaacuuggugaaaccccuucucuacuaaaaauacaaaaauuagccaggugcaguggcgagcgccuguaaucccaucuacucaggaggcugaggcaggagaauugcuugaacccaggaggcagagguugcaaugagccgagaucacgccacugcacuccagccuggaugaccgagugagacucagucucaauaaaauaaaauaaaauaauccaaaagaauuguauuauacuuuuagaaauggauagcuguaccugaaaaaugcccuuaccuugguggcucaauauaaacuaagacuagguuugugggcuuguaagaagacaucugaauaauauguuuuauguaguuucuauuaauaaaauguaaacaugaggugaaaggauaggaauugagguggcauugggagugugaacuuuccucauuucagacgaauuuuucauaaaagcuuuaaucugauugucaugacuguaacauauuugaaaaaacucuguuuuuaaaagacuaaguggggccgggugcgguggcuuaugccuguaagccccaggcugguggauuacaugaggucaggaguuagagaccagccuggccaacauggugaaaccccgucucuacuaaaaauacaaaaauuagcugggcgugguggcaggcgccuguagucccagcuacuugggaggcugaggcagaauugcuggaaccuaggaggcagagguugcagugagcugcgaugacgucacugcacuccagccugggugacagagcgagacuccaucucaaaaaaaaaaaaaaagacaagugaaauucuggauggcagaauguccuaggcuauuuauaauuaaaugugguucaucagcgucaucuccaacagggcugcuguagagaucuuugaaaauaccaaauuuuuauguuuuggagagcuacauaagaucuugcuaaguuuuaccgcauuaaacaaaagaguuucuuguagauaguagcuuucuuuuguuguugguuuuuuguuuuuuuggguuuuguuuuguuuuguuuuguuuuuuuugagacaggucucauucuguugcccaggcuggagugcaguggcgugaucucagcucacugcaaccuccgccucccagguucaagugauucucauaccucagccucccaaguaacugggauuacaggcaugcaccaccauaccuggcuaauuuuuguugguuuuaguagagauggguuuccaucauguuggucaggcugaucucaaacuucuggccucaugugauucaaguggugugcauaguagccuucuaucaagagguacauugcucuuuucugucuaccuuuguuuuauuacugucauguaucacauucagguacuauuuuucauccuuaauucuaagaauguguggugccuggagccauagaaaaacagacuuuuucugaauauuaaauauauuuuaaaacaaucaugguaucauacuguuaagucaacagcaaaacuuuuaauauuuauugaucauuuacuguguaccuauuaugugccagacgcuguucuaggcaguuggaauucaucaguaaacacaguguagcuaacauuaaauaaaugcuuguuaaagagggugcagacuaugauuacauuuccuuucuuauauagcuuccuccucccacccugaaauuuuuaauugcccuuuccuugcaaugucugcucuuacuagacuauguauuauuuauuuuuuguauguuuuuugagacagggucucacaugaucacggcagccuuaaccucccaggcucaagugauccucccaccucagucucuggaauagcugggacuauagcacaugccacaaugccuggccaauuuuuaaauuuuuuguaauuuuuuccgggggggaaucuugccguguugcccauacuggucucgagcuucugggcucaagugaucuaccugccuaagccucccaaagugcuggaauuacaggugugagccacugggcccagcguaaacagacuauacaagaauuuguaacugccgggcacaguggcucaugucuguaaucccagcaacucaggaggcugagacaggaggaucauuggaggccaggaguuccagaccagcccgugcaacauagugagaccccaucucuacaaaaaauuuuaaaacuuacgcuaggcgugguggcucacuccuguaaucccagcacuuugggaggccgaggcagguggaccacuugaggucaggaguuugaggacaacauggugaaaccccgucucuacuaaaaauaaaaagaauuaccugggcguggugagguacaccuguagucccagcuacucagaaggcugaggcacgagaaucacuugaacccgugggcgggggcgguggaggccaagcuugcaaugaucugagauggagccacugcacuccagccugggcgacagagugagacucugucucaaaaaauaauaaugaaaauaaaaacuuauucgggccugguggcacauaccuguagucccagcuacuugggaggcugaggugggagcaucacuugagcccagcaguuagaggccacagugagcugcaguugugccacugcacuccagccuaggcaacauacaagaccccaacucuaaauuuuaaauauuuuuuaaauuaaaaaaguauuaaaagcucuugauucucucaaguuuuacuguaguuaaauccuguagaauaucagcuucuuauguauaaaauggaagucuuaucacaaugauauguucucggagcaguacacagagaaugaaauuauguuacccgguauuacuaaauauauuuaucuaaauguaaaaauguaaauagggccaggcgcgguggcucacgccuguaaucccagcacuuugggaggcugaggcgggcagaucacgaggucaggagaucgagaccauccuggcuaacacagugaaaccccgucucuacuaaaaauacaaaaaauuagcuggguaugguggugggcgccuguagucucagcuacucgggaugcugaggcaggagaauggcgugaacccgggagguggagcuugcggugagccgggauggcgccacugcacuccacccugggcgacagagcgagacugucuaaaaaaaaaaaaaaaaaaaguaaauagcuagccaggcgcggugacucaacgccugcaaucccagcacuuugggaggccgaggugggcagagcagcugaggucaggaguucgaaaccagcauggccaacauggugaaacccugucucuacuaaaaaugcaaaaauuagcugggcaugguggugggugccuguaaucccagcuacuugggaggcuaaggcaggagaauugcuuggaccugggaggcagagguugcagugagcugagaucacgccacugcacuccagccugggcgacaagagugaaacuccgucucaaagaaauaaauagccaaaaaugccuaauaaauguuucuuuucauaauacggugauauuaguuuaaaugacacuugguuuucccauuuuggaaaaugacauucucuaagcgauuugcccaaaaugaaugaaagucugcuuuagaauugaagcuuuaguucuguucauuuucucacauuucucuuucuaaaaauacuuagcauuuugccgggcaugguggcucacgccuguaaucccagcacuuugggacgcugaggcaggcggaucaccugaggucgggaguuugagaccagccugaccaacauggagaaaccccgucucuacuaaaaauacaaaauuagcugggcuuaguggcgcaugccuguaaucccagcuacuugggaggcugaggcaggagaaucacuugaacccaggaggcggagguugcagugagccgagauugugccauugcacuucugccugggcaaaaagagugaaacuccgucucaaaacaaaaacaaaaaaaaccuuagcauuuguucagcgaauuuguccaucccacagauacuucuggagugagcacugugugccaggagcucuguuagguauuggauuccagcacgaacugcucagcuuagcucccugcucuuaugaggcuuuuggucuagugagggaacuuaggcacuaauuuagcaguaaauaaacaugaacccuggaaguaggcaaugccgugaaagaaguuaaaaggagauguugcgauagauugaguggcuacuucggguggacugaaagcaccaaaaguuuaaaauguuauauaaaugcaaagugauauuuuucagaugcugucuuaaaauauaguaaauauccugaugcuaacccacuuuuauuuuacuguuucauuccaguuugugaaguguggauaugcaggcucuaacuuuccagaacacaucuucccagcuuugguuggaagaccuauuaucagaucaaccaccaaagugggaaacauugaaaucaagguaauauuuuauuuauugauaaaugauaaucaagacaugugagguguucuuauaaaaguaguuuaacaguucuuuuaaguaguuuuaaaauauguugccaugaaaagcaaaggggaggguagaaguucucauauuuuuaauuuauaucaacaccugaacaggggcacaaaaauugaaguuaauuucaucugauuuuguuuauguauggcuugaugccauuacucuuuggaguaaaauacuuaaguuuauuacauuaaugugaaacgcuguguuagugacuuaaguccuauuacauaauauaauuuuuaaaagaaaucggccugguauuuuuaugucuuucaauuccauauauuugucauuguaugugagugucucuuuggcaccuuagacuuuuucuuuucauguuuuuauggccugaucccucuacuuuuuuauauagccauuuaggaaaacacaggguguaaaucucauugauuccucuuuucauuaauauaacuuauuuccauaaugugcagaaggaagccauucaagccuuuauuuggccuuggauuauguaucuuaccauaaagaggaaggaaaguuuucauugccuacucgcuguauuuaagaugaaagacuacaugaaaagacgaucgauuuuucucccauauuaaagggaucagaaaucaaguaggaguuacaauauuugacaagaaagagaacagugagaggacaguagucaccaguuggcuuuaaguucuucaggugacugaaggaucaaguuauacagaaugccauagaauuuagggucuuuuuuagugaauuauuugugaacacgcuagcauuguuuguccuaucuggauagucuuuagcaagccuucaguguaagguuaugagucauuugaaauaugcauuagggcguaucucuuugggacauuuguuuuauguaggaaggugguaaugggugguagagauuugcuauguagccuucugcuuuugggauagagaguugaguuacacaaugaauaaaaauacaagcugaaacuuggguucuguguuaguuuuuuuuuuucagaguuaaaguagcgaauuuuucuggccucuccuguuaacaaaaaaaauaaaaugggacacucaguguaaguuuuuccuuuuuaaggagcuuuuggaauauuugugggauuccuuacuugcuuauugugaacuccuuucauucugaaugaauucuaucuuaaaugaacuuugacuggaaauuagcuaauaauagugauaaggauaaacuguuuaaugaaguugaaggcuauacuuuuuauucagugucagguuuuuaaagaauggcuuuuuuauauacuggacaauaaaauuuuugagguaugaagaaauaucauguauagccauaaauuuauuuugcaacauaggcacaaauaacuacacaucucuucaugcccacuuucuucguguuuaaggccaagugauagaaaucaaauuugucaguaugcuaauaaaacauuuuugccaaggaauucccuagcagcauuugcuuguaugguuugucauucuguauucuauuggcucaauucuguucacucugugcaaucuuguaagccuaucaaguuaaauuauucuucgaguagaaaacagcaaaagauaccugugucaaauaaauuuaacuugaacacuagagcuuggaaaaacaacccugagcuaucuaacacucugccuacucagcuagaccuuugcuguuaucauuuauuuuucuuaauuaaaguucuuaaguucaguaaugaauuaaagaagcuuacuuuuuggaauuccugugcuuaguauuuugacuuauacuuuuugugucuuguuagcuaaaaugugguagacugaaaaauggaaauuuaaaucguuuaaugaguuaauuugcauucaggaauaacuguccauguuaauuuggcccuaauuauuaacuccauuaaauauaguaguacugcaucugaccucaaccuaauugucucuauugcuuguauguuuaaacauuucagugaggauuuuauuuaggccuuuucugacucuuacuucuaccuucucucucuucaccuuucuugacccguugaaguagaauaacaaaaagaugguaagugagguuacacacaugcucuguuuguuuuccacuuuugcuugaugggacaguaguuguuguuuugugucccuuuaguauuggggaggggggguuauuuccauauuuuuauuuuaaguacuuugauuuuuaaccuuuuucauugcuucaauuugauagcaacuaauuaaguccuauacuuuccugauugcguacaauggaccaaacaagaacuaauuacuaacauaguuuugaauuguuuuccuuguuuuucuuguagaugaauguuauaauuaaaauggaauguguugugcauaauauuagaaaccagauggcuuuauauaggauaugugugauccaaaaaauucaagugaaguuguuacauuugaauaaauucacuuuauugaccaguauuaaauugaacauugacugucauagccuguauauauauuugcaucuagugugguaucauauguguacuuaauaaacugaguaaaauuuuaauauguaaauaaaccauagauagaaaaagagaauucuuuccauaucauccuuacugaugagcagauuucacaacguuaucugaggauaaauaagaaaaagguaaagcuuuucuauaaacaacagauuucccccccaaacauuguacaguguguuuuucuuuauaacuauaagcuugcuggucuuaucucagacauuuaacucuucauuguauuuuucugugauagucuaagugcuucuguaguagauacuuuucaaguuuguuuuuaauauuguuuguaagaaucucugacaaaaaucaggcacuucuaauauauauuuuaacuaguaauaguaacuuugugaaguuuucuuuugaauaaacaaaaacauuuaaaagaggaaauuuauccuaaauaaaagaucauaacauuuguguuuauauucuaaugagauuaagaaaagggugugcuugcugggcacgguggcuugugccuguacucccagcacuuugggaggcccaggcggguggaucacgaggucacgaguucaagaccagccugacgaacauggugaagccccaucucuacuaaaaauagaaaaaucagccaggugugguggugugugccuguaauuccagcuacucaggaagcugaggcaggagaaucgcuugaacccgggaggcagagguugcagugagccgagaucacgccacugcauuccagccugggcaagagugagacuccaucucaaaaaaaagaaaagaaaaggaaagagugcgcuuguagagaacaguguaggcuuauuuuaacagaaguuuuugaccgagugagguguuucaugccuauaauuccagcacuuuggcaggacgaggugggaggauagcuugagcccaggaguucaagaccauccugggcaacauggcaagacccugucucuauagaaaguuuuuuaaaaaguaaccaggcauagugauaugugccucccaagcaacuugggagguuaaggcaggaguauugcuugagcccagaaguuugaggcugcagugggugaugacagggccacugcacuccagcuugggugacagagcaaaacccugccucuauuaguuaauugaacaaacaaacaaauguuuucaguggaauuuucuucuagggauuuaauugugcuuuugaacuugaguuuacucuguauucuaauuugaggugacauuguucaaaaugauucuuggcaaauguaaucccuacuacccacuuuucaugaaguauaaauaccuuugaaacagcaucucaguuacugugauuuuuuucauuguuucagauaggugauguucaguggcggggcaggugguuaaaaccuaaggucugaucugaucacuuauaacuugguucugagugaugaaggcaaguuauauaacacuuaguaggauuuuuuuauuaaaauuuucgauaugaaaauuuuuuaauuggauagcuuguauagucaaacuuuguacuucuuaaauaaguuaauacuccauuuuaaauguccuguuuguucugaggaagguaaggauacucaauuccaaacauuucuuucaguuaauccuuuauaguaugugugguccuagaaguagauacaugaggcauuuauuuagaguuggcauugggucauguaaauguaagccccuauuuguacauuaaauaaaaaguaaauuucuguugaaaucagaucagacuuauuucaaauugguugaaauaauacugauuauauuaucuaauuaucuaaucuguuaucuuguacaacacacaaaaaagacguaaaguuaguaacaaaaaugguauauauaauuacagguauagauuuccccccuaacauuuuauuaagcaguauuaagaaaauguagcaauauugaaaugauuuuacaaugaaacuuguauauccaucaccuggauucugacauuaauauauaucauacugauuuauuacauaucuguucaucuguucauucaucagugcaucuuguuuuuugauggauuucaaaguaaguugcagauaccaguauacuucucccugaauacuucaacaugugcauguuauuaacuagaauucacaaauacagauuuuuaguuuugcauauuccucauagaagaaucuaaacgguuggguguggugauucaugccuauaauccuagcacuuugggaggcugaggugggcggaucccuugagcccaggaguucaagaccagccugggcaacauggugaaacccugucucuacuaaaaauacaagaauuagcugggcauguagccuguagucccagcuacuugggaggcuaaggugggaggaucaccugagccuggggagguugaggcugugguaagcaauaauggcaccacugcacuccagcuugggugacagagugagaccccaucucaaaaaaaaaaaaaaaaaagaguguaaacauuuaauauuucagauauuugaguaauaaguuaguaaguuaugguaaaugaacuucauaagaaauugcaacaaauuuuuacugagcauuucuagcaucuguuuuuaacuuuguuauacuuuuugaugcuuuuaguggauuuuccagagaucuguuugguuuuuuguuagaguccucaccuugguuucaucucugauauuuucuuuuucuuuuuuuuuuaauuuaaaacucauauauuuuuaagccuuuguuuuaaaacaucucauguuggccaggugugguggcucaugccuguaaucccaacacuuugggaggccgagaugggugaauuacuugaggucaggaguuugagaccagcuuggccaacauggugaaaccccaucucuacuaaaaauacaaaaauuagccaggcgugguggcaggugccuguaaucccagcuacucaggaggcugaggcaggagaaucgcuugaaccugggaggcagagguuguagugagcugagaucaugccacugcgcucuagccugggcaguagagcgagacucagucucaaaaaaauaaucucguguuaauuuugcugcugcuuuuuuuugucucuccauaauuaaaacuuaacguauuguagcaaauaucuacuucugauacuaguuuuuuuaauugaauuuaucaacauauguagaaauuaguauuauuuaaccucuugacuagcuguucucuaaaaauaagucuaaaugcuaggacauccuuacuuauuauauauagaaaaugugacuuucaaaugugggucaucuuaaguaugcucucauuggagacaagacuugugaguauuaugcuucaugugugaugguguaguuuuccaguauacuuuaagauugaaaauguugcucaggagacaauuuuaaaggauggguuauuugccuauaucuuaauuuuuuauaacucuacaaauucucauucaccuuggugaggcauauguagaaacaguuuaaauucuuauucaggcauauguagauagaaguuugugcuauuuauuaguugguguauguaugcauuauuauagaguaauaaagaaucauuuuauuuuuugcuucuuucauuaugcuuuauaguacuuacauuuaucauuuugauauuuagugcaaagaaaugugcugcaugcauugagcauuuuucuacaaguuuuuuucccccugaugugcuauuucacauaucacaggccuuauuuuuugaacaauugagcaaaagaaacagaugaaaccucauacaaaacccuccaaaauaugaaaaugugggguuuauuugugcuaaugcucuucuuuuggaaacauuuguguuaaagguaaggucaauuuauugauuuaaaccacauuguauguaaaaauguauuauccaugauuaaacuuucuaagacauuguucuugauagaaaagauuuucuaacuuguggaauaaaaagauuuauuuugcaagugucagaaauauuaaaauuaauuauucccaaguuuucuuaaauauuaugcaaaacuuugaucuacagcuuugacauaauuuucuaggaucuuaugguuggugaugaggcaagugaauuacgaucaauguuagaaguuaacuacccuauggaaaauggcauaguacgaaauugggaugacaugaaacaccugugggacuacacauuuggaccagagaaacuuaauauagauaccagaaauuguaaaaucuuacucacagaaccuccuaugaacccaaccaaaaacagagagaagauuguagaggugaguuuuuaugcaggauaugcauauguguauuucugugauauuauguuaaaucaaaaauuuucuuacuguugcuauggauaaagagaauaaaaauaauuguuuuccuucagaucuuauuaaguaucuacuauaugcuagucauuauucuaaguaggaaaguaggauagaucaguaaacaaaaaauccuacugccauggaguguauauauucuaacagggaaaaacagaccaaaaaaauuaaguuuuuaauuuagugaguuaauuaaguuaauuaaguuuuuauggaggagccagcagaaggagacugaaaaggcuaauacaauaagcaguuacagaguuaauuaaaugguuuguuagaaggugagugauccaguugacccaugagcaaugcagggguuaggggcaccaacccucccuacucacgugcaaacuuaacuaccacccaaaauacuuaacuucuaauagccuacuguugaccagaagccuuacugauaacauaauauguauuauauacuauauucuuaacaauaaaguaagcuagaggaaauacuguuaagaaaaucauggccgggcgcgguggcucacgccuguaaucucagcacuuugggaggcggaggcgggcagaucacaaggucaggagaucgagaccauccuggcuaacacagugaaacuccgucucuacuaaaaauacaaaaaauuagccgggcgugguggcgggugccuguagucccagcuacucaggaggcugaggcaggagaaugacgugaacccuugaggcagagcuugcagugaguggagaucgugccacugcacuccagccugggcgacagagcgagacuccgucucaaaaaaaaauaaaaaaucauaagagaaaauacauuuacuauaccuuaaguggauguagaucaucauaaagaucuucaucgucauugucuucacaccgacgaagaagaggagggguuggucuugcugucucggguggcagagacagaagaggugcaaggggaggcaggaaagauuuauugacaaaaaucguguauaaguggaccugugugguucaaacuuguuguuauucauggaucagcuguagaugcuaaaggcaaaauaaaucagguuaacggggagugggagguuguaauuguacauagguugugagaaggugauguuuaaacagacaggguaagugaguuagccaggguauauaggagaaugguauuccagauaaagggaguagccaguguaaaggucuuaaguuaggaacaagcuugguauauuaaagaauaagcaaggaagccagugugguugaggagagagcaacagaagaugaggucgaguaaguaauauuggugccuuguaggcucuaauuaggaauugggcggcuggaaguggugguucaggccuguaaucccagcacuucugggaggccgaggugggcggaucacgaggucaagaguucgagaccagccugaccaacauagugaaacgccaucucuacuaaaaauacaaaaauuaacugggcauaguggugcgugccuguaaucccagcuacuugggaggcuggggcaggagaaucgcuugaacccaggaggcagaugcugcagugagccgagauuacaccacugcauuccagccugggcgacagggugagacucagucucaaaaagaaaaaaagggaauugggcuuuuacugugggugaaauauggggcuguuacaggaaaaggagaugcucagauuuagauuucucuuguguugugaguaucccacaaggaggcaaagauagaagaguuggagacuuuuucagucauuuaagcaaaagauaaugaugguuaggauugaaguaguaguaguagagauagugagaaauuaccagauuauaggucuguuuugaagguagggcuauaaaugauacgguucaacaaagaagaggguagacaguggugaaaaggccaaggaccagagagauaggaggagccagcagaaggagauugaaaacguuauugaggccgggcuagguggcucccagcacuuugggaggccaaggcggguggaucacuugagacuaggaauuugagaccagccuggccaacauggcaaaacuccgucucuacuaaaaacacaaaauuagcugggcauaguggugcacgccuguaaucccagcuacgcaggaggcugaggcaggagaauugcuugaacccaggagguggagguugcagugagcugagaucaccccacugcacuccaaccugagcgacagagcgagacucugucucaaaaagaaaaaagaaaaagaaaaaaaaaguuaaugaaauaaugaaauaagcaguuacagaggaaagagagagcaagagagcuaugauccucauaguuuaaauaaguaauuuuucaagguucuuuuauuuuuguauauaugaaguagaaauuuaauaacuucuguagcuuuccaguuacuguuuaauguacauauuuuguuuacgaauauguuuaaauguugauggaaauuuuugaaaggguuuagaagaaaauguuguuaguauuuuuaaagccuguauuaaaacucaguuuuuguauuaaguguuuugaaaaucuaagaucaugguuuuaaagaauccauaugauuucuuauggcuuauauuuuaauauucuuauuuguuuaugacuacaaauaugucuaugacugauaguguccuaccuuaaucucauuaacaugcuuucacauugguaugugcauauauaugaucauucuuccauuuucaucccuguggagguggaauaaaggaugauggaauaaaauacuauucagacuaucuaauugcuuaauugaugaguauguguuucagaguuguagaauuuaaauucuguguaauuuucauuguggucaguuguaaaauuucuaaauauuuagauauucagagugauaggcaacccuaccagucaaggggugcucagucaagaucaccaaaaaaaaaaucaugcaggauguucccagcugaccugggcuacagagaaugaacaugugugugaccagugagggcaaaaaggaaagaacuccuccuuccaggguaguucauuuggagguuguaauuacagucuugauucaaguagggacugggcucagcagcuaagccauuucuguaucuuccagcaaucaggaauuaaccauugauuuuugucuuugccguggcauuuuacuggguuuuuuauuuuuucuuucuuucuuucuuuuaauuuuuaagcugcucaggguagacagagcuacacucuuggcccagauugagggaggggguacgaggcucuguaaagcaauuucuauauuuugucuucgaauuaaaagauauuucccggccgggugcgguggcucacgccuguaaucccagcacuuugggaggccgaggcaggcggaucaugaggucaggagauggagaccauccuggcuaacacggugaaacccugucucuacuaaaaauacuaaaaauuagccggguguggugguguacgccuguagucccagcuacucgggaggcugaggcaggagaauggcgugaaccagggagguggagguugcagugagcugagauggcaccacugcacuccagccugggcgacagagcaagacuccgucucaaaaaaagaaaaaaaaaagauauuucccuggcuggaugugguggcugacaccuguaaucccagcacuuugggaggccgagguggguggaucaugaggucaggaguucgagacuagccuggccaacauagugaaacccugucuguacuaaaaauacaaaaauuagccaggcaugguggugcaugccuguagucccagcuacucaggaggcugaggcaggagaaucaguugaacccuggagguggagguugcagugagccaagauugcgccacugcacuccagcuugggcaacagagugagacuucaucucaaaaaaaaaaaaaaaaaaaaagaauuucccuuaagggauaucaauuaagaaagucuuguucaauacagagagcuuucuuucacacuaauuagucauuaacuaauacacuaagaaaucuuugcuuugucacgcuuaugaaaugcuuggggacuuagaaaucugucuucagauuuggagcucuguggcagcaggacuucaauaagaaauaagaggagcugaugaaaauggaagacuauuucagguccauuugauucuauuuugggcaauuaauucacucugugaccaugaggaaaacauuuauuuauuauguaauuuucuaaauaccaguuuuuuucuuucugucugcauuuacagguaauguuugaaacuuaccaguuuuccgguguauauguagccauccaggcaguucugacuuuguacgcucaagguagguuaagcuuaacuguuagaaaaaacacuucaucaaacauuuauuauguauguuuuaugucagagaauuugguuucucaauaaguuauaagccccagaaaacuacauuauuuauauaccacacuuugaaauauuuucaguuuuuaaaauuugugaaauaagauuuuauauacauuuuuauuugcuaaauauguauuuaagguaaaaaaaaaaggcuuaaagacuuauuuuuuaaaaaauaggauauucucucuuuuaagcuauuuaaauuuuuuuugagacagauuuucgcuuuuguugcccaggccggagugcaauagugcaaucuuggcuuaccacaaccuccaccuccuggguucaagugauuuuccugccucagccucccaaguauuugggauuacaggcaugugccaccacaccuggcuaauuuuguauuuuuaguagagaugggguuucuccauauuggucaggcuggucucaaacuccugaccucagguaguccgcccgccucagccuccugaagugcugggauuacaggcaugagucaccgugccuggcauagcuauuuuaauuuuuuaugcauggaauuuguccccagaauuggcuugaguuaaaaaaaauacgcagagauucaaaaagguagcauaaaaucaugccugucaaauauauaguagauuaaaaaggagaagguaaacauuugggagugcauuucuaacuuuugagguggguuuaauggaggggacuacuuauauauucucuugauauugccauuagcaacugccucccucuuuauuggaaauaaaauauuggccacguugggagagcucuuuuuuuuuuuuauggucuuauaaauucaacaggaacuuacugagaaugucugggccugucagauaugugccaaggagucuuuuaggcacuucaggggauaauccagugggaaaagaguguggcacuggaaaugggucaaguguguuuggagaaaggccaguaugugugugaccugauggaagugguagaaaauaaggugagguggguagggagggcucuuugggaaauaaaauguaaauucuugcauuagucaguguuccugggaguauuuuugaauugaugauggugugaauuccuccuuuuuuuuuucuuuuuugcaauggaaauccucuucuuuuuaaaagaguacaacauucaagggcuguauaugaguuuuaugaggcuuauugcaucaaggaauuauauccacuuaaaaaggagguaguuuuaggccgggugugguggcucacgccuguaaucccagcacuuugggaggccgagguggguggaucacgaggucaggagaucgagaccauccugacuaacacugugaaaccccgucucuacuaaaaaaaaaauacaaaaaauuagcugggcaugguggcaugugccuguaaucccagcuacuugggaggcugaggcgggagaaucgcuugaacccaggaggcagagguugcagugagcugagauugugccauugcacuccagccugggcgacagagugagacucugucucaaaaaaaauauguaaauaaaaauaaauaaaaaaaguuuuuuugaccagguaugguggcucauggcuguaaucccagcacuuugagaagccaagguggucaaauugcuguaucuccagaguuugagaccagccuaggcaacauagugagaucccuaucucuauaaaaaguaaaauuagcugggugugguugcacaugccuauaaucccagccacuugagaggcugaggugagaugaucacuugagcccaggagguugaggaaacaggggaaacaaagcagcuucuuugcuguucuuuuauuaugagguuuaacugacauugccuuuuauuauaaguuccagugaauaaucaaagugaugcuuuggcuagccauguuuaauuuuucuuagauuucuagcugucuaguaucaauaggcauuuuuccagaacacacaguauauguuauuuguaguauauucaaaacuaucuaaguugaaaaaaauaaagaauuguacagagcuuuaagaacguguucugcugggugugguggcucacgccuguaaccccagcaguuugagaggccaaggcagacagaucacuugaggccaggaguucgagaccagcuugggcaacauggcgaaacucugucucuacaaaaaaauuacaaaaauuagccaggcaugguggugcaugccuguagucccagcugcucaggaggcuaaggugggagguaugacuugaacccaggaaaugaagauugcagugagccuagauugagccacuguacuccuccagccugggugacagagccagacccugucucaaaaaaaaaaaggaaaaaaaaguccuguuuuucaguccucagucucagggucuguuucuucucaucuccuuggacagcacauaauaguagacuaaaagucuuaaaagagaacacucgcuuuaauacuuaugcauuagaaacaaacugcaaaauaacuaaauaauaaauucuggcuucuaguugguuacguuucuguuuuggcuucccuacuguauuuggaacucgcuggcuuugguuuuccugauuugacuuuuuauuuaaaucccccuggcuuuuaugcagguuuauugacugguguagugguagacucuggagauggugugacucacauuugcccaguauaugaaggcuuuucucucccucaucuuaccaggagacuggauauugcugggagggauauaacuagauaucuuaucaagguaagugaaaggaaaauaucauggaaauuaaauuuuguaauuuguuuaccaccuuaacacagaauugaaucuaucguuuuaggauuccagcaaaucuguaccacuagagaaauuauccaauuaccucccuuauuuauauaaaaauucauauaagauuuauacacaugaagaaaaaagaagauacauuaaaaacaaggaaaaaaguguacacacaugaucucuguauacuaaugagaguacauuauaucauuacauaauuauauuuguuauuccugaggagugaguagacagauauuucaaggauagaagagaccccuaauuugaaacuuucuuggacagcucaggcagccuuuucugccauaaaaccuuucuuugagcagguauguuuuaagccaugaucuugguuggguugucugcucuuguccuuuccuacaaaauacagugauagcaaauuaaugauauuugaggaaaacagcccaaauacgccagacuuuaauauuuaguaguuuucauggaauagaugcaguuuuuaauauuuacuauuuuaguuuauuucugaauauaacuaguuauaauuuucuuuaaaacauuacuggagaaaguacauaaggugucuacuugcuaacauauaucauuuuuaauauuaaaauaaaauuuagaaaauuguuuauaccacaauucuauaaucagucuauccucuccaggacagugguucucaccaggggacagugcuguccucugggggauauuagcaauuucuggacacauuuuugguugucugagcugggcaggaaugcuacugaacauucuauaaugaauagggcuggcugcacaacaaacaauguauagucugucaguggugcugcuauuaagaaacccugucucugcauuaaauuggguugcacugucuuuaccuugacauuggguuccuucagucucauuuaaaguaauccuccucaugaggggagauuaaauuaaugagaauuauaauacucucauuuuaggccaaaauucaaagcguaacuaacagaauuucugggguugucuuuagaacacagacucaaauauuagaggauuuuuuuuuuauuuguaaagucuaguaauuuuuuuucucucaguggguuuuuaaaaaaauaguaguauuuucuagcauuuaagaaauguaacaauggagauuauaccuuugaguaucccaauaauucccuuaucauucguuaaacaaaugcuauuguccuucuaauaugugccagacacaguacuagaagcuaaagauaaaacuuuuaaagacuugggggcauuucauaaauauggcauuaauugugugagcaaacugcaggcuacaggaguccaguacuaaaauaauauuuauucauuaauauacuuuugauuguuuaucaaaacuaucaaaacauuaguacucaugcagugcuuuucaaaaacugacuuuucuagucauuuuacugacuuacuuaugaauuguuaauucuuuuacccucucugaaacugaaauauaaauccuuuuauggcggauaaaauccugcuucugaaauaguaggagcugaggauccacugcccauucuguuuguuauugaugugacauauuuaaugagcauuacuagcuuuugcagaguagaacucauucagauguauuaugaacuuauugcuauuguuuuguaccagcuacuucuguugcgaggauacgccuucaaccacucugcugauuuugaaacgguucgcaugauuaaagaaaaacuguguuacgugggauauaauauugagcaagagcagaaacuggccuuagaaaccacaguauuaguugaaucuuauacaguaaguguuuccaguguauaauauauauguguuuuaaaguggacagccaugauuauuggugucagcuuaaggagguuuucuuagaaucaguauuuuugucuuggguuguuguaauauguauaugugugacuuuuaaugucucuuucuacauuaaguuucuauuuaauuauuuuagggcaccauauaaugcaaauuaaggcaagaaucauaaauuacucucuauacuaggauauaauuagaugcgagauguuauuuugagauucuaguauuuggcauagcauuucucaauguauguuuuacagaacuuuauuucccugagaugcuaauaagcauuucacaaaaauuaaaaaggauuacauugucagaugaguuugagaaagaguugauuucacuucacuguagaacucagagccuuugguaugcuaauaugggcacaauuaauauaguaugcguguuuuucagacuuaugcucuaggacuuuucagaauuucaugggauuagugaucuaagaaacauacuuuggaaauggucauucuagagcauugcuuuacuaauucaguagguggcagccuuuccugacuuaauauucuuuaaugagguguuaaauguuaacuugaaauuguaacuaaugagauuuaguaccugguuauaguuuauaacaccagaggaguugauccuacuugaauuuuuaaugaauuaccaucuuaagccuauuaaauuugucugaguauaaaguacuuccaggucucaucuuugaucuaguuauuacuaaaaugaaacaguaauaggcaaugaaggcaaguauuuuaaaaccauaugaugcauacuagcucuacauauucacaaauauaugcaaaauagucauuuuuaaaguaauuauaaaaaauuuguuguuggccgggcgcgguggcucacgccuguaaucccagcacuuugggaggccgaggcaggcggaucaccugaagucaggaguuggagaacagccuggccaacauggugaaacccgucuuuacugaaaauacaaaaaauuagcugggcaagguggugggcaccuguagucccagcuauucaggaggcugaggcaggagaauugcuucaacccaggaggcagagguugcagugagcugagaucgugccacugcacuccagccugggugacagagcaagacuccaugucgguaaaaaaaaaaaaaaaaaaaaaguuaagauagugauccaaauauucaguaaacccccauuuaaaauuuuuuuaaauuuauuuuuuauuauacuuuaaguucugggauacaugugcagaaaaugcagguuuguuacauagguacacaugugccauggugguuugcugcacccaucaaccugucaucugcauuagauauuucuccuaaugcuauaccucccuccccuugccgccccccacccaacaggccccauguguguuguuccccucccugugcccauauguucucauugucagcucccacuuaugaaugagaacauuugguguuugguuuucuguuccuguguuaauuugcugagaaugaugguuuccagcuucacccaugccccuguaaaggacaugaacucauucauuuuuuuauggcugcauaguauuccaugguguauaugugccacauuuucuuuauccagucuaacguugaugggcauuuggguugguuccaagucuuugcuauugugaauagugcugcaguaaacauaugugugcaugugucuuuauaguagcaugauuuauaauccuuuggguauauacccaguaaugggaucgcugggucaaaugguauuucuaguucuagauccuugaggaaucaccacauugucuuccacaaugguugaacuaauuuacacucccaccaacaguguaaaagcguuccuauuucuccauauccucuccagcaucuguuguuuccugacuuuuuaaggaucgccauucuaacuggcaugagauuuugugguuuugauuuguauuucucuaaugaccagcgaugaugagcuuuuuuucuuauguuuauuggccacauaaaugucuucuuuugaaaagugucuguucguauccuuugcccacuuuuucaugggguuauuugucuuuuucugguaaauuuguuuaaguuccuuguagauucugguuauuaaggcuuugucagauggauagauugcaaaaauuuuuucccauucuguagguugccuguucacucugaugauaguuucuuuugcuaugcaagaagcucuuuaguuuaauuagaacccauuugucaauuuuggcuuuuguugcaauugcuuuugguguuuuagucaugaagucuuugcccaugccuauguccugaaugguauuggcuagguuuucuucuaggaguaaacccauuuuguaacuuaaucaucuccagauuugcucuggagauuccuuccugaagucuucuugacaguuucucuaguugucugauuuuccaucuaccugacuauuuuggaagaaaguggcuggcacagggcaaaagauaagcaaacuaggaauguaaaacauguuuuauuucuuccuucucucuuuucucaaagaauuugagguaggcuacaaaaauauauacaaauaggcuggguguaguggcucacaccgguaaucccagcacuuugggaggcugagauacgaggaucacuugaggccaggaguucauggccagccugggcaauauaaugagacccugucucuacaaaaaaaauacaaaaauuugccaggcguaguggcacgugccuguaguccuagcuaguugagagguugaggugggaagauugcuugagcccaggaguucaaggcucaaguuuugaggcagagagcuaggauugcaccacugcacuccagccugggugaaggagcgagacccugucucaaaaacaaaacaaaauccauauauauauuugauauauauaugcacacacacacauauacacaaguauaaaguaauaagcugaugaauaagugaggagggacauggguggacaaauacagaacaggauaagauuuggugcaaagaaaugggaugccugcaguuuuaacaguucauuaaggugauuagaaaacuugaccccaugcuggccagcagccagagaauggagagaagccacacuaucaggcuucaagugcuuaaggcaggagguuuugcuaauaagaucugcugugugaaguuuuuccagauauuuugggugauuucaugugaacccaccugaagguggaggugguuuuuuuaaggguauaaguuuugguaaccuuuuuuuuuucuuucuguuuugagacaggguuuccucacucuguugcucaggcugcagugcaguggcaugaucucggcucacuucagucucaaucucccaggguuaggugauccucccaccucagccuccuagguagcugggaccaaagcuggaaucuaaacaaucauuguaauuggccaggcgcgguggcucuuccccauaaucccagcaauuugggaggccaagaugggaggaucauuugagcccaggaguucaagaccagucugaguaacaaagcaagacccccgucucuacaaaaaauaaaauuagccagccauaguagugugcaucuguagugccagcuacuugggaggcugaggugggagaaucccuugaaucugggagauugaggcugcagugagccaugaucacaccacugcccucuagccuggacaacagaugaagacccuaucucaaaaaaaauauauauguauuguagggccaggcaugguggcucaugccuguaaucccagcacuuuugggaggccaagccaggcagaucacuugaggccaggagcucgagaccagcccagccaacaugcagaaacucugucucuacuaaaaauacaaaaauuagccaggcgugguggcacaugccuguaaucucagcuacuuggggggcugagguaugagaaucauuugaacccaguaggcagagguugcacugagccacgaucaagccacuacacuccagccugggcaacagagcgagacucugucucaaaaaaaaauuaaauuauaaauguacuguuagacuuguuaauguaaaauuaauucugguaucucauggaaaugugucaaaugcuagcauacaugggcgugcuuauuacuuaggacaauccagugaauugugagguguuaugagaggaaguuucuacuuaacacuucucauuuaauuaaauaugaacaugaugugugacugacaagauuuuuuuguacaaagucauaauaugauaccugauuuguuuaaaucuuauuugcuuaaauugaaauuauauuuaucaguuacuuaaaauguauuaggaccuaguaggauacaacagaauugccuaauaaaaauagucuagaccaguguucuguaaacuuuuuugaucauaagacauuuuuuggauuaaaugauuugauagaagugguacacauguuauaaaguauuuuggcaaaauaauaguuucacagaguaauuauuugaugaaauaaaauuauuuaaaauguuuaauguggcuaggcgcagugguucaugcuuguaaucccaacacuuugggagguugaggcgagcagaucaccugaggccaggaguucaagaccgccuggucaacaugaugaaaccccgucuuuacuaaaaauacaaaaauaugcuggcgugguggcacaugccuguaauccgagcuacucaggaggcugaggcaggagaauugcuugaaccuaggagacagagguugcagugagccgagaucgugccauugcacuccagccugggcgacaagagaaacucugucucaaucaaucagucaaucaguguuuuaacaugucuguucuacauagcagaaauauccauaaaaucacaaauauguuaaaauuauaaaacuguaguaacacauaccagcaauaaucaaaauacaaugguuggucagugaugcuuguuucugcuuugcugcaaacaucaugcacucaugcaucagugauuucuccaagaaauuccugauauuugggggcguggcauaccuuuuuuuuuuuuuuuuuugagauggagucucgcucuauugccccugcuggagugcaguggcgugaucuuggcucacugcaagcucugccucccggguucacgccauucuccugccucagccuccccgaguagcugggacuauaggcgcccgccaccacacccggcuaauuuuuuguauuuuuaguagagacaggguuucauuguguuagucaggauggucucaaucuccugaccuugugauccgcccagcucagccucccaaagugcugggauuacagacgugagccaccacgcccagccuggcauaacauuuuuaaaagcaaaacagaaugugauaagagcaguuaccuaaaucuauuuaauuuaccuuuuuuuccccaaauauauuuuaggaaaaauuguuguugguaaugauuuugguuacagaacagauguauuuauaaguacuaguguuccggagaacacugggaaauuuuaaucuuuugcugauuaguaccugauuauucuugguuucuagcucccagauggacguaucaucaaaguugggggagagagauuugaagcaccagaagcuuuauuucagccucacuugaucaauguugaaggaguugguguugcugaauugcuuuuuaacacaauucaggcagcugacauugauaccagguacauuagaaguggugauuucaaaguuauuuaucagaaaaaucauaaaaauaguuuuaaaguuauuuaucagaaauagauggaauuaaauagaaugacuaaguuuauaaacuuacuugaaauaauuucagacuuacggaaagguugcaagaaaaaugcagaaaacuuaucuguauccuuuaucuggauuuaccauuuuacuaauucuaauguucuucauguuugcuuuuucauucuguuuuuucugaaccguuugaggguagauuaaaugcaucaguucuuuacuaguugguguuuccuaaggauaaagauacucucuuacauagucaugcugauuucagauccuuuggagauacacccaguaguggaauugcuggaucauaugguaguucuauuuuuaacuuuccgaggaaccuccauacuguuuucuguaauagcuguacuaauucacacucccaccagcaguguacaaggguuuccuuuucuccacauccucgccaguauucguuaccuuuccucuuuuugauaauagccauuccaacagaugugaagugauaucucauugugguuuaauuugcauuuauuucccugaugauuagggaugcuuagcauuuuuuccauuuguaugucuuuugagaaaugucuauucagguccuuugcccauuuauuaauuggguuauuugcuuucuugcuauugagucauuugagauuugaguuccuuacauauuuuggauauuaaccacuuaucagaugucugauuugcaaauauauucucacauucuauagguuauaucuucacuuuguugauuaauuccuuugcugugcagaaacuucuuuuguuguuguuuguuuuuugagacggaaugucacucucucacccaggcugaaguguaguggugcaaucuuggcucacugcaaccucugccucccguuuucaagcgauucuccugccucagccucccaaguagcugagauuacaggcauguaccaccaugcccagaauuuuuuuuuuuuuuuuuguauuuuuuaguagagaugggguuuugccguauugaccaggcuggucucgaacuccuggccucaagugauccaccccaccucagccuaccaaagugcugagagaaacuucuuaguuugauguaaaugcauguauauuuuuguuagauauugccaaauuucccucucuggcaauuguaucguuuauccuuuuccaccgaucugaugagugagaaauuauuucaguguaauuuuacuuuuuauuucugucauuaagagugaagucaaaccaggggugguggcuucuggcuguaaucgcagcacuuuggaggcugaggugggagguuugcuuaagccuaggaguuuaagaccagccugggcaacauauggagauccugucuuuacauaaauuuuuuucaaaaagauuagccagguaugguggugguguacuccuguaguccuagcuacucagaaggcugaagugggaggauugcuugagcuugagagguagaggcugcagugagccaugauugugucacugcacuccagccugggugacagagugagacccugucucuccccaccgccacaaaagaaaguuccuaaaaaaaaaacauauauauauauauaaaacauauuuuuauauguuuaagggacuuguuuguuuguuugagauagagucucgcucugucgccaggcuggagugcaguggugcagucucggcucacugcaaccuggguggagugauucuccugccucagccucccaaguagcuggaauugcagacgugagccaccacgcccagccuuaagggacauuuuaaauuuuuuuuuuuggcaaauuguuaauggcuuuuuguagauuuuggaguuuuggguuuuuuuuuuuuucaguuuugaaaaguuuucuuuuagcuuucugauaucuuucacagauacucucucuguuugccauuugucuauugcucuuaguguuuuggccaugcaaaaguuuguuuuuauuuagucauauaaaaagauuuauagucuuauuacaucuagagcuugagucauaguuagaaaucccuucucuacacucagguuauagaggaauucacccagaagcauuuuguacagcaagcauuuauuuguguaacccugaguuaaauagccaccuaauuaauuuugaugggauggcuuuggagccaggauaguaauagaaauuaauaaaaauagcaauugacucauaacaagcuauaaaccugguagaagaugaucagaaaucgaaucuagccuucauaauuaugguaaauucucaugauagggauuagggagaugauuuuguucuuugauguucauucacagcaaaauuguauuuaaaaguacaugccagcugggcgcgguggcucacgccuguaaucccagcacuuugggaggcugaggccggugaaucacgaggccggcgaaucacgaggucaggaguucaagaccagucuggccaaaauggugaaaccccgucucuacuaaaaauacaaaaaauuagcuggguguggugacgggugccuguaaucccagcuacucgggaggcugaggcaggagaauggcgugaaccugggaggcggagguugcagugagccgagaucgcaccacugcucuccagccugggugacagagugagacucuguauuaaaaaauaaaaaaagaaaaguacaugccuguugcugauuagagcuucgacguaccuaaagugcggagucagauucaguaccuucuccacagaguuugcauugcaaaguggaacaacucaaauuuuguuuuguguguucugcauguugaaaauguacauguaaaugcuugugaguacuuaucacaugaaucuguauuucaacugcuuaguuuaugcgacauucacugggcuugcuauggcaauuaaauacaaaagcaaugcuuuguuagaguugcaguagcuuuagccauugagaaccuggaagccagguugaaaaaggccaaaaugggugcaaaucagcucccaaacuuuacugugagaauuauuccucagacccucgcucagauucuguuacuuuuacuacauaugcagucuuuuuagauuggauuuucugaucucauagauaucagaauagaggguacugcugucaguagauagcaggguacuguaucagaaaagaggguacugcuauaagaagcauacacaucagucuagccaaaaauaacagcagacagccucuaagcaaaggaacaaaaaagaaaacuacaaaagauaaaugaaaaauuaaaaagcaggaauucuggauuaaaguagaauagggcuaauuauaguaaacaaccacaucuuaguggcuuuagggaagcaugugauaaaauaguuuguaauguaaaucuuggucauuauuagaagucucaguuauauucacaaaaaaguguauuauauacuuuuagaaguauuuuauuuucaucaaaauuaugaaaagauuuuauauguaaagaggggucguuacuucacaguaguaauaacagcaaauauucagcccugugauuuacauguggaauuuuauuuaauucucccagcaaccccgaggcugacauaaguaacaguaacccugagauaccauuuuccuaaccuaaaacuccaaaugaauaaccauugugccuuucuagaucugaauucuacaaacacauugugcuuucuggagggucuacuauguauccuggccugccaucacgguuggaacgagaacuuaaacagcuuuacuuagaacgaguuuugaagggugauguggaaaaacuuucuguaaguauuaguaaaucaacuauuacuaacauucuuuuaaaaggcuauacaguaguuugugaaucuugacaaccaccagagggagcaagacgucuuccaaaacaaauuccuacugcagucaagugcauccuggaaaugauagcaagaaggaaauaguucaagauaagcucuggucaccucuauagaguugguggauggaggcagugaggucagggccaaaaguucugguucaucuguaacaaccagcacggacucugaggcaccuguauaugcaugagaagaaccugcuguacuauagggaaauaaaugccccacuugaguuuuguucuuuuuuuaaacuuauuuuuuggauaugcaaucagccuucagcacuucucuugggcuaucucauauuucugacuuuauuuguugcauauguugucuucucagucagauugaaaaacaucaugucucaaaauuuuuugcauuccggugacugucauaacucuugaaacagacuuuaauugguuguuguugguauguacaguagaaagaaauuuuuaaacuagaaauaguugauguuucuuuggcauagguuuuuguguuuuuuccaccagacucuggacuaugugaaguauacaguaugugcuguauacuuaaccaagaguuaucuaauccugaguuaaucucugagcuuugucucacugacuuugaucaacuguuuuagauaaugagauuauguauuacagaguacuguauguuacaucuuucauauaugacucauuguugaaauuaaauugaguaugggcucacauacauuaaacagauuaacagacuggaaaggagccauacugucuaaguacuucacuuauuuuucugauuuuauugaguuuuacauauaauuuauaauuaaucucaggugaucauuuauucagcaaacauuucuugaacuccugggugccagacauaggucuaggugccggggacaaacaaaacaaugaaaacagaaucccugcuuuuagucuaaauaauguauuagugguaauaagugauaugaagaaaaguaaggugaagagcuggaaaauguuagugguuggggagguagugugcuccuucauaaacugugaucaggaaaggccuuuuggaugaagugacuuuugaucagagaccuaaguugagcgugagaggagugagccuugugacugucugggggaagaaucuuccaggcaggaaaaaugcaaaagccccagguuggugggagugugccaguguggcuggagcagagugagcaagggaggggggcaggugggauaugaggucagaaggguagcaggagggcaggucuuguucagccaugguaaaggguuuggcuugacuccuggugaaauggaaagucuugggugugggggcgguuuaagcagagaaaugauaggaucugauguauauuuuuaaaggaucauuaagucugguguggugaauagacucuugggggaagagggaacaaaggugggcauagagagaccaguuaggaggcacugagaggaggggagggaugguagaguuuuagaauagaggaggagguugaaaugguuguuuuggagaauggaagcgagaauagagaaauguaauaggauugccaugcagcaggaagggcucaguugagguuagugauacauuauagcaagauguuuuguuucuuuccuaucuuguucagcugcuugacagcaggugcaauuugucuguaggaaucuguagaugaguucagcaaggagggagugguagauggaaugaucugauagaaugaguuucaguggggcuauggaguuuuagggaugagcgagauagaagcagcaaugaagagcaauaacucauauuaccaaaccuccaggguuaagguagugugugagagagaaacaguaaagcaguugagguauuuacagaagcagugucuucaggggcuagcuaaguuucccuuagaguagagguggucaucuauagcccuuaugccaaaacugguuuguuuguuuuuuuuaaguuuuauuggaacacagccaagcccauuuguuuacauaauguuaccuguugucacauauugucugugggcaccuucuagcuacaugugggguuggguacuugucacgccuacaaagccucaaguaucuggcccuucacaaaaaaaguuugcugaccccuauguaagagcaagaaaguaaaaggaacaauuaaaacagucucagaauugguaaauaaacugauguuuuucuuuaucuuggauuguuagaacccuuacaguucauuuaugugacauaaauauacaaaugauuuagaaugacauaguuacauugggucuuuuuugcagaucgugauacuguaaaugaaaaacuugcuaugucauuuuaagguuucucuuucagguguugaccaaccauaaagauaaggauguguccuuccuagacacuuaauaguagcuacagaguauaaaacuuuucccaauugccuuuaauuuugguuacuguguucauuuucucauaacauccugaugauuuguuuugaccauauuuggccuuguuuauuuuaagaacauuucauuugauuuugagacaauagaaaguaagcuuugcuuaaaagaaaagaacuucaguuuuacucuauugcccuggacuagaaucauaacaguaugagaccuugaagaagucaugcaaguccucuuuuuuuuuuuuuuuuuuuuuuuuuuuugagauugagucucugggcucacugcaagcuccaccucccagguuuacgucauucuccugccucagccucccgaguagcugggacuacaggcacccacuaccaugcccggcuaauuuuuuuguauuuuuaguagagacgggguuucacuguguuagccaggauggucucgaucuccugaccucgugauccgcccgccuuggccucccaaagugcugggauuacacuugagccaccacacccagccaugcaaguccucuuauccagacuuugcuugacagcaaagugacuuucccaaguggucaucugccauuggaugggaaauuugcucuaauuaugucuuggauguuuggucucucaguaggguguuaagucauguaauuuacugaucaaauuaggacacucaagaauggaaagggugguauuaauaaugaugggacaccacguguaaaucaggacuguuccaagcaugcugggauggauguguggucuccuaaacaugagcuuugggcaaauuacuaaauguuucuguaccucagguaccaaauauuacguucuacuuauauuacaggacuguugcaaguuugagggagagcauauauuuaaaaagccauuuucauaaagcagaaagcacugugcacauguaccauuucauuauccuuucuuucuccuuuagaaauuuaagauccgcauugaagacccaccccgcagaaagcacaugguauuccuggguggugcaguucuagcggauaucaugaaagacaaagacaacuuuuggaugacccgacaagaguaccaagaaaaggguguccgugugcuagagaaacuuggugugacuguucgauaaacuccaaagcuuguucccgucauacccguaaugcuuucuuuuuuccuuuauugccaaucuuugaacucauucaacuccaggacauggaagaggccucucucugcccuuugacuggaaaggucaaguuuuauucuggugucuuggggaagcuuuguuaaauuuuuguuaauguggguaaaucugaguuuaauucaacugcuucccuacauagacuagagggcuaaggauucugucugcugcuuuguuucuucuaaguaggcauuuagaucauuccuauaggcuuccuauuuucacuuuacugcucuaaugcugcuagucguagucuuuagcacacuaggugguaugccuuuauuagcauaaaacaaaaaaaacuuuaacaggagcuuuuacauauuacugggauggggggugguucgggaugggugggcagcugcugaacccuuuagggcauuuccucuguaauguggcgcuuucaacuguacugcugcagcuuuaaguaccuuaaagcuucuccugugaacuucuuagggaaauguuagguucagaacuaaaguguuuuggguggguuuuguugcgggggggaggguaacaauggguggucuucugauuuuuauuuuugagguuuugucaacuggaguacguagaggaacuuuauuuacaguacuuugauuuggcagguuuucuucuacuugugcucugccuggagcuguuuccauaugauauaaaaagcaaguguaguauuccauuacuauguggcuuagggauuuauuuguuuuuuaaaaucaaccauguuagcugggauuagacucccuacaguccuucaauggaaaaguaacauuuaaaaauccuuuggguaauucgaauuacagauuuaaaagagcuuaagaucugguguuuuguuaaugcuucuguuuauuccagaagcauuaagguaacccauugccaaguaucauucuugcaaauuauucuuuuauauaacugaccagugcuuaauaaaacaagcagguacuuacaaauaauuacuggcaguagguuauaauuggugguuuaaaaauaacauuggaauacaggacuuguugccaauuggguaauuuucauuaguuguuuuguuuguuuugauuugaaaccuggaaauacaguaaaauuugacuguuuaaaauguuggccaaaaaaaucaagauuuaauuuuuuuauuuguacugaaaaacuaaucauaacuguuaauucucagccaucuuugaagcuugaaagaagagucuuugguauuuuguaaacguuagcagacuuuccugccagugucagaaaauccuauuuaugaauccugucgguauuccuugguaucugaaaaaaauaccaaauaguaccauacaugaguuauuucuaaguuugaaaaauaaaaagaaauugcaucacacuaauuacaaaauacaaguucuggaaaaaauauuuuucuucauuuuaaaacuuuuuuuuaacuaauaauagcuuugaaagaagaggcuuaauuugggggugguaacuaaaaucaaaagaaaugauugacuugagggucucuguuugguaagaauacaucauuagcuuaaauaagcagcagaagguuaguuuuaauuauguagcuucuguuaauauuaaguguuuuuugucuguuuuaccucaauuugaacagauaaguuugccugcaugcuggacaugccucagaacccugaauagcccguacuagaucuugggaacauggaucuuagagucacuuuggaauaaguucuuauauaaauacccccagccuuuugagaacggggcuuguuaaaggacgcguauguagggcccguaccuacuggcaguuggguucagggaaaugggauugacuuggccuucaggcuccuuuggucauaauuuuaaaauaugggaguagaaaacaacaaagaauggaauggacucuuaaaacaaugaaagagcauuuaucguuugucccuugaauguagaauuuguuuuugauuucauaauucugcugguaaaugugacaguuaaaauggugcauuauguauauauauuauaauuuagaaauaccauuuuauaauuuuacuauuccagggugacauaaugcauuuaaauuugggauuuggguggaguauuauguuuaacuggaguugucaaguaugagucccucaggaaaaaaaaaaaauucuguuuuaaaaagcaaucugauucuuagcucuugaaacuauugcuacuuaaauuuccaauaauuaaaaauuuaaaauuuuuaaauuagaauugccaauacuucuacauuugagaaggguuuuuuuagaaauacauuuaguaaaguccccaagacauuagucuuacauuuaaacuuuuuucuuuaaaacaugguuuuggugguuaacuuuuacacaguucugaguacuguuaauaucuggaaaguaucuugagauaucaguggaaagcuaaacagucuaaauuaacaugaaauacuucauuuugauugagaaaauaaaaucagauuuuuucaaagucaauuu

SEQ ID NO: 192217 - RNA, 43448 nt, Homo sapiens
cagguacgcaugccccagaggcgcggcgcuuggcgggaagcugaguccuggccuugcgucgcacugucuguccucagcucgcguagccgcgcucgcgacucccuuucccggcaugccaggcggugcggccgcccucugggccguguaaaggccccucggucuaaggcuucccuauuuccugguucgccggcggccauuuuggguggaagcgauagcugaguggcggcggcugcugauuguguucuaggggacggaguaggggaagacguuugcucucccggaacagccuaucucauuccuuucuuucgauuacccguggcgcggagagucagggcggcggcugcggcagcaagggcggcgguggcggcggcggcagcugcagugacauguccagcaugaaucccgaauagugaguucaggagagcaccggucggcuggguccgugggccagcuugggggaucuuaaaggggucgaggaggguuggggcagaagucggggcaucggcuggggugaggcgagggugaugggucaggagaggcuggcggccgggagucgggccccauugucugacgcggaggggcggccgcgcgggggaggggucgggccggaggggugagccgcccgggccuggaccgggucagguuagagggccugacugcggggcgggugcugaggaagccugccgaggggccuggggcggugugaagggguaucuucucucggaggcagugacuuuugaaggaggacuugucucuaaggggaggggauggggugggagagcccuucuagagggcacugucagacccugcgcccgcacucugcggagcugucaggaucuucgggguagaaaccagcuuuacuuguaaauccugagcuuguuggcucucucuccuuccauccuccccgccagguuucagguaauauggaugcuuuucgggacugcgugggauugaggggaaugaguagauggugagaagcaacugaacauuuauuaguucucuuuuugaguugugucuuggaggaguuguuuaagagcucgccggguccauugcccuccuauaaaaaccugggcauuugugagaauuuuguuuuuuuuuuuuuuaaagaggacaccuaagucauuuugucuucugugggucaagggaaaaaaaaaaaacuaaagccaagaaaugucuuuuugauacucgcagauuaaaggaagcuugcugucaaguugaaagagaaacgaacgggaccuaugauagaucuguauguagguuuuggauuaccugcuuggaugcuugcagauagggaaugagguuccaugacgugucaugaaaaguuaaugcauuucuuuuucuugcuuacucaagaagucaccacagcagaugugacacaccuggcaccuuuccugggaacugguguucacuucccuuggguagaguuuguugggcucuccucaauggcccuuuaaaaauuuccucuacaguuuacaugcauguaaaguaaugaauaauuggaagagaccgaauugguauuccuuuucagugucaaaggccuuugagggaugggggaacaucaguauuuguuguaaaaguugaguuuauuugcugguuuggucaauuacugcuagacauuuuccccuaaaagguccacccaccaguuuagcugacugucauaugugugucacauggcucuugcaaaaugcuuacaaguuuuguaauaguguggcuugaagcugaaaucuuuugcacuaaacagaaaccguaguauuuuauuagaauuucauguuuuagaaguugaggguaguguucuuguagugacauuugcuguguugacaguuuaaaaaaaauuuuuuuucaagggcuccaaggacaaaguugguuuugcacaguugaacggaggugaacuugagguucuuaauuuaguaguuuucuugguaacaauaaagaacauggauuuacugcuuuaucgagguuuauagaccucuacuguucaggaaauuuucugaauuugcuauauauauguuuauuaguguaaauaaaucuucaagauuaguugagaacuuugacaaguuacucagccucugaauuuuuuuucccuuuuguaaaauaggauaauuggagucauuauuccugucaggguaguggugaaauucaaauguauauaaaagaauuugaaaaaccgugugagcauucuucaggugguaugcaucauuuucaugaaaggcauucuauuaguaccaggauuuaggaauauaauccuugcgcuuaagaaguuuagauauaggccaggcgcgguggcucaccucaguaaucccagcacuuugggaggccgaggcgggcggaucccgaggucaggagaucgagaccauccucgguaacacggugaaaccccgucucuacuaaaaaugcaaaaaaauuagccgggcgugguggugggcaccuguagucccagcuacucgagaggcugaggcaggagaauggcgugaucccgggagguggagcuugcagugaaccaagaucuggccacugcacuccagccuggacgacagagcaagacuccgucucaaaaaaaaaauuauuuauuguuuugagacggaguuucaaucuuguugcccaggcuggagugcaauggcgcaaaucuccucucaccgccaccuccgccuccuggguucaagugauucuccugccucagauucccgagaaguugggauuacaggcaugugccaccacucccggcuaauuuuguauuuuugguagagacgggguuucuccauguuggucaggcuggucucaaacucccgaagugauccgcccgccucagcuucccaaaguguugggauuacaggcgugagccaccgcgcccggcagaaauagauuuuauacaugucaaauaccaguagauauagcaaauuccagauguguggcauggaugagagcaacaagauuucagggggaugguggguugugguuggcuaucuggguuuuggaagacuuuauagaagagagaccugaaagggauuuaucagcaauuagauuuggaggaacagagggagugacuaggaauuuucaagggggagaagaaggaggaauggcucauaaaugacaaggacaguaauuaauaaguaaauacggugucaaaucauccuuucuuuugaagacuaaugaccucaaagggaucaaacccagaaacaguuuuuauauuuuuucugggaucaaauacauggguaucuggccuacuauauuuguauucuagacuguuuaguaaaauaauacaggaauuugagaaaaccuuugcaaaaguguuagugaaaauuacuuagggugagaggaagugagggauauuuuauuaggggaggucacaagggcagugagcaaucagauuuuuaguaaucugacuuaagcaguuucuuuuuguuuuaaugaagcuuguuaucuuuauaaaaguaauuagagaaaauuuggaaaauaaaggaaagaaagaaaaguucuuuaguguuuuaucacgcaaauacaagcucauucguuuuuaacaucuuguuccaaacuccaaagucuugcuuucucuucaauuaaaacuuuaauggguggaugcuuuuccugcuuccaguauguuaucuuaauaacuaacaaugguauauuagcuaauguuuacaaauguacuccagauguuccuuaaguuacuuugguuuaucauuaccaauuuauauuguuucuuuuagaaauuuauaaucuuuguuaauggguucugcuaaauuugguagugaaaaugggaucuugagaaaaaagauucugaagcaacagaauuuuuagauuuauauugguuuacauaagaguugguagcuguauuacuuuuuuuguuuguuuuguuuuuuuuuugagacggaaucuugcucugucgcccgggccuuggccucccaaaguguugggauuacaggcgugagccacugugccuggcuguuuguguuuuuuuuuguuuuuguuuucuuuucuuuuucuuuuuuucgagauggagucucacucugucacccaggcuggagugcaguggcgcgaucuuggcucacugcaaucucugccuccuggguucaagcgauuuuccugccuuggucuccugaguagcugggauuacaggcauuugccaccauaaccagcuaauuuuuguauagaguacccagccaucucuaauguugaucaggcugaagcagguggaucaccuaaggucaggaguucaagaccagccuggccaauauggcaaaacccuaucucuacuaauacagaaaauuaucuggguguguuggcuggcgccuguaaucccagcuacucgggaggcugaggcaggacaaucucuugaaccucggagguggagguugcagugagccgagaucacaccauugcacuccagccugggcaacagagcaagacuugucucaaaaaaaaaaaaaaaaaaaaaaaaaaggcaauugaaaguguaaucugaacaguuaaaaaaguagauagaaaggguuaaagcuuuuuuuugaggaucugaagaaaaauguggauuuuuuuugagcuacguuuugaagcaggcagugauuauuucagcacauuaagaaaugcuuaacauggccaggcgcaguggcucacgccuguaaucucagcacuuugggaggccgaggugggcggaucauuugaggucaugaccagccuggccaacaugaugagacacugccucuacuaaaaauacaaaaauuagcugggugugguggugcacgccuguaauuccagcuacucaggaaccugaggcaggagagucacuugaaccugggaggcggaggcugcagugaguccagaucaugccacugcacuccagccugagggacagagugagacuccucaaaaaaaaaaaaaaaaaaagaaagaaauacuuaacauuauucucgugauuauucucauaacauuuuucauaauccacuggcuuccaguggauuuuuuuagugucaagaaaauaauuuugauugguucaucuuuaaggaauguguuaagaauaaagcaugucuaccugucuucaguauaccagcuaacuauaguaggaagaaauauaguagucuacuuagaucaacuauaauucuuuaaugcagaaaaaguuuaaaguauuuaccuuauuuuuagcccccauccccuuaaguauaucauggcuccagaaucucugaaaauguuaucagucuuucagacuuugcucuucuuucauguuauacucaagaaacauuugaccuuuuuuuuuuuuuuugcuugcauuguguuucaaauaauuuuuaacaaaacuuaaguguuugaaagugaaagcagguugucuuugugacuuuugguggugguuugaaaaacucagaaaaguuuaaagaagaaagauaacuaguauucucauuguccagaauaugauuuuuuaaaugucuauagaauaucaccaucuguaauucuuccgguaauuuaaguauucaguaguuguauaaaaccuuuaaaauauauauauugagaauuuugugugaaugagaugaugagauaaucuuguaggaucauuuaaagauaagaacugaggccuggcacaguggcucaugccuauaaucacagcacuuugggaggcccaggcgguagaucaccugaggucaggaguuugagaccagccuggccaacauggcaaaacccugucucuacuaagcauagaaaaauuaauuggguguggucgugccugcguguagucccagcugcuugggaagcugaggcgggagaaucucuugaacccuggaggugggcauugcagugagcugagauugcgccacugcacuccagccugggcgacagagcaagacucugucucaaaauaaaguaaaauaaaaugaagauaacaacugaaauuucacauuaaaaauuuuuuuguagcgacugugccuccuauguugugcaggcuggucucaaacuccuggccucaagcgauccuuccaaagcacugggugggccaccauguccagccugaaauuuugcauuaaaaaauuucccgcuuuuggcugggcgaggugucucacgccuguaauagcaguuugggaggccgaggcaggcagaucacuugaggucaguucuagaccggccuggccaauguggugaaacccugccucuacuaaaaacaccaaauuagcuaggcgugguggugugcgcuuguagucccaagcuacugaggaggcugagacaagagaaucgcuugaaucugggaaaaagagguugccgugagccaagauuggccacugcacuccagccugggugacagagugagauucugucucaaaaaaauaaaaaauaaaaauuucccccuuuaaucaaauuaaguuaaaaugagggauguuagacaguuuuuaaccaucaaauauuuuaguuuaguuuuuuuuuuuaacguugucuuaaagauggaagugcuucaaaaucaaaucuuccuugccaguucucuacuuggcuucuuuuuuuuucuuuuugagacagagucucacuuugucacuggagugcguuggcgugaucucggcucacugcaaccuccgccuuccagguuuaagugauucuuccaccucagccucucaaguagcugggaguacaggugugugccaccacacccggcuaauuuuuguaguuuuaguagagacaggguuucacuauguuggccaggcuggccucaaacuccugaccucgugauccacccaccucagccaaauugcugggauuacuugugugagccacgcgccuggcuucuacuuggcuuuuaaagggaauuuugcuuucugaguaauuuuauuucucagguaucuuggucuuuuuaauucuggaagcaaucuuaauaauuuauguaugugcccuguaaucccagcacuuugggaggccgaggugggcgaaucacgaggucaggagaucgagaccauccuggcuaacacggugaaaccccaucuacuaaaaauacaaaaaauuagcugggcgugguggcaggcgccuguagucccagcuacuugggaggcugaggcaggagaaucauuugaacccgggaggcagagcuugcagugagccgagaucgcgccacugcacuccagccugggcgacagagcgagacucugucucaaaaaaaaaaaaaaaaaaauuuacguaugugcuaacauccugcuauauucaccuuccauagcaaucuguuggcuguguguuguguauguguguguuuucucuucuggguaguuuugacuauaccuaugugaugguuucacuauuuguaguuugaauaguucaguuuuauuuuggauaguaaagaagagcuugcuuuuuuuuuuuuuuuuuuuuugucugagacggagucuuguucuguugcccaggcuggagugcaguggugugaucugggcucacugcaagcucugccuccugggcucacaccauucuccugccucagccucccgauuagcugggacuacaggugcccgccgccaggcccagcuaaauuuuugcauuuuuuaguagagaugggguuucacuguguuagccaggaugaucuccugaccuugugauccaccugccucugccucucaaagugcugagauuacaggcgugagccaccacgucuggccagaauagcuuucuuuuguggcaagcuauauacuuuccuaauauaugaacauguuuaggguaaaauaagaugcuucuuaacguuuugagauuuaaaaaaaauuugcuaaucaacuuugagugucuguuuuuugagauauagggucuuacucugucacgcaggcuacagugcagugaugcaaucauaacuuacuauagccuccaacuccuagccggguuucagugauccucccaccucagccuccugaguagcugagaauacaagcgcgugccaccacaccuggcuaauuuuuuuuuuuuuuuuguauuuuuuguagggaugggauuucaauauguugccccaggcuagucucaaauuccuggucucgagauccaccugccucagcuucccaaagugcugggauuauaggcaugagccccacgcuuggcugagugucuuaagaugaagaaaaacugaaaauggguguagugugccagugcaugagguauuuuaaauguguagcuuaccagcuuuuuuuuuuuuuuuuuuuuuuuuuuuuuugagauagagucuugcucugucacccaggcuggagugcaguggcacaaucuuggcuuacugcaacgucugucucccggguuccagcauuucuucugccucagccuccugaguaacugggacuacaggcguccaccaccacggccagcuaauuuuuauauuaguagagaugggguuucaccauguuggccaggcuggucuccaacuccugaccucaggugauccgccugccuuggucucccaaagugcuaggauuacaggcgugagccacuacguuuggcugcuuaucagcuuuuuaccacuuugucgccacuacauuuuggaauuuuccuuugagaauuaggcaaaaugcccagacucccccccggcccccgcuuuagagggagaggggagcaauuagacuauuccuuuguuucccuauagaagguggggcugagauuacugcuuugauaucuggaauguaauuuagggaagaaaauuuaggucuuggccuuucuuuggaaccacccugggaguguugcagauuauuaauaggguaaugguggaaugauauucaggggaaaaaugguccugaggagccagagaacuaaguguuaguuuguuggcugacugaaacaugugagagauaggguacagaagaaguaggaaauaguuuuccuugguacuucugugacagguuggcucaauuggcuggaacacccuacacugcuuuauuaaauccaagguugugauagguuccaguuaaguuuacuguguucuaugcuuguagauuuccuaauuaggacaaguaguguuaaauaugcaugccuuuauucacaagagggaccauucuuuuggaaacaucacuuuuuaauaauacuaggugcuauuuagcacuuacucggugccagccacguggcuaugguuuuuuuuuuuuuuuuuuucgagacaugaucuagcucugucucccaggcuggaguggugguagcacagucauggcucacugcagucucaaccuccuguacucuagugauccuccugucucagccuccugaguaacuggcaccaugccuggcuaauuuuuuuuuaagagaugagaugucgcuauguugccuaugcuggucucgaacaccugggcucaagugauccuccugccugagccucucaaaguguugggauuacaggugugacccaccucacuuggccaucuauggucuuuacauagggcauuuugugcagucugcgucucaaacuagugaucuucaacagugaaacucagugaauuauguaauucauguuuuccaagaacaaugauggauuuaauuucucugaauguauuuccuuuguauaauaauaguacuuaaguggaauuacucuuuguccuuucuacucuccuuauagauauuuucugguaucuugauuugggacuguuacauuuaacccauuuauggucguguagccauacucacguuacauuugaugcaucugcucccuuugugucuauauacucauauaacauuuugcauaaaguuauaggcaguucacaccaaggcuguucaugaaccucagauuaagaauacuugauuuaggagauugaaaacagaaaagagaauguuaacuaucauuaucaauauuaaaaugugaaaaucugagagugacaaagcuuagcuuuaaaucugguaucccaaacucauuugaguuuuuuuuuuuuuuuuuuuuuuuuugagacaaggugucgcuuugucccccaggcuggaguguaguggugugaucuuggcucacugcaaccuccaccucccagguucaagugauucuccugccucagccucugaaguugcugggauuacaggcugcgccaccacgcccagcuaauuuuuuguauuuauaguaaagacggaguuucaccuuauuggccaggcuggucucaaacuccugaucuugugauccucccgccucggccucccaaagugcugggauuacaggugugagccacuguucccggccuaauuugaguuuuaaaauguggaguuuaagauguuagucuuaaaguggguuagaugaaauuuauaaaaauagucaaauagcuaaauuuauaaaaggccauuugaaacaauuuugugaaauauauaauguggauaauuauguagugcuuuauguguagauuggugguuagcaucugccugaugaagagcaguuggauuucuuacuuacuaaagcuagugaaaucugaacuccaaauuaggcaucuucaccaggcuuuuuugagccgagcuaacuuacucucuuuuuuauuuuuauuuuuuaauuaauuaauuuuuuuuuuuuuuuuuuuuuuuuuguagagacaggaucuccccauguuacccaggcuugucucuggcuccuuggcucaagcaguccuccuaccuuagccucccaaagugcuaggauuacagcugugagccacugcgccaggcugagcuuauucucuacuaacacaaguguucuaauuuaauuuaagcagugaaucacacuuuucuuuguauuuggucagguucugggugcuaguuuauauaugauuugauucauucugauaggguuuuuuuguuuuuuuuuguuuuuguuuuuuuguuuuuuuuugagacagagucuagcucugucgcccaggcuggagugugguggcucgauuucgggucauugcaacuucugccucccacccaggcuggagugcaguggcucgauuucgggucauugcaaccucugccucccagguucaagcgauucuccugccucagccuccugaguagcugggauuacaagcacccaccaccaugcccggcuaauuuuguguauuuuuaguagagacuggguuucaccauguugaccacgcuggucucgaacuccugaccucaggugaucugccugccuuggccucccaaagugcugggauuacaggugugagccaccacaccaggccucaagaacuuuuuauuuuugagacagggucucacucugucacccaggcuggaguacaguggugagaucauggcuuacugcagccuggacuucccaggcucuggugauccucccaucucagccccuggaguaauuaggaauauagacacacacccaugccuggcaguuuuuguauuuuuuuucuuuuuucucuuuuuuuguagagacuggguuucacauguuguaucaggcugguuuugaacuccugagcucaagcaauccucacucuuugaccucccaacgugcugggauuacaggcaugagccacuguaccuggccuuuucuacauuaaaaacuuuuuauuaaaaaacccaaaucuuccuugugguuguauauacauauauacauagguacacacauggagaauuuuaccuuggaggaaggcuugguaaagaaaauagcccuuugggccgggugcgggggcugacgccuguaguccuagcacuuugggaggcugaggugggcggauugccugagcucaggaguucaagaccagccugggcaacacagugaaacccugucucuacuaaaauacaaaaaaucagcuggguguggcagcaugugccuguagucccagcuacuugggaggcugaggcaggagaacugcuugaacccgggaggcagagguugcagugagccgagauugugcuacugcacuucagccugcgcgacagagcaaaacucugucucaaaaaaacaaacaaacaaacaaaaaaggaaaauagccuuucucuaucaucagaguauauuaagaguugaguuuuuuuuucuguuuuuuaaaauuuuuguuguuuauuuuaaauuacaaaacauggacucugcuuacaaauuaagaaaaugacucauguucaaacaagcauaaucaauauaacaguuaauacaaguuaaauauuguaauauguuuacggaauagcauggcaaaauagugcaaaagauuuggggaaggggccuauaauuucuguuaacagaaaguuuuaguuauguugauucaacuggagaggaacagagcucccagaaggacuccagaacacuugaugcuugucugaguggggucagcagcacugaguucccaccagacagaaaguuuguguguguacauuauuucccuuaacugccacaauaaucccaugaagaaaaugcccuaguuuuacaaacaaggaaacagaggcagagaagaguuaaaugacuugcccaagggcauucaaaguaagcaacugaauuggaauuuuaacucaaaggcuuggaugucccacuacaacaaauaggcuguuucugcuuuacuacaugugcuuacuucuaagaauuuaacauuuuaggcugguugugguggcucacuccuguaaucucagcacuuucggaggcugagguggguaaaucacuugagcucaggaguuugagaccaaccugggcaacaugguaaaaccucaucucuaccaaaaaaaaaaaaaaaaacuagcuggacgugguggcacgcgccuguggucccagcuacucaggaggcugaaguaggaggaucguuugagccugggagguggagguugcagugagcccacauugcaucacugcacucuagccuaggugacagagugagagccuaucucacacacaaaaaaaagaauuuaaaauuuuagucaaguaauuaggcacuaacauuuuguggucaguuacuuuacgaauucaugguuggaggccugaugugguggcucaugccuguaaucccagcacuuugggaggcugaggcaggaggauugcuuaaggccaagaguucaaaucagccugagcaaccuaguaagauccccuuucugcaaaaaauuuaaaaauuagcugggcaugguagugugcaccuguagucccaaccacuugggaggcugaggugggaggauugccugaggccaggaguuugagaccugggcagcauaugaagacccugucucuaaaaaacuaaaaauaaaaaauagccaggugugguuggugugcuuguggucccagcuacucaagaggcugaggcaagaggguugcuugagcccagaaguuggaggcugccgugaacugugauugcaccacugcacuucagccugggugacauagcaagacccugucucuguggugguggugggugggggugggggaaggauuuaagaaggguuugugagguauguauuauuuauaaaugggcuuuuaacuuuacccuucacaucuuggguugaaauuaauuguauccauucucaguuuuucugucuugcuauauauuuaaacuuggagacuuagaggucauggaugucuuucuaugaaaagcaaaugaagcagagggcugccuucucuugcuguagagggcacacuugcugcagagcauguuacuguuuuaugcauugcuaggcuuugggaguugugacuuguaugaucauaguacuuacaacuauuaguuggcaauuuuuaaacuuuaacuuuagauuauauauguaaacuccuguguuccuuugucacugauaaucugaacagaagccuuggauaaauaauuuugaaguuuuugucugaaccucugaaauuuguauuguuaucucaugguuuugcugggaggaaggagaaauaacaauggccacuuacugugcuucuguaugugccagacaguaugugcuagauguuucagaaacgugauuuguaauccugacaagaagccuaauugggugguagugggugcuaauugaaccuuauagaugaggaaauugaggcucauggugguaagugaauaacuugcaccaagauccuauggcugguaugcaguagagccucaauucaaguacgggucuuccagguccaaacccaugcaggcuuugagagguaaggagguagagaacguugacaccccguucuugguguguuuuucagcaaauacuuguaugcauauuaaagacugucuacccuuuugucaucuugugucacuugcugcuuccuuugguacuacccaaauuucuuucagcauuucagcuuugaauuuuuauuuuuauuuuauuuaauuuauuuauuuuuuugagauggagucucacucuguuguccaggcuggagugcaguggcgugauaucagcucacugcaaccucugccucacagguucaagcaauucuuccugccucagccuccuuaguagcugggacuggaggugcccaccaccacgcccaacuaauuuuuguauuuuuaguagagauaggguuuuaccuuguuggccaggcugguuuugaacucuuggccucaagugauccacccaccucggccucccaaaaugcugggauuacaggcaugagccacugcaccuggccagcuuugaauuuuuagaauacuguucuaaacagaacuauauuggaaccuggaaaauuaaucuauugucucuaaauaccaaagaaaaacauguaauuuuagugguugauuaugggaacaauuuuuuuuaagaugguucaucugaauggaagcauuuuuuuuuaauugcuugacuauuucuuuaaauuuggagaaaagaccauugcccucucagauuucugguaauuggucacauugaucauuuauauugacugacaggcugcuuuguccacagcugaaggauuguuuaauuuuuuuuaaauuauaggaauaauaugugcucacuguaaaauucacaguacagaagcauaugaacuaacuaaaaguucuuaccucuugucuccagcaaggaguaaguguuucaaccugaagguugguuuugaauuguguucuguggagcauacuuaaagugagugaagaagaaaaauuuaugucaaucaugaucauugcagcugaaguuuuuauuguuucacccccuaaagguuauuaaaauaguauguaguuuaguagucuugauaauuuucccuuaagauuuauuggccaguauaucaggauuuuguuuuaaauuugauaugugagcuuaguuuuaugcuauuuucaaauaagacauuuagaagaagauaaaauaacauuucugucuuagucuguuuucugcugcuauaacagaauagcacagacuggguaauuuauaaacaguagaaguuuauuuggccugugguucuggaggcugggaacuucaagagcaugguucugcccuuugugcuguguuaucauaugguggaagguggaaaggcaagugaguaugucaagacagagagcaagaaggggcuugaacucacuuuuauaacagagugacuccagagauagcuaacccacuuuugagagaaugcauuaauccauucaugagggcagagcccuugugaccuaaucaccucucauuaggcucugcauccuuaaacugguuuuuuuuuuguuuuuuuuuuuugagacggagucucgcucuguugcccaggccggacugcggacugcaguggcgcaaucucggcucacugcaagcuccgccucccggguucacgccauucuccugccucagccucccgaguagcugggacuacaggcgcccgccaccgcgcccggcuaauuuuuuguauuuuuuuaguagagacgggguuucaccuuguuagccaggauggucucgaucuccugaccucaugauccacccgccucggccucccaaagugcugggauuacaggcgugagccaccgcgcccggccccccuuaaacuguuguauuggggauuaaguaucuaacacaggaacuuuggaggauacauuuaaaccauaagaauuccugucaugcaaaugaauccauucuagaugaaagagaaugaauuuaguuuccauugaacuuuauaaauaggccuuuucuaagguacuuacagcugauauuauaaaauuuauauuuguuuuuauaaauuuguauuuguauuucuguuuguacaaauacaauuauacacuauaguucucugcuguuagauuuuuuuucuuccuuagcauguuuccaaaggguggaauguugaaaguuggguuaaugucaaucagcuuucuuuuguaaaguguucauugacaugugaaccuugucugagaaucuaaauuuuauuucaugaaagaagaaaacaguauauucucauuuaacccagaauuuaacuucauauacuuguggcuguauugggaguaugccauugcugucuguuuacaaccugaccuacucuaccuacuuagaaguaauuuguguuaugauaggugugcugugcugacauaugcugaacauauuuguaaggguguuaagucauugaauaaaacgcuuuucuccuccuuucaaauaacauuuuuuauuucugguuauaaaagucauacaagcuuacugcagguuguuaaaaagguauaaagaagaaaccgucaauccauuauaguccuacaguuuagacuuccugcuccagccucucagagugcugagaugagcuagccaugcccagccccucaaaagauuuuuuaaaaaacaaaaaugagguuauacuuuaaaaaauucuauauuccuuucacauaacaguguuauuuuggagguuuuagaauuuccaguagcauuuuagauucagaaacaagcugauucauccucuacuuuguacuuuaggcaagaaaagaauuuuaccuaaauagaauuuugaacugaaaaucuguuuuucuaacuuuuuauuuaaagaauauuguuccaugcuuucacaguagugacuuuuaauuuuuauauuuuuuauuuuauuuauuuagagaugggggucucacucuuguugccuaggcuagagugagugcaaugguucuauuccuagcucacugcaaccuugaacuccugggcucaaguuacccuccugccucagccuucuaaguagcugggacuacaggugugcaccacugcaccaggcuuuuuuuaaaggcauagaaaaugguagugcuugcauacaaaaauggcguagguacauacaucagcggacaucaagacuauguucagaucauaaauguacauauauguaccgaugccauuuuugcacgcaaacaaauaauggaaauugaacucuaaacugaaauuugaaacaaggguucuggggugggcccucuugcugauuuguaauugaauguauaguucaauuuuuccccaucuguuaagcaaaagacaauucuaauguuagcaaaaauccacauauccugucauugaucauuuuuuccuuaauuuucuuuaagagauggggcuucucucuauguugcccaggcuggucuggaacucuugggcucaaaugauccuccagccucagccucccaaagugcuggaauuaauaggcacaagcugccgugccuggcccugucaucagucauuuaacuucaugcaaacugaguagaauaaaacucguccuuacuguaccuuauugcuuuuguuuuauuguuggaaccuccaauauugcgaaaguagaccaaaaguugacuuauaggaaaaacugauagcaaaaauaauuuuucucuuguugcuguauuucaugcccaccauccaguuguuaaagccuacuguuaauuucucucagccuccuccuuucuguccaggcuuauucuaugccauucuuaccuuaacuguuuuuagcuuucucauagagugaacuuuuuaaauuaaaauaaaauaucugcucguaguauuauaaaauucaagcaguucaacagaauuuuucacuaauagaaauacuuguaccucaaaagcagcuuuauuuuacaaacccagcccaauuugugauuagauuuaacuugagaaaacaugaaaugucucucauauuguuuaaaaauaucauaaguggcuggguacgguggcuuaugccuauaaucccaacacuuugggaggcugaggcagguggaucacuugaggucaggaguuugagaccagccaggccaacauggugaaaccccaucucuacuaaaauacaaaaauuagcugggcaugguggcacacaccuguaaucccagcuacuagggaggcugaggcaggugaaucgcuugaacccgggggagguggagguugcagugagcugagauaaugccauugcacuccagccuaggcaacagagcaagacucugucucaaaaaaaaaaaaaaaaucaugagcuagcauuuuugaagugauuguuugucauuuuucguuuuguuuuguuuuguuuuuuuugagauggagucuuguucuguugcccaggcuaaagugcaguggugcgauaucagcuuacugcaaccucuaccucccagguucaagcgauucuccugccucagcuuccugaguagcugagacuacaggugcgugccaccacgcccggcuaauuuuguauuuuuaguagaggcaggguuucaccauguuggccaggcuggucucaaacuccugaccucaggugauccaccugccugggccucccaaagugcugggauuauaggcuugagccucgccuggccuccucauaauuuuuuaaccuuuauaaaaaccuuuucuaaaacccuuuuuauuuugaacuaaauuuagauuuacugaaauugugaaaucaauguggaguucuuguauacccuucuuuccgcuuuuccuaauaguaacaucuuacauacaugguacauuuguccaaauuaagaaauaaacauugguacaguguuaacuauagacuuaaucugguuucucuaauuuuuucacuaauguucuuuuucuguucuaggaucuaauucaguauaccauauuguauuuaguuguaggccauguuagccaccuucaaucugugacaguuucucagucuuuccuucuuuuucguuaucuugacaaguuugaagagugcugauagguauuuuauagaauguccgucaguugucugucaguuuguauuugucugauguauuuuuuuuuuuuuuuugagauggugucucguucugucgccuaggcuggagugcaauggcaugaucuuggcucaaugcagccuccaccuccgggguucaagugacuguccugccucagucucccaaguaacugaaacuacaggcaugugccaccacgccuggcuaauuuuuuguauuuuaguagagaagcaguuucaccguguugcccaggcuggucucgugcuccugagcucaggcaauccacccgcguuggccucccaaagcgcuaggauuacaggugugagccaccaugccuggccaauauuuugagggauauacuuuggugaggucaugcagauauccuguuucuccuuaguuuuauccauuaauuuagcauuuauccaguaaaucuuccuugcagcaauuauuuuuucuuuuucuuuuuuccuuaauuuuuuuuuuaagagaugggaucucacucuguugcccaaguuggaaugcaguagugaguucauagcucacugcagccucaaacuccugggcucaagugauccuucugccucagccucucaaguagcugggacuacaggcauagaccaccacacccagcuaauuaaaaaaaauauuuuuagagauggggguuuugcuauguugcucaggcuggucuugaacuucuggccucaugugauccuucuaccucagccuuacaaguaggugggaauuacaggugugagccaccacacccagcauugcagcaauuauuaauguagugcuacuggucauuuucuguuuuucucauuucuucagcauguguuauugacuugucucuucccucccauuuauaaucauuuauacugcuaugaauucaugaguauuuauuuugugaguuauaaucuaauacguacuuaauuuauuuugugccucaaauuguucuggcuuggccauuuuuuuuuuuuuuuuugagacggucucgcucugcugcccaggcuggagugcaguagcgccaucucuucucacugcaaccuccaccucccggguucaagcgauucuccugccucagccuccugaguagcugggacuacaggcgugugccgccacacccgucuaauuuuuuguauuuuuaguagagacaggguuucaccauguuagccaggauggucucgaucuccugaccucgugaucugcccgccucagccuccaaaagugcugggauuacaggcgugagccaccaagcccgaccggcuccuguauccuuuuaacaugaggugcugucaucauuuuuucccccuaauauuuuggccaaaaauguuaaucaaggauggcacaaauuuucuguagcuguaucucacaacgaaagaggccugauuaaaaauguaaaacuaaaauguucucugaucucuuagcacaugcuuuguaaaaggcacagugcuagauccuuguauacguagaugaguaagucagcuuaccuuccacacccacagauagcuaugucaaacguaaggguggagaaacacagaccccaaacuucucgaggguagaaaauaugagguuauaguagauuagaacuacaaaaagcuagaggaaguucugaacuggaaacaguggauaggauuuacuagaauaauuuacgagggugacaauuguaaaucuucauagguuucuuuuuuuuccuuucucuuuuuuuuuuuuugagauggagucucgcucuguugcccaggcuggagugcaauggcgcagucucuccucacugcaaccuccgccuccuggguccaagugauucuccugccuuagccacccaaguagcugggauuacaggcaucugccaccaugcugagcuaauuuuuguauuuuuuuuuuuaguagagacgggguuucaccauguuggucaggcuggucuugaacuccugaccucagguaauccacccaccuuggccucccaaagugcugggauuacaggugugagccaccgcgcccagccaaauuuuuauugguuucuaaacuagcauaauuuaguuuuuuucacuuaagucaaaauuauauuauuguaggauaaaaacuuagugauccaaauucaugaggaaugaagaauaaauacauuuaaagucuuaccauuugcuaaauuagucuuggcucuuuguaccaaaauucuguccuugugcucuguaauuuuauauuuguauauuuucuaucaacauuuuuacugugugguguuuuguaaauuauaaaaacguuuuaaagcaaacucagaacaaugaauucucacgaauauucaguauauuuacaguugagaaauaaacuacuucuguaguagguaauuuaaaaugucccaaugcaaguuaacgugucacugaucacgcuauucaagugugugucuuugauaaggggagguggggaaguuuguggguuugauuuuauuugccuuucucaugugacuguugucauguuaguaaacaaaugguuugcgagagaaccaguagucuuuugcaaagauugucuuauacagagcacucaauucuucauauuauuuauaauggcuuuaauuuaagccuuaaauuauuagaaacucauaaauaauuuuuuuauuuguuuuuuugagauggaguuucgcccuuauuguccaggcugaaguacaaugaugugaucuugacucacugcaaccuccgccucucggguucaagugauucuccugccuuugccucccaaguagcugggauuacaggcaugcgcuaccaugccuggcuaauuuuguauuuuuaguaaagacgggauugcaccauguuggccaggcuggucucgaacucccaaccucaggugauccaccugcuucggccucccagagugcugggauuacaggcucacugagccacugugcccagccauaaugcguuaaaauaagaguguuauauuuguaaaacuuaaaaaaauguagugguugaaaaagguaauuuaaaaagaauugacuauuaauuucuugaaaccauaauguaacuuguagugcaauuaggaaaccuucauguuucuuucuuucuuuuuuuuuuuuuuugagauggaguuuugcucuuguugccuaggcuggagugugugaugucagcgcacugcaaccucugccuccuggguucaagcaauucuccugccucagccucccgaguagcugggauuacaggcgccugccaccacacccagcuaauuuuuguauuuuuaguagaggcgggguuucaucguguuggccuggcuggucucgaacuccugaacucaggugauccacugcaccuggcccccguucauguuuuuuaaagcuuuaugguugcucugaaauagaguuguugauuuuuuuuuuuuuuuugagacuccucuuuugcccgugcuggagugcaguggugugaucugagcucacugcaaccuccaccuccugaguucaagcaauucucaugggucagccucucaaguagcugagauuaaagcugcccaccaccaugccuagcuaauuuuaguauuuuuaguagagaugggguuucaccguauuggccaggguggucuggaacuucugaccucaggcaugagccacuacgccuagccuggguuguugaucuuuaaggugauacuucaggcaacaucugaggcccaguacaguccuuuacuucaacuggcuccaguacagcaaauucagggaauguuuuugaguguuuacuggaugccuggcguggaguucagggagauugguacauugaguccaguuguuguguugaaacuucuguuuaaaaaccucccuacuaagucccagcuacucaggaggcugaggccugagaaucacuugaacaccuggaggcagagguugcagugaaucgagaucgagccacugcacuccagccugggcgacagagugagacugucuaacaacaaaaacaacaccccccaaaaaaccaaccuacuaugguaguaucaaugcugugauagucuuccuuucuucauacagguaaauucuuaacauauacucauuguuaauguucaguguucaguauucuuaagaguauuuggggccaggcacgguggcucaugccuguacucccagcacuuugggaggcugaggugagcagauuaccugagguuaggagcuugagaacagccuccaacaugaugaaacucccgucuuuacuagaaauacaaaaauuagcuggguguguuagcacaugucuguaaucccagcuacuucagaggcugaggcaggagaauugcuugaaccugggagguggaggcugcagugaccugagauugcuucacugcacuccagccugggcaacagagcgagacucuugucucaaaacaaacaaacaaaaaaagaauauuuggggccaggcaugguggcucacaccuguagucccagcacuuugggaggccaaggcggguggaucacuugagaucaggaguuggagaccagcccgaccaacauggcuaaaucccgucucuacuaaaaguacaaaaauuagcuugagcaacagagcaagacucugucucaaaaaaagaaagaagaauauuugguuuaauuaagaaggaaccuuaucaauaguaguaaagucagccagcugaacugccaaguacaaauuguugguauuagguaucaaucauuuauuaaggauaauauucuacaauagcgaucuuuuuaaaaauuuuaaaaucucaaacuggaaaggaugucuaguucauucuaugcuucaguccccucuucugauuuacuuguuuagaagauuuuuguuuccuucucugacuucuauuuugcugcugacuggcacuugggauuuuuaaaaaauuauuuuccucauauauaauuaaagacaauaaguauaacaauaaguauaauaugguaauuugcuaaaacccaaacaauguuuuaaguaaugcauaucauuauguaaaccuacguaauaguugaauauucacaaagauaaucgcuuauagaaguuuuauauccucucuucuuuggcagugcaauuaaaacaaaaaaaauaaguuuuaugucuuguuuacauguaaauaauuuuaaucuaaauugugacgugguuuucacuuuagcauauuuuugaaaguaaaucaaaaaggacaaaauacaaaaucauguauaucuucuacaaaaacgauauauaaauucuaagguuuuuguccuuuugaaauugcuuaaaagaaugcauagaacuggugucugaguugggaaggaucuaugagggauuuccuuggagacugugggugaauaauaauguugucuuaguuccaugaaggaaucucuggggauaguuuuugaguuaggccuggcaauguuagagauacauaaagagagccuuguuuuaucacugggugcgguggcucacaccuguaauuccagcacuuugggaggcugaggcgggcagaucaugaggucaggagaucgagaccauccuggccaacacggugaaacccgugucuacuaaaaauacaaaaauuagcugggcgugguggcgcaugccuauaaucccagcuacucgggaggcugaggcaggagaaucacuugaaccagggaguuggagguugcagugagccgagaucgcgccacugcacuccagccugggugacagagcaagacuccgucucaaaaaaaaaaagcuugguuuucaaugguucugaaaaaugcuuuaauacaaguguagaguguuagucaaguuuugcacuuggauaaacagccugugaauuuaucacauuucuaguuuauaauaugggcuuucagaaguuauaugaacauuguuuugacgggagaauucaagcuggaugcuagagaaggaucgugagaaccccuucauuggaggagugcuaugaaauuauuugaucuuggaauuuuuuuuuuuuuuuuuuuuuuuuuuuuugagacagaguuucguucuuauugcccaggcuggagcuggaaugcaguggcacgaucucggcucacugcaaccucugccuccuggguucaagcaauucuucugccucagccuaccagguagcugggauuacaggcaugcgcaaccaugcccagcuaauuuuuguauuuuuaauggagacgggguuucaccauguuggucaggcuggucuugaacuccugaccucaagugaacugccugccucagccucccaaaguguugggauuacaggugugagccacugcgccuggccugaucuuagaauuugaaggagagacuaauauuucaugggcaaaaacaaugaaaaguuaccuuucuguauucuaauacuauagaggagugggauuuauuuagaauguuuuaaguaucuugggcaguccaagagugcguaucacuuauuuuucuuuuccuucuuucuuuuuaaguggaaguucacugauguuagagaucauagguggcauugccuacuuuuuacauaauuuuaucauguuuagugaucugucagaagggcuguggcuguuugcaguuuuggcuuaagccaugcaugggcuuuauaggagauguagucuucacagugaguuguuauuuguagcuguguuuuuguuuuuguauagcuuauagcaaugcagugugcuuuuuauuaacaucauuuucuuuuucuuuuugcagugauuauuuauucaaguuacuucugauuggcgacucagggguuggaaagucuugccuucuucuuagguuugcaguaaguugaaauugaaaugucuuuacaauuaaugguacaauuaaugcuauguauguuuucuagguagauaaaauuaaacaguuuuauucagaauaaguuaauucuuccagaauuuauauauuuaaagacuccaaauauacauccccagugguaucuuggacuguuaaauagaaaaauauuguugcucuuaaaagaaauucagugaaguaugguuauaaagucagaaugucuaauacuuuuggucagagucaaacagcaguuccaauauaggcagcaaguuaaagggguaguugguggccuguguugaaagcgacuugaugaaaauaaaucuuuaaauuaaacuuuaguagaauaagaagaaaaagcagagccaggugacgcaguggaucaugccugcagucucagcuacucagggugcugaggguggaaggaucacuugagucuaggaguuuugagaccaaccuggacaacauagcaugacucugucucugaaaaaaaaaguuaauaaaagaaaaaguagggucuuggacaaacuucguuggccaauggcauaguucuaaaugcugaagcugacagauaaaggacuuuugacuuaacagaauccacaguguccuucauagucuuuaucaacuaccuuuaaauuuagcauguuuccuggccaggugcgguggcucacgccuguaaucccagcacuuugggaggccgagacgggcggaucacaaggucaagagaucgagaccauccuggcuaacacggugaaaccccgucucuacuaaaaauacaaaaaauuagcuggguguggugccacacgccuguagucccagcuacucgggaggcugaggcaggagaaucgcuugaacccaggaggcggagguugcagugagcugagauggugccacugcacuccagccuggcaacagagcaagacugucucaaaaaaaaaagaaaaaaaauaaaaaaacaaauuagcauguuucccuucuagagaucauuguuucucagagcauggaccaaagacuccuggggguuaccaagacccucucagguagcccaugaggucaaaauauccuaauaauacuaagauguuaguauuuguaaggaaauauuuacuugguaauaauacuaauauaaaagauguuugcguuuuucagugaugacauuggcucugguacaaaagcauguggguaaaauugcugcuggcuugguacacaucaaggcagcgcuaagcuccaaauuguacucauggugauggcauucuuuaccucugugcccucacaggaacaaaaacaagccgugccauuuuuauugaagauuguccuugacaaaacaguuaaaaugauuaauuuuugaaaaauguugauccaugaguauuccuuuaaaaauauuugugaagaaaugggaaguucacauaaaacaauguuuuuuuuuuuuuuugagacagauucuggcuguguugccaaggcuagagugcaguggcgucuggcucccaggcucaagcuguucucccacuucagccucccaaguggcugggaccucccaaguggaugcgccaucaugccuggcugauuuuuguauuuuuuuguagugacaaggucucacuguguugcacaggcugcucucaaacuucugagcucaagcgaugcaugugccucagccucccaaagugcuggagaaagcacuuuuuacugcauacuggcuaguguguugguuauuuuggagaaaagaaaagcauuuguaguuuuuugaguuguaagcugagcuaacugcuuuauuuuuuucuguggaacaccauuucuuuuuuuuuuuuugagauggaauauugcuuuguugcccaggcuggagugcaguggcacaaucucggcucacugcaaccuccgcuucucggguucaagcaauucuucugccguagccucccaaguagcugggauuauaggcaccugccaccaagcccagcuaguuuuuguauuuuuaguagagaugggguuucaccauguuggccaggcuggucucgaacuccugacuucgugauccgcuugucucagccucccaaagugcugggauuacaggcgugaacuacugcaccuggacauuuuuuuuuuuuuuuuuaacuugaaagaacagcuaacagacagauuagaacagaauuggcuauuugacagauuuucucagaugaacugugauagucauuucaagggaaguagcugcaagcauuuguuggcugaaauaaaauuuaaguuuaucauggaaaauuagaauuugaaaaaacuuagaguuuaccacuugacaguauccuaaauacauaugacuuuucugaugagugccgauauuaaugaagguuauuuaaaaaauauuaaauaauguauaauucuuuuuauauaacaguuaaaaauaaaaccaugaguacuagaauaaaacauagguggcucuuuaaucuugguuugugaagguauuuuuuaaaauaagaaaaaagcaagaaaucacugcuaaauuugacuauuaaaauuaauuuaucacaggcacaaaaauguuagaaaacuaauggcaauagcaaauauauauauaugaggauugguauucucaacauauaaagcacauuugcacaucaacaagaaaagaauauuucuccuaauggaaauaguggcaaauacaugagcagucaguugaaaaaagaaguaauacaaauugcuggcuggguguggugggucacgccuguaaucccagcauuuagaggcugaggcuggcggaucaucugaggucaggaguucgagaccagccugaccaacauggagaaacccugucucuacuaaaaauacaaaauuagccggaugugguggcgcaugccuguaaucccagcuacuugggaggcugaggcaggagaauugcuugaacccaggaggcggagguuguggugagucgagaucgcaccauugcacuccagccugggcaacaagagcgaaacuccaucucaaaaaaaaaaaaaaaaaaaaaaaaggaaguaauacaaauugccaauaaauauggaaaaaaaaaaaggcucaacuuuauuuguaauuaaaggccuuuaaguuaaacuuaggugucauuuaauuuuuauuaaauuggcaaauauuaaaauuaagcauaauucuuaagcaacucucgguaggugggaagaaucuagcuguagccucaggcguuugugccucaaggaaaacccucucugggauguccauugcuugaagucaaagguuuuccaauaauaccuggaaacuauuuuuaaaaugcugauccccauacccucaaaauauuaauagagacaaucgugaggacuauaauaaagaaaugugcaauaagcucugggggcacagagggaagaaucuauuggcugaggaguugaagaaauuguuuggacacucaguauugccugagcucaaaacugaaggaugaauaaaugccacaugaccuuggggcuggggaguaaguaggguuaugcagagagagauaacugaggcuuuugggcagacgaauaguaacggcucaggcaugggaguaaaggucauuuagagauuuacaagaauucagcauuucuuucuuuuucuuuuuuuuuuugagauggagucuagcucugucauccaggcuggaguacaguggcaugaucucagcucacuauaacucccaccucccggguucaagugauucucaugccucagccucccgaguagcugguauuacaggcguguacuacugugccuggcuaauuuuuguauuuuuaguagagaugggguuucaccauguuggucaggcuggucuccaacuccugagcucaagugauaugugcaccucugcuccccaaagugcugggauuacaggcgugagccacuguacccggccaagaauucaguauuucuauccaaguaccugggggauagaugugcuacaugaauauuuauugcauucauuuuguucucugcauuuuuuuuuuuuuuuuuuugguuugagauggagucucgcucugucgcccaggcuggagugcagucgugcaaucucggcucacugcagccuccaccucauggguucaagcgauucuccaucuuggucuccugacuagcuagguuuacaggcgugugccaucacacccacuaauuuuuuguauuuuuaguagagacaggguuucaccauguuggccaggcuggucuugaacuccugaucuaaagugagccucccaccuuggccucccaaagugcugggauuacauaugugagccacugcgccuggccucuauauacuucuauaguaccugauacuuauuaggcacucaauuacaacauaacuuuuuuuuuuuuuuuuuuuuuuugagacagagacaugccuugucgccugggcuggagugcaguggcacagucucggcucacugcaaccuucaccucccggguucaagugauucuccuuccucagccucccggguagcugggauuacaggcgcccgccaccacguccagcuaauuuuuuguauuuuuaauagagaugagguuucaccaucuuggccaggcugaucucaaacuccugaccuugugauccacucaccuuggccucccaaagugcugguauuacaggugugagccaucaugcccggcccauauuucuaaaaacauuuucuuauaaaaugacauugccauuaucaaccugcaaaauacaguuuccauuugguuguuuucuugcuuagucuuuuaaucuagaguuuuauaccuuaucuuuuuuauuuauauauuuuuuaugucauugacuuuuugcagaaacugaagcacuuguccuguagauuguccaauauucuagauuugucauuuugcuuccuugugauguccuuaugcuuauuuguuugucccucuuucuguaauuagaagaccuagaacugcacuauccuuagaguagcuacuagcucuauguagcuauuuaaauuuaaauuaauuaaaauugaaaaaguuugguggcucacaccuguaaucccagcacuuugggaggccaaggugggaggauugcuugagugcaggaguucaaggcuucaguaagcuacgauuguacucuagccugggagacaucaagacccugucccuuuaagggggaaaaauaauugaaaaaaucaaaaacuuaguuucuuguuucacaagcugcauagggcuaauggcuaccauauuggcuagcacagcuuauagaaccuuuccauugucacaggaaguucuguuuggcagugccguucucauuagaccugauucgauuaagguccaucuuuguugacagaguacuucuuagguggugcuuugugguucauaugaugauagccuggucuguucauucauauaucuuuucacgagaaauauuuuuauuccauucugaauaaaauuucauggcagguacuugcaagaagcaguuauaauuuuaaaaguuuaacauuagguuaaaaaauugacaggaaacauauauucacaggaaaacuuguacacaaauguucauggcagcauuauucauaauagccaagaaguggaaacaacccaaaucaauuuaugaauggauaaaauguuguauauuuguaguacauguaauauuauucagccaauaaaaugggccaggcaugguggcucacaccuguaaucccagcacuuugagaggcucaggcagggggaucacuagaggucaggaguuugagaccagccugaccaucaucacgaaacccugucucuacuaaacguacaaaaauuaggcaggcguggugaugcacgccuguagucccuacuacucagguggcugagucaugaggauugcuuggaccccgggagacagagguugcagugagcugagaucaugacacugcacuccagcaugggcaacagagcaacauccugccucaaaaaaaaaaaaaaaaagaaguacuguuacaugguacaacauggaugaaccuugaaaacauucugcuaaaugaaggaagacagacacagagggccacauauuuuaugauuccauuuauacgaaauguccaaaauuggcaaaucuaaagagaaaguagauuagugguugccagggagugaagacggguucuuucuggagugaagaaaauguccuggaauucgugguuguaguuugcaaccuugugaauguauaaggaccacugaauuguccacuucaaaagggugacuuuuauguuaugugcauuauaucuaaaaaaaaaaaucauaauuaggaagcaagauugacuucuaagaaaaagcggagugaaauuguuguuuuguggugaauaaauugggugggugggucgcaagaguuuugcugauuagugauuagaaaaauuauucauaaucauugaaaauauaaaauauuuuucuauaugauguauguaaagaauuuggcaagagaugauguuuggaaaaaauaaagaauggcuauuguagagaucuuaaggaaagaaacuacaguuaaguagugcuuuguaaucagaauaugaaguaaguacugaaaguggauggaguggcuguugucagcauguuauacuuuauacauuucauucauaaauuuggacuguagauaaaaguaaacuuuuuuuuuauuuacucuugaacaacaguuuuuuuuuuuccacuuagacuugcaucugcuccacugaacaauacauuuaauuguuaauuauuucccccuucaggaugauacauauacagaaagcuacaucagcacaauugguguggauuucaaaauaagaacuauagaguuagacgggaaaacaaucaagcuucaaauaguaagugacuuggcuaguaauuuuuuugaaauuuauuuugguaaauuuguaauguauuguuauuuuguauauauuuacuaugcuaacaaaauugaauguaaaaugucuuaagauucauguacuuaagauagaaugguagaauaagaauuacuuagauuaaaaauaauauuuucaagauuacuuaagccucauugaauuuucuauucaugaagcagagaaacucauguuuuaagucaaacuugguccucaucuuuuucuuuuaucaguggaaaucuaaguucaaguuuaccuuguccuacacugcaaauguuauagaccauuuuuguuugucuuuuacugugcuaagugcauggaacauuaaaggaacccuaggaagagauucuucauauguggcucaguugaagagaaguacuuauguaguucuaaguauuuuuauuagauagugugcaccaacucuguagaaacacagaauuuuguuggaaaaaggaacuuaguuuuuguaacauguucauuuuacugcucaaaaaaacgaaugcugaaagauuuaaugacuugccuacaguuacugguagaaccaagugaccgaagcucugucuucaauauuuugugucucugugccauccuaucccccuuauccaucuuuacacccccagcccccaauuaaauauaggcaauuauaauaguucaguugugccucuucaguaugggucugaguccugucagugugggcauaucuguggucuuuuaaaaaauaaaucucucaguauuuuucagaguaggcuauuagcaagaaguaggcuauaaacacaggaaaccagugacugccccuuuucauggaacugaugacacauggaauuggaaggaguccugcauuaggagucagaagacuuagauuuguugucuugguucuaguauuuaccuguuagagaaucauggguuugugucucuggggaaaaggccgaaguaacccugagacccaguuuccuuucuaaaaugugugugaugacaccugauuuacuaauuuauaagcuaguugugagaaccaacuguaauagcuuuguguaugugacaauacgugugaaagcccuuuguaaacuuuugggcagcauauagauacuacuuaugauaugacaugcccagauaaauggguguuugauagguuaaguugcucccuuuucuuacaugacucugaugaggaaaagaagguauguuaacaaaagauagguggcuguggauauugauauaaguaaacacacuugaugugucaaauuaggacuugcaaggauuuaguuuucagaaauagcuugaaauacuuucaaucagugaacaaauuacccuccauauuuuuucccacgauauaaguacagucucaaccuuuuauuuggcaccauaaagagcacauaaagaucuacccaaaacuguacuuuaaagcacugguauggaauaauuguauuaugugugaucauugguguuuauaagauuuggguguguauucgugugugaaacauucauauuuuguuacuuuccuguggcuggaagggaucuuauaggacacugucuuucaucuuugucugucuuucaucuuuaauaggaauuucuuuuccaugccugaaggccucauuuugaacauuuuguuuguuuguuuuuuuauuuuuugagauacaguauugcucugucucccaggcuggagugcaguggcgcgauuugagcucacugcaaccuccgccuccuggguucaagugauucuccugccuuagccucccuaauagcugggauuauauguguguaccaccaugcccggacaauuuuuuuuuuuuugagauggagccuugcuuugucgcccaggcuggagugcaguggugcaaucuuggcucgcugcagccuccgccucccagguucaagcaguucucuugccucagccuccugaguagcugggauuacaggcgugcgccaccacacccugcuaauuuuuuguauuuuuaguagagacagaguuucaccauguugguuaggcuggucucgaacuccugaccucgugaucugccugacucggcuucccaaagugcugggauuacaggcaugagccacugugcccagccuuccgauaauuuuuguauuuuucguagagaugggauuucgccauguuggccaggcuggucucaaacuccuuaccucaagugauccacccgucuuggccucccaaagugcugggauuacaggcgugagccaccacgccuggguuuuugaacauuuuuaagaagcuuaccauuuuuucgaaauagcuaguuccauuuuacacauaacuucagcuaggcauguugccucaugccuguaaucccagcacuuugggaggccgaggucagagagucacuugaggccaggagucaacauagcuccugugaccagccuggucaacauagagacucuaucucuaccaaaaaaaaaaaaaaaaaaguaaccagguguggugguccaugccuguaguccuagcuccccaggagacugaggugggaggaauguuugagcccaggacuucaaggcugcagugaggcaagauugcaccauugcaccccagcuuuggggacagagugagagacccugucucaaaaacaaaauaaggcugggcgcaguggcuguccgggcgucgugguucacgcuuauaguccuagcacuuugggaggccaaggugggcagauugccugagcucaggaggucuaagaccagccugagcaacauggcgaaaccucaucuuugcaaaacauacagaaaaaaacaaaaaaaaccacaaaaccucuaguugccaguuauuuuuuuuauuuauuccuagugauucuucuuuuuuucuuuuuucugagacaaaaauuucacuuugucucccucgcuagagugcagcggucagcucacuacaugauucuuuuagagacauguuaauucuuuauauugagcugaagccuguuucuuuuacuucugucucuucuuauuccuccgccuuguagagcugccugaaucagauuaauuccucuuuuauuggcaagccugcccuucagauugaucuuaucacaaccuuucuucuaccucugaaguccucauucuuuccuguaaugauauuuucagaaccuugugcaauuuggguuauucuuacauuuuauaaaugccuuuuauuaaauuugauuucuuaaaucaaguaugagauauaacacaugagguaaauccugucuugauuuggagccugaaugaauuucucucuugaacuucaagggcucauggcccuuucuuauuauuaaucaaagacaaccauuuguuguuucaguagcuauauuauuucuaguuugggucuuaagguuuuugauuugcuuguuuuuucuuuuuucuuuuuuuuuuuuuuugagacggaguuucgcucuuguugcccagacuggagugcaauggcgugaucucggcucacugcaaccuccgccucccagguucaagcgauucuucugccucagccucccuaguagcagggauuacaggcaugugccaccacgccgggcuaauuuuguauuuuuaguagagaugggguuucuccauguuggucacgcuggucucgaacucccgaccucaggugauccgccugccuuggccucccaaagugcugggauuacagucgugagccacggcgccuggccgauuugcuuguuuuuaauuaaaauaggggccuuggccaggugcaguuguucaccccuguaaucccaguacuuugggaggcugaggcaggcagaucucuugaguucaggaguucaagaccaguaugggcaacauggugaaacccugucucuaccaaaaacacaaaauucagccaggcaugguggugugucccuguaguucaagguacucaggaggcugaggugggaggauugcuugagcccggagauggagguugcggugagccaagauugugccauuugcacucuagccugggcaacagagcgagaccuuguuucaaaaaaaaaaaagaagagggucucacuuuacacuucugugacugguguuuuaaaaaucuaaacacaggccgggcacgguggcucacgccuguaaucccagcacuuugggaggcagaggcacgcagaucacaaggucaggaguucgugaccagccuggccagcauggugaagcccaucucuacuaaaaauacaaaaaaauuagcugggcaugguggcaggugccuguaaucccagcuacuugggaggcugagacaggggaaucacuugaacccaggaggcggagauugcagugagccaagauugcgccauugcacuccagccuggugacagagcgagacuccgucugaaaaaaaaaaaaaaaaaucuaaacacaagauuuuacuuuuaauccuaucauuuccucuugcuuggcuucaguaauccuucaaguuuucuaggucuuuucaaaaucuugauucuguugauuuauauuuuaauuaucuuuuccuuucagcuuuuccuguucaggugugacaucugggucuuuaucugaguuuuauuagauuauaaaacauucagcaagauagggcagguacugaguccaguuguacaccauggaaggccucuuucugugauuguucauucaugaggcuuuaugaaaaugucuacauuacaccaggcacuuggagguuacagagaugaauaaaacauaguccauuaggaggcagacaaugggagagacaaacaugggaaaaaguuacucugauuaugaggaguaaugagaauuacauaugaaggaaaguauuguuaguacuguuaggauuuagugucaggaaaguuuucagaguagcaaggaaacaucagaaauuuuacucuuucugccaggcauggugcauguauuauucuguucucacacugccacaaggaacugaccaaaacugggugauuuauuaaaaaaaagguuuaauugacucauaguucugcauggcugaggaggccucaggaaacuuacuguggcagaaagggaagcaggcacgucuuacauggcaggaggcgagagagugugaaggaagugaagggggaagagccccuuaugagaccaucagaucuugugagaauucauucacuaucacuugaaugggggaaaccgucgucauaauccaaucacuucuccauaauccaaucacuucccucagugauuacaacuugagaugagauuuggguggggacacagagccaaaccauaucagugccuguagucccaguuacuuggaggcugaggcaggaggaacacuugagcccaggaguucaagaucugccugggcaacauagcaauaccuccauuuuggauaaaaaggaaauuuuacuuuuugggugccauugcuuacuuuaaucagcuguaacuucuuguugacuuuuagucaaaaaacaauuuuuccuucuaucuuugugaaagagguuggugagcaaggaagaaaaggaaacuugcuuuauugagcagcuucuauagucaggcacauuuuacaaacauuaguucauuuaaaccccuuuagcuguuguacaaggugaaugcuaucuagcauuuacagaugaagaaacuguuaggugacucucccuaauauuaaauaaccaggaaccuggauuugauguuuugaagucaggguagcuugauccucgaguucaugcuuccuccaaggauacacugaaagacuuugagccucuuuuuuuuuuuuucucuuuuuuugagacaggaucuggcucucuugcccagagugcaguggugugaucucagcucacugcaaccucugccuccugggcucaagcgauucugccucagccucucgaguagcugggaccacaggcgcacgccagcauacuuggcuaauuuuuggauuuuuaguagagacaggguuucaccauguuggucaggcuggucucgaacuccugagcucguaauccgcccgucucggccccacaaagugcugggauuacaggcgugagccaccguacccagucccaacaguuuuuuaaaacccagaacuauaaugcaauaauguuagcauuuguuuugggaguuugagccuaaaugguugaagugcaguaaauuguucuuaaaauacguuuuaugaaaguauuuggagucaucuuccuuacauuuuuuucucuaggaugaagacaacaccuagccaggcaugguggcucaugccaguaaugccagcacuuugggagaaugaguuaggauaauugcuugaguccaggaauuugagaccagccugggcaauguagcgagacucugucucuacaaaaaagaaaaaauuagccgggugugguggcaugugccuguagucccagcuacucaggaggcucagguggaaggauugcuugaggugggagguugaggcugcagcgagccaugaucaugccacuguacucagccuggaugacagaaugagacgcugcuugagaggggaaaaaaaagacaccugcuugggaugauuaaaguucugucuugacugguaguuauuugaauuaggucccuccagugcuuuuaaucaugguagaaugugcuagcaagugaguuugucuuacauggaagaguucuguguucaagggcuuucggccaguggcauuccuaaacacaguguuaaaggcgguagggaaugugaaaaguaugacauaguuccugcucucaacagcuuguaauuuuaguauuauuaucguaagcucaauuguagguacuacuucuuuucuggacuuucaggugcuuauuaccgugcaauuuagugguaugaguugaggacuaauguuucuauaucacauccugauaaucuccacaguuaugaaaacuaaacuauuuccccucccuccuacacuuuuccccaacuuuauuuuaauggaauuguuuggauuucuugauuguuuuguaauagugggacacagcaggccaggaaagauuucgaacaaucaccuccaguuauuacagaggagcccauggcaucauaguuguguaugaugugacagaucagguaaguuccaagaggagauuguguuacagugaccaaguaggaagccauuauuugauuaaugucagauucauuuacuacuucauauauaagccaucaguauuaauuuuauggcagaaaacuuuguccacucucaaauauaaaugugaaucacuuaaaagacauuuguuuuccuguaauaaauaaaagauuaguaauuaguuuuacguuugcuuucaagggauucugguuguauuuauugucaacuaaauaacuuugaucaaauagccaagacucuaacauauaggcaagaguuuguagggaaucgugaguugcuuggcuuauacuguguucuugguguuaaguauuaacaggaauauggccugguaauuagaacuuguccaucagaauugccaaaagugggauucgggggucucugccuauggaggaugugguucagaaauaaagaauuugaauaggauaagcuguaggaggaucuuaguaugagaaugaguaucugaagauuagcugugagagagggcagagcgauggagggaacaaugugggacagugugaagcaugugauccaggggccauaacuuuuuuuguuacuauuuuuuuaaaucagaaacuuagauuucaguguccuuucuaucaaagaaaaggacaaaagauaaacguucaaaauuggaauuuauuuuucuuuuggcaaauguuaaaucucaccucuaaugagaaaucauagcuaauuaggagauaacuuacauguaagcauuuagauucagugccauuagaagugcugggugggugauaucugcaggagaaaaaaaugaugcuaguuuaaaaaaucucuacuauuaccgugaaauauuuuuaaaugaaaacuuucguccucuaaauaugacuguggaaaagaaaaugaguauauuuaauaacaucuuuugacaucucuaguaguaacaguaggucaucuuauucauaaaccaaaauuuuaccaaauuucaggccaggcgcaguggcucacgccuguaaucccagaacuuugggaggccgaggcgggcggaucaccugaggucaggaguuagagacuagccucgccaacauggcaaaaucccaucucuaguaaaaauacaaaaauuagccaggcgugggggcccgugccuguaauccuagccacuugggaggcugagacaggagaaucgcuugaacccagcgggcagagguugcagugagccgagaucgcgccauugcacuccagccuggaugacagaacaagacuuugucucaaaaaaaaaaaaaaaaaauuaaucaaauuucaaaaccagguuuuguaguacauuuaaauugcauauuccaaagcaguuggguuugccugcguugcaguuuaauauuaagcuauacuucccuuucaaauaagguauuuucaucguuaagccuguaaauucuaguuugucauuguuuagauauuuauagucauuuuaauauaucuguuuacggccagcugcaauggcuaacaccuguaaacucagcacuuuuugaggccaaggugggccgauugagcucaggaguucgagaccagccugggcaacauagugaaacuccaucuauacaaaaaauccaaaaaaaaaaagacaggugugguggcaugugccuguagucccagcuaucccggaggcggaggcgggaggauggcuugagcuugggaggucgagggugcagugagcugugauugugccacugcacuccggccuaggugacagagcaagacccugucucaaaaaaaaaaaucucuucacuccuuagcagugguuauuuuguagcuagaguugucucacuagcucuuuguuauuugucuguuaggucaggaacgauguuucuguuuauuccagaacuauauuaucgaacuauauuaucagucuuucaaaugucuuuuuaggaguccuucaauaauguuaaacaguggcugcaggaaauagaucguuaugccagugaaaaugucaacaaauuguugguagggaacaaaugugaucugaccacaaagaaaguaguagacuacacaacagcgaagguauguuuaaaguuuaauuuucauacugaauuugaagguguugaauuauguauggguucugcaguaacaguaaggccacagccuuuuaaaaauaugugcacuagaauacugugacagugacaauuuguguagcaucuguuuggauccaaugaacuuaguuccucacgcuccauuauggaugguagaaaugcacuaagaauuagugaaaaagauuuuucaguguuaauugugccucauuauucucuuaggaauuugcugauucccuuggaauuccguuuuuggaaaccagugcuaagaaugcaacgaauguagaacagucuuucaugacgauggcagcugagauuaaaaagcgaaugggucccggagcaacagcugguggugcugagaaguccaauguuaaaauucagagcacuccagucaagcagucagguggagguugcugcuaaaauuugccuccauccuuuucucacagcaaugaauuugcaaucugaacccaagugaaaaaacaaaauugccugaauuguacuguauguagcugcacuacaacagauucuuaccgucuccacaaaggucagagauuguaaauggucaauacugacuuuuuuuuuauucccuugacucaagacagcuaacuucauuuucagaacuguuuuaaaccuuugugugcugguuuauaaaauaauguguguaauccuuguugcuuuccugauaccagacuguuucccgugguugguuagaauauauuuuguuuugauguuuauauuggcauguuuagaugucagguuuagucuucugaagaugaaguucagccauuuuguaucaaacagcacaagcagugucugucacuuuccaugcauaaaguuuagugagauguuauauguaagaucugauuugcuaguucuuccuuguagaguuauaaauggaaagauuacacuaucugauuaauaguuucuucauacucugcauauaauuuguggcugcagaauauuguaauuuguugcacacuauguaacaaaacaacugaagauauguuuaauaaauauuguacuuauuggaaguaauaucaaacuguauggugauaaguauuguuuugauucuuaugguuaaagggaaauagagccuugcauuauauucaacacagccauuugugugugcacaaugcaaacuaagguauucuagaccuaucuuagagcagcauccaguauuugcuuucuagauaauaugcccaauaacaugaccuagaggggcuucugugcuguguagggauuuaaccaacuucagugguucagggagcucaaacuauauguaaaacaaguuuagaauguaugcuaucuagcccguuaucucugauccuucucuaaaaccauuugaaauagcuucauugaucaacauuucauaaaugcaucugugguagagguagaaagcagcaccuuuccuaauuggcaaaugaucagacuaaugugugcuaauguuuuucuuccaugcuuucagucagauucaacuauuuuauccuccacaguugcuuaacuugguguuggaggaggguuuaagcauuaagauaggaagcaggaaauuugauugcucuaaauuuagaaauuauaucccuaaaaauuaaaacaugaauacugggugguaaugauaauugaggcaaauguauuuauuuuggugacauuuugcauauaugaagauuuucugaaauaggaccuucaagauccuaggggguuuuguuugguuuuuaauugugaggaauaaaaaaucuucugcccacacuggcauuuuaaggugacugaggucaaacguuguuuccuuagguugaaauagcagccaaaacauucuucacgcaggggcuugggauauggcugcuggcaacacauuuuguugugggcuccuuaauuuaaugauaaaauuuaagcuaaacacaagccaaaaaugaauagguuuuuuuaauuuuuauuuuucacuaaacaggcaauugaaauacaugguacaaaaauaagugguaagauaauuguaaaaugaaauggacagaauauucaauuuuccaucuaugaaaauuucacaauaaaaaucauaguuuacuuugua

SEQ ID NO: 192218 - RNA, 2336 nt, Homo sapiens
augagucuucuagcuaaaccuaugagcuuugaaaccacagcaaucacuuucuucaucauccuucuaauuugccucauuugcauccuccucuuauuggugguuuuuuuauauaaaugguauaaauccaugcugauaauugggaucagauuucaagucacauuagcaaauguguauagaaauaauguaaaacaauuuaaaacagaacaaguaaugauaccauaauuaucuacuuuuccauuucagcauuuuagaaaugcugauauccuguuuaaacgugaaguuucuauaccacaccuuaaaaucagggccauucuuccuuuucugaauuuguggcuuguuuguuuucaguuuccaaggcaggaaagguaaagagacaaagaaagugccuuguacagaugcaaacggagguguagacugugcagcugccaaaguggugacaagcaauccagaggaccaugaaaggcgaguguggugcaggauguggcagaggccauuuuguguuugauaguggggaugaggaugcaugaauguuuaaaacucuaccgauuaauuuucuaggaucuuaaugcaagucaugaacuugaaugugccgaugaggccuggcauucuuguccagagacagaguaaggaaguguuggccacacccuuagaaaacagaagggacauggaggcagaagaggagaaccaaauaaaugagaagcaagagccugagaaugcuggagaaacuggucaagaagaggugauguguuuuucuacucucaaagagcaguuuagaauuuguuugauugaaaauaagguacauuccucagcuagguauaauaauaggagauggaggaccgggcggguggcucacgccuguaaucccagcauuuugggaggccaaggagggcggaucacgagggcacaucgagaccagccuggccaacauggugaaaccccgucucuacuaaaaauacaaaaauuagcugggcgugguggcacccgccuguaaucccagcuacuugggaggcugaggcaggagaaucgcuugaacccgggagucagagguugcagugagccaagaucgccacugcacuccagccuggugacagagggagacuccaucucaaaaaaaaauaauaauaauaauaaauaauaauaauaauaggagauggaguugcauauaacuuagguuuguaaguagaaugaguccaaugcccacagucauuuaagccauucugguugcuuaucaguucguguuacuaaaccauuacauaugccaagucuagaaacuugcuuagucuucauucuuacauuuauguuuuucuuaauaauuccccuucaguuuguuuuucucaaaauccuagaaucuuagagcuguuaagagacuaucuagggauccagcccucuccuguuuccaaugagaaaacgagaugaauuguuuaccucuccacuguggccaagcucaggcccagaccgcagcccccugugcuagcuccaggguccuacaacagcacacaacacagcuggguccuucuugagcucugugucugcgauucccugacacgaacaacucacauacccucccaccccauggccaugcccgguugacgacagaaugaugguccugguggcucuuggguuugaccacuucauggagagaauuacaugucaccaaauguuauuugaauaugucagugugugcuuuuauaaccauaaaaaugugaaaaugugaucaugauggauuauugcuacuuuccuauaucauuuagaaaugcuuuuucuguuucucguuaaguguacauauaaccuguaauuuuaaaagcagggcuugucauaaauugauuauuuguuuauauuguuugucccauucucuugcaggaugaugguuugcagaaaauacacacaucugucacuagaacuccuucaguuguugaaagccaaaaaagaccuuuaaaaggagugacauuuucuagggagguaauuguuguggaucuugggaaugaauacccuacaccucgaagcuauacucgagaacauaaagagaggaaaugaagcucaaaaaaggguaagagugaaagaaaauguaacguuugacuaacguugaaagacugaggguacaaaaucauguugaaacaacaaaacaauggggaauuaagcaaauaaagauauuauuuuaccuuugugcagaaaggagugagccaugugcaaaauucuguaaguaaaauacuuagagcuugaauauaauuuuuuaaaaauucaaaucugaguucaagaaauugauuguauugcccuuaaaacuaucuacucaaacacuguucuggcaugugaauaaagugauuuuuguuuguacaaau

SEQ ID NO: 192219 - RNA, 146273 nt, Homo sapiens
aacggcaaauaaccuuguuauuuuauuagaagcauauuuacauucuuguaguuaacuuuccagagaacauuuuacaaaaauuuuguauaaagucuggaaacuacauaaaaauaauuucuaucuuucauaaagggaaaauaaaaguuaguuacauuuacucuaaaaccagacagaggaaaaaaacccaguucugucugucccuuauacagaaagcacuaacacagggcacgaggaauaccgcgugggccucucagagaugggcauugcacgguggcuccacggugaggcuaggugaccccgccaguccccauccagaaaagcacaggggagcucugagggcucaggcggcacugagcggggacgcggcaacuccuugaagggcaaaagugaugugaaggacgagccacgaggggaaugaucacagacuuucaccugaaccaugaaacuggcauuucaccuaauacuuucucacacgccaggcuacacauggaaauacuguaagcaaagcccaaagcagcccugucuggugguucccaacgcuggccuggccugguagaacugggucuauguucugcaguuacacugccgcuaguucauguuuccccagcaccaaugcaccaaagagaauaaaaggagacaauuguuucgcuugucucauuugugagagaccuaaaaaacacccccaucugggucaaauucugcagcaggcaagcuaaaugcucacuaaccugagaaccauugcuagcuccaagagaaucuugacugugcauuuaagauuugggcaguccccuuuuccuguugaagggcugccccucccuucccaagcauucaguuauaaccaauguugagaaaauuuccagggaauugcuuuagaaagacagaguauacagaaccuuaaccuagcugggugcaguagcauguaucugucgucccagcuacucaagguugaagcgggagaaucaguugagccacgaguuugagaucagcuugggcaacauauuagagacccugucucaaagaauuuuuuuuuuuuuuuuuuuugagagacagagucucgcccugucaccuaggcuggagugcaguggugugaccuuggcuuacugcaaccucugccuccuggguucaagcgauucuccugccucagccucccgaguagcugggauuauaggcaugcaccaccacgccuggcuaauuuuuguacuuuuaguagagacaggguuuugccauguuggccaggcuagucucgaacuccucaccucaggugagucaccaugcccggccuaaaaauaaagaaucuuaaaucuguaggagugaaggcggaaaaaguccucccaggaagucucaaccacucuaccaccagcgaaacacuacccagacucaauaugcccgcaugauuacuccaaaucauuaccaguuuuguguuguuguucuuguuuguuguuuuaaaaagcagauaucuuccuggagaaaccauacauuuuauaguuguuucaauaaaauaauuagaaaucagggugaaaaaagguuuccuuguaaguaaacccgcauacugguucaaacauuugcuuuuauugcguuauauacauucugcagcuguagaaucagaaucugggggaagccaacugagaccccgaaggcccagcaggaguccaucugagguacagaaccugugcuucugccauguuccuggggcaggggcauuccauuucccccugaugcuuuuucuuccugaagagaaguccaacagacugccagcccaggucugaaaugcaaggugggacuccugaacacagucggggggauggggcagaggcaaacagcccuccuguuucaccugcagacagggugggccagagugcuauggagcagacuggguuguggaagccucgugugcugaggaaucagucccugcacacaggagccugugcgggggccagcacgcaucgcagccuggcaguacagccugugcuuuuccaugccuccggugccaacaccccgcacgugccacaccaacugcuccaccuaacaugcucaguggcacaggcucaggcagcaaacguguuccaacccaccugggcagaagaggccaggccagcagaccaaguccuguguguacgcguaugugugugcauucacacccaugugcaggaagggggacgcgagauggcaugaaacacgggagaagcagaauaaacauuucagccucccucuuuccccgguccccgccccccacauagacaaggcuuugucuuaaguggaaagcaaacugggagaacaggaggaaugaggccaucuccugagcagccagcugcaggccuggcuccucugggaacagaaauggcugugagggacuugaugauugagugacucugcagggaauggcugaaaaaccaagaauuccagcccggaugagcccacggggacuucaucagcagugcuuugucccacagagagcaaaacugguauuuucgcaaacaggagaggacucgaggccacagaacacccauuccucuuggacccugaccccaccaacagccccaucccuuccagcuugaagggaucuggggcucaaggagaauauacauuagguucaggugacaaauaauuacaccucacccuccacaggccagcaagaagucaggaacgcuggggcaggucuaucaggcacaguugggguggcacagggcgaggggcuggauuugagcuggcacagacgcaagagggaaaagggguccugaguuacauguucacagagaaugaaggagaaggcccuggggcccaccaagcugccagccacagccccgggcgguuguuaagaagcauccgcagaacuguaggggaagaacuuggcggccuugcuugggguggagggguuugggcacuccgccuccucgcucagcuugaagaacaucuccugcucccgcuucuucugguucagauccucuuccagagccuagggaagagagaggauggauggcacuuggugagaucugcaggccacacgugggucucccacucacaggacccccacugacauggccuucucuggaacauucccuuccaggccucagugcuugagaaacuacggcuucccuauuuccuacccuagagcuccucccacaggagguaaguaccaccuccugccaccgccacucagaagcucccuguggacugaaggguacaguugggggaaaugucaaucuagacggggcagggaggaaaaaaaagcagaugcaaauccccuggcaggaaaacagccaaaugacuggagaaaaacccgagggagaagauggagagagacugagcagcaaaggaagcagagaugucagaaguuuuuuuuuucaaaauacacaugccugaguugagauugcgccacugcacuccaacuugggcgacggugcgagacuccaucucaaaaacaaaaacaaaaacaaaaacaaaauacacgugccuuugccuaaacccagagguucggauuuugaagaucuguggugggaccaaggccuucuguacuguacaaacucuucagguaacucagaggagagcucuaguugaaaagcacugcgggagguucccuugggcacaagcaaguuuaucuagguaaauuggauccuaccagaaauauuuuucuuuuuuuugagacagaguuuugcucugucgcccaggcuggagugcaguggcacuaucuuggcucacugcaaauucagccucacagguucaagugauucuccugacucagccuccccaguagcugggauuacaggcaccugccaccaugacuggcuaauuuuuguauuuuuaauagagaagggguuucaucguguuggccagacuggucucaaacuccugacuucaugugauccacccaccuuggccucccaaagugcuuggauuacaggcgugagccaccgcgccuggccuaggauuuucuaaagaaacuggaaaucaagauuuuaauguaaaaucuccuuauauacuuaaaaguggacaucuuuuaaacaauuuacaggccaggugcggugucucagccuuguaaucccagcacuuugggaggccaaggcgggcggaucaccugaggucaggaguucaagaccagccuggccaacaaggcgaaaccccaucucuacuaaaaacacaaaaauuagccaggucugguagugugugccuguaaucccagcuacuugggaggcugaggcaggagaaucacuugaggcgagguggaaguugcagugagccgagaucgugccacugcacucuagccugggugacagagcaagacucugucucaaaaaaaaaaaaaaaaauuuuuuuuacaucacuauguuggccaaacauaccaugccuguaagccaauuccagcacauaggcuaucaguuugggaccucugcucuaggaauaccaacaauuuaauaauaauagcuacuacuuuuugagcacagaaugguuuaguaacuugcccaagguuucacaacuaguaauggaggaguuaggacuucaucccaccugugugacuccaaagccugggcuguuuaagcauuauucuguucuacccaccacauauauuucucaauacaaccuucuuacgccagagucagcgaucuuuuuucuguuaugugacagauaguaaacauuuuuggcuuugcaggacauauuuggucucuauugugacuacucaacugccacuguaguacaaaaucagccacagacaaucuguaaaugaacgagcauggcuguguuccaauaaaacuuuauuuacaaauauagguggugggccagauuaggacauuggcagugguuugcuaacaccuacuuuaaggaaauaaauauuaucuacauuuuacagcccgaaaagccaggguucaggagggaagauuugacuuguuugaggccacauucugugugaacacugacccaagcaacacuucauugacucuaccagauauuccguacuuacucgaaauacaucugaauuuuucuaaaaauacuccacaauguacaaucaucucccugccuccauacaaggcaggggguucacaggcugcugaccguaaugcaagaauguaaaagaccauuuauucucgaaugaaaaucaucaccuccgggucauuguuccagcagaaacccaagcagcuaaugacagaagaauucuauaaagaauucugcaaagaggcagcccccacaggcaaaguccaaugcuggcuucccaacugcacacucguggugccuccccugagcccaggccccucuuugaagcgaucugagacauaaggcaauagcuagaggaaacgcgaucauucauuuucaaacucucucaggauaggccaaggguauagaacccccagguaagagaaccagguggacguucauuuccugauugcagaaccaaccuaugucagcaggaacauuauugacuugacugucaaguauggaaagucccagcagaccaugguuacagaaacugaugagcgugggccuaacaggaagucugggaucuuggccagcuuccagccagaaagcuccaugagcgcagggagggaggccucaauucaaggacucccaaggccaucacacagcugagaugggcaguugccuccuguccagaccacaguuacaguaagcagaacugauguacgauggcagaacaaaccucaggacuucaggacccgugggcaugagauuaagaguaacuugggcaguucucuccucagagaguuuaggggaaugaguauguccuuggccuguacuaugugcuggcaacuucugacauaaccuugcaguauugauagcuucacuguacaaauaaccacacugaggucccauguuuuuuggguuuuuuuuuuuuuuuuuuuuugagacggagucuugcucugucacccaggcuggggugcagugaugcgaucuuggcucacugcaaccuccgccucccggguucaagccauucuccugccucagccccccauguagcugggauuacaggcaugcgccacugugcccgacugauuucugugaugguuaauuuuaugugucagcuuggcaaggccacgguauccaccuguuuggucaaacaccagcuagaugucacuaugaagguauuuucuagaugugauuagcauuucaaucaguaaacucugaguaaugcaaauuacccuucaucaugugggugggccucaaucaguugaaggccuucagagaaaacaagagagaaggaauucugccucuagacagcaacaacaacugggucuccagccugcugaccuguccugcagauuucagacuuaccagcccccacaaucguguaagccaauuccuuaaaauaacuaaaucaauuucccucucccucucccuacacacacacacacacacacacacacacacacacacacauccucucucuaucuugguucuguuucucuagagaauccagacuaauacggcccagagcggggaagauggcuugcccaagaucccaaagcuggugaccagcaagaacgucuagagugccagcuagagaggaaauggacaaauucccccaaccucugauaccauccuaguucaagauaccacccuaguccaagcugccaucauuagucaccaaggcuaucacaaugguuuccugacuggucucucugccuccacucuugaccccugagggcagccagcgggauccuuuucaaaacaugagucagaccaccuuguccucugcucagaacccuccaguggcuuccaucucacacagaguaaaagccagacuuuacgcaggccccccaccccucugacuuuaccuccuaucaccucccaccgucaccaccacucucuccggccgcaggggucuccuuguuucacgagcaagguguccgggccuuugcaguugcucuucccugugcugggaaugucccccugaaaacccccacggcugcacgccucccucccucagguccuucagaucuuggcucagaugucaucuucuuagacgacaucuuccugccacaccgucugaagcagccucacuuugugacccccccaugcuguuucccucccugcuucuuggccccuuacuagaaggucgguucuuccggagggcauggacuugucccuuuuguucaaugcagugucucuagagucugaaacagcguggggcacuuagcagguguucaagaaauauguguugcauuaauacacaaacgaaugaaccaucaagcuaacgaugacacacaaaugcaaucccaugugauaaacaccaugacaggggcaaggacggggagcccagaagacaccauacagccuccgugggggaggccugaauaaugcagacaaacagaaguuggccaagcaaaggcugguggguagagaauuccuggcaaggggaacaggcugggcaaaagcccagcagggaacgagggaagcgcauauggcauggagaucuauuuggguacugaaaucugcucagagcacaagucggggaugagacucacgggagauaaggcaagaacaguaguucucgaagugugguccacgaaccccuagggggcccaaaacgcuuucugggggugggggaggggcagcaagcucuaguuuccugcuaagacacaguuugcuuuuucauuguuuugauauuggugcuaaugguacaaaagcaaugauggguaaaacuucuggagcuucuggaggauuaagacaauggccccuccuaacugaauggguauucuucaccaccgugcacucacauguguuuauuuuuauuuuuauuuuuugagauggaguuucacucuuucgcccaggcuggagugaaguggugagaucuuggcucacugcaaacucugcccgccggguucaagugauucuccugccucagccgcccaaguaucugggauuacaggcaugcaccaccaugucuggcuaauuuuuguauuuuuaguagagacuggguuucgccauguuggccaggcuggucucgaacucuuaaccucaggugauccacccgccuuggccucccaaagugcugggauuacaggugugagccaccaugccaggcccacucauaguauuuuagaaaguuuuucaauuaaaacaauaaagccaauugcacuuaagaucaccuugauggugcaacacaaaugguucauuuuauuaaauccugaccuucaaggucacagcccuuuaacguccugugugaggaaaugagaacuaugcauaaggcccgccugcugccggucaaagcaugauggcugucuagagauccuguucuugugccugguauuguucuugugcaaucaucuugaguugugggcugaacucgccacuugauucugcagaauaucauuuugauuaaaaaacaacucacaacugggcaugguggcauguguuauaguuccagcuacuugggaggcugagacaggagaacugcuugagcccagguagucgaaaugagccugggcaacauagcaagaccccauuucaaaaaaaaauuacugacaaauauggguauuuagcaaacacucucuugaaaaugaacaaacugagcugaucacgucaagggaaacaaacuaaggauauuuacugccaaugacaaaauuugagcauucaagcaaaaaugagaacuuuggaaaaccuguguccaccagccugaacuugacagcuucucaauuuuuuuuuuuuuucuuuuugcgagggucucaaucugucacccaggcgggagugcaguagugcaaucauggcucacugcagccuugacuuccuggccucaagcgauccucccaucucaggcuccagaguaucugggacuacaggcaugugccacugugcccggcuaauuuuuguauuuuuuguagagaugagguuucacuguguugcccaggcuggucucgaacuccuggguucacaccuauaaucccagcacuuuaggagugguggcgggugccuguaaucccagcugcucaggaagguugaggcaggagaaucgcuugaaccugggagguggagguugcagugaaccgagauagcgccacuccgucucaggaaaaaaaaaaaaauccgcuggucuuucucgcacuuggauguaacuuugcuccagccaugauccuguaacaucaugcauuggucacuuagaaaauauugguuuacugaguuaugcagaucuuccaaaaguugacacauuucauuauacaauauuuaaaaaaaauuauaucuccaccaggcacaguggugcacaccuguagucccagcuagucgggaagcuaaggcaggagaaucacuugaacccaggaggcagagguugcagagagccacguucccacgccuguaaucccagcacuuugggaggccgaggggggcggaucacuugaggucaggaguucaagaccagccuggacaacauggugaaaccccgucucuacuaaaaauagaaaaacuagccaggcauaguggcaugugccuguaaucccagcuauucaggagguugaggcaggaaaaucauuugaacccaggaggcagagguugcagugagcugagauggcaccaccgcacuccagccuugggcgaaagagugaaacugucucuaaaauaaaaaauaaaauaaagaaaucaacagaugggucacgagggacguugcaaaggggcuagugacagagaagaaacccagcagaaggugggccuaggaggacaaggcaggcgaggaagagagugacuggcagcacuggcugccaccaggaggucaaguccagccagccguauccaugcgagucagccaccaggauguugguauugaccaugccagcagcggcugcagugggcugagaaaggaauuucucaguggguggaggaagaaauugugacagggcuucgcagagaaagagagagacagggcaguaaagaaagaugugggacugagcgagggcaugggguuugaaggugaaaguauggcaggcaccauucaaaaaugaccccugugacucucucucauauaacucuccccgcuccucugcguguggguggaaccucugaaugugguaucauuccugcaagcagggaggcuaucccgugacccugauuuaaucacaugagcacaaaaggguuuucucuagcugguggcagaaagggauaucagagacauucaaagcacgaggaggucugaaugcaugcuggcuauuugagguggaggaggccacgugauaaggagugccgguggcuucuagaaaauaacccgucugaggucagcaaggaaacagggaccucagaccuacagccauaaggaacuggauucugucgaaagcugaauggguuuggaagugauucuuccccagaaacuucagcuaagagcccagccacgcugacaacguugauugcagccuggugagacccugagcagagaacccagagagcccacccagacucuugaacuccaucacuaggagagaguaaacgggcguugguuuaagcugcuaaguguguggcaguucaucacacagcaacagaaaacuaaauuggcaagcaguuuaucuugugcugcguucugacuccucagaauaacuuccucuaagagaaaauccccacaggcugggcuucuggcccagcagcguggcugguuugacucacugcagcguccucuguggacacauggcaggaguccuucgguccaugagagggagcuaaacaagaggcugcccuuccagagguggaagcugcagggcguucagccacaaaggguuagaaaguuccccucucucucaggcuggagauccauuugauggugccacaaagcaagaguccaccaaaauaaggagaccuaacauguccuggccagaggccugugcauggcacagagcagagcccgagacugagcccaccagcucggauaaaguuaccuucuugcgcggccgaagcuugucccgccauuccuucagguucugguuauggcucucauccagggccuucaguuucuggguuucgugcucuaccaggagguggcacuuuucauucuggaacagauuccaggcagaacaggugagaaaucagaagacgcaggcccugaagacugagacacaccucacgcuguggcuacgagggcaccagcaucguucauuuauuauuucuucuugacuauaaaucccauuuauucaaacucuauacguaaaucacaugcaccaagaagugccuggaggaauaguccagaauauguuaauaguucuuauuaacucugugguggggagguauaguaaauuugcaacuuucugugaggauacagcaagaaggcagcuguccgcaagccaggaagggagcccucaccagaaccccacccugcuggcacccugaucucagacuuccagccuucagaacugugagaaagaaguuucuguuaauuaaagcaucaugguuuguuauggcagcccgagcuaagauacucuguaugucucacauauaauuuccucagggagaucuguggcaaggaaugagggucacugacaugggugagacucuucuaaccucgcuguucuuucucugagguaaguuaucugcuuuacaaaauguaaaucucucucauaggcagcagugacaagucccuguugauuucuugcagggaaucagucuugucaugaggagcuuauaaagcagggggaagugccuuuauccagauaccacgacccuacuggguuggaaaaguagaauccuuugggagauuuucauuuuggguuucaugcuagaggcuucugggaguuuagaacuuggcugagugagaaguaauacucgcagcagcgcugcaugccuguggccugccaggagcugugcucggcacuucauacgggcucucucagugcucacacugaggcagggaucacccgaggcagggauaggaaaacggaugcggaaggugaauggcuuggccaaaagucacacagugguaaucagcagagccgugccgggcaggccucaacaccuggaauguuuccuccaugccuccccaccucuccagaaauugcccgauggguccaacagccugagcaguuccugagguucgaaucagccccguccccacaagggggcuucaaguaccagcuccuggggccaggacccucaggcauggggcaaacccaggggccaggaagcuugaagaggucaggaauuaccacagcaaaagcagcccacaaggggcucggccacaccccaaccaccuuugcccaaaacacagugaugacucagaaacccugcagcagcccacugccagcuccgucacuucauucacaaguccuugccccaauccugcacagcaggaauggucauccccaugcccauuuuaggggugugagagcuauggcuuaggagggugauaugauuugcccaaccucacagagcccuagagcagcauggcagggcuggaaaccauccaucccgggcgugucugaugaagauccuucccugcuguggaguuucuggcccccugagaucugauggccuuggggaaacugaggcagccugggggcaggggcaggggcaggcagggcgguaccugcagcugcugcagcucgcucauguugcucucacacugcgccagcaugucccgcaucugguucucguguuucugcuguugcugcagccgcuccgacuucugccucuucuccuccugcugggagaacugcaccagagagagggugggugccucaggggaccagggccuggcugguuggguagggagccccacucagcccuggcccagggagaccccucagggggacuggucugugcacagccccaguacccagcaccaccucaggcugugcccguguuaaguccucacccugagcugagacccagccccagcccucgaggagcccccaggcugguggggacaugacacugcaaugugacacacgccaggaaaguguguguagcaggcaggaaucacaagggcccgugugcccgagccacaagggcaacacaggauguggggaagcuggccaaauaaaagugugggagugcggaagggaagggugcaggagaauuggcaacauagcaccaagcucuaccucuguccacacacagaggugaauucaccaugaggcugaugaagcuuccagggcacgcauggugacucgcacacccccucccaagaccuuauggcgggugggucggagugcaucuuucuuuuuuguuuuuuuaagauggagucucgcucuguugcccaggcuggagugcagugguucaaucuuggcucaccgcaaccucugccucccgggcucaagcgauccucccaccucggccuuccaaauagccaccacaccuggcuaauauuuuuaaaaaauuauuuuuuuguagagaugggguuuugcuguguugcccaggcuggucucaaacuccugggcucaagugacccgcccgccucggccucucaaaguguugggauuacagacgugagccagccugcaucuuguuucauauucuccaaaacuguauaaggcccaggucccgccaaaccuggcccugccuacaccccagcacacuugcagaccccgcaggcccggcccccaccugcuugaucuucucacgcugcucagcugcgcugcccccgccguugauguggaggcucuucuuguacauggccaugcgcgucuugcccucacuccucuggaucuugggcagccgcgccuuuuccuguugcugccgcaccuucagcugcucuaucaugcgcugguuguagcgcugcaucugcucccgcuccuggagaggaauauccagaggggcugagggcagcugcacucuggacucagagcguggucacaggcuaaagguccccacacuccacucaggggcccaggaccaacgcagcccacaauguucagcagaucaaggcugguguuauuuugcuucuacacuaauaacauuauuuguucucacuuuaaaaauucuuguuaauaauaucuuggauucuuaccuucuaaaugccuuuucaucuaaucaaugauggcaugccaucauuagcuaauaucucaaagcaaaauguacacgaaaggggaugguuuaccauuagugauggcagauaugaacuuauauuuuaaaaaauccugauagauuugaauuuuuuccuuccccuaacaccuauuuguauuucaaagcucagcaugggcaucaccuccuccaagaagccuuccccgauuucuucacuugguuggguagccuuauucugaacucccauggcccuauacugacuuccaucacugcauuuagauaagaaacuggaauuauacacagcugcugugcauccagaccuuggucugucugucacugucccacuauggaggcugaacugagacagacaauucccgcaggagagggugcuuuggccacacagaguaggggcccucaccagcucuggggaguucagggaaggcuucccagcagaggugguguuuaaguggagaccuaaaaguauugagggaaugcacaagaaagagagaaauaaagacaaaauggaaagggaggacaaaaagagggaaaagagaaaaaagagcaaaagaaagacacacaccgggcaggcacaguggcucacgccuguaauccuggcacuuugggaggccaaggcgggcagaucacuugaggucagggguuugagaccagccuggccaacagggugaaagcccaacucugcuaaaaaaaaaaauacaaaaauuagccaggcaugguggcaagcaccuguaaucccagcuacucgggaggcugaggcaggagaaucacuugaacccaggagguggagguugcagugagccuagauggcgccacugcacuccagccugagugagagagcgacuccaucucgaaagaaagaaagaaagaaaagaaagaagagaaagaaagaaagaaagaaggaaggaaggaaagaaaagaaagaaagaaagaaggaaagaaagaaagaaagaaagaaagaaagaaagaaagaaagagaaagaaggaaagaaagaaagaaagaaagaaagaaagaaagaaagaaagaaagaaaagaagaaagggaaaaaaaagaaaagaaagagacauacacagcaaguaacagucagugagggagccacuugggccauuggcuucccugcaucguuuccccuauuccuagccccuugagcugaagcaggacgccccuggagaaccuccuggggccucacugcagccagcccuggcuccucuugggggcacuugucauccaaagugugcacccaagaggugccccaucacauacagccucauggcucucccaggucggcccggcagcagauccgagccccgugccaccggcagccucaccuucucaugcuugcgcagcagcucgugccgcuggaggaaguacuggucuuugagcugcugcuucaccagcuggugccucuccugcagcuggugcucuuccaucucccacagggcugcuucccggucugcagaggacaugccaccgagcuggugaggugcugacaaccagagacucgacaggcccccugccccccaccucugccuggccuccucaugcuggagaugauaaccaaccugcugggcucaggaauugccacauguucuaccucauuagaccauguuggcugaucugagcugaggccuagaaacuuccuuuaagccuaaggaaugagagcucccaggagcaugguauagcaggaaguauucaaagucaggagccacagaaacugcagcuauaggcuggaacccagcuccaucggugggauuaggaauggagagguucucuaggcaucagcugccaugucugccagauggacacagcuauaccauggagggaggggacguccuugggagaaacuuugaagugcaaaguuuccacacugcaucucuaccuuccugaugggcaccugggaagagcucagauggagaccccaugaagaagacagaauggccucuugucacuauuuccuccuuugaaaaaugggugagauccuccuugucuccugcacgucccaggcaugcguuaugaagacaaugaagauacuggcaucuuaacacuggaggucuauuaauccaccccugugcacagcacccggguggggaccuggggucaaagggagaaucucacgcccuucgagacaggagauuaugcuuggcucagugcgaauguuguuuauuucacugcauuccuguuccgugcaaaaugguaucugcuuuugguauaucagaauagugauucuggcuuccaccccaaaaucagaaccacaguucuguaaauaggacgguucuuaccaacaucaugggauaggaaaaggaagugagggcuuuucucaaaacaacugugcucuauucagaauauugaaaacucaagaacccuguuuugcugauccacaucaaauaauaagagguuuaucuugcuuaacugcacuggucaucaaaggccuggaugaggccuguuuuauaaaugagccaaaaauugcccugggauauuggccucguguuguuuacuuccucacagcaggcuuggaccgucaaaaguccacaggcaccaaacucaaauuuguacccauccucuuguuauuuuuaaaacauaauauguacggccaggcacaguggcucacaccguagucccagcauuuugggaggcugaggugggcagaucgcuugagccuagaaaccugagaccagccugggcaaaauggcgaaacccagucucuacuaaaaauauaaaaaucagcugggugugguggugugcaccuguaaucacagcugcucaggggccuaaggcaugagaauugcuugaacaggggaggcagaggcugcagugagccaauaucgugccacugcacuccagccugagugacagaguaagacuuggucucaaaaaacaaaaacaaaaaaaauguauauaguuacauaaaaaagcucaaacagggccaggcgcgguggcucaugccuguaauccuagcacuuugggaggccgacgcaggcagaucacaaggucaggagauugagaccauccuggcuaacacggugagaccccgucucuacuaaaaauacaaaaaaaaaaaaauuagcugggcaugguggcgggcgccuguagucccagcuacucaggaggcugaggcaggagaauggcgcaguggcucacaccuguaaucccagcacuuugggaggccaaggcagguggauugcuuaaggucaggaguucaagaccggccuggccaacauggugaaaucccaucucuccuaaaaauauaaaaaauuagcuggacaugguggcgcaaagcuguaaucaucccagcuaugaaggaggcuaaggcagaagaacugcuugaaccugggagguggagguugcagugagcuaagauugugccacugcacuccagccuggaugacacagugagacagcgagacucuccaucucaaaaaaaaaaaaaaaaaaaaaagcucaaaccaagcagauauuuagccauuuggagccugccuacuuugcauaccccaugaaacugcaccuaacaucugccagccauagagauggaagacccaagggcuccauaaagaccccaagccaccguugcccuuugcaguucucugacccagagacgccccgucugagcuccccacgcuggacgacaucaucuagacaugugagcccccucucaguccccuucuugcccaagaguuccuuugcccucuuccccugcuggaugguggcccgcaccaucaucuccagaaagccucauucuguaagggacccccucagcgugucaacuugucaaaaugccccccaagcaaagcugcugguaugcuacugccaucuuguggucauuuauuuuuccucaaucagcccagaaaucccuugaacucccaacagcaccaggguaggcccggcuuccugauauugucauccaaggcccagcucuaucacccauuaacugugcaaccucagugcuaugaucuaaacguuuguguccccuccccaaauguguauguuggaaucuuaaccccugaggugaggguauuaggagauggggcuuuuugggaggugauuaggucaugaggguggagcccucgugaauggaauuagugccuuuuuauuaauaaaagagaccccaggcugggcacguuggcuuaugccucuaaucccagcacuuugggaggcugagacaggcagaccacuugagcccaagacuuugagaccagccuggacaacacagaagaccccauuuacacaaaaaacacaaaaauuagccaagcgugguagcacgugccuguagucccagcuacuugggaggcugaagucagaggacugcuugagccucagaggcagaggucacaaugagccaugacugugccacugcacuccagccuuggcuacagagcuagacccugucucaauaaauaaauaaauaaacaaaaauccccaaaacccaaaaaaccacaaaaccccaaaaacccagagaccccagagcuagucucccuuccacuaugugaggauacagugagaaggugccaucuaugaagcagagaguaaguccucuccagaccacaaaugugcuggcacccugacuguggauuucccagccuccagaagugugggaaaugaaugucuguuguugauaagccacccagucagugguauuuuguuacagcagccugaaugaacuaagauacuuggccaaagaauaguaacucuccaagccucaguuuccucaucuacagaaauggggauaaccuaggcccugccucacaguguuaggugaggauuugaugagauaaagguagaaaaauggacuggcacauggccuggcagagugguugcucaguccacgccaagcucucuccaccucccguaaauccagcucacuuauuaacauacucugccuguuucuuucuuuucuucucuugacuucuggaauaaucucaaauagucuuggugacaacugguguccuuaccucguuccuuacuucaaguggggcuuuuccccagguuuccccaugaagaaugauguuuaguuuuggggauggagaaggccugggagguucuuguugcccaccccacuucccagggcugggauguccacagcgacucugggccaagacagcgcugccacuugcacacccccaccucgaaggagcuccugcuucuucaugaggcacucgcgcuccuugucacagaucucccgccuguugucgguggugagccucuucauggccagcuccagguccuccuucugcuuggcuacaaagucccgguccuguggggagagaggaggacaggccuuuauccagagccggcuugggcaccuccaugucucuuccuauuaugggagaaaagcccgcgugaucagagaagaaaaugcaggaacagaaaagaaauugguggaggagaaauuuaagggagacuuagagacgcaucaaccaauuucaacaugugggcuucaucuggauccuggaucaaagaacagucucggucugucaccagagcuggagugcaguggcaugaucucggcucacugcaaccucugccucccgcguucaagugauucuccugccucagccuccugaguagcugggauuauaggugagcaccaccacuccugacuaauuuuuguauuuuuaguagagacgggguuucaccauguuggucaggcuggucucaaacuccugaccuugugaucugccugccucguccucccaaagugcugggauuacaggagugauuggaaacuggaauacugacaacaugacguuguucagcaauuauuguugaauuugcuagguguguuuaugguaugguaguuauuucugugauguuugacagguaaaauaauaugaugucugggauuugauuaaaaagaauaccuuggggucagggagugaaugaguggacaugaggugauauuacugagauuaggugacagguauaugguaguucauuauaccuauucccauguuacuuuucuuuuuucuuuuuuuuuuuuugagagagagucucgcucugucacccaggcuggagugcaauggcgugaucucagcucgcugcaaccucagccucccagguucaagugauucucccaucucagcuuccugaguagcugggacuacaggugcacaccaccacaccuggcuaacuuuuguauuuuuaguagagacgggguuucaccauguuggccaggcuggucuucaacuccuggccucaagugauccacccgccucggccucccuauuccuguguuuuuaauuuuccauaauaaaggguaaaaaaaauuaaaauaaaaaaauuuagaaaccacggaauuaguaaaacucuccacucaucuuaucccccagaguuggcagcugcgguagguaugucuauacaaguguaucuauagcuauuguuauugcuguguuacaaaaauuauuaaaaagggcucaaagagauaugugugcacccaaguucacagcagcauuauucacaacagucaagggaugaaaacagcccacguguccgucgauagauaaauggauaaaucauguguuauauccacacaauggaauauuauucagccuuaaaaaggaaggaaauucugacacaugcaacaacauggaugaaccuugaggacauuacgcuaagugaaauaagccagucacaaaaggacaaauauucuaugauuccacuuacaugagguaccuagaguagucaaauucauagggaaagcagaauaaaguuaccaaggguuggaggagaagaaauggagaauuacgguuugaugggugcagaguuucaguuuuacaagacaagagaguucuggagauagauggcggagauggccgcacaaugugaauaggcuuaacgccacuacacuguacacuuaauaaugguaaagaugguaaacuuuauguuaugacuauuuuaccacaauuuuaaaaaauuauuuuaagaaaucuuuccauguuauaaugugaucuucuggccaggugcaguggcucaugccuguaaucccagcacguugggagacugaggcaggcggaucaccugaggucaggaguucgagaccagccuggccaacauggugaaacccuaacucuauuaaaaauacaaaaauuagcuaggcgugauggcaggcaccuguagucccagcuacuugggaggcugaggcaggagaauugcuugaacccaggaggcagagguugcagugagcugagaucgugccaccgcacuccagccugggcaacagagugagacuccaucucaaaaaagaaaaaaaaaaaacugggaugaaacucccaguuuugaaacuccgucucagauaaauaaauaaugugaucuucuaucacauguguuugaauggcugaaaauauuucaugcuauggauguuauuuauccaauaaacaacagggugucucuagguuuuaucuauuuuaaauagcgcuacuucauauucugguagcuaaguauuugugaaccucugugauaacuccuucaggauuuucagauucccucaggauuucuagaagcagaaaauccaagccaaaggauguguacaucuucaaagcucuccaugcaacugccuccuccaggccaaucugcugucccucugcguggaugagggccugugugccccgcccucaccaguccugcguucucuuccuaaucgugcuguaaugggacagacaggucauagggugucccggagagaacacaagcuugaggccucgacccccucccugaaugugaacucagcaauguuaccucucucagccuuuguuuccucuucugcgaaugggaaaaugaacagcuccuaccauaguaagcuaugaaugcugaagcagguaauauacaaagcauuucuaaauauggacucaaaaauucuuugcuuugggggcugaggaagcagaacacacaaagacccccucgugggggaaaauaggagcauuccggcaaaggaugaaaagaaggcuggggaggccggccagggcacagcaaagaggcggcgcuuaucuuagggacaaugugggagccacugaaggguuuuaaggcacagggcuguggggggaagggugcuauuaucagacuuggaauucacauugaucacacgcaggcaggagagaagaaacugcaggggaaaaacagcuacaggaagccucgcugggaggccacuggacaguggcugggggaucauggagauggugacgaguucauagauccagagacaggagauaagaaauauacauaccaugcuucuggaggugacgaaggacuggagggaaaggaggcgucaggaaugaugggccagaaaggaaggaaaauggcacccccucagagcauaacaggaccaggucugggacaucacaaguuugauguccuucagacuuaaaagaugccaagugggcaggggaauauacuggguuggucaaggagaugugacuuacaaauaaauaacccuaaaacaagguaggaggugcuaaggguuugggagguggucaauguaaaguguugggguauccagagauggaagagcuuacuuccagauggaggcagggcaaucgaggaaggcugcauggaggaggggauaauggggccaugaaggaugaggccagauuuagguauucagaacgggguauuugaggggcagggauugggcaaaggcagagagggggccuggucaccauuccaggucucgcaccagccccugcgcuccccagcugaggccagggacucacaagaagcugcuuuuucugcgugugcuccuccaucuucugcuucaugcuuuccuuccgcugcugucgggggagcuucuccaccucguucuucaccugcagcagagacagcagagaguagcugggucaggguccucuccaugcuuccuacaguauaaucuucaacgcagaacccccgggccagagaaaccaaagaagaggcucagcuuugcagcggccagcacccuacgcggcuccccaccaagccccucugagcaggugcuccacacuggccuacuccugccugccgcugguuucagcuuccaacucccccagagugggcaggugcuguuuucagcagcuugguauccaccccccucuucugguaacagcaccucaguuuccugcagggaaguguuucucaaccuuuuuaaaaaauuacagucccuacagaaguucuuuuagacauuuuucccuaaucccucuccccccaugaaauacuaguccaacagacaauaucgucaaucugacaaaccauugucauauuucaguuauuuugcuuccuuuaggguaacacuagccgggcugaaaaugcacuuuuuuuuuuuuuuuuuuuugagauggaaucaagcaauucuccugccuaagccuuccaaguagcuggcauuacaagugugcaccaccacaccuggcuaauuuuuguauuuuuaguagagaugggguuucaccauguuggccaggcuggucucaaacuccugaccucaagugaucugccugccugggccucccaaagugcagggauuacaggcaugugccaccgcgccuggccgagaaugcauacuuuaguaucccccuugucagccccugagguccaggugaacugacaucccuacccccgcuggcccugggcugagcaucugauccaggcuggccaagcagcauauuccaugcccuuagccucaggaacugauucagagauaagcacgugacccucacugguccagugugagcuuugggacguuugcuggaacuacugaagaaaagcuaccugcuguccucugggguuguuaaacuggagggaugaaggccaaggugagucaccuugucagccccuggaggggacugccugagaugaacucagcacagggaagcaauguccagagaugagaagaagaaucccuggcaacacuccugcccuccuggucagacgccagcaaguguucuuuccuucuuaagccagcugggauuggguuucugucuuuuauaacaggagggagaagagauccaugacacuucucucuaaggaccuuagaguuccucagacaguuccuucccaagaaacccacaccuucacaggugccuaauaacccaaaaccugcauugacagagggcucuuaagagcaucugauggggggaaaggcccgccugugaucaaaaagagagcauuccagggaguucuggcauggugagguaagccaagacaggcugugucuccugauaauuacagugaaaacucugcaucaaauaugaaagcagcuacuugaggacucugaaaaccaaacaaaagcagguggcacgaaggggagucaaaacuugcagacaagacugguacaggggauaaguuuccuauuuuuuuuuucacccuuuugcucuccuggcuuugcaccaauuccagaccugcccaguagugcaguagaaaagcuggcuaaaacucuguaagaaaccuuguguuucuggccagagaaccaggaaaagaggccugugcaguccagugaguaugggaugaaucccaaagagaagggcacagaaggccaggcggaguggcucacgccuguaaucccagcacuuugggaggccgagaaagguggaucacuugaggucaggaguucaagaccagccuugggcaacauggugaaacccugucucuacuaaaaauacaaaaaucagccgggugugguggcacaugccaguuaucccagcuccuugggaaggaggcaugagaaucacuugaacucaggcggcguagguugcagugagccgagaucauaccauugaacuuccagccugagggacagagcgagacuccgucucaaaaacaaagagaagagcgcaggaaaagggaaauuccuaacugugugugugaacacagagauucaccccugagcugaguaugagugagacaggugccaagcaguauagcaaaaaacaaaaaaagcaaagacccaacuaaacuaacacugaaaccacuacccacagaagaucagacagaaccuguggucugcaggguuuccuguuaaacaaaaaacaucuacauucuucaaaagauuauaauacggacccacagucuacagaacauaacacugaaaugucagggauagccaggcacgguggcucacaccuguaaucccagcacuuugggaggcuggguggaucaccugagcucaggaguucgagaccaaccugggcaacauggcaaaaacccgucucuacagaaaauauuaauacaaaaaacuagcuggguguggugccagugcaccuguagucucagcuacucaggaggcugaagugggaggaucacuuuagcccaggagguugaggcugcagugagcugugacugcaccacugcacuccauccugggcaacagagcaagacccugucucuaaauaaauaaauagaauaaauaaauaaauaaauaaauaaauaaauaaauaaauagaauaaaaugccaaggaaacaauaaaaaauuacucuacauacaaagaaucaggaaauagaaccaauuuucaaagaaaaaggcaaucaauagaugucagcuccgggaugacacagauguugggacuggcagaaagaaacuuuaaagcagcuauuauaacuguacuccaugagguaaagcccuuuaauauuucaaguauggaaagaugaaaguucacagcccagaaaaacuauuuuuuaaaaaauuagaaaauuuaaaacuaaacaauacaaugucugaaauuaaaauaaaacaauaguggaauggugaucacagaggagggucauucauuugaagacugauuaauaaagauuauauaauaugaaugauagagagaaaaaaagaugaaaaagaggaagguuucaggaacuuaugggaaaauuaucaaaagcucaaugaaacccaaacagguuaaauuaaaagaaaaccacccucauacauaucauaauaaaacuugaaaaccaaacacuaaaaaaauucaggagaguaguuaagagaaaugugacauauuaacacaggaaaauaaugacuccagugaccauggauuccccaacagacacuagggaggccaaaagccaccggaguaucauccuuaaagugcugaaagaagggccgggcgcgguggcucacgccuguaaucccagcacuuggggaggcuaaggcggguggaucacgaggucaggaauucaagacaagccuggccaagauggugaaacccugucucuacuaaaaauacaaaaaaauuagcuggguauggugacaggcgccuguaaucccagcuacucaggaggcugaagcagagaacugcuugaacccgggaggcacagguugcagugagccgagaucacaccacugcacuccagucugggcgacagagcgagacucugucucaaaaaaaaaaagugcugagauagguaugucuagugaaacuauccuucagaaaugaaaguaaaauaaagacauuuucagaugaaggaaaguaggaaacuuuguggucaggaagaaaggcuacauuggaaguucuucagguugaaaagaagugagcugagaagaaaacuuguaucuucaguaaaaaagaaagagugacagaaaugguaaauaucuggauaaacauaaucaacacuuuuucccuuaagaucuuuaaaaucucaaugaccauuuaaagcaaaaguugucacauugucugguaugguuuuuaauauauguagauauaauacaugugauaggccaggugugguggcucacaccuguaaugccagcacuuugggaggcugaggugggcggauugcuugaggccaggcaagaccagccuggccaacauggugaaacccugucucuaggcaugagaacugcuugaacccaggaggcagagguugcagugagccaagaucauaccauugcacuucagccugggcgacagagcaagacucugccucaaaaaaaaaaaacaaaaccaaaaacgugacaauuauaacaaaauugagaaaguaucaagaaauuuacaugguuguaaagguacauuuuacuuaaagaauuacaauaucaacucuaaauagaugcugagauagguauguauauuauaaugccccagagcaaccauuaaacacaaacacacacacacacauaaaauauaaacuaauucaugaauuaaaaaauaauacuaaaaauauucaaauacuucaaaaggagguagaaaaacagggaagagaggaacaaaaaccaaaggagacaaaacagguaauaauuuaauuaaauauaaaugccauaaacaccucuacuaaaaaacaaagauuuucagaugggauuaaaaaaaaugaaagcacaacuauaugcugucaacaagaaacccauguuaaauauaaagauuuagacagguuaaauugaaaggaugggaaaagauacuguaugcaaacacuuaucaaaagaaaguaggauuggcuauuuauuagacaagguagacuucagaacaaggaauauuaucaggaauaaugaugggcauuauauaauuauaaaaggaagacucaguucacuaagaaaauaugacuauuuuagucuuagcuaaagucuaggaggcugaggaggaucacuugagcccaggaguuugagggcacucugggcaacauaguuagacuuccauugcaaagaaaauaaacaaauaaauaaauaaaagaaaaugugacuauuuaaaauaacaaaauaauuucaaaaaugugaaacaaaagcugacagaacugaaugagaaauagauaaauccacaauuacaguuggagauguuaacauuccuuucucaguagccaguagaacaaguggucagaaaaucaguaagaauagagaagaccugaacaauacuaucaauuaaguugaccuacuugacauuuauagaauacuccacucaacaacagcagaauacacauccuuuucaagugcacacggaacacucagcaacacagaccacaucccggaccauaaaacaagccauaauacauuuuuaaaaacugaaaucuuaaaaaauauaugggccgggcgugguggcucaugccuguaaucccagcacuuugggaggcugaggcauguggaucaccugaggucaagaguucaagaccagccuggccaacauggugaaacccugucucuacuaaaaauacaaaaauuagcugggugugguggcaugugccuguaaucccagcuacuuggggggcugaggcaggagaaucacuugaacccgggaggcagagguugcagugagccgagaucaugccauugcacuccagccugggcgacaagagcaaaauuccaccucaaaaaaauauauaucuauauaucuauauaucuauauauauauguuauuugauuugaucauaaugaaaucaaacuaaaaaacaauaagagaaagauaugagagccccaaaacauuuuaaaauuaaacaacaagcuuuuaaauaaccugggucaaagaggaaguugcaaaggaaauuaaaaaguaauugguauugaauaaaaaugaaaauacaacauauaaagauuuguggaaugaagcuaaaacagugcuccauuuauagcauuaagugaaauuuauagcauuaagugcuuaaagaauagucucaaaucaauguucuaaaugagcuucuacauuaagaaaccauaaaaagaagagcaauuuaaacccaagacuaauauaacagcagaaaucaauaacauugaaaagagaaaaaucaaugaaaccaaaagcugguucuuugauaaggucaauaaaauuaauaauuagacugacagggaaggaggaggagaggaggaggagaaggaggaugagaagaugacaauacaaaauaccaauaugagggaugaaagaaagaacaucacuauagaugcuacaggcauuaaaaggauagucaggaaauauuuaaugccaauaaauuugaguauuaaaaugaaaucuacaaauuccuugaaagacagaagcuacuaaaguuuacuuaagaagaaacaggccaggggcggugguguaucccagcacuuugggaggcugaggcgggcagaucaccugaaaucagaaguuuaagaccagccuggcuaacauggugagagcccaugucuacuaaaaauacaaaaacauuagccgggugugguggcacgcaccuguaaucccagcuacucaggaggcugagcaggagaaucgcuugaaccugggaggcagagguugcagugagcugagauugcaccacugcucuccagccugggcgacagagugagacgcucucuaucucaaaaaaaaaaaaaaaaaaaaaaaaaaaaagaaauagguauuucauuggaaggccauguaacaaugaaaaguuuaaaaaaaaaaaaaagaagaagaaauagauaacuaaaacugaggcaggauagguagcaaaaaaaaaaaaaaaaaaaaaaugaccagguucucuggacacagcaacuauggugaccauacagucaacaccauaagccucagcauucucauuguaauugagcucauucaagcacagcuaucuucaguaggggauuuucccuguagggagcaagcacauuuugauuuuaccuguccuccgacugacucuuuguucauuguaauaguaaaaaacacaucccuggguagagauguaagaugcuaaugagacagugacaaaugaacaagcauguacagcuacuacagcugugcacccagaggaccacccagaacaugcuuccuggcaacgccucuucccaccuacuuaggaaccaucauguaaggcucccuuuaaaagagucucccuagugccagucuuugcugucucguccuuacaagcagcccacucugaauucucucucucucaggguguacugucuauucuauaccuaacuuucaaaauauuauuuuccuuuugcaauaaaucacucuaugcugcaucuccuuugcugugugucucauguuuaaauucuuuaaagccaagaagacaagaaccgagguaucacaacagcugucaacaaaaccagauagacaucacaagaaaaccacagaucgauauccuucaugaacacagaccccaaaauccucaccaaaauaucagcaaauugaguccaguaauauauaaaaaggaaaauauacaauaaccaagugguucuuaccccaaaaaggcaaagcugaugcaauauuuuaaaaucaagcaauauaauuuauaucaacagacuaacagaagaaaaaccauaugaucauaucaauugauacaugaaacccauuugauaaaauucaacaccuauucauaaugaaauugauuggcauacuaggaauaggagacuuaaaaaauuuuuuuucuuuucuuuucuuuuuuuuuugagauggagucuugcucugucgcccaggcuggagugcaguggcgcaaucucggcucacugcaagauccgccuaccggguucaugccauucuccugccucagccucccgaguagcugggacuacaggcgcacacugccacgccuggcuaauuuuuuguauuuuuaguagagaugggguuucacccuguguuagccaggauggucucgaucuccugaccuugugauccgccugccucggccucccaaagugcuaggauuacaggcgugagccaccgcgccuggccucuuuucuuucuuuuuaaccucagcuucugcgucuguauaaagagacuuucuuaauccaaugagggcagcuauaaacagcccuauugcuagcaucauacuuaaugaugagauauugaaugccuuccccuuaaaauggggaacaaggcaaagauguccucucuacuauuccuauucaacauccuacuggaggccuuggcuagcacaauaaagcaauuaaaaaauaaaaagcauacagauugaaaaggaagcaauaagaccguuucuauuuguagauaugaugucuauguagaaaaucucaaggaaucuacaaagaaagauacgaguacuaauaagugaguuuaacaagauugcaguacaagauuaauauauaaauaucaauguauuuuuacaaucuagcaaugaacaauuagaauuuuucuuuuccaaguuggguuuuacuuuguucccaggcuaaagcacaguggugcaauuauggcucacuugcagccucgaacuccugggcucaagugauccucucucaccucagcuucccaagcagcugggauuacaggugcaugccaccacacccagcuaauuauuuauuuauuuauuuauuuuuugagaugaagucuugcucugucacccaggcuggagugcaguaguggugcgaucuuggcucacugcagccucugccucccggguucaagcaauucuccugcuucagccucccaaguagcugggauuacagaugcacaccaccacauuggcuaauuuuuguauuuuuaguagagaugagguuucaccauguugaccaggcuggucuugaacuccugaccucaaguggucugccugccucagccuuccaaagugcugggauuacagguaugagucaccgcacccaaccuaauuuuuaauuuuuuuuuuguuuguuuuagagacaggguuucaguauguugcccaggcuggucucaaacuccuggccucaagugauccucccaucucagucucuuuaguugcuaggauuauaggcguaagccacugcaucuggcagaaauugauuuuuuuuaaaaaguauguugcauaacagcaccaaaaacaugaaauaaauauaauucaaggccgggagcaguggcucaugccuauaauccuagcacuuugggaggcugaguuggguggauaauuugaggucagaaguuccagaccagcuuggccaacauggugaaaccccaucucuacuaaaaauagcaaaaaaaaaaaaaaaaaaaaaauuagucaggcgugguggcacacaccuguaaucccagcuaccugggaggcugaggcaagagaaacgcuugaaccugggaggcggagguuguagugagccaagaucacgccacuacacuccagucuaggugacagagcaagacucugucucaaauaauaauaauaauaauaauaauucgaauauaaauauaaaauauauagugaaucuguaugcucaaauuaaaaacacuaaggaaauguaacaaagaagaccuaaguaaauggagagauauguuaugcucaauauuguucagauguccuaucucuccacacugaucuaugaauucaacucaaucccaaucaaaaacucagcagguauuucacagaaaucaguaggaugauucuaagguuuauauagaaaggcaaaagaacuagaauggccaaacaacuuuaaaaaacaaggacaaaguuggaagacucacacuaccugauuucacggcuuuuauaaagcuacaaucgucaagacacuguaguauuggugaaggacagacaaauagaucggugaaacagcagagaauccagaaauaccacauacaaguauauguggucaacuaacuuuucacaaagguacaaaagcaauucaguggaaaaaggauagccuuuucaacaaauggugcuggaauaaucagacauccauaggcaauaauuauuauuauagcaguaauaauaauagugaaccuaacccacaccuuauaucuuauauaacaaugaacucaaaauggauuauauaucaaaauauaaaaccuaaaauuguaaaacuucuaaagcaugugauguuggguuaggcaaagauuucuuggauauacugcuaauagcauaaucccuaaaagaaaaaaugauaaaacagacuucaucaaaaacaaaguacuaauuaaaaaauuagcagccgggugcguuggcucacaacaguaaucauggcacuuucggaaaccgaagcaggcggaucacuugaggucaggaguuuaaggccagccuggccaacauggugaaacccugucucuaauaaaaauacaaaaaugagcuaagugugguggcgcaugucuguaaucccaguuacuugggaggcugaggcaggaggauugcucgaacccacgagcugcagggugcaaguaagcugagauugcaccacugcacuccagccugggggaccgagugagacuccauuaaaaaaaaaaaaaauuagcugaguguguugguaugugccuuuugucccagcuacuugggaggcugaggugggagcccaggaauucaaggcuauauugagccaugauuguaccacugcauuccauccuggaaggcagaccaagacccugucaaaaaaagaaaaaaaaaaaaaaguacuucugcucuauacaagacacuguuaggagaaaagacaagccacaggcuggaaguaaaugugggcaaaauacaacauauuugagaaaauacuugcauacagaaucuaaaaggaacuguugauauucaguaguaagaaaaaucacccaguuaaauaaacggccaaagaucugacccaauacuucacuaaaaaauacauaugggugccaggcgcgguggcucaugccuguaaucccagcacuuugggaggccgaggugggcggaucuucuggggucaggaguucaagaccauccuggccaacauggugaaaccccaucucuacuaaaaauacaaaaauuagcugcgcaugguggcaggugccuguagucccagcuacucgggaggcugaggcaggagaaucgcuugaaccuggaaggugguggagguugcagugagccgagaucgugccauugcacuccagccugggcgacaagagcgaaacuccaucucaagauaaauaaauaaauaaaauaaaauaaauacauauggguagcaagugagcacacgaaaagauacucaaaucauuaguuguuagugaaaugugaauuagaaaccacaaugaaacaccacuuuacaccuaucagaauggcuaaaaaaccugacaauugcaagugcuggugaggaccuggagcaacuggaacucuuguaccucguugugauguaaaaugauccagcucuuuuuggaacagucuggcagucucucauaaagucaaacaugcacuuaccaccugaccccaaaaucccagcagcuauucuugucucuucuuucaauucuuggauuuauuuuuuucauggucuuagauuuguaaucugaauccuucuccuauguucuuuggccuaauggucuuagaucaggguuuugcaacuucagcacuacugaccuugaggguggagaguucuuuguugugggggcuguccugugcauuuguugugggggcuguccugugcguuaguugugggggcuguccugugcauuuguugugggggcguccugugcauuuguugugggggcguccugugcguuaguugugggggcuguccugugcguuaguuguaggggcuguccugugcguuaguugugggggcguccugugcguuaguugugggggcuguccugugcguuaguugugggggcuguccugugcauuuguugugggggcguccugugcauuuguugugggggcguccugugcguuaguugugggggcuguccugugcauuuguugugggggcguccugugcguuaguugugggggcguccugugcguuaguugugggggcguccugugcauuauaggaaguuagcagcaucccuggcuucuaccugcucaaugccaguagcacugcucccuuauuuccccaguggugacaaccaaaauguuuccagauauugccaauuggcccccacggaacaaaauaguccccgguugaggaucacugucuuagaaguccuaguaaaauauuuaaaucuuauuugugccacuucugcuuccauaucaaagggucgccuuggagaugcuauauaacccuaguucagcaucuggcuguggugucugccaaaaugccuuucgacagcaccaucucaggcaucauacaauuuaaaggccucacgagcuuaaaacugugcuguugcaagcaugauuucuugauuuuccaggacagacaauuagaagcagcaguuuaguaaaggauuucugccaaaggcaccaaaaacacgaagaaacgucacaccacugaccauggagggcgaaggcaaaggaacaguaaaaguagagucacaugggaccacuugacaaaggggcacaggacuuccauccaucaguaucccccgaggacauucacauaccagcacugcucucccgcugagaucuacugacaggcaggggcaggggaacugcaugcugcuggaugucagaaaaccugcauucuaguccagcuacgugucuucagaaaaguuacugaacucguucgaguuccucauuuucucaucaggaaaagccaucuggcuuucaacuaaaauuucuuuagggauccuucgaggguuacaauucugugguguuacagagauccaaacuauuuaauagcuaaauucuguuuauugaacuuugcccgggaaggcaggaaaacagaguucuggaaagauuuccuucaagacugguuauauuuguuuucagauuucagugaucuaagaaguuacaacugucaagccaguuucucauggaugcuagagauuacuugguauauaggaacugaguagcagaccaucaagucccuucuuacagaguugugagaauguauccacauuaauuguauaugcauauauacacauacacaggaagaugcaguaaauuacuugaaauugacaugaagaauaaauaggucccuguucaacuaccuugcuaauaauuauuuuuccuauauguguauuuccuuauugaaaagugauuagcaugauaaauaucccacaccaauugcuguaauacugaagagggucccaggaggcuucucaaaucuuauugguuuuuuuuuuuugguguguguuucccacgccugaauuuaaauuaugacaugcucucucacacugauuggaucguagggaaauggacaggguacacacuuccuugcucugggcugguuaaaggaaagugccuguugcauaugcguauggucucccucuccagcauccacgugugaauuacucuguugcagcacuggaauggcugaugcaucuguagguaguucagaggcugcucaccugguggggggggucucgucccuucuaauucuguccaucaccccugcugcugcauccugaccacuaugucaagggcaauaggccagaccucccauuccuacuuggaauuccuacuuccucacccagcaccuugcagcccucacagaggugaccuuuggaaucagagaaggaguucuuaggaguguggaguaggcaauggcaagacagugccaucugggauaucugggguugccauggagcaaagccucucacuggccuccugccaucgcuguguuacauaaguaaacugcagaaucaaagcaagaaaguuugccuacacaaaagaccaguaacugggacaccaucuuacuaaacggugugagcccuguccucaaaaagccaaaagagucugggugcaauggcucacgccuauaaucccaacaguuugggaggccgaggcaggaggaucacuugaggccaggaauucaagaccagccugggcaaguaagugagaccccuauuccuacaaaaauuuuuuuaaaaaauuagcagggucccaaauacucaggaggcuggagcaggaggaucacuugagcccaggaguucaaggcugcagugacccgugacugugccacugcauuccagccucaucauuaaaaaaaaaaaaaaaaaaaaaaaaaaaaaagccaaaagagcaaagaaguuaagcucuuucuuuccaugaaaacuucuugaagaaaaacacccauagaaaaagauauuugaaaaaacugaaugugagcggaaccccaggugccagaucccacgcucugccucguucagaggcaggcucgagagccuuccuggaacccugcuggugaggaaguccaacuuuguuaagggcaaguucugggaaagggugaggagaucuguggcuucccccauccccuccuaaacuaggcaacuuccucugucgccuccucucucucccacucuuauaaguccacacacacacacacacacacacacacacacacggugugcacaugugacagggcgcagagccaaggagggaaugggcaucuacccagcucuuauuccaagcagauacugggucuaacccugaauguacuucucauuuaaugcuaaaacaucuauguaaggacaggauguuaacaggauuauuaaaauagcacacuccugccuguggcccacugcccuacguggucucugccuaccugucugauucuaccuugugccaaucuccccuuugcuuccuaagcuccugcuacauggaugguuuuccagcucuuugaacacuccaagcucuuucucauaccucaggaccucugcaggugcugucccacccuccuggaagguucuuaggccucccagcauccuucuguacucagcuuacaugucauacacugagaggcuuucccagacccaucuaaagcagaucucuccagaucucuagucagccagucuauaugcuucccuagcauguuggcaacuguuuuauuuguucaauauuggacuuuuuguuuguuugucuggcuucucuggaaauuaacagauccggaaauuaauagaauauauacauauauuuauuuauuuauuuauuuauuuauuuuugagauggaguuuugcucuuguugcccaggcuggacugcaauggcaugaucucggcucacugcaaccuccgucuccuggguucgagcaguucuccugcucagccucccgaguagcugggauuaaggcaccugugaucaugccugacuaauuuuuuuguguuuuuagcagagaugggguuucaccauguuggccaggcugguuucgaacuccugaccucaagugauccgcccgccugggccucccaaagugcugggauuacaagugugagccauggcacccggcugcauuaaaauuuuuuuuaucuugaugacugaguuuuuggguccucugaaaugugcagguauaccucauuuuuucaugcuucacuuuauuacacuuugcagauacugucauuuuuacaaauugaagguuuguggcaacucugugucgagcaagucuaucagugucauuuuuccaaaagcaugugcucacuuccugucuguucacauuuugguaauucucgcaauauuucacauuuuuucauuauuauuaucucuauuaugacgaucugugaugagugagcucugauguuacuccuguaauuguuauagggugccacgagcccauauaagacagcaaacuuaaucaauaaguguugaaugugaucugacugcuccacagacuggccuuuccccugucucuuccccucuccucaggccucccuauucucugagacacaacgauauugauauuaggccaauuaauaucccuacaauggccucuaaguguucacgugaaagcaggaguugcgugucucucacuuuaaaucaaaagcuagaaaugaugaagcuuagugaggaaggcauggagaaaaccuacugggucaaaaggaaggccuccuacaccagacgguuagccaaguugugaaugcaaagaaaaaguucuugaaagauaaaagugcuacuccaaugaacacgaaugaugagaaagcaaaacagccuaugcugagauaaacuuugaguggucuggguagaagaucaaaccagcuauaacacucccuuaugccaaagccugauccagggcaaggcccuaaaucucuucaauucugugaaggcugagagaggugaggaagcugaggaagaaaggcuggaagcuagcagagguugguucaugauguucaagaaaagaugccaucuccauaacgugaaagugcaaggugcagcagcaagugcugacggagaagcugcagugaguaauccugaagaccuagcuaagaucauugaugaaaguggcugcacuaaacaauggauuuucaauguagaugaaacagcuuucuguugguagaaaaugccaucuaggacucucauaacuacagagaagucaaugccuggcuucaaagcuucaaaggacaggcugacucucuuguuaggguuucaugcugauggugacuugaaguugaagccaaugcucauuuaccauuuugaaaauccuagggcccuuaagaaucaugcuaagcugggcaugguggcucaugccuauaaccucaguacuuugagaggccuaggcgggcagaucaugagguuaggaguuugagaccagccuggccaauauggugaaaccccaucucuaccaaaaauacaaaaauuagccaagcgugguggugcgugccuguagucccagcuacucgggaggcugaggcagaagaaucgcuugaacucgggaggcagagguugcagugagccgagauugugccacugcacuccagccugggugacagacugagacuccaucuccaaaaaaaaaaaaaaaaaaaaaaucaggcuaaaucuacucugcuugugcucuaaaaaugaagccacaaagcccaggugacagcacaucuguguacagcaugguuuacugaauauugacuggcuuuauugcaguauucgcuuuauugcggugguauggaaccaaacccacaguaucuccgagguauaucugugccuaaggugacugccucaacugcucagcuggccaggaacccuggcucccagaggcagcuucccaaggccucugggaugcccccgaaugucaugcccaccaugguaaagucuggaaucugggcucugagguccucugaggaccacccucagaggcugcucauccacugcuaccaguugggagacugggaacagccuggacuggcguuccugcccugggggcuuccagccugcuugucuccuuccuccacagagggaggcaugggcuguucuuugacacucagaugccucucuccagagcagcucgagagaugugccucaggaccacauaccuccuuccauccuccccuuccccuuccaacauggggaggaggaggaggcagagaggguggagcauagagggcauguuguaugugccuacccacccagcacccacucgcccuucugggaacagcaucucaaauucccccggaccaccagcccuuccuucuuccccgcucuuucucggcagggguugcuaagcugggaggauguaaaggaagcugccugaggccacagggugaggccugcccugagccauagcaacacagaggaaagcagaguucagaagauggagaaguggcuccucauggcgcagcuugggcacacagauccaggcucaccugcucccgagcucuucagccguaccccucugcugccaaggugagguugaggccacgaucacuugcaaccaagaaggccccuaauacuccgagaugccccugcccccacugagcacauacucaccucuuucuucaucaguuugagcugcucuuggaaccugguguagucccgauccugcuccaggcggauccgccuggccuccucccggcggcgcacggcauggucuugcuccaucuucuccacuugcugcuuuugcugacgcuccagguucucuaauuccgugucaaagaacuucuucuuggccugaaaggagcagaaauucugagaaacuuagcgaagucacuuuauaccugggagggacaugggaaguggaauggggagaacucagagcuugugaucagaccuaagcuugaaucccagcucuacuaccccguugcugugugaccuggggcaaguuacuuagccugagucuccauuuccucaucugcaaaagggagaccagaccauguguuguugcacggugcucaauacagguuauuuccccucuggagauccuccugugggacucaggaucgcugugaccuucacgggguucuguguuaacaagucacugccuaacaagaucgggaagcccccaggaauugggcaauuguugugaauuacucuccacuacccaaucauucccacuauguagcuuccacugagagaacaccuggaggcaagaagcccugcagggucccaucuuuucucgcacucacguugauuuccuguucaaaacguuuaugcauuugcuccagcugcagcucaugcuuguuacucagcugggucugguuccgaugcucuucuuucuggagcagccgaagcucucggaguuccuggcgccugaaagguuaaaggauacagauauuucacaguaagaaacuggcuucagagaucacaauauuugcaacuuggaacacugaagguuggaucauggagcaaaaucacacaagucuggggcacaggcaugacuagaacucaggcuucauuugauauuuauugacagacaaaaccuuaauaaucuuaauaaauaaagagugcuuacaaaucaauaaaaaggaagauuauccuaaccaaaaaaaguggcaaagaacaugaacagacaugaagcaaaagauaaaaagaaauuuuagaaucaccuauauagauauaaaauacaaaugaaaaagaaacuauaauuucuugauguagaaaacauaaugcagaaaauuugauguagaaacuacauuuucaugauguagaaaauuugaugguagaaacugguacauuucuggaggacaauuugguaauaagcuuauguuuuuugacauaguaguuuccacuucuggauacugauuuuaaagaaauauuuauagaugcacaaaaccacugaauaagaauauucagcugggugugguggcucacaccuguaauuccagcacuuugggaggccaaagcagaagaaucaccugaggucaggaguuugagaccagccuggccaacauggcaaaaccccaucucuacuaaaaauacaaaaauuagcuggacaugguggcacacgccuguacucccagcuacucaggaggcugaggcaggagaaucgcuugaaccugggagguggagguuccagugggccgagaugacgccauugcacuccagccuggacuacaagagcgaaacuccgucucaacaacacaaaaaaaagaaaaaaaaaaaaaaaaagaauaaucagucauuuaaaaugaauguuauuuaguaaaaaauuggaagcaaauguccaucaauauaggucuauguaaauaaaguauauugauaugauggaauucuauacaaccuuaaaaaaaucaaguuuuagaaaauguuuaauuacauaaggaaacauauuaaaaauaauaauucagcugggcacaguggcucauaccuguaaucccagcacuuugggaggccgaggaggguggaucaccugaggucggggguucaagaccagccugaccaacauggagaaccccaucucuacuaaaaauacaaaauuagcugggugugguggugcaugccuguaaucccagcuacuuaagaggcugaggcaagagaaucgcuugaauccgggaggcggagguugcagugagccgagauagcgccacugcacucccgccugggcaacaagggcaaaauucugucucaaaauaauaauaauaauaauaauaauaauauuuaugaacagauauggaguaaucucuagguaaaaaaaagcaagauauuaaagaauaggucuguuaugccaccuuaucugggagaaaaaggacaacaaugucucuguacacacauauauguauuguuuacuuuucuaguaucucuggaaggauuaaaccauaaaacacuaacacaggaaagggaacuggauuucugguaggaaaaugaagagggaaauuuuucacuguuuaucuucuuucuuuuuuuuuuuaauuucgaaccauggaccuuauacagguagaguauccuuuacugaaaaagcuugggaccagaaguguuuugggugucagauuuuuuuagauuguagaauauuauacuuacugaacgagcaucccuaaucugaaaaucugaaguccgaaauguuccagugagaauuugaugucagugcucaaaaaguugcagauuuuggagcauuuuggauuuuggauuuuuugauuugggauguuuaaccuuuauuaucugcuaaaaaauauauaauaaaaauuugaccuaggccaugcgugguggcccaugccuauaaucccaguacuuugggaggccgaguugggaggaucacuugagcucaggaguucaagaccagccugggccacauagcgagaccucaucucugccaaaaauacaaaaauuagccgggcaugguggugcauguguguggucccagcuacuuaaaaggcugaggccggaagauugcuugagcccaggagguccaggcugcagugagccgugacuaugccgcuugcacuccagccugggcaacagagcaagauccuguguuaaaaaaagaaaaaaaaauugaccuaagcaacaugcccuaauuauauauauauauuuauguugucaguguauguguguacucacagaaaaaauaucggagggauaagccccaaguguuaaccacguuucuuaaugagcaaauccauuaaaaauugcuauguaggccgggcgcgguggcucacaccuguaaucccagcacuuuggggggcugaggcuggcggaucacuugaggucaggaguucaaaaccagccuggccaacauggugaaaccccaucucuacuaaaaauacaaaaauuagccagguaugguggugcacgucuguaaucccagcuacuugggaggcugaggcaggagaauggcgugaaccugggaggcagagguuguagugagccgagaucacaccacugcacuccagccugggcgacagagugagacuccauuucaaaaaaaaaaaaaagagagagaaaauugcuacauaucauucauauaaucggaaaaaaagaaaaaaccaaacuacuacagaaagaaccuaggccuccugacugaacuggaggcuccuggcggccucucaggguugggguccgugaggccuguguccuaguccagugcggcaccaugcugauucccaugaggccacgcucugaccccaguggccuuccucaugacucggaggggccauaacugcucacagaacugccccccaagagcagcacaaggagggguugggcagugcagcgaggccaagagcauucucuggggucgcagcgccccugugugaaucuaggcucagucagcuuuccagcugggugcccgcucggggagucacuuauccuugugggacucacucccuccucugcaaaaugaggcuaacaaucuuuaccuguuggguccuuugaaggauaaaugagaugacacagguaaagugcccacguggcacaugaccagcacucuguaaauggcaacuggucgaauucuaccaaggaagaagaggcaauggcugcccugccucugggaaaagccagaggcgcuuucuacagccacagagggaagacugucugagccucugcuuuucuggaaagugggaagagaggaggcagguuuugagaguguuaacgaggaaauggaaauccugacucaagagaaacuaagguuuagagaagaacugacaaaaagccuaaaaggaguacagaaagaaggcaggcagccagcucuagcacucccugguccaccugugcucucagaaggaaaggcaagcaaagagaaggcugaggcucaagagcgagggaacggcagaagccguuuuagggaaggacaggaggaacucugcccggaagccucaucagucugagaaugugauaaaugcucagccacaugguucagaugccuaggugugacccaauucuccaaaaacgccaggggucagguaugaccaggggccugggccagcaggggaugaucagggccuuccacaccccuguggucugguggccuggccuaguuuacaggcgcucagaccuccagaccacggcaggcaagcgagaaaaucccgguuccugccgagcaccucuucaccuccucgaggucuccccuuuugacccugaguagcacacagcugcucugcucaggaggaggguggggaaccacagccagggccagagagcacugcuucuccaugggguguggccaaucuagaauuuaucccugagaacuucaauugcccagaggggaggugauggaaacccagcucuugagguugaaacucagaguccagggugccucucaggugaccauuagaacagaaggugguuucaucugccaaagcaaccugugcccuagccucccgacccacacagaugacaccagugugugugugugugugugugugugugugugugugugugugugugugguguaugcagauacacuagugaaaagucuguuuuuccucccucugucuccuagagggagaagagauccacaacaucuaaaacuacuuuuauuugguuuuggcuuauuuauuuauuuauuuauuuauuuauuuacuuuugagacagaaucucacccugucgcccaggcuggaguguagugacacaaucucggcucacugcaaccuccgccuccuggguucaagugauucuccugucucagccucccgaguagcugggauuacagacgccggccaccacagcuggcuaauuuuuguaguuuuaguagagaccagguuuugccauguuggccaggcuuuucucgaacuccugaccucaggugauccacucgccuaggccucccaaagugcugggauuacaggugugagccacuacaccuggccuaugcuuucauuuuuuacaauuuauuuuuuaaauuuauuuacuuauuuauuuuuuuuuuuuuuuugagacggagucucgcucugucgcccaggccggacugcggacugcaguggcgcaaucucggcucacugcaagcuccgccucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccuuaaauuuauuuuugagagauagagucuugcucuguuacccaggcuggagugcgguggcaugaacgcagcucacugcagccuugaccuccuaugcucaagugauccucccacuucagccucccgaguagcugggacuacagguaugugcccagcuaauuuuaaaauuuuuuuguagagacacuagguugcccagauggucucgaacuccugggcucaagugauccucucacuucagccucccaaagugcugaaauuacaggugugugcugcugugcccagcugcaugguuaaacguuuaaaaaaauaugaguauuaggccgggcgcgguggcucacaucuguaauuccagcacuuugggaggccgaggugggcggaucacaaggucaggaguuugagaccagccuggccaauacggugaaaccccguguguacuaaaaauacaaaaauuagccgggcaugguggcgggcaccuguagucccagcuacucaggaggcugaggcaagagaaucgcuugaacccgggaggcagaaguugcacugaaccaagauagcaccacugcacuccagccugagcgacagagcgagacuccaucucaaaaaauaaauaaauacauaaaauuaaaaaaauuuuaauucacauguauaaaaauaugugauuaauguucuagaaauuuucucuacacuaaccaugaauuuacccugcaaaggccuggcccccaggggacuccguggcuccauggccucccuaaguguuaagcucccccaaccccugccagcuacaugguccagugaaaccugaaggaauucucacacacacagacccaguuagaaucucagcuuuaccccugccuaacuggaagacccagggcaagugacuuacuugcccagaaauaguguuuccucauuuguuuaaaaaauguggaaauagggucucccgaaggagggcuguaagugggggaugaacaacugaaaaguauaaagcugauccuagcaaacagcuuugccucacaccuuccucccuguuccaguccuuuaccaacucacugguuuugccuccaaaauguaggucaaaucugaccauguuuuucccucuucccggccacugccccagccugagcccagagccugcccauccuagucaagaucucccucucucccuccaccagucccuuaaacaagcugaguaguuaucccucagggccucagcaacugcaauuuccccugggcucccccagcucuccuccccuuauccuuuaggccuggcucaggggcuucccuuggagcagccuccccuacuccaagcacucacuaucaugucaccuguuacuuguuucauggcauguaccacaaucagggauuaucuuguguacuguauguuggcccauuagguguaaguucuacaagggcaauggccuuaucuauuugggucaccaccuugucuccaaccugguggguugguggauacauggauggauggauggauggauggauggauggauggauggauggauggauggaugguuagguagauagguggaaggcugaauggguagaugaguggguggguggauggaugacuggauggaugauuggguggacagacggaaagguagauagggaguagguaaauagauagauggguagauaaauggauagaaggauaaaauggacggaugggugauuggguggauggauagauaaacagauggauaauucggcagaugaagggaaggauggaauggugagugaguagaaggauggguggauuguuagguggauagauggaaggugagugaguggguagaugaaucaguggaugaguggaugaauggauggaugaauggaugggugaaugacuggguggauagauggauaggcagacaggugaguagguggauugaugcguggauaaaugaauggaaggauggaugauuaaguagauagguagaugaauggguggacaguuggauggauggauggaaaguugaguggguagauagguggauggguggaggggugaguggguggaaggauggguagacggauggguggauagaugaauagguagauaggugaguagguggauagaugggugaauaaaugaauggaugaguggauagauaggugaacgguuggguagaugggggagugcaggaucgcaggcaaaaugaguuuccuuuugccuccuugauucccccacuucaugcuguagacagacagcccucucaccaaaggaccaaugcccacuccucuuaccauagccccacccuguuaccaccauugguggcccuucccaggcuugccugagaaaucucaucuccucauccuucuucucaucuucgcugaugaucuuggagguggugaugcucaccuccacaccauccaccacaaauuugcguguccgcuugaggguuuuuuuguacaguuucggguccuggccagggaaaaccauuagacaagucucagcauuucagcuaaggacccauggcugucgcagcaggugaggccacagcucugcugggcccacagcuucagaaccacccccagagagauguggccauccaucgucccucuugccucaacuuaaccuaggagcuggggguucugagcuuauucccuugcucuucccugaucucagccuucagaaacugugcugaggccuccccuaccuugcugccagcaccucucaugcauccaggacauggugucagaaagagcugcguucuugccaggcacgguggcuuacgcuuguaaucccagcacuuugggaggccgaggcaggcggaucacaaggucaggaguucgagaccagccuggccaacacagugaaacccugucucuacuaaaaauacaaaaaguagccaggcaugguggcaggugccuguaaucacagcuacuugggaggcugaggcaggagaaucacuugaacccaggaggcggaguuugcagagagcuuagaucacgccacugcacuccagccugggccauacagcuagacuccgucucuaaaaaaaaaaaaaaaaaaaaaaaaaaaaagagcugcguucuaacccucacugcaccacuuacuugcucugugucucugggccagccucuuguccugucugagccucagcuuccucaccuguucagggaggauagucacacuacuugccucccagggugguugugaagauucagugagagaacacauggcaggcacacagagcagugcccacucccggccuguguuccaugcuuagcauuucuuucugacaguuauuacugcagaccacacacaauccucgcgcauggugccaaaauccaaaggagcccgaaaaccaaaggcuguuuuuauaacugguuugguagccaaagcugaccuggccugaacuccccaccugcuaggagucaccaugagauuacgcauaaucgucaucuuuuccugugaguaaucgcacacgccacaagugauugugcaggugccaccugggauccuggagguguuugugugucauaauacgugguacccucuggaaguucucagcucugauucugaagguguccccauaacccucccgcucugcccacugccucuggccucuugguugguuucaaagccucuuuuuuuuuuuuuuuuugagauggagucucgcucuguugcccaggcuggagugcaguggcgcagucucagcucaccacaaccucugccucccggauucaagugauucuccugccuuagccuccugaguggcugggauuacaggcaugcgccaccacgcccggcuaauuuuuuaauuuuuuuaaguagagacaggguuucaccauguugguaaggcuggucucgaacuccugaccucgugauccacccgccuuggccucccaaagugcugggauuacaggugugagccacggcgcccggcccaaagacucuuuuugguguagcccagcccugccuuccuaacacggggccucccagccccugaaagaggagugaggagccagcguggcaggucucuugaccccuugaaaucuaugcugagcuccacuccugcugagucgagaggggcagacuguuuuugcucccugaggucugggccccugucuccugcccauggcaccucgcccaggggcucuggacagcaucagcauggacccagcaugcccgacucucaucucucuacggugaccagcucacaugugccaggacccagucaggaugggucaggccagcagugagaaguagaggccggcaggagugagaguggaggggaagaaagggcacccacagccacagcccucugcugagaacugcuccuggccagggggccuccaucccugaaggaacaggcuccuagucacgccagggggugccggcacagcgggggacucucaugagaacggccugaggucccugacgcaaugcagucaaccagaaacauucuccacagccuugagaagagcaggggagccccugcuuuaggugggucugucucauuaaaaaaacaaauaaaaacaccuuuuuuucacucagugucuucaggaagagaaguggcaggaugccgguccuaaggaagacgcugcucacagguaacagcugcugugcaugcuugucccgguggccuguuggaacugugcuucccuucccugccuaaagcugauuggccguugcggcuccugucacuccccuuugcuuagcaaauauguucgagucucuacugcguguuuuucaccaaguacauuugggaaggaaaaacaaaaucauacaguauuuccucuaaaaugagcuuuggguagagggucaggugacccauggugaguuuaguaacaccccgggauuuaucggggaggccaggaaaggagucagccccuuccagcucccuaagaaggaggccauggcucccacugggaagguuuagaguuuggagccuggggucuguccaucuucccacuccuaccuggcccugggcuggcuccucacuucucugagccuccaucugcuuaucuguaaagugagaggaugaaggagccugucuguucuuuuuaaagcacuuuguacaggguucgccucaagcccaggccucuagugcgguggcuaucgucauucgcaacacugcccaccuccagaaaggccccggaggcggggaagauggcuuugagcuguuuccuuuaguuggauuuaccaguuaucagcugggucucguggcugaccucuggaugacagaacuucauuuguagcuaaggccuaagaguucucucucccaaauuuuaccagggccuuuuaccaagcuuugaaauuuaaacccaaaccaacugcuuuacauuccuaaaucccauauugaacccagauauuuuggagauuaaacuaugagucaaacccaaaacccccuaaugaaccacuuaaaaugcaaggaagccccuaaaugcuuuugaaaccaaaauggagccacagaacauccugcaauggucuugcugcaagcccgugguggcagaggcgguguuaccuugauggacagagagcccaucucuuuguucagcgacaggucaguggagagauugguaccauaguccaugcucucagaggugcagaggcugcugcaguccgagucccucuuggaaggcccuggagcugccugggcagguggcuccaggcugccauuggccagcuucuccccacccaaggucuccagggcgcugcuguugggccggcucuggcuggccuuuugagaucuguuggcugcugggcugagguccccacccugcucagcaacuugcuucuccugggcuaccugaauucuggcauccauugacacgggucgggacuuccgcaggggcacaggcacugccaggccguucucauuuccaggggccacgacugggggacuggugguuuggagggaucuguccccagagggcuggcugcagggcucauucacacuguccugagacuggcugggugccagcgggguggaaggugacuccucgagaggcuugucagcauugaggcuuggcggacucaccucagaggaguucugaguaugguucuccagggucuagaaaaauauauauauauauauuaaaggccaugcugcuguauguucaaggcaagagucagagaugcaguggagaaagucagacacccucaagaugaagugggccagcgccaagaaaggagagcagauaucucccuagccagucuucagcacucccuauugccuaaccguaauacaauuacuacuuauuuugaggcauggcaaucuccucacuaucucuaaucucagcugaauguaauagcuguuauuccugcuaggaggcagcuguggccagcuggccagcucauggcccacagggaggggucaguggccgcuccauuccagccaauugugacaaugugggaaaauggcuccccuguggccaaaccuucccaguuuuuuaauuuuaauuuuuuauuuuauuuauuuaucuauuuuuuugagacagggucuugcucugucacccaggcuggaguguaguggugccaucuuggcucaaugcaaccuccaccuccuggguucccaccugggagugguccucccaccucagccucccgaggagccucccgaguagcugggacuacaggugcaugccaccacacccagcuaauuuuugcauuuuuuaguagggacaggguuucaguaugucacccaggcuggucucaaacuccuggacucaagugaucugcccgccucggccucccaaagugcugggauuagaggugugugccaccgcacccagccaaaccuuccaauuuuuuaagacaaguuugaaaucuagguuuuuaauggacaucucuuaauuuuuagguggcaacuaacucauauuuuuuaaaaaaucauauaaaggccaagccaagccugucuggggacuggauucagcccuuguggccacuaaguuuucagcuucauuuuuguuuuuuagagucuuuguuggguggaaaguacuggaaauguugcuaugcuaaggugaaacagaacauucuuccuguguauaaaacauaaacauccaacuuggugaauagagugaguauccauguagccacuuuccaggucaggaggggacauugcuuugccccagagggccauccccugccgccccguccuucucaguggcaaugcucucccaccucuugacauagucacuguccuauggucucuaagugcuacagaugagcugugccugcuuauaaacgugguaugaauggauuuauacuauaaguauuccuuugggucuugccagccaccgguuuuuaaccucagcuauggcagcugguggaagcaacuccaaucuaccuucuagucaacacccagagugauggcucaaaaacgcagaucugauucugucaccuccaccccaauacccagucccugccugaaacccuucggggcucccaauacccacaggacaaagaucagccuccugcaugcagacaaugaggccaggugugagcgcuuucuaccuccuccuggagccaggccccacugagguucuccuacuccaaauccaccccuggcccugccaucuaucggcucagccagccacuucacuguaucgaucucaguuuuccugucuguaagcuggagcuugguuacccugugucagagcuguagagggcccggcagccaccaggggcuccaugcauggcgggggugguugugaugauuccgcuugcccugcccuucgggcuuuccuucuucacccuggugagggucugcgccagccucaggcuccacccaggacugaauuaaauuugaggaagcugcagugccguccacagcacaaggaugugggccagcuccauccccugauggguaaguccagccccugcuucucuaggcacagggagccaccgggauggccacccuaucccugggaagaggccuccccaaguaaggccagggauuacggagcaacagcuugggccagaauccagcccacagacauguuuuccuuggcucacaggguuuuuacaaauuuaaauuagcuuuaauuucaaucuaaauccagcaagcacugaagcugcaaaagaguuccaaaugugcccagacauggguccccuuggcacugagggcagcuagaggggggccaggguguugccuguggccauaugcagccucccauauuuaucccaaaaugagcuaaaaacagucucauuugguaugugagcugugacaggaacaaaggaugggaagccaugaaucaguuaccaacuuuuaaaaauuggaagauuucaugugaaaaucuagaucucugguaucuccugaaaacucacaggaucgggaucuggccaacacccccugcugccucaccccggcccacaugccaucuuacguuaccugcagcgugggagucugcaaccucugagcuggcaauaaauugccugagccagaguccuggccuucccugccccucccacaccagcagggccagcugagauccuguccucccagcccccgcuaagccccacucucccuggccuuacggaggcggcauccacggcguccuccucuucccccucaucccggccgucuucgaucucuuccaucaccucggccuuggccucagccaccagcucccgcagagccuuguuacuggugaugcugcugacgaagggaugcugagggggcaagaugcacccagauuagaaccacucuggggucacggugggguggaagaggcugggggagcucacccccggggcagaaaaggccagccucauuccugagcaaaaugugcacaugaacuuggagacccagagacagccuggaaagucccaaguguguuggaaagagggcagaucccagcugugucucucagcggcugugugaccuugagcaugucacuuaaccucucugagccacaggcuccucaucucucaaguggacacguuaacaaugaacccacagggaggucaugcggauuaaaugagaucaugcacuugaaaaugcuuagcccaaaguaggggcucaagccguguuugcaagggagggugucuauuuuccuuuuuaaaagguuuuaauauauaguuuuauaaaauaugcuacauacauuuuguugaggaauaacauuccuacagcaaaguucacagguuguaaagcucaaugacuuuuuugagacagaguuucacucuuguugcccaggcuggaaggcaguugcgcaaucuuggcucacugcaaccuccaccuaccagguucaagggauucuccugccucagccucccaaguagcugggauuacaggcaugugccaccacgccaggcuaauuuuuuauauuuuuaguagagacgggguuucaccauguuggccaggcuggucucaaacuccugaccuuaagugauccacccgccucagccucccaaagugcugggauuacaggcgugagccacugugcccagccucaaugacuuuuuacauauauaugcacgcaccguaacugccacccagcucaagauacagaacauuuccaucaccggggaaggcucccgucucccuuggcaggcaaccccacucccacgccgccagccucgggagccugcuccucagcuuccuagaaacagagcaucgugugugcagucuuucgcguuggcuuccuuuacucagcgucaugacugugagauucaccuacauugucgccuauuucaguaaacuguuccuguuuuauuucugugcagggucucacuguaugacuacggcacaguuuguuuauucauccugcugcugcuggacaucugggcuguuucccauuuuuggcaacuaugaauaaagcugcaagagacauucucguauaugucuuuggguggacauauguguuugguuuuaagaaaggaaauacaagaucuugaggcagagugguguauguucuauucuagguuuuuauacaaaugucagagucuuauuuaaaagugaauguucuuuuacggaccuugcaaaacgccaaagcaaaaggucucagcgauauuaagucagugugagguauccugagugagggcacccggguauagccagggaugugggauuccucaacccaccacgcucaccgaaggccacugggaaaggaaugaugggguggggugggaggcaucaugaagcuagaauuugcucauuuacaauauacaggaaggcucugaugaaauucacuguuuuuacucucagacaauuuauccggggaggaagugucaacaagauugcuggggaaguauuuaaacgacuaaaaaacaaauuucuagcaccuggaaaacacauucagaacguauauguucaucacaaaucauucuuaucuguuuguucauuuaaaacaguucauuuggccgggcgcgguggcucaaaugauaaacaagagaauuccagaucuuguauagcugagggugguggagacuaaagucugcaggcagaggggccucauucaaggucaaauucaagcugagacccaagggaaagaucugggcacagagaauuccaggcagagggagcagcugguacaaagaaggcccugagacuggacugagcuuguugggcggcaggagccaugagacgggcaggauggugggacacacaggaugcagaggaaggaugggccgugugugcaggugagccacagagacuguccucacaagccaccaacaggcugcagugcagcagugauauucacuacuacccuuuagagaugucauucuggcugcucuguacuuuuaagaggucuugaguggggcguuaaggguuuacuaaucauaggaggcaaaguagcaugcaguuaagagugcuggcuguagacucuagaaccaaggcaccugguaaaauccagcuuccaccaacuugggcaagucacuuaacccugagucucaguuugcucaucuauauauuaggaacagcuguuauaagcauuaugguaaaugcucagauauggcagccaucaucaucaucaucaccaccaccaccaucaucaccuucaccaccaucaccaccaccaucaccaccaucauuaccauuaccaucaucaccaccaccaccaucaucaccuucaccaccaucaccaccaucauuaccaucaccaccaucauuaccauuaccaucaucaucaucaccaccaucaccuucaccaccaucaccaccaucauuaccaucaccaucauuaucaacaucaucaucacgaccauuaccaucaccaccaucacuaucaccaucauuaccaccaucauccccaucaccaucaccauuacacccaucaccacuaucaucaccaucaccaugaccauuaccaucaccaccaucacccccgucagcagcaggagcagcagcacaaucagaaaagcccguuauggcccggcacaguggcucacaucuguaaucccagcacuuugggaggccaaggcgguggaucaccugaggucaggaguucaagaucagccuggccaacauggugaaacccugucucuacuaaaaauaacaaaaauuagcugggcaugguggugcaugccuguaaucccagcuacucaggaggcugaggcaggagaaucacuugaacccgggaggcagagguuacagugaaccaagaucaugccaaugcacuucagccugggugacaaagggagacucugucucaaaaacaauaacagaaaaagaaaagccuguuuugcauuccuagccacuccuauucccucccacaugcccccagagcacagcuuuuuggaaccaaaggugagaaccaagaucccaaaggugagaaccaagaucccaaaggugagaaccaagaucccaaagguuccuaagcuccacacugcgcaaucuaacacaagugaacuugagcgaaacgccacaggacgcuucacugcaguggcugaagcagacgcggcagaaauaaauaaacacaggcaggggcuucuggaaacaccagguuuucaucggggcaccccauguauugaucaaaucaguggcuuuucagcacggccaggaacucugcuuucuugaggcagaaucaucugcccacugccucccugaccaccccagcguccuuaggaggaggaaggagggccauggggaagaaagucugugaugggugggugaggagggcagcucugccaggcaccagagcaagcaaggcuggcacacagggccacccguccuauggcugauuaggcccaaacacuguuuuacagacugcucugggacacaaaacacagaccaccuccaccacggcaucagcuccucugccgccagagauguguuuagaggcccauuagagagauaacgcccuggcuaugcugcaagggagaauccuagccugcaccagguaggcuggucugggcacacguguccccaguggaaggcuagaucacagaggaacuugaccucccaguccuuccccccaguaagaggcaccggcuggcuguucagugccaucuuugcugaaaaaggcaaccggcagcugcucucuagccagggccuccccugccaucuaaacagauguccuuuccaagaacucaagccuacuuuuccucuaugugcuuagaaaccaucagccagagggguccuauacuccaagaugggcuuuaaaaaacgccaaaaaggccaggcaugguggcucacaccuguaaucccagcacuuugggagccugaggcaggugcaucacuugaggucaggaguucgagaccacccuggccaacauggcgaaaucccaucucuacugaaaauacaagaauuagccgggugugguggcaggcgucuguaaucccagcuacucgggaggcugaagcaagagaaucgcuugaacccaggaggcggagauugcagugaaccgagaucaggccacuguacuccagccugggcaacacgacgagacuccauuucaaaaaaaauaaaaauaagaauaaaaacaccuaauaaugcucgcaguuuucaggcgcuggcaucucuuucaauccucucucccuucuggucuucuucccucccucucucuuucauucauucggagaggcagcuuaccagagaggucaagagcacagacucuugaacccgaggaccaggaucagaacccagcucuguggccuacaggcugugugacuuugugccagcuacuucacugcugugugccuccguuuuaccaucugcucaacagagagcugaacagcaucuacuucagagcguugguaugaggauuaaauuaggugacauuugcuaaguauuuauaaucguaccuggcaugaacaaaggguuauguaacaguuuguuagguaaaaauaagucaauuuuggccaggcgugguggcucacgccuguaaucccagcacuuugggaggcugaggcaagcagaucuccccaggucaggaguucaagaccagccuggccaacauggugaaaccccaccucuacuaaaaacacaaaaauuacccaggcgugguggugcaugccuguaaucccaacuacuugggaagccgagacaggagaaucacuugaacccaggggguggaggcugcgguaagccaagauagcuccacugcacuucagccuggcaacagagcgagacuccgucuccaaaaaaaaaaaaaaaaaagucaauuuauuuagcaaauauuugcugagggcucucuauauaccaggcacuguuccugggaccuaucagcgaacaaaacaaagacgcuguccucagggcacugacaugccgggcagggagcuugacaacaaaccuaauaagcaggcaaguuauauccugagugccaugugccauggaagaaggaagaaguagggcagggaaaggggacugggaauguggggaguguaguggguuugcaauuucaugugggugguugggggaggccucaccacaaggcugacauuagagcaaugacuugaagagggagagucagucacagagggauccggaggaaggccauuccaggcggcauggacagccagugccaaggcccugaggcaggaacaugccguguucagagcacagcaaggcggcugggcaggcuggagaagagugaggcuggagugugggagcgagaggggcgaugggggucagcaggguggggggggcggaucacacagcacucuaaggggcccugagacucuggguuuucccuagagugaaacgggagccacuggggagcuuuggcccggggaggacaugagcuggccccuguugagaagguucacucuggcugcugugcucagcccagacccaacagagagggcaggggaccagcgaggaggcagcagcccgagugagagguggugguggcccagguaguggcugcaauggaggggugggaaaggcugaagucuaggcacguaccgaaugcagggacaacgggauuuccugauaggugggcuagggaguguggaagaaagaggagcaagggugccugcaugguuuggggccugagccacuggaaggguggagcugccaucggccgagaugggaaagccagugguggagcacgucggcgaaaagauccaagugcucagcguucagugugagaugcccacuggaccuccggggagucaacagcuggacgcgggccgaggcauggagcugggagugcugcacgcugggugcguggagauggagggagggcccugugcacucucacacuaaugagcuggggcaaaggggggcgagcaaaggcaacggagaaggagaggcuuaugaccaaggguguguggaggccuggaggucgagugccgacaggaggaggagaucgacugggcuggugcuguugauguguucagugagaccaacaccaaggcugacccauggcacagaaaccgcugacaaccuugacaagagcagcugugauagaguggacggguuuaagagcaaauucagccaguaucuacucagcaccucacaugugacagcuguauguuaaaaauguuacauacaaaaucucauucacucacacaauccugugcagccagcacucucuacaucuuacagaugaggaaacugaggcacagagugagaaccaugcagauucuggguggggggggcggggcauggcaugucugauuucagagccugguuacuaaccacaaguugguccaggcccaaagaaugucugcaggagucaaugaaugaaucacaaaccaaugggggcgugaaucacuccgcccagggcgggacacagggagacgugagagccaggcacuucuuggaagccgguagacacccugaaggcugacagcacuggaggugggggcugggaagccaagaucugggcccaccucugucacucaaagccaagcggccuggggccagucaccucccugcucugaucccgguguccucccgaggggguaaugccaugcccacccucucucacuggagaggaaaaggcgcgugggugaagccagcagcagcacaggcgugaaaggugcuuuauucaucuccagagaucgcuccuuuguucugcaacccuuucugcuggacgguaagaauccucuggcaggacauuuuuuccaaguauggagcggaaauuccuggcugaggcugcagcuccggagcugccauauggggaugggggacagcuggucucuccguggaauguccuggaggccggauguaucagggcaggaggugccucuuacaggaaacaauuggccccaagcggcuuggacagugacagcagccccacucgaccccacccacuucggggggccccagcccacucccaacaauacccagaaaaugaggccuuugggcacuccagaaauuugcuuucaaauacguuauagaaauguaaaaggaacaacugugaccccccacccccggcaguagauagaccucauuuugcauucugguucuuuucauuuuuaaaaaaauaaauaccucaguccuaugcaucaagcauuccuggagcacugugcuuaagaguuaagcuaagcgcuucauaguaccucuucauuuaauccucacaaccacccaguaaggggacugcugcuauucacucccauuucagagugacaagcaagucacagagagguuaagccauuugcccaggggcucacagccaguaaauggcagagcugucgaacccuggacuuucccgccccagcucacacucauaauaacuaagcugcuaccccagaaggacgcacaguggcucagaaugccgaccacaggcccagugcauggcacacaguaggaagcugggaaaagcugggugaauacaaagacucaagugccugguguggcgccuuccuccccuuccugccacugcaccucuaaggcugucaugcugagggcaggaccggagccgacacggcagugaaagggcagcccuguugcaucacccaggcccauuccucccccucuuccaucaguggcagugacauggggacacuggucggcagauuugcaaaugaccgggcaagugcugugcacagcccucagaacacuguuguggacacaccgaccucacccagccuccagccaugacgcccuaacucgaggcaugggcccaggcaaagaguggcucacagcucccuccaauaguucaaaaagcuucaaggaaaccauuauccaccugcccauucuaaggcaguacagccagcuaaugagaugcucagagucuccugaucccgcauacagcagccagaaggcaggaagacccuuguaaauggaugucgaugcugugucuccccuaaugcacagauaaagcccaggaccuggcucuggcuugcaaggcccugcaggacccugugugcagaaaauaacacagcaagcuucagaaagggccgcuaacaagguuggauccucagcuggucucugcaaacuaggagagggcucccaccauuaacuaauaagaguggcccgcucugccuaaacuguucugcaaacaauauggcuuagguggaauaccuccuuuccuucuagagucuggaacucuggucugugccaggcagggggugcuuaugugaccacuacccacuaaaaacccuaaggggcuuccgugguggacagcacagagaauuaagcuguccuggugacuguacugggagagggcucuggaagcuugcaccuggcucccaagaccuuuucccacacaccuccuccuugggcugaguucucucugugcuuuugcuguccuaagucuccuguggggagagaauaugcugaggccagguguucuccuagggaaccaucgagccuugggacagacgccccagugccucuccgcucucgucuccccuccccuggccccugugcuccugcucccccaccucccacccccacccccuggcucuucccagcauguguggaacaugcugcugucccaggcguuugccuccucucccucugggccacuggccuugcuccuucccuuccuguggacaucugcucacccagagaacccuuccuuauccucccuuacaagacaacagcugaucccaggcgccccaccccugcacuguggaucuccuuccguggcacuggccacccccugccacgcacacauacuugcuuauuugccaccuguauccccacuggaacacacgcuccaugaggacaaggucuggguggcuucguuccccaaggcacucccaacacagagcuggcauucaggaggugccuggggaauacccgcugauggacaaacagcuguccaugcuguucccugggcggggugagaacaugcccagcguccaggucacuggugaguucauuaggcuccacccuucagggagcagagugggaggggaauccacucaccuccagcagcugcgcggcacugggucggguuucuggguucuuauccagggcuaucuucaggaagucacggaacucuacagaccugggaggacaggcgucagagguaagcauggaggaggcaagagcagagagaagccccccacgucacagacuccacugucccaaucaugccccucaaaggacagaggaaacuuucacaagcuaaaacagugacagggccuacacgacgcccuuuucaucauggacaccacuguccagauggggacccagacaucggcgaggagcagggacgugcccaggccacgcagugaggagacucagcagugccgggauuugaacccaggcccccgaugucccgcccagggugugccauguggcuccugcggcucagcuggggcuccuguuccccagugggagccagcuuauuugggugacuugguuugcucuggugaagaucucaugucaagugcacagaggcagcacgguagcucacgccuguaauuccagcacuuugggaggccgaggcagacggaucccuugaggccaggaguucaagaccagccugggcaacauaggagaccuugucucuacagaaaauuagccaggcaugguggugggugccuguacucucggcuacaagggaggcugaggugugaggaucucuugagccuaggaggucgagguugcagugagcuaugacugcaccacuguacuccagccugggcaaaagagugagacccuaucucaaaaaaaaaaaaaaaaaggaacacaaagggaaaaagaggcacgaagggcccgggggggcucagaaacgccugaagacccccaggccccaaccucuccuuuggagcuagcagcaccaggagaacgcuaccacugcaccuccccagccccguccaccacauauuccagcccuaaucccggcgcaggcaccccggcagguggcccugccccugccccucaccacuuagagggcgugagcagcgugggaggguccgacuuggcgaucuuuagcaggacccgcaugggguugagcucgugguguggcggcucgaucugggccaucucaaucagcgugaugcccagggaccagaugucggcuuuguagucguagggcgugucuuucauggucucacacaugaccaccucgggggccauccugaaccaaccaagggacaacauagggcuaagaaucuggccuuuacaggugcuucuuggacauucagggucaagggccaccacgagccacugucgggguuggcagcacucccgaaucaugaucugcgugacuuugcaucccacugucuuccuuaggacgcucuuccacagaaaaacgccuccacgcggcuccccgccacguccugcugcaguuccgaugccuaccgcgagauggcagcagcaacccggaacacagaguccuggggagggggcgggugggagcggaggggaaggugcggagcaaaaaaaaaggggcguggaggugggugggcgagaagacaccagcacagagaggagaaacagguauaaaaggggggagagagagagcaagggugaguaacaagcaagcaagaaaggagcccaaacuacacaauggcaaguaaugcacaugaaaaaauuggaaacacggcaaacagagaguagucaggcgugaaauugagugacaguguuuugcuuuuaaaguaauaguucuggaaaagaaggaaacacgacagacuacagaaguccagggagacuucacaugacgguaggaauugaacuuguacuguucaccuucacgguccccauccccggcccucaauacauacguggcgaauaaaucacgaacugaauccuguuuuauggauucuaguucaguuauuaauggagugccuucuaugugcaccauuucauuucauucucacaguagccuuauuaaguaggggccauuauaucccuaauuuuauggaugaagaaacugacgcacgggaaagcuaaacagcuuguccaaggucacacagcuaguaagccacgaggcagggcguguagcccuugucuuccggccccucucugucuaaagcgccugguggucaccuuggagaguuuuuacauccaguccauuccauuuccagaagcuacacgacucaccaguaaggcgugccgaugaaggaaucucguuucuguagagucuucagauucuuggcagacacaccaaagucagcugcaagacaaaaucucagcuagcguuuuccacccauagcccugggguaaaagccggggauguggacucagggguacacauuccaagucgacuaacagaugccauuuucuaucuagcaaauuagaaagcauuaaaaauguaagacuaucugcugcugagaggaaguaccgagaugaacacuuuccucucuacuaacgagagccugcacuggcagcagccuucaggaaagcaauuuggcaauaaauagcaagaaccuuuaaaauacccauaccauuuuaauccaguaauuccaaauccaggacucugcccuaaugaaacagucuuaaauuuaaaaaaaugcauaaugauguuaaucaaaaucccauuauaauaacagugccauuauaaaauuauaauaauagugacacacugaaaacaaccauaauugcuuggcuaucaggcagugauuuuaaaacuuuuuauauagauuaagaaaaauggaggccaggcaggguggcucacgccuguaaucccaguacuuugggaggcugaaacaggcagaucgcuugaggcugggaguuggagaucaaccuggccaacguggcaaaacccagucucuacuaaaaauacaaaaauuagccagguguggugguggacgccuguaaucccagauacuuggggggcugaggcacaaaaaucgcuugaacccgggagguggaggcugcagggagcugcaaucgcaccacugcgcuccagcccaggcaauagagugagacugucucaaaaaaaaaaaaaaaaaaaaaauuagccaggugugguggcaugucccugcagucccaauuacuugggaggcugaggugggagaaucacuugaacccaggaggcagaggcugcagugagccaggauugugccacugcacuccaaccugggcgguauuuauuacuauuuauuaauuuauuauuauuuuuuugagauggagucuugcucugucacccaggcuggagugcaguggcgcaaucuuggcucacuguaaccuccaccucccggguuccagcgauucuugugccucagccucccaaguagaugacauuacaggcaugugccgacaugcccagcuaauuuuuguauuuuuaguagagauggaguuucaccacguugcccaggcuugucuugaacuccuaaccucaggugguccaccagccuuggccuuccaaagugcugggauuauaggcgugagccacugcgcccggccuuacugauuacuauuuauauuacuguaaaagguuaaguggggagaagggggauacacaguugaauauacugucuggucagaaucaugccccucucacuccaaaaaggggaaaaauacacacugaacugacuuggaggaaauauaccacacuacuuaaauggcuguguguggguggugagacuuccacaccuuugcuaugauaaaguguauuauuugcaggacuagcaaaaauaaaugaacacuuuuuuuuuuuuuucaugacagaguccacucugucacccaagcuggagugcaguggcacaaucauggcucacugcagccucaaccucccaggcucaagcaauccucccgaguagcugagacuacagguguaugccaccacacccggcuaauuuuuguauuuuuuguagagauggagucucuauguugcccaggcuggucuugaacccugggcucaagcaauccuccugccuuggccuccgaaagugcuaggauuacaggcgugaggcaccaggaccggccaauaagauguaucuuuacaugcauuccaacacucucagucuuuccucacacacccgcugcuaagagaagaauucagcgcuaccaagagaaauuuucuccagggcuccugccuucuguggugaaguuucaucuugacugaaaaauagauucaggaugaaacaacacuuugagagaacccgggaugcuccauuugaaacucccugaauggaauuuaugagggguguccccugcuagaugauggcugccuuuggacgauucaucccaagaagcugcagcauuaugacaacuucaggccaccccgggcaccagugccuggucuugaaaugagcuguauccaggagcuccuuucagacuugcaacgugaaacaaggaggcagcacaaugccaagaggcugggccugaauacgggagaacuugguuccagccucugcucuucugcuucacuguccacucacccauucauucaggugcucaccaggcuccaucaggagcgagacacuagccgggaucagagaauacaaugaggacccucggggaauccacaguuuaguugggggagcagagaguaagcaaauaaacaaacaucuacuccuaacauggaaaguguugggaagacaggaccggggcuacucaagagugcacaguagggggugugaccucgaggggacggucauggagggagggcugggggcuuuggaggaaggacaguuuuauucagcauacacuaacugcacaucuauuaugugcccgacacuguucuaggcacagagaugaaagcaaccaaguccugccugacaugccacauguuauucccgugguggcgacaggcaccuggcaaaacccccggaaugccuggcagcgagaagggcccagggcugagaaggcagggagaagaacacagugcuggggugcaggguggggagcuacuuuagacacaaacucaggaucugggggagguauuuccaggcagagaaaacugcaaacagacugggaggcaggaaacagcaggcuggagggaccagcggggacaggacacagccuggccggaaggagggggccggggguggaagcagauaaggcaggagacgggcagggcaguuacaaagccucugagccucaguuuccccaucugugacacgggggugauagcacagaaccauugcgcagguuuuccugaggauuaaaugacaaacgcaaagcacugugaugcaagguccacucguggcaaaagcgagaagauggugauucuuucaccggcccaugagccaguccagccuuuuucaggcuggggcaaggcugaggcugaacuaagaccccccggcaccuccugggaguggucaggaaagcuggcuucugagccccgguuagugcuaacuggacagcaguugcuauaucaggggacagucuggccagcaagaggggacagggggcccucagccuccugaagugggaccaacaggugcugcaagugaggugcagaagcaggaaacccagguagagccuggcucugcugaugacucuggcaggcggcuccccugggccuccaggguaagaaugggaagcuggccccaccuuccugcugggucagccaggccccccugugggccuggcucccucgcaaacaccacuaagggcuggcacaucaucccaucccaggaaaccuuuugggaacagugacugccucucaggcccagggugaggaucccaaaagguggccacuccccgaccacaggcccugccgaucccuuccugagaagagagacgagaaacagaaaccaccaacgugcaaugacacaccguagguccccagggccucccucaggcacgcaccagccagcucuuuggguagcugcuacuuccccuucugccccacacgauggggcccagaugggagaguggggcagccccaccuugcagcccagagaacugagccuguuugcucccuccgcagaguuuauaagggagugucccuugauagcugauggcugcccuugagcaauucaaaagggauuuucaccaugcagucucuucugaugaaaacacucccccuucuccucccauuuuaaaauguauuagagacaagggcggcggagauaagggaaaucucccuuucuccgcuguaauuuccauaaagaaagagaucauuucugcuguggccacaguuguaucccuggcacguuaucuggagcaggaagcacucaacagguuuaucgaaugagcaugcucauaaauaaauaaagagacagaauuugcuaaaaugccuuuacucauauauguaaaaaauaaaacuggguuuuaaaaacuuguuugccagcaauucuauuuguagaaauccaucucuaaaaccagaucuauaauauauauggaugcuuauaaaagcaacagccaaaaagaauggaaaauuggaaaucauccaaaguguugcuggagcuucauugcugaaugguuagauaaguugugguucaccccagcuaugaaauaacaugcagcucuuaaaaagaaugaggcuguauuuguauggacuaacuuggaaguguaucucuaauacauuaauacaugucccaaacauguugcugacugacugaugagucuuauaaaauguguagcaugauuccagaaaugauccaagugcagguacuccaguagaagauuaucuuuaaaggaauaauauaugcaucuuguguguacaugucugcacgcaugugcauacacacacacacacaccggucuggaagucugcacaucaaacuuaauguucaucucccuggaagugggauuuuggugggggcagugcacagaagggaccuuacuuuuuuuuuuuuuuuuuuuuuuugagacagagucucgcaugucacccaggcuggagugcaguggugugaucuucgcucacugcaagcuccaccuccuggguucacgccauucuccugccucagccucccaaguagcuggcacuacaggcaccugccaccaugcccggcuaauuuuuuuuuuuuuaguagagacgggguuucaccauguuagccaggauggucucgaucuccugaccucaugauccgcccaccucggccucccaaagugcugggauuacaggugugagccacugcacccggccaggacccuacauuuuucacuuuacacacuuuuauucuuuuuuuuucagauggaguuucauucuuguugcccaggcuggagugcaauggcacgaucucggcucacugcaaccuccaccuuccggguucaagcaauucuccugccucagccucccaagcagcugggauuacaggcaugcgccaccacgcccggcuaauuuuguauuuuuaguagagacgggggguuucaucauguuggucaggcuggucucaaaaucccgaccucaggugauccaccugccucggccucccaaagugcuaggauuacaggcaugagccaacgcgcccgacccacuuuuguucuuuaaaauguuuuugauagaguguauuguuucuaugguuuaaaaaacugaaaugcauauguagcaaaguuuuuugguuuuguggguuuuuuuguuuuuucucuauuaaguaaaacccaguaggggccaggauguggugaaaagagaauugcacacugcacuggggggggugucaacugguaugaccagcacggagggcaugccggcugcaggaugaacaaaaccccaacucacugcacacacccagcacucugcuucugagaauuccucuucaagguauguuacagaaagagacgcaaagauccaugaacaagcacacucaucacugcaugauuucguaaagaugauaaaccucaugagaaacccaaguauccaauucagggcuuuccucagggcucugauagguaaauuacauuuugugccugugauggguacaagaaaaacacgaaaauaaucauguuucugaggaaucuuuaaggauauggaggaauacgcugauauucaauguuaaaaaccagacuaggaaacuguauauauauauaauaauccuaguuuaucuuauaaaaacuaauauugucaccggacacgguggcucaugccuguaaucccagcacuuugggaggcugaggcaggcagaucaccugaggucaggaguucgagacaaaaaccaacauggaaaaauccccucucuacuaaaaauacgaaauuagccaggcgugguggcacaugccuguaaucccagcugcucaggaggcugaugcaagagaaucgcuugaacccaggaggcagcgguuguggagagcuaagaucgugccauugcacuccagccugggcaacaaaagcaaaacuccaucucaaaaaaaaaaaaaagaaaaacuaauauuuacugagaacuuaccauaugcauagcacugugcaaagaaacuuaugcauaucaucugcauaucuauuccuacacacaucguuuauaucuaugacccuuuaaggcagggaaaauuaugacucccauuuuacagauaaggaagcuuaacuuaagaaagacuaaguaaugcacagaaggucacccagcugugcucuuucccacuaucugauccgacuuuucugcagacaaaaaaagacuuggagggaagcccacggagaguggugguuuauucuggcaggauuaggaaggaccuuaauucuccuuuuugugggucuuauuccaaauuguguacaggacucuagcuacucucguguguguguguguguguguguguguauguguguuuucugauuaccaaagucauguugcuuauuaaaaacucauuauuuuucagauuaaaaacuauaauacugacaacuaaacauuuacggguuugcuguguauagcuccaaauuuauguauauuaaaauuauauauauauauauauauauauauuuuuuuuuuuuuuuuuuuuuuuuuuugagacggagucucacucugucgcccaggcuggagugcaguggcgcaaucucggcucacugcaagcuccgccucccggguucacgccauucuccuaccucagccucccgaguagcugggacuacaggcgcccgccaccaugccuggcuaauuuuuuuguauuuuuaguagagaugggauuucaccguguuagccaggauggucuugaucuccugaccucgugauccgcccgccucggccucccaaagugcugggauuacaggcgugagccaccgcacccggccgguuauuuuuauuuucuuccguuuuuuaggaaccuagagacgcgugcccauuugauaagggcuucgucuuccgguuugaccccccaccuucggccuucacugacucuccuccucgcaacacacugcacugucuuccugacacccuccacgcacucaccgccaacccagcccuuucuuguugcuucccaucccucaagcuucugccucacuuacuuccccucugcugggccugugcgauucucacaggcugggcaggguagguagaccgcaauuuuuuuuucuggccaguccgaauccucccuuccucugaaaaaccaucuccccacccaccacacugccucauugcgggggcgagggcuacuuccguguugucacgugaccccacccuccgugccagagacugaagacaagccgggccugugggagacccccuccugccugggccucacugauugguccaaggauuacuaucugggccaaacggggccagucagagcccuccccugggauuauugaugccaaagccuccaauggugaguucggguucaggcagcagcagaugaugccgggaaaugugaaacuagaugguauccugagcuugguggagaggguuggucugggagccgaaccuacaugcacagaaagccaagggccagggauacgguccuggcagcguuaagggccagggauacgguccuggcagcguuuauguuccagguuucaacuaacuuuaaggcccacccagcuguauuucuucuccaauuuggcuccaugauguacacauuuuccugucugccuuaacucuuaggaaguggguuuuuaucauuugccacuaagagaggcgacaagaggguagugguuaagcacguaggcucuggacccagcugccuugguuugaaccccaguuguuccucuuaucggcaaugugaccuuggauaagucagucuugcuaggucccaaauccauccugcaagaugauaucaguggcuuuugagaauggaaugaguuaacacauaucagaugcuggcucagugcaugguagcucuagugaaagaaccaggcccccagccugcugguagcaggaaauagcaaugcugggcugggugaaggcagcagugagagaugggcaguuggcuuccugacugguccaccugccaagucuccagcacauugggcggggcauggggguugggaguuggggaugcugaaguaacuaaccauaggcuaaagugguggucaugcuggaagugacuguuuauugagcaccaacuauguguuguuuguuuuuuuguuuuuguuuuuguuuuuguuuucgugaaacagggucuuacucuguugcccagaccggagugcaguggugcaaucucagcucacugcaaacucugccuccuggguucaagcgauucuccugucucagccuccugaguagcugggaauacaggcgugugccaccacgcccggcuaauuuuuguauuuuuaguagagauugggguuucgccauguuggccaggcugguccugaacuccugaccucaggugauccacccaccucggccucccaaagugcugggauuacaggcgugagccaccaugccuggccgaaaaucauuacuuuaaaaaaugcauuguagccauaucauuuggcgaugcagaaguacacaugagaagagcucaaagcgcuugucucugcagguggauggcaaaaggagacacgugaggggaugacacauguauguguuauuuugguuaaaaaaauaaaaacauuaaaaauacaaagaggagacauuuaaagaagaagguuuugagccgggcggggugguucacaccuguaaucccagcacuuugggaggccgaggcgggugguucacuuguggucaggaacucgagaccagccuggccaacauggugaaacccggucucuacuaaaaauacaaaaauuagccaggugugguggugggugccuauagucccagcaacucaggaggcugaggcaggagaaucacuugaacugaggagguggagguugcagugagccgagauuucgccacugcacuccagccuggauaacagagugagacucuguccaaaaacaacaacaaaaaaagaagguuuugauauaugugcuuaauguccuacuguuuucccucuggggauggagcugggucaucccuccauccaucacucucauucgaauucucuugauuagaaagaagcuggccaggcacaguggugcacaccuguaaucccagcauuuugggaggccaaggcgggcagaucacuugagaugaggaguucgagaccagcuuggccaacauggugaaaccucaucucuacuaaaaguacaaaaaguagccaggcaugguggcaggugccugugaucccagcuacuugggaggcugaaacacaagaagcacuugaaccugggagguggagguugcagugagccaagaacgcaccacugcacuccagccugggugacagagcaagacugccucaaaaaaauaaaauaaaauaaaauaauugaaaaaaagcaaagaaucaagaguaggaaggggagaacugcugacaugccaagagggcguaggcgugaggaccccacacccccaugagguccacacucccacuggccugcagaggccaggccaacacccccaggcagacacccuguggcuccaccuuucccacccugagccccuuacccagccugaugucucccucgagggucaucagcacguugccagcuuucagaucucgguggaugauccucuugcugugcaggaaguugagggcuucuagcaucuggcggcaaaccaccuguaucuggggcuccgugaggccucuguccagcucuggaaauggaggagaacggcugucaauucaguaagcccuggacacaggaaacugaaaugucaggcccacgccagggagaaauauaaaagccaccaacauuaggccaggcgugguggcucacgccuguaaucccagcacuuugagaggccgaggcagguggauuacgaggucagggguucaaggccagccuagccaagauguugaaaucccaccucuacuaaaaauacaaaaauuagcugggcacgguggcaggcagcuguaaucccagcuacucaggagguugaggcaggagaauugcuugaaccugggcagcagagguugcagugagcugagaucguaccacugcacuccagccugugcgacagugauacuccaucucaaaaaaaaaaaaaaaaaaaaagccaccaauauuaaggagugcucaccguguacuggauucauuucuaagcacaucaugugcacugacccauuuugucuucauaacaguccuaugaagcaggcacaauuauuguccccauuuuacagaugaggaaauugaggcuuggaaagguuaagccacucgcucaaggucaugcaggugggaagacacagaucugagauucaaaccagggucuggcuuuagaguucagguuuguaaacauaagcccgacugagacagagagaucuguugugucugcagacacugagagggcacuuacuaugugucuggcucugugcuuggagcaggaaggcagaugggacauggaaacggugagugacacuuggaacagagugaggugcaggcaugugggaugucagaaugggcaggaaccccuuauagcugggggaacuggaaggcugcccagaggaaaugacauuugggcuaugucuuaaaggaagagaauagguggggcgagggcacucuaggucaaggagccagcagaggcaacagcugacaugagcuggugucuccaaaauguccacuggggccagacgcaguggcucaugccuguaaucccagcacuuugggaagcagaggcgggggggaucacgaggucaggaguucaagaccauccuggccaacaugaugaaaccuugucucuacuaaaaauacaaaaacuagcugggcgugguggugcacgcaugugaucacagcuacucaggaggcugaggcaggagaaucgcuugaccccaggaggcagagguugcagugagccgagaucgcgccacugcacuccagccugggugacagagcgagacucagucucaaaaaaaaaaaaaaaaaaaguguccacugaggagacccucucuucggugacccauuuucucagcaugaggaagcuuuuucucucucucuucuuuuuugccuauuaaacuuuccacuggcuguuggugguggcaccaggguaugcggaugcggaagggccagagaggccggagggcugguugccaagagccuuuuguucuuuauggggagacacagcgcccacgugcgcacgcugcagaucacucaguguccaccgagagauggccagggcccuucuucccugagguucacagguugaguaggucugagcaggcagggagcgggaaggugggcagcaggaagaauauuccuggaaaggggaacagacuuguguggugggagggggcaaaugaagggaaagugacucgaggucagaggucagcaggccuuggcucugcaggaccuucgggccaugcuguggaggcugcauuguauuugaaaugcaguggguaguccacgagaaguucugagugggccagacacagucugauuuuugcauuaaaaaaaaauucccauggcugagagcaguggcucaaugccuguagugccagcuacuuaggaugcaaagguuggagaaucacuugaggccaggaguucaaggccagccugggccacauagcgagacccagcuaugcuuguagcauuuauuauauuauaaacaaaauaggccaggcgcgguggcucacgccuguaaucccagcauuuugggaggccgaggugggaggaucacgaggucaggagaucgagaccauccuggcuaaaacggugaaaccccgucucuacuaaaaauacaaaaaauuagccgggcguaguggcgggcgccuguagucccagcuacucgggaggcugaggcaggagaauggcgugaacccgggaggcagagcuugcagugagcggagaucacgccacugcacuccagccugggcgacagagcgagacuccaucucaaaaaauaaauaaauaaauaauaaauaaacaaauaauucccucuagcacagcaaagagcuugcugggcagcaggggcaggggcucagcuggaggucaucacagugguccagauaggcaccaaagcagagaggaggaaagcugcucaauggacagauuagggagguggagcuggcggaauguggaggcggugggaggaggggagugagaagauuccaaggugacagccuugugcucugcgucccacaggacuguccugauugagucaacguagcuacccaagaccccugugaccaggggagccaccucccuuggccugccagguucccaggcugucggcuucuaagccuggucaccaaagggcacugcuccgagucuucccucugccuacaacagcacugcuguguccggcuugccuaguggugccuggacaggaauccacaaggcucagcucucccagccaggcccucaggagugguauaauagacaugccaaccaggaaugcagguaccaacugcccugcucugggaagccaggccccagaccagggcuccuggaccagggacccuucucucuggaguccgcaagcugccugcccccugucccuguggccucauccugaaccucugugucuccagccaggggccaggaucagagccugcaugggcuucaggaccacacagaccgaggccguacccaggugcugccucucacuagcugugugguuacuggcaagucgcccaagcucucuggcccuucauuuccuggucugugaaaugggaugauuauaaucgacauaggcagggcuccagccaucagccauguucaguucucaguguggaaaauaggcaauaaagggggauuauugcuauguugguucuaagaugaguccagggcuggaauaugugccgcaaucuuuuuaauggcaaaaaugugucuugcucaugucuaauuuacugauauaaaugaaauaggaaugacaaaaauacuaaugaugaugaugaagauaauuaugaucuaaucaccaccauuuuuggagcccuuauaaugugucaggcaugaggauaaggacacggugcauacugucauuuaauccucgcaguaacccagugaggugggaaggagauacucuuuaauuuuguuuuuuguuguuguuguuggguuucuuuccuuuuuuuuuuuuuugagauggagucuugcucucuugcccaggcuggagugcaaugguguggucucggcucacugcaaccuccaccuccuagguucaagcaauucuccugccucagccucccgaguagcugggaugacaggcaugugccacgacgcccggcuaauuuuuuuguacuauuaguagagacgggguuucaccauguuggccaagcugaucuugaacuccugaccucaggugauccacccgccucggccucccaaagugcugggauuauaugcaugagccacugcgcccagccuaauuuuuuguuuguuuuuguuuguuuguuuuagacagggucccacucuguugcucaggcuggagggcaguggaucacggcccacugcagccucgaucucccaggcucaugcaaucuucccaccucagccuccugaguagcuggaaccaccggugugugccaccacacucagcuaguuuauaaaaaaaauuuuuggcagggcgcgguggcucacgccuguaaucccagcacuucgggagguggaggugggcagaucaccugagguuaggaguucaagaccagccugaucaacauggagaaaccccgucucuacuaaaaauacaaaauuagccgggugugguugcacuccagccuggggaacaagagcaaaacucugucucuaaauaaauaaauaaauaaauaauuuuuuguuuuuuggagacagagucuuacuacguuguccaagcugguaaucuuggacuccuagcugcaagcaaucuccuaccuugguuucccaaaguguugggauuacaggcaugggccacuaugccuagcuaauauacuuuuuuuuuuuuuuuuagacgacgucucugucacccaggcuggaaugcaguggcgugaucuuggcucacugcaaccucugccaccuggguucaagcgauucuccugccucucagccucccgaguggcugggauuaugggcaccugccacuguaccuggcuaauuuuuguauuuuuaguagagaugggcuuucaccaucuuggccaggcuggucuucaacuccugaccuugugauccacccgccgcagccuuccuaagugcugggaucacaggugugaccaaccaugcccggccugauacacuuuuuaaagucaggauuauugagguauaauuuacauauauaaaaaauucacuuuuuuaagguauacaguuuuauaaauuuugauaaacauauucagucauggaacccccaucacaauuuagauacaaaauccauccaccauccuccaagauuccccugugaccuuugcaguaaacucuucccguuuccagucccuguguaaucacuaauuuguuuucugugccuauagucuugccuuuuucuaaagugucauauaauuggaaucauacaauaugcagccuuuugaguccaauacauuuuuagaaauaguuuucaauuacacagcaaugcaugaauaccuucuccuuauuaaaaaaacuacaacauugcaaaguccccguugacaccacaucuaauucuagccucucauccuuuccacgauaagaggguggagacccaagauguuuguuuauuuguuuuguuuuguuuugagauggagucucgcucugucgcccaggcuggagugcaguggcacgaucuaggcucacugcaagcuccgccucccagguucacgccauucuccugccucagccucccaaguagcugggacuacaggcgcccgccaccaugcucggcuaauuuuuuguauuuucaguagagacgagguuucaccauguuagccaggauggucucgaucuccugaccucaugauccacccgccucggccucccaaagugcugggauuacaggcgugagccaccgcgcccggccaagacccaagauguuuaauagccagcaaggcauggccaaccauaucuauuccaaucagaacaggcccuggauguuacauagaauggccccacagugacauaccacguggguauucucuccaucucacaaaagggccaguccugugccccaaagccuccaaaaagagaaaccuggaauggaccucagggaauggaccccugggccccaagcucaggccaguaaugcuucccagccaugcggggcaaaguggagauggauggaggggcagaaaccccucuaagcagggcaggcaucugcaggaaggucaacacuaaacagagagcugcaacgaggaccuggcucugaacuugucagcuguccccauuucagcuucucuuugcacaucaucauucccaaaaugcuccuuucacugcugccaccaacagggggaaaacugccuagggcuggagcagucaggaccacgaggagaacugggacgggagccagagaaggguuugucugcuggcugagcuguagccuagggcacgcccuagcugugaaugaggucgaggacacaguacacuuccaugccuuuccaucucugaugcuccccuccagcuaagcucauucaguuaagcugcauaccaggggacacagagggggugcuagcuggcuuccauuuuccccuucuuuuuuuaguaucagcacauauggcuacccagcuagaaaaccacauuccccagccuccauuccagcugugugugauaugcuacagccaaugagacauaaaucaaggugccauguggagcuuuucugaagucucuuuaaaagagucuucagugugggaugggugguuauucuacccuguugucuacccugcugcuuggaauucagaugugauggcuggagcucccacaccaucuuguugucaagaugcaugcagaaaaccagcaugagaauggggcuaacacagaggacaguggggccaagaguuggagaaagaaaucaaguccauaucacaacucuuuauuauuuuauuuuuuugagacagggucucacucugucaccugggcugagugcacuggcaugaucuuagcucaaugcaaccucuucuuccugggcucaagcaauccuccagccucagccucccaaguagcugggauuacaggugcaaaccacuaacgcccagcuaacuuuuguacuuuuuguagagacgggguuuugcccuguugcccaggcuggucucaaacuccugagcucaaagugauccaccugccucggccucccaaagggcugggauuacaggcuugagccgcugcacuccaucucuuaucauaacucuuuaaaacuccuggaacaagcugugccugaagcuagccaucccugaagucuucaguuauuugugcaaauaaauuccaccucccacaucccagaccuuucccccaccuaaaaaaguuugaguauucuggcuccucauaaccuaaagucucaauucauaccagacuaucacuuuuauacuguuagauucuauccccccaaaugauaaucuucaaaggcagugccugcugagagaaggcacacccaagagccauauaacaugugccauguauccucccugcuacugucaucuaccugggaacuccauggggcaguaaguggcucuguaacgaaggcuuguggguccuacauuucuacagcccgggauggggauggacuacuguaaauuucacacauuccugagauggguuuggaucauaauccuaaaagagaccaucucaaauaccauaaucccaaauauugaaauccccaaagaucaaaaucccuaaagucuaaaauccuaaaaaucucaaucacaggauaguuguauccugugaggucaacucuuaugaacggucucugugcaacugcccguaaucucucccuguaauacacuuggucauauguuaaauuugaaaaaacuaaauggucuuuaguauauauauauuuuuuucccccacuauuuuaaauagcauuacuuuuugcaauucacuaugcuauguauuucaucuucacaucauuuucaauacuggagguauaaaugguauagagacuuugagagaguucuaauuccuuuuaugcguuuguugcaaauuugacucccugaaaguguauuaucucagcauugcugguguguaagcauugugcauguauggaaaaaugcugaaaguuccucaguaaacauagggauguccuuuugguacauccgcauuuguggaagauaaacuuucuccagauccuggcucuuucggcaucugcauaugcccuagugacccacugaggguuuugaucaaucucgucaacaggcuuugguuguucauuacaguauuucagacaacagcuauaaagcuguguguacacaaucaccaauccuggugauaugcacuuauacaucucccuuuuugaccuaccucuuuauggguacaagucaucugcucaugacuuuuuuucauuuuuuuuuuuuugagauggagucucacucugucgcccaggcuggagugcaguggcaucaccuuggcucacugcaaccucuaccgccuggguucaagugauucuccugccucagccucccaaguagcugggauuacaggcgccugccaucacgcccagcuaauuuucauauauuuuguagagauggguuuuugccauguuggccaggcugguuucaaacucguggccucaggugauccgcccaccucggccucccaaagugcugggacuacaggcgugagccaccacacccagccaaucugcucauaauuguuacagcuguaccaccaucuuugguauagcuguuuaugcuugcaaaguauguauguuacuacugccuauuugauuguguaaaguggccuaugaagcgccuugaaguuuuuauauuucucaaauuccccuuuaaaauauaaguaaauaucaagaauuuuaaaaaaaauuuuagcauuauauuuuugggauuuugaucuuucgggauuguacuugacaggauuugagacuuuaggcauuuugcucuuuuuggauuucaacauucagguuuauggcauucaaggcuaugucaggacuacaguuggcucccuccugagguaaacucagggaaaauaccuugaauggugugacauuauccuaagugccucuccucuucugggccaucccagaauccuggacaugucacucaaccuuccaggccucuccucagccucucugcacucacugcccugaaggguagcaugagccggggaugcugcaggaugggccaugguccaugguuaggagcgggucacccagaccuggguucacagcucuccugugugaucugggugagucccuuaaccuuucaagugucagcccaaucaaaaauaaaagugauauuugccuguaaucccagcgcuuugggaggcagaggcagguggaucacccaaggucaggaguucgagaccagccuggccaacauggugaaaccccaucacuacuaacauacaaaaauuagccgggcauggucgugggcaccuguagucccagcuacucgggaggcuggggcagaagaaucaccugaacccgggagguggagguuacaguaagcugagauugcgccacugcacuccagccugggcaacagagugagacuccaucucaaaaauaaauaaauaaaauacucuuccugauuuuauaccugaggauuagaggaggaccgcauaugggaacgugguuaccacacucucuggcauauagugacuauucacaaaggaauggccacuacuaacauuucacugugaucaucgucgucauuauugcucaagcuugcccaggacauugagaccugacacuguccccacagagcauuuacugaauguguggguauccccacuuuucaaagaccuuccucggguaucucgguuuuaccuccugagaguguguggggucccgcaaagaaggcaucauacccaucuuagaucaagaggccucaagagggagaguggccaguucaaggacacacggcuucuggaacagggagugauggucuuccagcgaauguccugcguucucuucaagaacccaaccccuccaucucuacuaaaaauacaaaaacaagccgugcgugguggcacggaccuguaaucccaggcuacucaggaggcugaggcaggagagucauuugaacccgggaggcggaggcugcagugagugagcugagaucgcaccacugcauuccagccugggcaacagagcaagacucugucucaaaaagagaaagaaagaaaaaaagaacccacacccugcucccaaaagcagacauaguagagaggugcucaaagaggccaugggaacugauggaaugggagaguggaggucccaguccuagacagagcuguccagcagucaggcuuaggacuccaaacgagucgucuggucccgacaaugcaccgaaucaaguaagacucacccagcaugauggcguccacggcucccccuggacagaacucaaucaugaucugcagaaaacacagggcaaagugacaaugaguggggcugcccagccgucgagacgggaaccccacaggcccauugggcaggguccacccaugcccaaugccugggugccccugcucuccagcccuuccuccuccugccuugggagcccgucccccucccccagugggccucaaaccucacuggaggcucugacacccagaggagcuucuuggcugcuucauuuucugaagaaggaaaacuaaguugcuacgaagaccugaagcuucagcaaacagccucuucagccaagcccacacccucccuccucgcucccgccuaugcgccuggugcccaccugccagcugcccuguuuccuaugcuccacagccaagaaccucaggaugccuucccccggccaagcuggccaaguccucucagaaucccagcaccugucucaggcucucuccaucuuccagaacccuggaccuugcuggcucagaacaucagggccuugaagaucagcucagauggagaaacugaggccaaaaaaggggauguaacugaccaaggccacagagauuguuccuggacuggaagcagagcuccaaacccucaggucauucauucauucaucauacaccuacuccacacugacaggcugcaggccccgggagaacaaccaggucuaggcccucaaggggcucccagccuaguggaggggcagaaaggacgauuacaguagaaagguccuuccugaccucgugauccacccgcugcacuccagccugggcaauagagcaauagagggagacuccgucucaaaaaaaaaaaaaaaaaaaaaaaagaaagguucuuccagcccugguucacucccauucucacucuuucuggcccacuccgggcucuuugcauagaugcuuuuucuuuucuuucuucuuuccuuuuuuuuuuuuuuuuuagacagacucucgcucuugucacccaggcuagcgugcaauggcacaaucuuggcuccaucucugggguucaagugauucuccugccucagccuccugaguagcugggauuaaaggcaccugccaccacaccuggcuaauguuuguguuuuuaguagagaugggguuucaccauguuggccaggcuggucucaaacaucugaccucaggugauccacccgcccuggccucccaaagugcugggauuacaggcgugagccacccugccugaccucuuuuuucuuaaaguagggcuacaggugguugaggaagagggauggcgucacaaacuucaggacaggcagaaucaccucuuagcuuccagcuccuggccccugcuuguugugaaguuccuucaacccagcucagcagaggcccuggagaguggggcagucaagaagacccacgcugucucuaaacaggaaagaaacucucaaccauggucuagcuggaccagagacagcucuccagccagaggaggguggagcagccucaggaauuugaugaagccuccaguuuguggcuuaccuuccaggagccuccuggcaauguaaauaugacccugaggucauguggguccuaugaggauguggugaugcguggcuuuggagccagucacggcugggcucauggcccagguccaccgcucacuaguguggccuuggacaggucacuuccguccucugagacuguguccucagcuguaaaauggggcugcugaugcuguugcucugaacugggaccccauggcugggcuacacuagggguauaagccgggcugggaugcacgaaaccacagcagauaaaacaggggacuuuaacgugggccagggauacuagagauacuagguuccagggguagcaaccauuccaggcccugccaggcuugccacuugccuuggagggcugugugccacggcagagagcuguggaaggcggcacggcccacuuccacaccacucccugcugaggaggaaggaggccuucugggucacucugguccugccuggucaucaacaacgggccugaccucagcuuccccaagacuucucucuaacacuacagugaccugucacccuugaauaaaagucaucagaaauggauccaugcaugcugaucccgaacgccaaggaagagguacuuccuccauccacuuguucauucauucauucguccauucauuuguucccucuuacccaaccaccaccuaaccagcuuguucccaguggcaagggaacagacagaggugacuuggaaacaggcaaugaccuuuugaagcacagcauaucauucugccuuguaguaauucucagcuccacgaaagaggaagaaaaauucuacuaacugcuagaaaaaaaacaagccacaagaggugaugauggaaaagaagcaaaacucagugaccaugcaaggccacuuacuagcugggcgaccugugagauggggaugauacacccuaacccucaugggaaugauaagcucauccaggccuugacacgugccuggccccaggucgggacucaguuaugugagcugucacuaugauucuuuccuugaguucaugggucuguuuuucucauuuauuuuuguuuggguuuuuugaggcucugugaaagccauccucuccccucucacccagaaauguuccugugccauucuauugaauccuuccacauccugaaguuccaucaccaaacccuggcugggaaccccugguuagccucccuaacaccuaccaucuguauggccuuggacaaccgccaauccucuccguaaaaugggcuaauauuacguggcucuaggauuuacuguaaggaacagaugaggugguacuuauaaagaccuaguccuaggcugggggcagugacucacucuuguaaucccagcauauugggaagaugaggcaggcagaucaccugaggucaggaguucgagaccagccuggccaaaauggcaaaaccccgucuccacuaaaaauacaaaaaguagccaggugugguggcgggcaccuguaaucccagcuacuugggaggcggaggcaggagaaucacuugaacccaggaggcggaggcugcagugagcggagaucacaccacagcauuccagucugggugacagagcaagacucugucuccaaaaaaaaaaaaaaccgaaaaacccaguccuaauacaccguggauauguaacaaggucagacacuucccgcuucuccaacaaggugccaacacagaggaaaagauuguaaaccuggggucgaguccuggugugccacuuaauugacuacaugacccuggauaagucaaucucccugagccuccauuuccccaucuguaaaauggccuaaucaucucuugccuccaacuucauugagaaaguuaaaugagauuccuuacaugaaagaacagcacaaaagccacacaguuaauauguguuuguuaaaucucuaccaaaugaaaucaccaguaaguuucaugcuuagaucacgucacuuaggauuccuacaaaaauaugccuuccucucagucugauuccuagggaaaacaaaacaaaacaaagaaaugucuucccagaacuacaauuucuuuauguauuuauuuauuuuugagaacuaaaaguuauggacaugccaucagcuguuuuuuuuuuuuuuuuuuuuugacagagucucacucuguugcccaggcuggagugcaguggcgcgaucuuggcucacugcaagcuccgccucccagguucacgccauucuccugccucagccucccgaguagcugggacuacaggcgcccgccaccacauccggcuaauuuuuuguauuuuuugguagaggcaggguuucaccguguuagccaggauggucucgaucuccugaccucgcgaucugccugccucagccucccaaagugcugggauuacaggcgugagcccccgcgccuggccugucaucagcuauucuuaagagucaguaugagaagugaccaaacccaggcaguuccugcaucuuucagugaaacugucccuuacacaacacucuuauacaacgucccugugcccucuccagaggucagcaccaggaaagcucgugcauucugacaaccuggcuugcuuccucuucuuuaguucaagagcuccacaaccccuugagcuucccuuuuauuuauuuauuuuuuugccuuggcugcugggaagcucuggguuaaguuccucagcuuugguuugacucccaggccuuacuugcuuuuuuuaguaucugggucuuaacauuuuuaccuucagcuuaucaguggcaggagggcuacaggggauugguauuauaaacuugucagggcuuuuugcagaaauacaugggguuuaauuaauaaaacaauagucucaacaguaacagauaaaauaauaguugaauguaucucccaaaaggcauguguuggaaacuuaauccccaauguaacaguguugggaggugggaccaacaguaaugggagguguuuagaccaugagggcuccacccucaugaaugaauuagugcugauuauaaaagggcuagaggcugugaguucaguugcuggcucucuccugcaugcccucuugcucuuuccaccuuccacgauggcaagaaggcccucgccagaugcagggcccucaaccuuggacuucccagccuccagagccaugagcuagauaaauuucuauuguuuacaaauuacccagugucagguauucuguuauagcagcauaaaaugcacugagacgaugguaauaaauaugaauaaaauaauaaucucaaugcuuuaggaaauuacuacauaugcaugcuuagaaaaaagacuggaagcacaaaacccauaggaggauuacagguaguuuguacuuuuauguauuauauucaauaaauauguauuaucaaauuguauauuagaaauaaacaugacuuuuaaauuuuuaauuuuuuuaauuuuuuuaauucaaccuaggggcuuuaguuuuuuuuuaauggaaagaacuggccuagaauaaccuacugcuacagauacagcuauucuucugauugggauggggaauccgugcccacccgugaugaaggucccagugguccaguccccugcuuccuggauaaagggaggcuccucaggaucggaaagcuaaaggccucuaagcccugaucaaguccaaagugaaaccgccccagugcuaaaaggacggauucccugaaccugucaagggcauaagcagccuauauuugcagguggcucacgguuuuccuaggaccugaagaacugagauuuguggucaguuuaaugcauugaucauuauaaacugagugucuaccaggggcccuacuuugcuaggcaacaguaggggacacaaaaguaguaugugaucaacaaacacuaucugagcuccuagugcguggcaagccuggggacugaggacccagggagaaucaaacaggucccugccccaaaaucaccagcugagggagauauagaaaugaguggugcaggcacacggugacuauguaacccagaagccuguggacacggucauuaaccugccuuagagcuaucccagaggaagcagauauccaggcugaguuuugaagggugaauuuaccacguggggaaggguaaaggcacuccuggcagaacacagaagcagagguggggcagcagggaaaagcguggaagcggguaauggcggagcauuccaugggguuccaaaggaugggaauccagcaggcuggaggucaauuagaacuagaacuugaacaucucaaaguaugaaccuaaucuggagagcugugugugcgugugugcgugugugucuggggagauacaccaaaggguuuaagcaagagguguuguagacaggcuuuugcuuuggaaagaucccucuagaugcauuauuaaggaaaaaacaguggguuggggacaaacagcgaagaggccauuucaugaguccugauguccugggcaccauggcuaccucccccuccacauacaccaugucuuccuuccccuuugugaaauagccaugagaacuggguaggacuuacucauccccugcaagggagggguagaagcagggugcuaagccagucaggaaaauuuucugccucgugcccugacucagggcuggugucaucagagcuaagcuggugaguugugcuugaugguguggaaugccacgucgucucacucuggagcuaauuaggaagcacacaacucugaugguugcaggaaaccauguugcaaccacgagagaagugggugugaagacaaagcuaauacacagaggaagacagagagaaucacaggaaaacggagaacaagccugcucccuacugacuuuuuaggcagaauaugcaaacgaauuaauuucugcgcuguuuaguagguuaguuuaagguuugcugucacuuguuaccaaaaguaccugaucccacgcuuggcaggagaugaugaguaaccacacucuccagguggcagacuccagguuguaccagcugaaaaugcuacaccaacggcucuccaacuugaacguucagcagagugcuuguuaaaacagaucacugggucccacuccagagcuucugauucagugggucugaagcaagguccaagaaucugguuuccaacaagugcucagaugcugcugcuguugcuggaccccuggucacacuuugagaacuacugcucaaugggaauuuauaagagcaagaggccuggacccugggaccacaucuguccuccccuuaacaaaaggcacuguaagauguugguagagaaacuugggggcaaacuggcagaaguacugccucuuuuaugcuccuuguuauccuaaauuucaucaccaguguuccuuuuuaucuugccucaaaccaaagagugaggggcuuugguaggauguaugaucauccucaucagccuuuaccaagagaugguuugagaagcccugaguauucacacagaagcuuuggggaucuucauuauuaaagaccguacugcagucuguuucaaugaguuuuuuaaaaaaauauuuccauauccucccaucuuuaaauaaaaauuuugaggaccucuaaauaugugucaaaggguauauggggguuaguaaaagaccagauggacaaaaaugacaccaaaagcacaagcaaccaaagaaaaaauagauacccuggacuucaucaacauugaacauauuugugcaucaaaggacaguaucaagaaaguaaaggcuggguacaauggcucacgccuguaaucucagcauucugggaggcugagaugggaggaucacuugagcccaggaguuugagaccagccugggcaacauagggagaccucauauuuacaaaaaaaaaaaaaaggaaaaaaauuuucauuagcgggguaugguggcacacaccuguggucccagauacuuggggggcugagguggaaggaucauuugagcuugggaggucgagaaugcagcgugcaauaauugugacacugcacgccagccugggagaaagaacaagacuuuaucucaaaaaaaaaaagaaaaagaaaaaguaacccacaaauggaaaauauuugcaaaucauauaucugauaaaggacuaguauccagaauacauaaagaacucauagcacucaaaaauaaaagagcaaauaacccaaucuuaaaauaggcaaaagauuugaauagauguuuuuccaaagaagauguacaaauggccacuaagcauaugaaaagaugcucaacauuacuagucauuagggcaacacuaaucaaaaccaaaaugagauaccacuucacacaugcuagaaugcucagaauuaaaaacaugaacaaggcugggcacgguggcucacgucugugaucccagcacuuugggaggcugagguggguggaucaccugaggucaggaguuugagacagccuggccgacauagugaaacccugucucuaauaaaaauacaaaaguuagccaggugugguggcacacgccuguagucccaguuacuuaggaggcugagacaaaagaaucauuugaaccugggaggcggagguugcagugagccaagaucacgucacugcacuccagccugggagacagagcgagacuccaucucaaaaaacaaaagauaaacaacaguaaguguuggcaggaauauggagaaauuggaaccuucauacacugauggugguaauguaaaaugugcaguccaggcacuuugggagaguccggcaguuccucaauauguuaaacguagcauuacuauugauccaaauggcaauucccuccuacauauagauccaaaagaauuuuuaaaauauguucauuagcuaaacagacuaaguuaaaaacucaaauuauggccaggcacguuggcucacgccuauaaucccagugcuuugggguggaucaccugaggucaggcauucaagaccagccuggccaacauagagaaacccugucucuacuaaaaauacaaaaauuugccaggcuugguggcacacgccuguaaucccagcuacuuggguggcugagguaugagaaucgcuugaacccaggagguggagguugcagugagccgagaucacaccacugcacuccagccuaggcaacagagugagacucugucucaaaauaaauaaauaaacaaacaaacaaaagaaagaaaaagaaaaaaagaaaaaaaaaccucaaauuacuacaaucagaaaugaaaaaggggacacauuacuacugauuugacagaaaggacuaucagagaguacuaugaacaacuguaugacaacaaauugaauaaacuagaugaaauagaaaaauuccuagaaacacaaccuggcaagccuggaucaugaagaaacagaagaccugaauagauguaacuucuaaggagacugaacaguaauuuaaaaccuccacacaggcugggcgcaguggcucacgccugucaucccagcacuuuggaaggccgaggcggguggacacgugaggucaggaguucgagaccagccugcccaacauggugaaaccccaucucuauuaaaaauacaaaaacuuagccaggugugguggcaggcaccuguagucccagcuacucgggaggcugaggcaggagaauggugugaacccaggaggcagagcuugcagugagccaagaucgcgccacugcacuccagccugggcgacagagcgagacuccgucucaaaauaaauaaauaaauaaauaaauaaaguaaagaagugaaagaauagcuauuccauaggcagagcauggcauuccaaaaaauaagaggaggaaugugcccaccuagguacaaugcuugcuuauauauaacaaaaaucauggaggagaugugcucuacuacaaggguuugugauaaaggauugcuaaucuuuguguaacuacugucuuucaugagagccuuuauuauuaucuauuuuuuuuuuuuauacuuuaaguucugggauacacgugcagaacauguagguuaguuacauagguauacacaugccaugaugguuugcugcacccaucaacccaucaucuacauuaaauauuucuccuaaugcuaucccuccccuagccccccacccccgaacaggccccggugugugauguuccccucccaguguccacguguucucacugugcauauauuauuaucuuuaaagugagacuuauuuuaaaacuaggaauguuuuuguucuuaagauauaaggacaucaggacaguuccugggucuguuauauccugggucuguuucuguucccuuaacuauaaacgucuuagggcuaagaauaccuaaccucuugagaauguggcccagcaggucucagccucauuuuacccagccccuauucaagauaaagucacucugguuugaaugccucugacauacugaugcaaagauacucaacaaaauacuugcgaaucauauucaacuauuaaaagagagauuacaccaugaucaagugggauuuauuccuggaauguaaggaugguucaacauucaaaaaucuaucaauguaauauaccacauuaacacgaugaaaggagauaaaaaaaaacuacgugaucaucucaguuaaagcagaaaaagcauuuggcacaguuaaacaccacuucaugagaaauacucaacaaacaaaauagaagaaaacaaccucaacauauauaaaggucauauauuaaaaugccauauauugggccaggcgcaguggcucacgccuguaaucucagcacuuugggaggccgaggcgggcggaucacaaggucaggagaucgagaccauccuggcuaacacagugaaaucccaucuuuacuaaaaauacaaaaaaaaaaaaaaaaaaauuagccgggcgugguggcgggcgccuguagucccagcuacucgggaggcugaggcaggagaauggcaugaaccuggaggcggagcuugcagugagccgagaucacaccacaguacuccagccuggacgacagagcgagacucugucucaaaaaaaaaaaaaaaaaggccauauauuaaaggccauauauuaaaaaugcacaauuaacaucgcacuuaauggugaaagacugaaagcuuuuccuccaagaucacgaacaaggcaaaaaugcccacgcucaccacuccuauacaacauagcacugagaguccuagccagugcacuuaggcaacaaaaugaaauaaaagacaucuaaauuggaaaggagaaauaaaauuauuauuauuauuuuuuuauugagauggagucucacucugucacccaggcuggagugcaguggcacaaucuuggcucacugcaacuuccgccucccggguucaagcaauucuccugcuucagccucccaaguagcuggaauuacaggcaugugccaccacgccuggcuaauuuuuuuguauuuuuaguagagaggggguuucaccauauuggccaggcuggucuugaauucuugaccuugugauccgcccaccuuggccucccaaagugcugggauuacaggcaugagccacugcgcccagccaauaaaauuauuucuguugguauacaacauaaucuuauauguagaaaaugcuaaagauuaugcaagaaaguuagaauuaauaaacacauuuaguugcagguauaagauaagcacacaaaaaucaaccguguuucuacauacuaacaaugaauaaacaaaaaauucaauuuacaacagcaucaaaaaaugaauauacuuaggaauguuuauauaguauuccuaaaaacuuaagaagaaauaaacuuaaaaaggaggcaaaaguccugugcacugaaaacuauaaauuguugcaaaaaaaaauuaaagauuggccaggcgcgguggcucacaccuguaaucccagcacuuugggaggcuaaggugggcggaucacgaggucaggagaucgagaccauccuggcuaacacagugaaaccccgucucuacuaaaaaaguacaaaaaaucagcuggacgugguggcgggugccuguagucccagcuacucgggaggcugaggcaggagaauggugugaacccaggaggcggagcuugcagugagccaagaucacaccacugcacuccagucugggcgacagagcgagacuccgucucaaaauaaaauaaaaaauaaaaauuaaagaugacacauauaaauggaagacaucccagcuuuauggaccggaagacuuaauauuguuaagaugucaauacuacccaacaugaucuacagauucauuguaaucccugucaaauccugauggcaucuuuuacagaaauagaaaaaucuauccuaaaauauuauggaaucucaagggacccuaaauagccaaaacaauuuugaaaaagaaaaacaaaggugaaggucgcacacuuccagauuucaaaauguacuacaaugcugcaguaaccaauacggugugguacuggcauaaagacagacauauagaucaagagaacagaauagagaguccagaaauaaggcugggcaugguggcucacacugguaaucucagcaccuugggaggugagaggacugcuugaguccaggaauucaagaccagccugggcaauauagugagaccccaucucuggaaaaaaaaaaaaaaaagaaaagagagagggaguccagaaauaaaaccuugacauauauagucaaauggguuuuggcaaggaugccaacaagaccaaucaauaaggaaggaacagucuuuuugauaaauggagcugggaaaacuggauauccaugaaagagagagaagcuggagcccuaccuuacaccauauacaaaaaccaacucaaaaugaauuacaaagugaaguguuaaacuuaaaaaaggaggcaaaagaccugugcacugaaaacuacaaauuguugccaaaagaaauuaaagaugacacauauaaaugugucauaaaacuccuagaagaaaucauaggggaaaagcuuccuaacaucgaucuuggcaaugauuucauggauauuacaccaaaagcacagccaaaaaaaaaaaaaaaaaacccaaaaauaaacaagugggauacaucaaacuaaaaaguucugcacagcaaaggagacaaucaguagaaugaaaaggcagccuacaaaauggggagaaauauuugcaaaccauauauuuaacagggguuaaucuccaaaauauauaaggaacuccugcaacuugauugcaaaaaaaacccuaauaucccaauuaaaaaaugaaugaaggacgugaauggacaccucuucaaagacgacauacaaauguccaacagguaaauaaaaagaugcucaacaucacuaaucaucacggaaaggcaaaucaaaaccacagugagauauguaucaucuuacaccuguaaaaauggcuaucaucaagaagacaaaagaugacacguguugaugaggauguggagaaaagggagcacuugcacacuguugguggguauacaaaacggugcagcugcuauagaaaacaguauggaaguuccucaaaaauuaaaaacagaacuacuuggccaggugugguggugcaugccuguaaucccgucacuuucggaggccgaggcagguggaucaccuggggucaggaguucgagaccagccuggccaacauggcaaaaccucgucucuacuaaaaauacaaaaauuagccuggugugguggcacaugccuguaaucccagcuacucaggaggcugaggcaggagaaucgcuugaauccgggaggcggagguugcagugagccaagauugugccacugcacuccagccugggcaacugagcaagacucugucucaaaaauaaauaaauaaauaauaaaaauaaaaauagaacuacuauaugauccagcaaucccacuucuggguauuuauccaaaagcauuaaaagcaggauccugaagagauaccugcacccccauguucaucgcagcacuauucauaaaagccgagauguagaaacaaccuaaauguccaccaagagaugaauggauaaagaaaauguaguauguacacacaauggaucccuauucugccuuaagaaggaaauuccgcaaagugagacaauauggaugaacccugaggacauuaugcuacauggaauaagccagucacggaaaggcaaguacugcagauuccacuuaaaugaggaaucugguaaaacagucaaaauccuagaaucaagaguggaaugguggcugccacgggcugaugguagaggaaauggggaguuacucauuacugggcauaaaguuucaguuaagccagaugaauaagcucuggagaucuguuggacaacgcuauagcuauggucugcacaaugugcuguacacguuaaaauguguuuaaaggguagucucacgcuaaguguucuuaucacaagaaaauacaauuuagggccaggcgcgguggcucaugccuguaaucccagcacuuugggaggccgaggcgggaagauugcuugagcucaggaguucgagaccagccugggcaacaaagugagaccucguaucuacaaaaaauacaaaaaaaaauuagccaggcauaguggugcgugccuguggucccagcuacucaggaggcugacgugggaggauggcuugugcccaggaaucagagguugcagugagccgauugugccacuacauacacuccagccugugugucagagccagacccugucucaaaaaaaaaaaaaaaaauuuaaaagagagaaaaauaaggugguccugcaugggcuuagauacagguaauacacucugguaagggaggugccugcucuaccugggcccucuugucagagguguggucucugcacccaggaacuccuuguuucccuggcaaccucagccuauaugcgcucucagagggugucugaugggggaugucacagcagccuguaaucgccggcuuucuucucuggcugagggccaaaggaaacuggacaccuguguuccaugacccccaucaguuuagaucgagcagcugucguggugccguguaaggguuggggccuugcuacgggauccuggcaggccgcaacaccucuaagguaacucguccauucauucauaaauuuaucaggcaccugcccuguaccaggcauuguuuuagccacugggaauacagcagugaaaaaacaguuuccaucuccugggaguucacauucaggaggccaaucuaugggucuggaugguuaucuccaccugcuaggcggggauaaaugagacagcacacgucacacacccagcauuagaccugcacaccucaauuuaaguaauuauuugccuuuuuggcccaguguccacuuagaguugccgugggacugauuacuacacaaacgucuuuagagcugugcaaauuaggaaucagcucaauauugcuuaggacugacagagcuaggauuuuaaaaucucucuucuccaccagaccagcccucugggaauaaauauugacaccaaagugcugugccaaguugauuuccacccuucuaaguaaugcgcacaaagagaacccgaugugugcagguguucuaagguuuuacaucauguccucaacauccccacaaggcaggcaguuagcaguuuaaccugggccaaccucgguaucccuaucuacgacaccuaaugcaauuugagagcuuacucugugccgggccguaugcuaagugcuuuccauggauuaucucacacucacuauuugagguagguauccuaaaaaaugccuggaccucauaagauuuauugugaggauuaaguaggauaauguaugucagaacaaaagacauugccugguacauaguaagucaaugcuugauaaauguuaucgaguauuaccagcacuagguauuauuguauucccauuuuacauauggggaaacugaggcucaggaagauuaaggucacagauaaguggcagagaucuaagcaccccaucccuccucaugccucaaggaggaagccacaaacaggcugggucacagccccuggguggguggggggaaaggccccucugcuucuuugcuccagcccucucugggcccuacuggucagcacacacauaccaagugagcuugcucaccagagauaaggaagccaggaugucccagauaagggugagccuggaccacccacaggguuuagacauuaacuuuuacagcguauaggcaguaggaccagcaggaauuggguuggcacugucacagccccagcuguccucaagaaaaaaccgagugcuaggcgcagugguucacgaguucaggaguuugagaccagccugggcaacaaggccaaacccugucucuaguaaaaauacaaaagucagccaggugugguggcacaugucuauaaucccagcuacucgggaggcugaggcaggagaauagcuugaaccgggaggcagaggcugcagugagccgagaucgugccacugcacuccaggcuaagcaacacagcaagacacugucucaaaaacaaaacaaaaaaaaagaaagaaagaaaauuaaggcacuuugacuccagaggugaggcaucaacacgcagugaccacaccgugcucugggccuggauccccucaccucccugggcuuuccugaggccaagagcauguccuggguacacaaaggugcucaauaaauaaauguuagcaaaacuccuagaacucaaauuaaauaagccacagccaggagauguggacaugguccugggucugccaccauccuucuguggggcuguccugaccucuuuccugcucugagccuccgcuguuuucccaucuggaaaaugaagcucucaacagcaauaaggucauuugcaacauggacuauguagguucaaagugagcgaagucacuuuauccuugaagaagcaguuuacaucuaaaaaaauucccuucauacgauccaauaucaaagcccgggaccuaguacaucaucauaaguguuuguugaauaaaugaaugaauaaacaugaaugaaaaaauucaguagccuuaagaugcccagaaaucaggggcagaacagccaaaagauggcuaacagagaugacagccagauugugcaaacgaagcaggacaaaggcaagccagucccucccucuacugccaaccaagagagaagagaugauggcugccauuacugagccgcuagugcauacguggcauggcgcuaaguguuugauaagcauuccuucacuuaauuucauaagcaauacaaauauuccuguuuuacagauggggaaacugagguuuggugggggaaggggcuuccccaaagccacucagcuaauaagugacagaaccagaguauagaccaaggucagucugacuccaagacacacggacagccuagcuguguagccacgggcaagcugcuuucccucucuaggcuuguuucuuccugcggaagcagagguaggcaugaccaucagccccccaggccucccugcacugagagaugcugucaguggggcggugcugggaaccuccuuagccucuccaauacagcacagaagacaaaaguuauccaaccaaggccucugccugagaagcaagucccuggaggcagacaccaaaaaacgcaacagucaacacagaaauguccuuagcauaucugcagccagcugcuguggguggagucccagaaucuccccaucucugagcuccaggccaaacaaugcugccauuuacuaggcagccuacacccccaggccucccaggaacgcugggccaggcguguuccuccacccccagccucacccaccacauucgaaggaagccuggggaaggaauuaggacugcccuugagcagggugaacugaguucacccaugggcaagggcaucuggaacagagggagugaccuugagguuccuaagcguguacgugccauggggccggguggagggaguccugccgaggcaaaggggagggaacaucuaagggaugacuuagauaccccccacccccuuuuacagaugaggagacucaggugguugcacaccuaacuacgcgugcccaagucccaaggcaccucaggauggaaccaaggcgacucaauuucaggggaccuaacucccucagguacuaucuggcccacaggucgcaagcacuggcucuggggucaaaguccccugagcuugaguccaucccaucuuccagaaaugccaagaucagggcuaagaucagacucugugcagaugcuaaccggacuucagcccuagcggagagacaaaggcaguucugugucugcagggacauuuuucauccauuugaccaucugucucucuggccacuguucucuaaagccagcucugcuaaggacagugcuggacacaaaggggaaggagccaggcccaugccccugcccugaggaaagugacccccaaggaggaggucaggagauggacucacaaaucccaggacaaggguaagaagggacagggaaaagcacaccagcuguuggaaggcggcacauucaacucaaauugcuaaauguuuuguaaccuuucaguugguccuugagggacagguaggagucaaaccaaggcggcggggguggggcaguguggggcgguggccacugcaggcagagcacgcgcuggcccgcucagagccugcucagaaagccagggaagaagcacuucccuaagggcaacccccagccuucccggauucauuagucaagggacauaugucuccaaagaaccaaagcucccacgugaaccaaggugagcacuggguuuccacucuggagccagacacaccugggucccaauuauggccggacacuaacagaaugaccuugggacaaguaacuucggagauccaagccucaguaugcucaucuguaaagugggggugaugguagaggcugccucccugguugugaucacaugggaucacacagggaaagccuguagcucagaaccugguguccagugaguacagcacagccauuaguagcauguccaugcuguguccgugcuguguccaugcuggaaaccgaaaucaccauccauagagacagcccugcaccagcgccugccccgugcaaggcuggagaaacaacagguguccugggcaagcucacaccucccacaggacaguaaaacacugcgcacacacacacacuguguggcguccaucuguuguccacagcacacgucaccaacucacgucaccaacucacauacuauacgccuuacuuuuauugucuguugucugccucccccuccucccugcccccuguagaauguaaauuuccagagggcaggccuucgugucugugccccagcaccuaaacugccgggcccacagccggugcuccccggggaagcauguguuggugagugaaugaaugacugagugaaucauugcuacccugucuaaacgagggaggugggaggccaaucacaugagaucaugcauguggaaugccagacacagguagguauuaucaugacggggacagaggccacgauagcugcaacugcuaaagguuccaccagagacaacccacucccaaggccaggaagaaggaagcagcucaagaaacacaaggaaaacggaacacagccccacagcccccucuaccuccuuugucuccacacuccuucccacagcacuggaaucaucugcuccuaucucauacaggaaggagcaugaauccagaguggucaccuggccggggcaggacaaaccagggagcauguaccuauguagaggggcagccacacccagccuggcgcacagagccugcgagggaauagggcccguggggccaagucagaugucuggauucuuauaugaaagguguggauguauaaagggccacaccaauucaaauaguacaaaaagcuugcuguugaggaauaacuuucaaaccuuguuuuuccucuguucucacaccacaaucaucaacacagaagacaucugugaccaaauguggggguuuuccccacacacaggcaguggacaccagcuguguguauuccgauucaauuccgacacuaucuaccgggagacagcgucagaucucacaggcugagggcucaggccccgagacugcgcccuccaccccacauaccaguugcacgucgaggccucuggaccuucugagauacuggcuuccaguugggguucccacgaacccugcuuugaauuugguuaauuugcuggaacuggcucacagaacucauggaaacauuuacuuauguuuacugauucauuauagaagauauuacaaaagauacagaugaagggauguguauggugaggcugggggaaggggcaaggggcuuccaugcccucccuggguacaccacccuccaggaagcuccaccuggucagcuguccagagguucccugaacccuauccucuugggauuuuaugaagacuucguuacacaggcaugacugacaaccguguacagagacgugauuggaaaaaaaagugcacggucuaaacccagcaagaccugcugcucagacuuuucuuucuuucuuuuuuuuuuuuugagacagagucuugcucugucguccaggcuggagggcaguggcacaaucucggcucucugcaaccucugccucccggguucacgccauucuccugccucagccucccgaauagcugggaccacaggcacaugucaccaugcccagcuaaucuuuuuguauuuucaguagagaugggguuucaccauauuggccaggguggucucgaacuucugaccucgugaucugcccgccuuggccucccuaagugcugggauuacaggcgugagccacugugcccagccucagacuuuucuuggccucucuguguggcaugccuuccuauaagaccccucuggaaucggucucuugacccacaaucagauuagaguccugccuuaggcaggugacaggaggacaggagaaggucaaagagagagacucuguuuccuggggccugcuccugaggccuaacucacccaacaugauaacaaaacauuguaauaagggcuaugggaguuaugagccaggaauugcggaugaaaaccaauauacaugugaucguaucacaccugccaucugcguagccugugggcgugguucacacaucuguuggcugauguggacuaugagcaacacgccuguccugcuaguuaagaugccuggcuuggagucauaccaugaaagccacgagcaggucugggacccuccuacacugcuacugucugccagcuggguuuccaacccuggacacacuguggugaucagcacuaucauccccgacguccagaugagaagccuggagcucagaggcacgaagaggcgugucuggggucacacagcaggacagggugcaggcagauuccaaucccacucugugcaugaucaacugaaggaaugagggugugagugacaggguggggggcagagggaagcagggcugggaggugcccggagaguacuaaugcaggggaaggacaaggucagauggugcacugaccugacaggaagggcuacauggacgugcuuggugacauggugggcgaauccuggaaugacaaucacccuugcuccucugcaugugagauagacagcccaggccggcuauuccaacagcgggaucccagcaaagcccucaguuauccaccugcugcuucacagcuccaucugcucugggccaccaaccgcacccgggucacugcccaagggagcagcuggacaggucccccggcacaggccuccucaccaccaagcccugccaaaaaacauucugccggacgauggccccucaaguggaagggugggggucacagauuacauccuuugaacuguucccagugaugcccagagccuggcacccagagaggggcauuccagggggcaggagagaaggcuuuggagcuaggcagaccugggcuggagccuggcucugacaugugggacgagccucuccacuccaccguucuaacccuuggucuucacaucuguaaaaugggggugacaacaucucaaucucgagccaggcgugguggcucacgccuauaaucccagcacuuugggaggcggagggaggcaaaucgcuugaguccaguaguuggagaccagcccugucucuacaaaaaauacaaaaauugucugggugugguggcacaugcuuguaaucccagcuacuugggaggcuaaggagggaggauugcuugagccugggaggcagagguugcagugaguugagaucaugccacuccacuccagccugggugacagagcaauacaaaagcaaacaaacaaaacucaaucccacagaacugugaggauuuggugagauagucaggaaacagcccacccggcacaggccuagcacagaaaacauuccugacgaggccaacuauccacaucaucauguugcugccuccuuccuuuuguuaccacccccugccuccugauucacccucuaggccaaggagcugccagccuccucccccacuuucccucccugagccuuagggugucuguccccucuguaaaaugggcaugucgauacaguaauaauacacccaccuccagggcugcaaagccugugcagacuuuaaagugcuuuacaaagugcucgugugugugugugugugugugugugucugugugugugugugugugugucccaacaaccgggugccccaauccagagagagggcagggguuggugagugccagggagcccgaggaagaccagguccccacggcaaauggaaaggguucuggcacccaaaacugccaaaaagggcugccccaggccaggugaccacagauccagacuucagaacugcagagauacaagggccaggauaaaaugggcagacuccguugaaagaccuccuugggccgggcgcgguggcucaugccuguaaucccaacacuuugggaggccgaggcggguggaucaccugaggucagaaguucaagaccagccuggucaacauggugaaaccucgucucuacuaaauauacaaaaaauuagcugggugugguggcagacaccuguaaucccagcuacucgggaggcugaggcaggagaaucgcuugaacccaggaggcagagguugcagggagccgagaucgcgccauugcaguccagccugggcaacaagaacaaaacuuugucucaaaaaaaaaaaaaaaaaaaagaaagaaagaccuccuugggauccucccuuccaagccccuagaguuauggauuaggaaacagaggcccaggaaaggaagcucaucucgggucacacagccaguuggucccaggcagaacucaggucuccuaggcugggcaugguggcucacgccuguaaucccagcacuuugggaggcugaggagguuggaucaccugaggucaggaguucaagaacagucuggccaacauggcgaaaccccgucucuacuaaaaauacaaaaauuagccgggugugguggugcaugccuguaaucccagcuagucgggaagcugaggcaggagaaucgcuugaaccugggaggcagagguugcagugagccgagaucacgccacugcacuccagccugggcaacaagagcgaaacaacaccucaaaaaaaaaaaaaaagaaagaaagaagaacucaggucuccugauuccagccccagaucccuucugccacacugaacaacuuucuaaaguacacagcacugucagcuacuuccgggugucacauucucuuuacaguuuuggcuguuuugaggucagauaugcaaucucugucaaugaccaagggcuggccucugagcccaggacuacaagccacaaaaacccuggccagcaacguguggucauauggggacacauguggacagcaggcucaucccauccaugcccugcucuugauccugggaccaguacuuccucuuuacagaaugcucaguuugaggcaagaagccacacugagaaaggcccacagucacuccuucagggaggguaaccacggcgccagccaacuuccucaucaggaagucuuagggagcguucuugggcugggccaccccaaagggacuuuggcugcucgcgacagaccccugccccaccaagggcaggcacguccugucuccuuucaucuccccagugcauaucuaccauggacagauuucacaccaggccccgugccggggaccaaagagaacagaaagugaaggagaggcacgaugaaggugacagcugauacuuaccgaaguuucugugugcccagcccuguuauagaccuuuucuauuuguaaacaacuauuagcucaauuauuccuacaggcacuacugugaagauccccauucuacaguugagaaaacugaggcacaaggacagaaggaauuggcucuggucucacaguaaguggcaggcaggagacggauugcgaaccugcaggcuucagaggccgaccuuugcguuuuucuuuuuuuucuuuuucuuuuuuuuuuuuaauugagucagagucucacucuugucacccaggcuggagugcaauggcacaaucuuuggcucauugcaaccuccaccucccggguucaaguaauucuccugccucacccuccugaguagcugggauuacaggcacacgccaccacgcccggcuaacuuuuguauuuuuaguagagacgggguuucaccauauuggccaggcuggucucaaacgccugauucgugauccacccaccucggccucccaaagugcugagauuacaggcgugagccacugcgcccggcccacuucacaauuuuauauccauccugaucacugcuggaguuauguguucaugcgcuguuaguugucucccacauguagacuggaggcuccaugaggaugaggaccguuucccucuugcucacugaugaauccccagcccccaccauggggccuuccacuuaguagcugcucagcagcaugugcugcagacagucuagccucgguucacguuacucugccgcucucccuccaccacgcgccagccgcaacaccuucugugggguccucugcagacuccugccucagggccugugcacuucugauucccucuaccuggcacuuucugcccccacacauuuggaggucugccuccaucuggucuuuuggcucucagcuaaaaugucaccucaugagagaggcuuucucuguccaucguguuuacagcaccugcuccugacccuacccaggaaugccuacugcauuuccccacugauuuuucuuccacucacuugucacuugcccaaguccucucaucuacuucuucacuggccuucauaccgucuguuucugccacuagacuuugagcuccgugaggccagaggccuucccaacucuguuaaugacaucgaguugguagcuugaaacugaucagguggacauaugugcauucagaaaugggccaaaugccagacaccagagcuuuucuucccaaagaacucacucuugcuccuguaauacauguuggaaaagagaucccccggccauugaaagauuugcccagagaccaaaaucuggcucagggcuggggguggaggauggggguagcuauuagcagaggacauucacgaggucagcccaggccuucuugcagucacucauuuugggcccugggagucaucuagagcuucacugucuaugccguccaauaugggagacacuaacacaugugcuacugaguguucgaaauguggcgacgguagagaccuaaauguauuauuccauucucuucuaauucauuuaaauuugaaaacugagacuugguucaguuacugggaaacguuuaagaauguuggaacaacuugggugugugaaucuaccuuucucaacuguaaauuuuaugacaucuaaacacagaucaaggacuucugaugaaaauuuagcucccaaauuuagauguguuaaaaguguaaaauauacacuggacuugaagacuuagaaugaaaaaaaguaaaauagcucaauaacucuuucaauggaucacaugucaaaaugaucauauuuuuauacacuggguuaaauaaauuauauuauggaaacuaauuucaucuguuucuuuuugcucuuuuggauguggcuguuagaaauguaaaauuauacauauaggccuggugcagugacucaugccuguaaucccagcacuuugggaggcugaggcaggcagaucaccugaggucgggaguucaagaccagccugaccaacauggagaaaccccaucucuacuaaaaauacaaaauuagccagggguaguggugcaugccuguaaucccagcuacucaggaggcugaggcaagagaaucucuugaacacaggagauagagguuguggugagcugaaaucgcgccauugcacuccagccugggcaacaggagcaaaacuccaucucaaaaagaaagaaagaaagaaagaaagaaagaaagaaagaaauguaaaaugaugcauguggcucacauuauaguucuacuggucuagagcauuuuggcuuguuuuucuccaacuugcaccauuugauauucaaaagcagaaguagugauaaggaagcacagacggauuuugccaugauuacaaauucugaacaaaaaugagcuaaucuugucaaauugcacauggggugguguggugaaugaccuccaccccacucgggggaaagucugucccugucugccauggcuacagaagggaccuaagacacuuggggaacagccaguuucucaucccaaagucccugagagcagaccccagguccagaacugguuuugucaaagauauccacauggaaaagugggcuccuaaagccacaggggcccaggccuggucacaagaugcgccugagaaccaucacacagaaggaaauaucaaaggguuggugcauccuucaaccuguaucucuggacuucucccuucuacacuuuugcccauuugcuggucccucuacuuugacuguucuuccuucucuuaucuccccagaggacuccuaugcauucugcaagaccccguucaaaugucccuuccucugaagccuccccugaccagaugauguuccacaucacauccuugggcuucuggccuagucuauucuuaccacuucucaaacugccuccacguuuuucucuuguccucucaaaccugacuucuuucuguaacacagaauaugccucuccccugcaaaaaaguaccacugggucuccauuaccuaaaacagugauucucaagcuuaaacgagcaucagagucacuuagauugcugggcccuaccuuaaaacgccaauugcugggccucaccucaguuacugacucaaugggccucaggaggggccugauaaccugcaugucuaacaaagauccagggugugcugauccaaggguuguacuuugagaaccacugcaguaaaagauggagggauaagucuucaccuuggcaugcagggccuucuacaacauggcccccaauuacuuuaccacccucaucuuucaccacaugcugcccuggcccuagacuagccaccucccaaacaggcuguaccuuucaugccuccacaccgcugcccacgcugucucuccugccugccauccuuucccccucuuuaucuacccagcuccagggccaccuuccuugaucucauagugucuaaaaggcaaaucggaggagcuggggccuucuacaaaguaacaaauguaggcugucagggcagcuacaauagaggagggaaagaaauggucuuggccacagcagugggccuggaggagaaagcaccagccuaaagugacaauuuagggacggaaaagucuagcguauuuauuuaaacaacagcaugacagucgcagucuaguuacaaacuguguuuggcucuaccugguuuuccagcucugccacuugcuagcuguguggccuggggagcagcucacauagcuuuuuuguuucucauuuucuuuuguaagaugggauaaagcaacaaccucacagaaugaagauuaaaccacauaaugcaagugaaacucauagcaaaaggccaagcacacaguaaacucucaauaaaugcuagcuacuauaaguaguaucuuuggaccugggaaaguuaugaacuugguacccagccacaaucaauaacaggaauagaaacauaauagcuauuuuucuuaauggguacauagucagcaggccaacaaaugcuguaugcacagagaggaagaugaauggacagaaaguggguggcugggugggugggugggucaaugggagaucuccuuugguuaauaucaaaaguggcucugugaggccaguuuggcaauagacauuaaagacucuuaaaaauucucgcugggcacagugccucacgccuguaaucccagcauuuugggcagccgaggcagguggaucuccugaggucaggaguucaagaagagccugaccaagacggugaaaccccgucucuacuaaaaauauaaaaagcagccaggcgugguggcaugcaccuguaaucccagcugcuuaggaggcugaggcaggagaauugcuugaacccaggaggcggagguugcagucagccgagaucgugccacugcacuccagccuggaaaacagagugagacuccaucucaaaaaaaaaaaaaaaauucucauaaaaaagcucucagaggacacacaaaaaaauccaaagauguccaucacagaguuguuuauaagagcaaaauaaaaauaaaaauaaaaaaaagaaagaaagaaaaggaaauagccuaaaugcccaacaguagagaagggcacagucagaagauggauuucuuuggaagaauuagaaaaaaaaaaaaugaagaggacugggcaugguggcuaacaccaguaaucccagcacuuugggaggccaaggccagcggaucaccugaggucaggaguucgagaccagccuggccaacacggcaaaaccccaucucuacuaaaaauacaaaaauuagcugggcaugguggcacaugccuauaaucccagcuacucaggaggcugaggcaggagaauugcuugaagccgggaggcggaggguguagugagccaagaucacaccacugcauuccagccugggcaacagaacgaggcuccaucucaaaaaaaaaaaaaagaaguugagggguguugcugaguuuggaagauggcgcuugaagcuacaaccacacugugaggaugcugauggagaauagcgggcugguaaagagcccccuucuuuagugcagccaucgagaaggaucuccauguaacagcuguagcaguggcagaagaagugcuacuaugacaaauaacaaaacagccaauacuuaccgggcucuuacaugugcccagcacucuucuaagcaccuaucaugaauuaacucacuuaaucgcaguaaucacucuaugagcuagguacuauuauuagccccaccuuacagauggagaaacuaaggcauggagagguuaggaacuugguuaggauuauuaagcuuguaaacagcagggcugggauucgaggccaggccauagcgcuuucuguuccaaaucacuaguucuacucccaagggggaggcaccacaggaaaggguggguaaguggccaggagcucccuacuucaccaucuccuugcccuagcccucguccucaaagcagaugcugagaaagagcugaagacuucaggaccaggcuagcuccagagcaccaggccaugggggcugagcugggacagacagggcggcagccuuacccacagcuucccgucgugauaguaggcucccaggagcuucacaauguagggguggucgcagguggccaggaucucaaucuccacgauguaguccuccagcuccuccucacucuugguuucaaugacuuuggccgcagccaaagcacccgucuccuuauucuuggccugcaaagaggagauacaggaggucaacaaggcaugcuccgcaggaaacugaccuuuggacgugagcccgcaguccugcaugagugugaaaacagaggccggauguccagaugcugaaccggaacguacauuguucuuaacaauagccacacaucaugucuguacuuaagaguaaguaccauacaccccuacaacacuauggaauaaacaaaaauacaagaaugacacagcucuacaaauaccaacauggaaagacuguugauuuguucaguaaaaaacgaagaaaaaaacccaagucauugaacaauaaaaauggcacaauacuuuuugcauaaaaaauggaaaacuacgccuucauacaugcucacaagcaucugugaauguauggaaaacucaggaaagauacugccugacagcaggcuggggaggggccagaaauagggaggcauucaaaggguacuuucacucuguuuaaaauuuaaaaucuaggccgggugcgguggcucacaccuguaaucccagcacuuugagaggccaaggcagggagaucacaaggucaggaguucgagacaagccuggccaacauagugaaaccccaucucuaccaaaaauacaaaaauuagccagugugguggcaugcgccuguagucccagcuauuggggaggcugaagcaggagaaucgcuugaacccgggaggcagagguugcagugagcagagaccacaccauugcacuccagccugggugacagagugagacuccaucccaaaagaaaaaacauuuuuuuaaaucuguuuaaaaauuuuuuuuguuguuuuuugagauggagucucacucugucgcccaggcugaagugcaguggugugaucacuguuuacugcagccuccgccuucuagguucaagcuaauucuccugccucagccucccgagaacuggaacuacagaugugcaccaccacgccuggcuaaauuuuguguuuuuaguagagacaggguuucaccacauuggcugggcuggucucgaacuccuggccucaagugauccgcccaucucggccucccaaaguguugggauuacaggugugagccacugugucuggccuaaaauuuguuuaaaauuuaugauaggaauguuugaugcguuuauuugcaacauuucccacgcacuaacaguagaaugaaaaggcagacugcguaagugcccaccaguuacagcggaacuguuucguagaugcaugucaccuaggcaaaacaagucuuccuuaugugaggaauaagaggguaagaaaacuccacacacacuaagauggcuauaauuuuaaaaaauggaaaauaacaaguguuggugaggacuggagaaguuagaacccuugugcauuguuggugggaauguaaaauggugcagccaguguggaaaacaguuugccaguuucucgaaagguuaaacauagaccuauccuaggaccuagcaauucugcucauagguauauacccaaaaaaaaaagcucaaagcaaggacucaaggagauauuuauauacucauagcagccaaaguguggaaacaauccaaguguccaucaauagaugaagaauauuugggaggcggaggcaggcagaucacuugaggucaggaguucgagaccagccuggccaacauggugaaaccccaucucacuaaaaacacaaaaauuagccgggcgugguggugggcgccuguaaucccagcuacucaggaggcugaggcaggagaaucacuugaacccaggaggcagggguugcagugagccaagaucaugcgacugcacuccagccuggaugacagagcaagacuccaucucaaaacaaacaaacaacaaaaaaagaugaaugaauaaacaaaaugcgguauauccacacacuaaaauauucugccauaaaaaggaacaaaaaggaaggcaauucugacacaaacuacauggaugaauccugaaaacauuauguaaagugaaauaagccagacacaggaaacauaguguauaauuccacuuaccugaaguacccagaguagcugaaaucauagaaguggaaaguagaauagagguuuccagggguuagaaaggggaaauggggaguuauuguuuaguggguaaagaguuuuuguagaggaugaugaaaauuuugagguguagacagcagugauggcuacacagcugugaacugauuuaaugccacuaaauuuacacuuaaaauuggccaaaaugauaaauaugauguucuguauauuuuaccacaauucaaaagagagagaaauaaucauguaaauggagcaagcaaucccaccccauugcacacaaggagcuagugucugggaaaugggaggugaggacccacagcuccccaaggauccugcgaggacguugguggggaaugcugcagcaaacaucucacccacccugcugcaugggguuccaguguugaacaaguacacauggccaggcacgguggcucacgccuacaaucccagcauuugggaauccgaggcggguggcuugcuugaguccaugaguuuaagaauagcccaggcaacagagcgaaaucccgccucuacaaaaaaaaaugcaaaaacuagccaggcaugauggcaugcaccuguagucccagcugcuugagaggcugaggcgggaggaucacuugagcccaggagacggaggcugcagugagcugagaucuugccacugcacuccagccugggugacaggaaaaaaagaaaacagccgggcacaguggcucaugccuguaauccuagcacuuugggaggccgagacaggcggauugccugagcucagaaauucgagaccagccuaggcaagauggugaaaccucauuucuacuaaaauaccaaaaaaucagcugggcauggugguaagcaccuguaaucccagcuacucaggaggcugaggcacaagaauugcuugaacccggaaggcagagguugcagugagccaagauggcaccacugcaucccagacuagaaaacaaagcaaaacucugucucaaaaaaaauaaauaaauaaaaaagaaagaaaaaggccgggcgcaguggcucaugccuguaaucccagcacuuugggaggccaaggugggcggaucacaaggucaggaguuugagaccauccugaccaacauggugaaaccccaucucuacuaaaaauacaaaaauuagcugggcgugguggcagacgccuguaaucccagcuacuuaggaagcugaggcaggagaacugcuugaacucgggagacggagauugcagugagccgagauugcaccacggcacuccagcuugggcgacagagugagacucugucucaaaaaaaaaagaaagaaaaaaaaaccacaaacacauuucccuacaaaauggccccuagccaggugcggugguucaugccuguaaucccagcauuuugggaggccaagguagguggaucaccugaagucaggaguucaagaccagccuggccaacauggugaaacccugucucuacuaaaaaguacaaaaacuagccaagugugguggcacaugccuguaaucucagcuacucaagaggcugaugugggagaacugcuugaaccugggagguggagguugcagugagccgagaucgcaccacugcacuccagccugggugacagagugagaugccaucucaaaaaaaaaaaaggccccuaaaagcacgcugcucaucuggagaccuuaaacagcaaucuauugcaaagcacagggaaaacgagcuccucuggacugaaugaacauauuauagcuuagucuccaccguggcaccuuccuaaggauaauauugaucacgcuccacccuugccuuccauaacaacucuggaaccugacugcaccggaaauuccggcuggccaaguuauuccugcacaucuagcacccuauggaugacaaugagcauucauuccugucaucacagggacccgaggcuuggaguuucccccauuccacagacggacgugcaaguccagguuuagaggggaaaugugauuggaacuaggggaguggcaccagaauuugcaucaggauccucuaacgucaaaauuuucugcacuuuccaccacuguacaaggucucccuacaaucuccaccacuuagaagucucuaagaccagaugccaacagacauuuaacagagcacuacugggccagcccugcacagggugcccacaauacagacacagagcaacccucucccuggccagcucaaagucuagcuagagagacacagcccucuacugaaagugacgagacagcaugcuuaugauggggugugggagagggcaccuaaccccaccaaggagccuucuggaaggaagcaauacuaaggggugggccgggugugguggcgcacgccuguaauccuagcacuuugggaagcugagauggguggauugcuugaggucaggaguuugagaccagccuggccaaaauggugaaaccucgucucuacuaaaaauacaaaaaauuagccaggcgugguggugaccgccuguagucccaacuacucgggaggcugaagcaggagaaucgcuugaacccaggagguggagauugcagugagccgagaucacaccacugcacuccagccugggugacagagugagacuccgucucaaaaaaaaaaaauaaaaaaauacugaggaguggugcaagcaggcaauuucucuccacauuugcuuucuguacacucauucucaguuuagauaaauauuucuuucauuaauugagcugcaaaguccccaggaucccaugcagugauaauaauaugccauuugucauauuaugucauugauaauaauauguuggaguggacccuugauccacucugcaugcagcacuaggcagugcugcuuauaugugucagugcauuuaucuccuggaucacccuacaauguggugcugucaauaucucauagacagaugaggagaccgauccgaggcagaguacccuaggaaugaggcggcagagugggcuuggaacuaaggcagucccaugcccaggugugcacacucuugguggccacauucuuccuccauccaagucccuugcaggccagagccugggaugccuccacacugggcccaggagcccaguucagggaaggacauuucaugaugggccauuuuccagagccagucauuguccuagaauuuaccagcucauguggcucuaacucuguggggacuucuccccuaaacucaauuuugaaagcuuguuuaggccgggcgcaguggcucacgauuguaaucccagcacuuugggaggucggggcagguggcucaccugaagucaaggguuggggaccagccugaccaacaugguaaaaccccaucucuacuaaaaauacaaaaauuagccaggcaggguggugggugccuguaaucccagcuacucgggaggcuggggcaggagaauugcuugaacccggaagguggaggugcagugagccgacugcgccacugcacuccagccuggacaacagagugagacuccaucucaaaaaauaaauaaauaaaaauuaaaauuaaaaaaagcuuguuuagaaugccuuagccacccaucauuuaaguuaucuggugcuugcucgcucacuugcucucucucucucucucacacacacacacacagucuuaacugauugugucccugccuuuucauuccuuguaaagcugauuucuguacauccccaccagagggcuggaaagaauccuuuccuucugcacacauuccucuuucucuuccuacuccuccccuuccuccucuccaaacccagaagagagguuacaccagcucugcuccuuuccugagaggaagguugaaggcuuaguggaguggcuagagccagggccagugaccaaggcaaccaccuugaccaugcugagcuggccaagggccccccuucaaucacucaucuuucaguccugaaagcuggcaaagaaggccgcaugucaccuuuaccuggguuuccugaaaagggauguugucuccugaugguggaggaggcccagguggggaccauuuuccaggagugcacaaaccuugccuugcccaccauccugaaaggcagcacugaccagacggccaggccucagccaguaccagugucaacacaaggcacgcccgcuacccagcaccucacucagauuccauggagaccagaaccugccagacagagguuaguaggaaccacggaccaaaaagugacuuggccaaaauuaaauucuuucaaagccucguugaggcagcaauccaucaccuugaggccacaggagauguaauacggcugaugauaaaaacagcuaacacugacugagcacucucuguguuccaggacaggacuuaaacggaauuucucacuucauccuccauccagcccuuaaagacaaauauuauugccaguuuacagaugaggaaaaagauucagagagguggggugaugugccucaggucacacagcgaguggggguggaggguaaaggcuggauccaauucaagccuuccuuaccuccaaaacauuucccccaaagaccuuuccugaugacuguccagagcucccuguucuaucucccuuugcuaaagaugaaugacaaucacagccaauagcaaccacucacagcaagggagugccuggcagcugaggagugcucaggcagccagaaugucaucugccaacaaaccguuaaggccagcguuagccuuggugccgguuucccaagugagcagacugaggcuugggaauccagcaggacugugagcugucacaguggccuccugacucccggccuaguguucacuacaccacacugccaggaagcagcuuauucccuagucauucauucaaccacuauuuacuuggcuaaauucuaaugaacaagacaagcaauuuucugccuaggaaaauuugcaugagggaaucacugcccucccauaucauaauucacccuuccccgauuuuucuucagcagggaccaaccugcccucauuuccagucccuaaaauacaauaucuagaaguggguagggacucaucuuggccaaucagaauaccgcgcucccucuggccacagugauuggcucaagaauaggcacguggccaggcgcgguggcugaccccugugaucccagcacuuugggaagccuaggcagguggaucaccugaggucaggaguuugagaccagccuggccaacauggugaaaccccaccucuacuaaaaauacaaaaauuagcugggcgugauggugcaugccuguaaucccagcuacucgggaggcugaggcaggagaaucacuugaacccgggaggcggagguugcagugagccaagauagcgccauugcacuccagcccgggcaacaagagcgaaacuccaucuaaaaaaaaaaaaaaaaaaaaaaaaauuggcaugugaucaagucagccaaugaaaugcauucucagaacaacugcugagccagcugagacugcugcaagcucuccuugacuucuagccuccagccuaaagccauccugccccuaagggggccugaaaaucaaacuaggucugaggcacuaaagcugagagagggcaugagaagaccguugaucccuucaauuaacuuuuacaacucucuauuaagggcuuuauuuuauauauaagaaaaccgaugcuuagagagaugaagucaccggcccaaggucacacagcagguucaaaggauuaggaauugaauuccggccaauguggguucaaauuccauguaucugacagcuuugccagagaugccuguauauucugcaaaagucucaucugggccucagucuccccccuauaugggggaggauggauggugaaaugauguccaacucucuccaugcucugaugagagccgucuuagggagugggugagucuuggaaagcuaagggugguccaaguagaugaggcccacgugggaguuggcaggcaaggaauagcauaaagaacaagcggcugucuguggccuccgaugucccucucucccagcggcugaagcaaggccggguuccggcgcacgaugaggggagccuuggcccagccuuccacugcuggcuggcagugacuaacgccucagcccacacccuugcgagcagauacacaguggccacuuguguuuucuggcccaagcaccucugugggaacaauccucccccuuguacccgcaaggggcccagccuggaggagguggggauaacccucccagccggggacacugcuucacccaaggggcccagccagcccagucaggggcugggggcuuccugagagucagcugcacaaaggccagcaggggacccacccccaggcccuccccuucccucccggcugcccacugaucaguguguugcucccaccgcuucccgggaaauagcugauaucacagaccucaggacagugagaaaacauuagccaccccuccuuaacuccagcuccccaacccaacucugcagaugaggaagcugaguccaccaaggcgaaugcagagaccagggucccaucugugacacuugucucaucugugacacaggugugccucaagaagaguaaaugagaacacaagagcaaagagccuagaggggccuguuccuggggcaccccuaaccucaggucugggagccacuggagcugcugggaaauugacccuggggcuggggagcagugggggacuuggccagcauccauucccccuuguggauucaaaacucuaguugcuuuuggacacugccucucccucgcucugaguccaagggauucauagcggguugaccucacccugggccggggcauaccccaggcccagcuaaucagaggacugaaccaagggcgccugaaaaugaaacuugucacagucauugguucagagaugccugggcauggucccaaggcaggccaacagggucgugccuggguggcucuuuaaauuuguuuuugguuguuugcuuuuuuuuuuuuuuuugagacggaguuucccucuuuguugcccaggcuggagugcaauggugcgaucuuggcucacugcaaccuccaccucccggauucaagugauucuccugccucagccucccgaguagcugggauuacaggcaugcgccaccacgcccggcuguuuuuguauuuuuaguggcgacgggguuucuccauguuggucaggcuggucucgaacucccgaccucaagugauccgcccaccuuggccucccaaagcgcagggauuacaggcgugagccacugcgcucggccaguuguuugcauuuuugcugaaguuaucaggacagcagcuuuuucuuucucuggcgcugcuaaaucgguagaaugaaaggcugaagggucuuguagcccaucuugccacuccuucagaguggcugccggagggugaggccaagauggcagaagcagggcucacaaauggagugcuacuggcucuguggaacaccuggagacagcuguaccugaaggcggacucuacccguagacuucucaguuacaugagccgauaaauucccuuuuggauuccugccauuggccaccaagaaggagaugaguucccucucucuggggcuguuccagcaaggaacagauaucuagaggagugccucaccacacaacacgcguguaucaagggccaccuucauucccaagcccaccauaaucuauaaggugacauucacugagaccucaccaaagagcugacugauaaucuaggauuuggagaccuacauggaaaacacguaggacagaggccaacagcaacuauggaauucuucugccaaaagaaucuuccuccaaaaaaguggaaaggaucauuuuacacuuaauaaauuagcaaaaacaugcaauugugacaacccagcacuggagacgauguaguaaaaugggugaacgcauuacugacaagaauagaaacugauucaaucuuucaaagacaacaauuggaaauagguuuuaaaagccaugaaaauaccuuuucagccuauuaucccucauuccugggaauuuaaggccaggaaauacuuuuaaaaagacaacaggccaggcacgguggcucgugccuguaaucccagcacuuugaggggcugaggcgggcggaucagaaagucagaaguucgaggccaggcugaccaacauagugaaaccccgucucuacuaaaaauacaaaaauuagccaggcaagauggcgcgcaccuguagucccagcuacucgggaggcuggggcagaagaaucacuugaaccugggaggcagagguuguggugagcugagaucgugccacugcacuccagccugggaacagagcaagaaucugucucaaaaaaaaaaaaagaaaaaaaagaaaggcaacaaaagaaauguacuaggaucauguucaguuuauauuaguccauaauaauagaaaaaaggugaaaucacuaaagacaaugguuaaauuaacuuaaugggauauuaaguaacccuuaaaugauaaacaagaagauaauacaguaaugagaaaaaauccuuaagccauaauaguaaauaacaaaauaggauaaugaaauuguaacuaggcuacaauuuuccuuugggaaaacugcaugugccuauggacagggacgagcuaaaacacagcauaaugaagucaagcgauuuauaaagaugauuuucacccagugacaucuggcaauuauccacaggggucccagcgagggcagacugggacuggugcaaauaagccucccacauagagagagaccacuucaucugagcuugccuuacacguuccagagacagacacccucguucuuucggaacccacaugagcugcacugucugauacaguagcuacuagccgcacguggcuauuuaaauuaauagauaugaagcaaaaauuuaguuccucaguugcauuagccacauuucacgugccaccacacuguggcuaccguauugaacagagcagguacauacagaacacuucgaucacuguagaaaguucacccccagcccucucuggcagaaaaugccucuucggagguaagggagcaucuaaaacucacuccacugucccagacccagauucugaaacauggguuucuuuuucuaggaagcaaaaggggacaugugcaaggaaucagcagaggaaccccacccaaugaucauuugcuacggaagucuccuagcaaccuggcugaguggcaggugugagggaaggcucccagcugaccugucggaugaaaagccugggugugggucagagccaaaggacggagcagucagggcucaggguuccuauuucccugucuuuauucuggacggccgugccaggcauguaucaaauaugguucaggccacuggaaccaaagcagggcuuggucugggugucacacaauguacagcugugcugucccugccugaacacaguuaaucuuugcauggugaugaaggcggucaaucgcaggaagggcugcgacucuauuuaggagagagaaaaucuggccccagagaaaaccacggucacagcagaacugacuaugugcaggaaaagggcccaacauaaagccaaagggggugaccugaggacagcagacacagagccgggguggccagcugacaugggcuugaguuuagagcccacuaaggccccuggcuggcaggcgugagucagcagaggacaggagccuuaugcaccacgggccugggccuugggaggcccagguccuugcgggcucaggaugaaaaaggccugucaaacccucuuauggucucuugcugcagggcaacgagcagcccgccuuucuccagcacaggcccaugaaguacacagagguaccaccaucgccuuuuauggaagagaaaagggaggcccaggcagagaaacugacuugucccaggucacauagcuaggaggcacuggcaggccuggagcucagcucuggcucuccgcccagugcucugugcccucagcagcccaccaaaguugucaugccaggggucucccgcccagcugcucagugugccagcccuccuuccccucuuucccuccguggccuucaaccagaaacacucagggugaacccucaagggcuccuagcugcugacaagcuaacgcaggagcucccuggcccagcacucacacccucaugaccugccccugcccacuuccccagggucccgccauucccucucacucagccccgugccugcugccuacuucccagcccucuucaugcucccuccuccacagagaacaccuccucccuaccugcguuuaaucagccagcaaaaucgaacucaaccccagccuagcucaugacaucuuccccagaaccccagcccaccuccccgacuagaaucucuuugcaccuuguuaagguuuucaucgcagacugcccuguccccugggcaucugcaucacagauucucugaccuggcugugaucucugaaaggcucagcccaccugacuccucucagucuacccuacagagccuggcacagaagagccaguggguagaugggacagugggagugggagugaacgggaagauaggugggcagacaagcacauggaggagugaacggaugggagguaggggcuggaggaauggaugggaaaaugaguuaagugggauggugaauggaugagagguugggugaauggaugggugggcagaagaaugggaggguggguggaugggcagaugaauggaaggauggacagaugcaugggagagugaguuggcaggggcaugaaugggugugcaugagacuagguggguaugagagggauaaaggaaugacauguauguccagggaguagacaauuaucaucuucccuucuuuccaaaaggcacuugagcccacccuugcuggguucuaugaacaucagccucucuccuuccuucaauccuguagccaauaaaguuauuguuacaggaaucgaccccgcucccuccgauguccccaucuuggcaaacuuagaaaugagcaaauuucuaucgagcaauuuguggaaacagcgcaggaccuaagcucaagucccaacucuacuacuuacuagcuaagugugcuugcggaagccaggacaccaggccuucguuuccugaugaagacauaaacaauuucagugacgcacgggaaaaucaauaaaccacuauggguuagccaguugacuauugguuguuacuguucucucuuggaacuguguauuuuuuguuuuugaaagccuaaaaacauguuuauuuuguucaccaauguaucuauuacucuggucauggcagacacucaguauguauccuuuuuuuuuuuuuuuucaguauguauucuuaaaugacuaaggaaugaaugaauaaaacugguguuugugccucccugcaaacagagagaaaugagguccuccacauaagagaggaaaggaaagugauaagaagucgacuuucuccauaacauauuucuauuucugaaucucuggcuguucuccaguuuugaaagauggcaccucuuuaccuugcaggagccaaagccuucgacugggccaggauguacacagcugaguccugccaagcagagagaaaccacuucccaaucaaucaucaccaugccaaguuucagcucaacgacaagugagauggccaaguuucagaacaagugacauguaaggauggcaaagaucaugaagcccaaaagcagaaugacguggcuuucaaagacgugccuugaacacugucucccucagggaggggaagccuggccagccacccuggcacagcucagggaaauguugagccgcaaaaguucuugugaaccagcaaauaaaauacggaaacccaaacgggauuggcccaaagauaccaagucuuggccuuggcugaaaacgggagcaaccuguccaacuuggcuggggaugugggagcccucagauguuagcucuccaaaaccaauggggaauccaacccaccuaucacugauaaaggaggcgugaaaggugcccaugggcucugccuccuugcaggggaccgcucccaccuuucccaggcuccucgcuacccagaggaggacagugagacucaaugcggaguugcagaggggagaggacuccgggguccacagaggaggaggaagugaggaaggaagcacuuuauggagggccaccuaugcccccugccugcauguguuuaagacacucauuuaaucuucaccacaaccuugggggucguguccauucaugaacucuguuuuagagacaguaucaaaccucagagagguuaagucggccuguuuauuccaucaacaguccuuguggugcugaaguaacaucugugcguuaaagacaaucuuaaaaauauaaugguacaaggaagaaaaucaaagcuuuucauaauccaagggacucgccuuugguauucugcggugggacguucuugaacuguuucccaaucccagcucuaacacuucccagcugugugccccugaggggacuucuuuguccucacuucccagccuuuuauaccuuuacauaaugaagauguaaccgcuccuccuccagaagcuguugugagcauuuaaugaguuauacgugaaaggcgcuuagaagaggcuggguccuuggcugcgcaugguggcucaaauguguaaucccagcacuuugggaggcugagacagguggaucaccugaggucagaaauucaaaaccagucuggccaacagagugaaacuccaucucuacuaaaaauacaaaaauuagccgggcaugguggcacacuccuguagucccagcuacuugaggaagcugaagcaggagaaucacuuggacccgugaggcagagguugcaguaagccaagaucgcguuacugcacuccaaccugagcgacagagugaaacucuugucuuaaaauaaaauaaaaugaauagaauagaauagaauagaauagaauaggcuggguccagagugaaagucuagaaauauucacucauuauacucucucuggccacaaauauauucuuccauacuuuacaaaauugggauuaaacuguauacacuggucauucuuacuuucacuuaacaguauagcauggcuggacacaguggcucacaccuguaaucccccuguaaggccagcacuuugggaggggagguggguggaucaccugaagucaggaguuugagaccagccugaccaacauggugaaacccugucucuacaaaaauacaaaauuagccaggcaugguggcacgcaccuauagucccagcuacucgggaggcugaggcaggagaaucucuugaacccaggugguggagguugcagugagcugagauggcaccacugcacuccagccugggugacaagaguaaaacuccaucucaaaaaaacaaacaguauggcaugcacagcccuucggagcacaaaacacucuuccccaacgucaucuccaaggguggcagaauguuccacugagugacgggacccuccucuauuugagcagcucccuaucauggggccaugccacccuggucgcguggugccgcauccaaaagcauaggccuugauuuacauguugucaaaugcucuccaaauggcaggaccaagcuauacccguguuccaccaacacuagguaucauccagaugugacgcugggcuugggucaguucugccacaucuggcuguguguccuuggcacuggccucaugauggugcagguguaaagaugccuaugucccacugugagaggcacuauugucccuauuuugcagaaaagaaaaccaagguucagaggggugacaucacuugcccaggguuacacagcaaugccaacugcugagcugcgacuuguaagaugaacagcauccccaggucagaagccucugaaguggccgggcgcaguggcucaugccuguaaucccagcacuuugggaggcugaggcggguggaucacuugaggucaggaguucaagaccagccuggccaauauggugaaacccugucucuacuaaaaauacaaaaauuagcugggugugguagcacgugccuguaauuccagcuacucgggagccugaggcaggagaaucgcuugaacccaggaagcggagguugcagugagucgagaucgcgucacugcacuccagccugggugacagagcaagacucugucaaaaaaaagaaaaaaaaaagccucugaggcgaggagacccgcguggggugggcuggggucuucagggguccucuccuagccacuguagaugguccugcagccagaccagaggccagcaccagugucuggagcuccaguuuccucauuaacagaggcgccccagucaccucuccccagcucaaagauggguuuccuaucaccucaaaguggcgguuguggggagggcagugagggcccccaaaaagaaggggucuugagagggagcucaggcuuccccaaccccguaucagggcccucuaagaugcaaagcaaggguagaaagaaucucagggcugaccagggagguucgccagcucugacaagggucauugccucagggugacaaugcuggcucugacaguggcaacugccucauagggccaagcguugggccugggcucccagacaagacuguguggagcuuuccaggaaggagagugaagggaagccaggcaucagcauuagcuucuuucuccagggcacaaaugcuccacuucuggugcccucaacuacaacucacccuggggcaggcacggagcugagaccuuacacucaucccaccagaccccccaguagcccugugccgucuccaggcugggaugcaggcuuauuuuaucuucauaacagagagagcaacaaacugaggcugaucccagaacgcuuuacaucccuccacccagaagcacccugcaguguaacaggcaagggaggaguucagggccucaaggcaaucugccucugucaagccccaggaaggggaagaucagcuuaagucaccccacagaaauggcaacaaucacaguaacagccacauuuacaucuugugugugaggcaggacagugagggcuggccacaagcaucaauguucgcaaagucggggcaaagggcuguuuugauuuagacgucacagcucaagaugcugaggaucagaggggugaggugacuugcccaaagucacacagccaacaggcagggaagcuaggaggaagcucagaacugauuccagcgccacaucauaaccacaaugcggccucccgaguguagccacgucauaaccacaaugcggggccuguccagggagaggcaacaagcgaggcccggcauucacucacucauccuuucaauugcucagcagguauuuuuuguuguuguuguuguuuaauuuuuuuuugagacggcguuucacucuuguugaccaggcuggagugcaguggcgcaaucucagcucacugcaaccuccgccuuucggguucaagcuauucuucugccucagccuccugaguagcugggauuacaggcgcgcaccaucacgcccagccaauuuuuguauuuuuaauagagauggcguuucaccauauuggccaggcuggucucgaacucuugaccucagaugauccacccgccucggccucccaaagugcugggauuacagguaugagcgagccacugcacgccugcagcucagcaguuaugaacugaacaucuacccuccgcgggcccuguuccaaaugcaggggacacaaagaucacuccuuguccucagggacuucacaucugcuggaggggacagaaaauaaagaaggagaaacacaagagaaucccaguuuguaacaacagcccugaaggaaaucuacaggcagcugccaccauggucagggagcgguggucgggacaggccucucugaggagggaaucugaguugagacccggagaaugaggaggagccagcuguacagagucacagguagacuggcaggcaggggacccgccagcgcaauggcaaugguccggaagcagaaaggagcugcgcuucccucagcuccucccagaggcaccacuggccuccaccacccugcaccaccugacccaggcuggcuggaguuaacucuucagucaccagugcauugguaaagucccuccucguccccauccuucuccccaagucuuagugucuaauucuggcucugguauagccuguuuuuucuuguuauuguuguuuucagacaaccugcuuuucagucagggucuugcccugucacccagacuggagugcaguggugugaucacagcucacugcagccuugaauuccuggccucaagugauccuccugccucagccuccagagcagcuaggacuagauuuggugccaccacgccuggcuaauuuuuuaaauuuuuuggaagagauggagucuuccuauguuuccuaggcuggucgugaacuccuagccacccgaagugccagcccugcuauagucuguuaguaugaaaaaaucgguaagcuauggggggagaagggaaaaaaugcaucacaggggaagcagagagaaaggggaagagaaagagugaaguggaaggugaguaugguggagagagggagaagggagaaggaagccuuucagcacucacccucccugcucugcugacaagacccagagacacccugcacugcaggcugcugcggucccagcagccccacccaccagggugccaggaggggccccaggagcacucagcuuccccgcccugacacccgcccuuuuccccugccacuuccugugcuaguccugccugcaccccucaccacuuccucugcaugagaggccaccauccaucgccauccagcugaggcacgcuugcaaagaagggugacauuccugggcacagagaccacaaggccaagaguagacaccgcacugaagcgaccguggacugcccaacaagcccguuugucuuucucucugugcuaugcaagagaaaagagacacgcuccuggccagaaagaucuggaugcaagucccagcccugccaaaaaaaagcuaugugacccugaguaagucacuguaccucucugggucucugcuucaucagguguggagugaggauaucccccuaccuuucauggggauacgagaagaauaaaugauggacauguaggaacugagcaaaagucaacucccuacucaucuaucuuguucacuuuggaacccacagggccuggcacaaguaggugcucaauaaacaaucuagagcuaacacuuacaugacuucuuccaguguccuagacuaagugguuuccauggguugucucauuucaucuuccaacagcccuaugugauuguaccauuaccaucaccauuucacagcuuaagaaacugaggcagagauaaguaaauuccucagcaucacacagccugcaagagguagagccaggcuugaacugcaggaauuccuccagguucccagacaaccucugauccgcagcagacacaagcuugccuuccugucucauccucucugcucucuuuccaucuccuaagaugcccuagacucuuucaugccuccugucucacaaacaucuucucaggcuggucaccucucaccugucaccucacucccucagcucugauucggguuccaacuacagcucuggccuucccucccacacccaccugguucggucaccagggucggucacucuggcccagccuccauucagcauggaccaccuuaguuuugggcagccaggaauccuggcucuggcacccugcaauugugucgccucucuggucauggccuccucccccaucaaaagacaguccuucucuaauguuacaugggcugaccugaucaggcccugggggacuuaaggcaggcaggacauuuuuugagaucaaaacugccaagucuaaauucauuggcuuagcauucaaagcucucuugacuuggucccugcuaugguccgagugucugugucccuacaaaauucuuauguugaaaucccaaccuccaaggugauagcauuagaaggaggggccuuuugggaaaugauuaggucuuaaugagauuaguguucuuguaaaacagaccccagaggccggugcgguggcucacgccuguaaucccagcacucugggaggccgaggcgaguggaucacuugaagccaggaguuugagaccagacuggccaacaugguaaaacgccaucucuacuaaaaauacaaaaauuagccagaugugguggugcacgccugugaucccagcuacucuggaggcugaggcacaagaaucacuugaacccaggaggcgaucaugccgccagugagccgcgaucaugccacugcacuccagccuggaugaaggagugcagucuuuaaaaaaaaaaagaaaagacccuagaaggcuagcuguccuucugucccucccacuaugugaggucacagcgagaaggcaccaucuaugaagcagagcaggcccucguuagacaccaacucugugggagccuugaucuuggacuucccagccuccaaacuaugugaaauaaaauguuuauuguuugcaagccauccagccuaugguauuuugucacggcagcccgaaugagccacgcccccaaaugcuauugcagaucuggccuggcccuggcccaugcccacuucccaaauccagugaccacuggguuugaggaggcaacaguagaggccagaucugucgugcccaacauggcagucacuagccacaugucacuaucgagcaccugacauguggcuggugcagauggagaugugccauaagugcaacacccaccaauuucaaagacuucgcaugaaaaagaauacaacacauugcuuuaauucugcauuuauuacaugcugaagugauaaauauaccauuaaaauucauuucccuauuuuuccucugguuugaaugaggugacuaggaaaccugccauugccuguauagccugcguaacacucccuuggacagcaucauuagcccagagacagaagggaccaacuuaccuguuuuuguuuuguuuuguuuuguugagacagagucuugcucuguugcccaggcuggagugcaauggcgcuuucucagcucacugcaaccucugccucccagguuucaggugauuuuccugccucagccucccaaguagcugggacuacaggcaugagccaccacacccagcuaauuuuguauuuuuaguacagaugaaguuucaccauguuggccaggcuggucucgaacuccugaccucaggugauccacccaccucggccucccaaagugcugggauuacaggugugagccaccgcgcccagcccaggaucaaauuaucugauacuuacagagaagaccgaaaucugggauuuucugugaaaucucuucauuuaaaaauacuggcaaucaagucaaauuugguucaacccgcgugggggccacaccguguggccccauccucaggccacaucaggccgcuacaucaggcucaacggccagcagucagcaaccucgggccacucaugggccggccucucuccuggccuggacuuccuucccuccaccuuaucaccaucccgccugccguaccagguggaagcuuccccgcucucggcuggcugccugcuugucccuguacaacucucaucucaggcagcaccuuucggucuccucccccaugacacacuggaagcagcaggggaggccgccuucuuauccugagcaccuacgguggcuaacuggauacccgcuguaugagcuacucaggcaauucucacaauagcucccgcagguguagucagccccacuguacucauggggaagcugagggaggcugagacaagccacuugccugaaaggacacaguggcuaaauggcacagccgggaugcaaacccuggcuucucugacugaaagacccaacucucucauugcacacccagagaccugacagaggaggucaacaaauaccgucugccgggcugaauaaaggaacgcucgucugcacaagacagugguucucagcuggagccauuaugccucccucccccauggagcauguggcaacgucuggggacacuuuugguugccacaacugcaaggagguguucuggcauccagugggcugaagccagggauccuguggaacacccuauaauguacguaacagcuccauaacaaagaacgaccccacccaaaaugccaguagugccaggugaggaagcgcugguaugagggcuaugcuaucaacaccgagguauuccugccuugucccuaaagucauagugacaggucaggagcuucuccaucugacaccaagagcagcaaucauaacaccucaucgucauuuccugagcccuuccugggugagaaucagaugcuaaacacaucaccuccucaacuccucucagcccuguggccaacuccacuuugcagacacaagauucagguucagaggaggagguggucaccuauuugggguucaaauagggccaggacuaggacccagauccuacugagccccaaaucucuucccuucaccaccacccuguuccacuacccucagcagcagggggccugagagugaccacccagggcuguucugggggcuauggggugacaaccucuggagagucccccuaaucuagguaaccuuggcaggccaggccacaggagaguccuagguggagggcggguccaucuguuuguuucgaucccuuccaccgcagcuugcuuucgcaucagccaaaaaaaauucccagaacggccagugugaaaucagacccgcagggcugugggcagggccccacgcagaagccgaagggcgucauccacgggaaguucagacccccuuggaugagggcugagucacgaguuagaaacccacucacaauagcauggacuuggguuuaaaaauacuuggcugagcggaaacaagguuacugccuggggccagaucucuuuccggaggaggaggggaggacugagaccuuccccauccccagaggaaguggaaacccaagcuuucaaacuaguaggcaggagaggaggugaaaggagaagacucuggcucagggacgggcaagacggccugggagggcuccuaccucacuuaaccugagcuuccucucaaccaggcagggagggcagaaugucacaucacuccuaaagccagcacacagcagaggcaccuaagcucugagcagcagcugccaaggcccccugugcacuugaggggucuaagaggacuugggaauuggcucucagcaauagcaagagacaaaggggaccuguauuaauuuaucucauuuuauuuuuaaaaucacccucaaauaggcauaugcuuugaccuaguaauucccuuugaaaguccggccuaggccgggcgugguggcucacgccuguaaucccagcaguuugggaggccgaggcgggcagaucaccagaagucaggaguucaagaccagccuggccaacauggcaaaaucucgucucuacuaaaaaauacaaaaauuagcugggcaugguggcgggcgccuguaaucccagcuacuugagaggccaaggcaggagaaucacuugaaccugggaggcggagguugcaguaagccgaguucgugccacugcacuccagccugggcgacagagcaagacuucgucucaaaaaagaaagucuagccuaaaagguaaauuaaaauacagcaacggccaggugcaguggcucacgccuguaaucccagcacuuugggaggccgaggcaggcggaucacuugaggucaggaguucaagaccagccuggccaacauggugaaaccccgucucuacuaaaaauacaacaacaacaaaaaaaaaaaacauuagccgggcgugguggcgcacaccuguaaucccagcuacucaggaggcugaggcaggagaaucacuugaacccaggaagcagagguuucagugagcugagauugcaccacugcauuccagccugggcaacagagugagacucugucuaaaguaaaauaaaauaacauacagcaagaacucuacaaagcuguucaucaagauacaguuggcucugugagaacccuuauuuugaaccugccaacuuugcuccaacaccaucaacauaccagggagugauucugcuauaaugcuaaggucguauuugguuacauauagaaacagcaagugaacgccgcagaugaaugcagaaaacugcacucagcugacucagguguugaaggaaugcacaaaacacacaggcacacaccucugacauccaucaaccaccucugagccacacccaugugcaucugccaucagauugcacacacaccuccuuccacagcucccuacgcugcugccuucccagcacccacauccacccauguggugcaucuuuuuucagguaaaaugccuacuuaccgcagcaugugcguauuucuucuccacguaacuugcguaaaacuguacuacuggauuuuagauucugaacuuuuuuuaaaagacgccacugaugaaguuuuuaagugcugugcccucaaccccauucuucccauaaggccucugguuuuuacugcaugauuuugcauagcucugugauuuuuacgaagggauaauugucuucuauuacguauuacguaaagcgccuagcacagugccuggcauacgauuauuuaauuuauuuuaauuuuuuuuuuuuuugagacagagucucgcugugucacucaggcuggagaacagugauacaaucuuggcucacugcaaccuccaccucccagguucaagcgauucuccugccucacccucccugaguagcugggauuacaggcgcccaccaccaugccaggcuaguuuuuguauuuuuaguagagaggggguuuugccauguuggccaggcuggucucgaacuccugaccucagguuaugcucccaccucgggagguggagguugcagugagccaagaucgcgcuaaugcaauccagccugggugacagagcaagacucugucuaaaagaaaaaaagaaauaaaacacuacagauacauaugauuagaaccaagcaggaaaaaaaauucaccacaacaucaaaagucuagaaggaaauauaucaacaugucaacagacgcugauggaacccaggguaauuuuuuucuucuuaauugcugcuauuuguuugguaaacucccaauuuugcaaaacaauaaaucuuuuaaaaguuuaaaaaggccggcucgguggcucacgccuguaaucccagcacuuugggaggcugaggcgggcggaucacaaggucaggaguucgagaccagccuggccagcaugguaaaaccccgucucuacuaaaaauacaaaaauuagccggguguggcggugcgcaccuguaaucccagcuacuugggaggcugaggcaagagaauugcuugaaccuggaaagcggagguugcggugagcugagaucgcaccauugcacuccagccugggugacagagcuagacucugucucagagggaaaaaaaaaaaaaaaaaaaggcuuaaaaacaacaaaaaaucaaaaccaaagcaauuuucuauuuuuuguuuuguuuuguuuugagccagggucucagggucucauucuguugcccaggcuggagugcagaggcgugggugcaguggcucaccacaaccucugccucccaggcucaagcuauccucccaccucagccuccugaguagcugggaccacgggcgcaugucaccaugcccagcucauuuuuuuuuuuuuuuuuuuugagacggaguuuucgcucuuucacccagguugguuugcaauggcacaaucucagcucauugcaaccuccaccuuccaauuucaagcgauucucuugccucagccuccagagcagcugggauuacaggcgcccaccaccacgccuggcuaauuuuuguauuuuccguagagacgggguuucaccauguugcccaggcuggucuugaacuccugaccucaugauccacccaauucagccucucaaagugcugagauuacaggugugagccaccgcgcccggccaauuuuuuguauuuuugguggagaugggguuucgucauguugcucaggcuggcaaagcaauuuuuaagaaggauaccaggcucaguggcucauaccuauaaucccagcacuuuggauggcugaggcaggaggaucacuugagccuaggaguucaagaccaaccuggacaauauagugagaccccaucucuacaaaaaauuuaaaaauuagccaggugugguggcgugugccuguagucccagcuacucuggaggcugagacaggaggaucccuugagcccaggaguucgaggcugaaguaagcaaugauggugccacugcacuccaguccuugagacagaguaagacacugucucuaaaaacaaacaaaaagaagcagaaaaaucaucucagccugcuaacccaacuccuuucauuucuccaugcucccuguccacauugugugcaugaguaccuguguugccugcugcuaucacagcaagcacacccgcuaaagucagcuuuucccacucaaucuaucaccuuuuccccuuucuaccuccucuucaaaaugaagauuauuuucagugauaagaauuuugaaaccauauagcuuguaaacuuuacuuuuuuuuuuuuuuuugagacagaguuucacucucuuguccaggcuggagugcacaaucucugcucucugcaaccucugccuuccagguucaagcaguucuccugccucggccuccuaguagcugggauuacaggcuuacaggcaugcgccaccacgcccagcuaauuuuuuguauuuuuaguagagaugggguuuuaccauguuggccaggcuggucuugaacuccugacgucaagugauccaccagccucggccucccaaagugcugggauuacagucuacuuuguauucuaguaauuaacuaggaaugguuuucuuuugaaaccaauuuguaggacugguuuucuuuugaaaucaauuugcauucacauaggcauugagugagaaugagcuugacuuugcacaaaaucaauccuauccuccucuuuuucuccugaggcagacacauuaaggcuuaucagggagaggaggaaaaaaagagguuugauaucucggagacugcuccugugaagacuccucaggaaaucuggagucagaguccucuccugacacugugacaaacucagacuuccaaggcccagaaagaccucaggaagccuucgacacuuaggcugucagaagaaaaacagugcuacuggcagucccuccucagcucccugccaauugcuuucucaggugccgugucaaaauggaaucucugguuccagccauaacaccaagauggaauuuuugguuuggguuacuucaguaaccaggccagggaaaaccaagugggcaggagucgugguccuugauuagaggggucuuuaguaaaagcaauaccuacuucgacuucaggcaggaggggugaguaaacagcaccucucgaguaggcagccugggugacagggaucucugauccaggaugggucuuccuuagcuggugacuaaggaaaaaguguucaacugaagcccagagcccuggauucuagucccuucucuucucugggcaccgggacauaugggguuggcuuaggucagagggguacaugcuaaggccaaguagguaauagauuguucaggucuaucagcaaucacacagcucucuuggucuggcucacccuuaauuaagagaaaaugguggauucggagguaggcggagagggcugugguggagacagcucacaacuuugagaauuaaagucacuuuuuguuuuuauuguuguuguuuuugagacagagucucccucugucccccagacucgagugcagcggcaugaucucagcccacagcaaccuccgccucacggguucaagcaauucuccugccucagccucccgaguagcugggauuauagggcacgcgccaccacacccggcuaauuuuuuuauuuuuuuauuuuuaguagaggugggguuucaccauguugccccagcuggucucaaacuccuaaccucaagugauccacccgccucggccuccugaagugcuaggauuacaggcgugagccacagcaccuggcccuggagucacuuuuuuaaaaacugacuuuccacgugcuuuggagaaccaagaggagacaguaucgauuguggaucggaugaguuccuuuguaugaaacuuucagaguagcaggggagucuuaagggacuaaagcaggaggaaacacaacugaaaaugacaaggggaaaucuuaccagcaugaaagcaaaguucugcguuuaaguuuaaaggaagaugaacccugugaagccaggacacacugcggggaaggggacaagaaugcaauugaaagccccuaacggagaaaaaaaaaagcccauauguuuguuuuguuuuguuuuguuuuugagacagagucucgcucugucgccaggcuggagugcaguggcgcuaucucagcucacugcacccuccaccucccugguucaaacguuucucuugccucagccuccugagacgcugggauuacgggcaugcaucaccaugcccggcuaauuucuguauuuuuaguagagacaggguuucaccauguuggccaguauggucugaauuuccugaccucaugaucugccugcuucagccucccaaagugcuaggauuacaggcgugagccaccacgcccggcccaaaaaacccauauguuuagcauacgcuaaaaacaccaacugaaccuucuggagaaaguggguccuguggugagcugaccacagggguccagcugcccucacaguagucagagcacagcugcaggagcaggcucugucuaaggcagucaaggacacuggcaguguccagagacaguugcaaggcugaggaucguucucuggugccaccaggaagaagaugcagcucugaggagaguaaagaaaagacgugcugaggacagggugagcuggcugcccucaaauaugggcaaggcccucaggcaaaggaggacagcaagucggggcaguccaaaagcacugccucucggaucacaagaccucucccuaccccauaacaggaagugugggcucagaggggagguggcaaggaaacaaaacaggcaccaggccaggcacaguggcucacgccuguaaucccaacacuuugggaggccgagguggguggaucaacugaggucaggaguucgagaccagcuuagacaacauggugaaaccccgucucuacuaaaaaaacaaaaauuagccaggcaugguggugugugccugcaaucccagcuacuugggaggcugagguaggagaauugcuugaacccaggaaguggagguugcagugagggccgagaucaaaccaccgcacuccagcuugggcaauagagugagacuccgucucacaaaaaauaaaaauaaaaaaagacacugagugggccugguuggucucaaaauugccaccgcuccaggucaggcaggguggcucaccgcuguaaucccaacacuuugggaggcugaaacgagcugauuucaugagcucaggaguucaugacaagccugggcuacguggcgaaaccccaagucuacaaaaaauacaaaaauuagccgggcuguggugugcaccuguagaccuagcuacuccgaaggcugaggcaggagaauugcuugagcccaggaggcagagguugcagugagccgagaucgggccacugcacuccagacugagcaacagagggaaacccugucucaaaaaaaagaaaagaaaaaagaaaaaacgccaccacuccaagccucuagggcaguacuucucaaaccuauuugcuuaggaaucaccugggaucuuauuaaaacguagacucuaauucagcaggucggggcugggcaugagauuguucacuucugacaagcucccaaaugaugcuauuauaacaccggucaucuaggaacuacuucgguaacuaggcgauagaccacuuccaagucagaggagaaggccuggagaagccuucucugugguccagccucauagaacggcaauccuagggucagagugcccuacaagcuacaggagccccaaggaggaggauaguggcuuagaagagaggugcucuccuggagguauacaccaauuuaacaagugggcgucucccaguaaaaauuuucuuaggggaaaggggggagucaagcuguagguguuggcucccuaaaacaacucaccaccucagaauuagcucccaggagcagaaaccaacguccugcugccacacuucucuagacucaaucagcucugccccacccacuccacaaaagcucucugccgcgucuuccucuaggggagaggugacugcaggcugggagacuccccagcugugacucagaccgacggaaucaaaucuguucccccaggcucagcauucaccagauccugaccucccccucugaccagccccaacccaccuuuccaagccccaccucucaguccaugggccaccccucgcccaccccacuucccugucucuggcucaucuucagaugugucccuagcucccaacccguccaagcgcagccgaguuucucgguccacaucgccucgauauucccacagcaucuguggucucucuuaaaaaaaaaagugugcccguaucgccguuuuacggaacgucccuggaaggucccucgaguggcccucucggaugcugagguccugucaacgccccuuugucuccccgugcggcgccgagcgcagugcaggacacacaggaagugcuccgaaacagggcuagggugggggcggcaaccgugcccggagggggcgcccagagcgcagggacucggccgggccgagugauguuccccccaaaaaacaagagucaucgggaugagggccagggaccccgaauucagcgccgggcagcccucggagccggagccaggcuggccggguccggcucaggcaucccuuccuuccggagccccucgacgcgcguccggccacccaccucagcgcccucaccuuguaaaccuugccgaaggcgccgucgcccagcucgcccacgaucucccacaccucguugggguccaggucgcggcggacgugcucauauucgcgggacuuucucuucucgaagguagacaggcgcaggaugcggcggaaauuggcaaaagccauggccgggggcgcgguggcgccggcucgggcucgggcucgggcucgggcuguggcuucggcggccgcgaggagaaggaggaggaguuggaggacgccgcgucucucgggguucuccccagacccgccuuuccccgcagcccgaccucggucaagugugcccugggcagcgccgcgccgggagcacccggaaccgcgcaggcggcggcgugcccgcccccgcccccgcccugucagguccccagggccgccucccuugugccggccucgcagcuccugcccggcccagcccugccugcgaga

SEQ ID NO: 192220 - RNA, 31437 nt, Homo sapiens
auucuuucuucguguuccugugcgggauuggugugcccagggguuuggcuuuccaauuggcuaacgccgggguggguggggaauguggggagauuugaauuugaaaccgguagggagugauaauccgcauucaguugucgaggagugccagucaccuucaguuucuggagcuggccgucaacauguccuuuccuaaggcgcccuugaaacgauucaaugacccuucuggugcguaagggggaaagagcugggggacgggagacgcccuaacgcccuuugccucuuucagcucccuucuugggaggcaagcaggaggcgauuuuagggucgggcuggggcucauucaguugauugauuuuucucaaauaugcucuaagcaucuguuacaugccaagcacuaaucaggaugcuaaggauaccgcagugaaacagucuccgccccguggggcuuacauucaggcggggaauacugucaauaaacagcgguaauggagaaacuacagcagggcgaagggaauggacccgagacguugguagcuacuugauuuucaaguccgagagggccucacugauaagaacacuggaguauuacuuguagucugaacuugugcauuucuuuuguguauuccauuugggcauaaaagaaggaagauuaguaaaggcaguuuauggguguaaaauuagagcagcagcacuuauugaaaacauaaacaaugaaguuauggcugauauugaccacuuauaccucaagcaccguacuaaggcuuuacaucgauuauuaguuauguuaauuucccaccaacucuaagggguaauccuauuauuauuuuauugauaaaaagacugagacuuaaauuugcucagugcuacauuaccaaagugaccggacuggaauaugaacccagcccccaucgugugcucuuaacaccgcaaugcacagcacaguaaccaggaagccuuagcuguguuugguaggcacucaucauuuaagaugcuguaugcggccgggcgcggcggcucacgccuguaaucccagcacuuugggaggccgaggcagguggaucacgaggucaggagaucgagaccaccgugaaaccccgucuguacuaaaaauacaaaaaaaauuagccaggcgcgguggcgggcgccuguagucccagcugacuacaggcugaggcaggagaauggcgugaacccgggaggcggagcuugcgaugagccgagaucgcgccacugcacuccagccugggcgacagagcaagacucugucuuacagaaaaaaaaaaaaugcuguaugcugggacugugcuacuagaucuuguuuauuccuuccaaaagccaagugaggaagguacugauauugaccucauuuuacagaugagaaaacagagguuuuguaucuugcacaaucaguaagugguagagcuaaauauuaaagcucaugauuuauucacuaucauacacuauuucgugguuacucauuacgucucuaaguuuugucagccaacgugugaaugaaaauacaacuacucacaaaggaaggccaaaugagcaagugaaucagcacaaacuuauuuucuuaguuaaaagacucaaggaccauaugauuucccgaguaaucaaaggaccuacucuuaaguuuugucagcaguguggcuuuaagguuuuuuugguuuuuuuguuguuugcauuauaguagguuaaacuggcuuuaucaaagauauaguauuucaggcucacaguuacagaaauaauacuaauuauuaauuugaugcuuaauguguaugaggcacuguggugauuuuucauauuccaguacuccagccugggugacagugcgagacucuguuucaaaaaaaaaaaagcaaaaaaacccccaaaauuuauauuucaaccuaagauguauuuuuauaucucuacacauacauacgaaagaaaaguuucacaaaacaaugccuaacuuugcagcauaugagucaugcuuuuucuauuguuuuuacuuuuuaaaaaaugcuaaucaagaucuacucauggggcugggccuggugguucacacguguaauccuagcacuuugggaggccgaggcagagagaucagcugaggucaggaguucaagaccagccuggccaacauggugaaacccugucucuaguaaaaauacaaaaaacuagcugggcgugguggugggagccuguaaucccagcuacucgggaggcugaggcaggagaaucgcuugaacccaggaggcaaagguuucagugagccaagauggcgccacuacacuccagccuagacaacagagcaagacuccgucucaaaaaaaaaaaaaaaaaaaaaaaaaucaugaguuccugucuacuguuugacaaacauuuaggggacagcaguaguugccugggaaugguccaagcuccuugcucuuccuauuuauuugcaugagacucuagacugaaguaaauagcuuuucagagaauaguauuaaucuauuuguucccaaucagcuaaagcuuuaggcuaguaguauuuuaauuacuuuaaguccuaaaggccccaucucaggucugcuauguguauuuacucagaaaugccuucaaaucugggacuuuaguuaagugaaauuaugcaguauaaacuucuggaacauacaaauauagucuaguacaauuuguacuuuguguaacauuggcuuuuugaauuuccuaagccucacauucuuugucuauaaauuaucacacaggauucuugugaggauuaaauaaaauaacaucugugaaaugcuuagcauaaugccuggcauuuaguaagugcucaaaaaauucuaguugcucuagugugguugcuuuucuuccauguguuugaauugcaguugacaucuuuaauaggucugauguauugauauuagccagagauggauuaucacuauaaauuuuuauucuaggcuaaacauugagggauagacaauuuuaauuacuuuauuucuagaaacugauaguaguuaucuuugugacucucuucgaguagaguugacaccaaguauuuuauuugcuauauucaauccuuaguaagaaagccauauauugccuguaauauaugauguucaucucaaaacugucguuugcucaguugccuguguuccuuugacccgguugauauaaagggcaagaugauauuguucuucauagagaggccuucuuuguaauaucaaauggaugcaauuuuuuacauuuaaaaaaagcaguuuguuaaugacauuuuuacauuuauauucacuuuauuaugacauguuuuaacuuaagaucauaaguaacauuagauaauauauuaauguuuucuauuuccucuagguugugcaccaucuccaggugcuuaugauguuaaaacuuuagaaguauugaaaggaccaguauccuuucagaaaucacaaagauuuaaacagcaaaaagguaauauagaucaccaaagaacaaugguuaugugaucuuauaaguuuuaaaguuaugaauaacaauauuuaaagauguuauagcauuuuuuaaaaugugaagcuagaacuauauuuaaauuuuauuugauggauuuaugaaagggucaaguacagaauaaugcugucaucauuacauuguuauauaaccaggaaaauuaagcaagauacuuauauugauauguagcuucccuuuugguaauuaccuugacuugucagggaauauuaggaaaaucagaaagguguuagauguguaaaaaaauuguaugaguaauuauuugaaaauguacaacuaaggaaagaauauauuguuucaucaaaaguuguaauuagaaauuuggggccgggcaagguggcucgugcucguaauccuggcacucugugaggccaagguggguggaucacaugaguucaggauuucgagacaagccuggccaacauggugaaaccccaucucuacuaaaaauacagaaauuagccaggugugguggggugcgccugugguuccagcuacuagggaggaaagugggagaguugcuugaaacugggaggcagagguugcagugggcugagaugacaccacugcaguccaggcugggugacagugagacugucucaaaaaacaaaaacaaacaaaaagagaaagacaaaaaaauuuggaaauuguguuuuguguguaguuaaaacacauugacaucaaccaugaucuguacaauucauuuuuccgcagaaucuaaacaaaaucuuaauguugacaaagauacuaccuugccugcuucagcuagaaaaguuaagucuucggaaucaaaggugaggagcuuuuauaugccagcugguuuaucaaguguaucaucaaaaacaucugaaaguauuguauuugauuagaauggguuaaguguaugaaucaagguuauaaguaaaucuguaaauuaaugaaaugaguuaucauuagaacucuagcaaguuuuacauuucugccuaggucauuauguuuaaaugugcccuuaguucacaauuauaauggucuucaauucucaaucacuucuauguuuaaauuguucauuaccuaguaaacauuucaaaauuaugugaugcuuugauuuauuaaguaccaccauuugaguuguuuuguuuuuguguauuuguuuguggggaaggguaaguguuuuugaagaaaagugggaaaaaaugccaauaucuaagagagguuugcuacugagaaacuguuaaggaguggugagagauuaaauucuuaauagucuuguggcuugugcaagagcuacuauuacucuuuucauaaguuuauaaacaggcaagcugcauaguacuuuuuaaauuuuauuuauguauuuuuuuuuugagauggaguaucacucugucacccaggcuaaagugcaguggcgccaucucagcuuacugcagccucuguccccacaggcucaagcgauucuccugccucagccuccccaguagcugggauuacaggcacgccccaccacgcccaguuacuuuuuguguuuuugcuaaagacgagguuuaaacauauuagccaguugggcaggcuaggcuggucuugaauuccugacuucaggugaucagcccacuuuggccucccaaagugcugggauuacagguguuguccaccacacccagccgccauauaauacuuuuuaaaagacagcuggggggcgcacagugguucacgccuauaaucccagcacuuugggaggcaaggcagguggaucacuugaggucaggaguuugagaccagccuggccaacauguagucaaaccccaucucuacuaaaaaauacaaaaaugugcuggacgugguggcacgugccuguagucccagcuacuugggaagcugaggcaggagaauugcuugaaccugggaggcagagguugcagucagccaagguggugccacuguacuccagccugggcaacagagcgagacucagucucuccaaaaaaaaaaaaaaagacagccgggcacaguagcucacgccuguaaucccagcacuuugggaggcugaagcagguggauugcuugaggucaagaguucgagaccagccugacccacauggugaaaccccgucucuacuaaaaauacaagaaaauuagccgugugugguggcacguaccuguaaucccagcuacucgggaggcugaggcaggagaacugcuugaaccuagggaggcagagguugcagugagccgagagauugcaccacugcacuccagccugggcagcagagcgagaccuaucucaaagauaaaaauaaaguaaaaaaguuguacaaauuaauagguuuuuugaugugaaaaauauucagaguuggaaaaaggcuuagguuguucauucauuuggcaguugccuaagccucauauucuguaauauagagcuauguuguucuguauggaagcauagccacaugugucuauugagcaacugaaauguggcuagugcuauuaaagaacuaaauuuuuaauauuuaauuuuaauuaauacauauuuaaagacauacucgauuuuguuaguggaacgcuuuuaaauauuuuuggaacaacuugaguaugugaauuuacuuucuccuuucuauguuuuaugaaauuaaauauacauaaacauuucugaugaaaauuuagcauugaauuaagacgugcuauaaguguagaauacaaagaaaacuuuaaagacuuaguacaaaaauauaaaacaucucauugauaauuuuauaccaaugacaugcugaaaaaauauauuugauauguuggguuaaauaaaauauauuaagauuuuuacuuuuuaaacacacuacuagaaaaauuuaaaugcauagguggcuugcauuauuuuuauugggcaggacuauuauagacacucuuuucuuagaaauugauguaagugguuugacuuaaauuucuugaagaaacuguucuguaauuuuguaauuuauaaagccccuuagaaaacuaaauuacauacaaguuuguauggagccccaaaauaauaguccuuccccauaaaaaauuucauggagugugaaauuaauaaacaugacacugaugucacccccaccuccugccccacuuagaaacaucugaaacagauuucauucaagauguugaugccuuucuuccauuuuuagauggaaaagauauucuuuuucuagccauugugucagaaagucuguuggauauaaaaagauauagugugaaaauuauaugucuuauuuagaauaaagccaaugagaaaauuagaaucagagcuuaugcuguuucaguuuuuauuucuuugcaucuguauauuuuccucuucggguaucaaaguuuaagucgauuucucuuuguaagauucuuucugagauagcauaauuaaauauucaagauguguugcuauuuaacauuagagggaggcagucaguagcuuuauucauaaaguuccaccuguucuuuucacugggcugauuaggaaaauccugauuuauuggguugaaaauuucuaaaccuaaaaugucuugagauuuuuagaauauuuuauuuaucagaugaguggccuacacaauguuuaacaguguaauguuuaaaauagaaacuaacugauuggaucccuucaucuuuucugauaacugaaaaacaaauuuggcugucauaucugugacaucuaaauuugcuuauaaguuuuuuuggcuuuuaaacagaaggaaucucaaaagaaugauaaagauuugaagauauuagagaaagagguaagcagugcuuuaaacuuagugaaaaguacacaugauagaaagagaguuacacagauuuaagagauaaggauucuguugcagugugaggaguccugcagugaggcaaacaugccauccagaacagugccuacaggaaaacaguucuuacaguauuucacagaucuauccgggcuauguuaaugugguaugcuggcaacgccgagauuaaagauagcccacuuaaugaaaaacugauaacugaaaaaucauuaugucaguugauuacaauuauauauguggaucaaauauuuauaucuauccaucguucacagucuuccuguaugcuaacuuauguuaacacaacauagcuagaggauuucuuagugagcaugcaauccuagcugguuagacugugaugaaguuaggcuaacucgaugcauugcucugcacaauagguauaggccuuccucaugggugaaauaacauagagcugugcuguuugauaugguagcuacucaccacaugugaugaucuaaauuaaauaagaacucaauuccucaguugcaauaaucacauuucaagugcucaguagccacaugugauuggcagcuaccauacuggacagggcauuuccaccaugacagaaauuucuauugaacaguacuaaccuaaagaacccauuuacuuuccuagcaaugcuaagcagcucacugugaacuuugcuucucugcagucuuuuuuuucuguuuccauugcugaccaacucuuuuccucauggauauauucuuucaauauauuaaaaucuuucauuugauuacagucgaauguuggcuuucaaccaagaguaugucagaguaacuguaaaugucugcucaguugcucugauucuuuuuuauguauucuaauaauguuagcuaucauuuuacugaggguacauguagggguugauacuuacaggaauaaucacugagucucagugagauagcugguaagugagugguagagccaggauuagaacuaauaauuuacaccagugacuucauuggguauagaauuuuaggguggcagguucccccccauuauauuaaaaauaucauuucauugucuuuuggcuuccacauuuucuguugacaaauauugguuuggguuuuuuuuuguuuuuuguuuuuuuaaucugguaauagcagcaagaaugauggcuugccaaugccuaguacauucuccucagaagcccagcucugccuucuugaaauaaaaaacauuuagcauuuuaagcuaauuugaauuuguguaauugaagcuagagaaaauaacuauuauagguggaaauaccuuaaaagugaauaaauagcggccgggugugguggcuuacaccuguaauccuagcacuuugggaggcugaggcggguggaucacgaggucaggagaucgagaccauccuggcuaauauggugaaaccccgucucuauuaaaaauacaaaaaauuagccgggugugguggcccgugcugguagucccagcuauucgggaggcugaggcaggagaaucgcuugaacccaggaggcggagcuugcagugagccgagaucgugccacugcacuccagccugggcaacagagcacagagcaagacuccaucucaaaaaaaaaaaaaaaaaagugaauagauagcuuaauuguacuuggaacuuauggcaacuaaaguucuuauguucuuaaaaugcauuaagacuuuuaagauguaucauagguaaauaugauuauucaaauagcuaguaacauuagaauaucuacaagcauaaugucaaaaucagagauuuuuccagaaacuuuaggggugauuauugguagcaucuccuuauguuggcauucuaucagugaaucauuuauuaucaccuuguuuuuguccagauucguguucuucuacaggaacguggugcccaggacaggcggauccaggaucuggaaacugaguuggaaaagauggaagcaaggcuaaaugcugcacuaagggaaaaaacaucucucucugcaaauaaugcuacacuggaaaaacaacuuauugaauugaccaggacuaaugaacuacuaaaaucuaagguaucugagccucaugauaauauuuacaauugaauaaauauaaacacguuuuuuagggccgggcacgguggcucacgccuguguucccagcauuuugggaggccaaggcaggcggaucaccugaggucgggaguucgagaccagccugaccaacauggagaaacccugucucuacuaaaaauacaaaaauuagcuaggccuauuggcgggcgccuguaaucucagcuacucgggaggcugaggcagaagaaucacuugaacccaggagguggagguugcagugagcugacauggcgccauugcacuucagccuaggcaagagagugcgacuccaucucaaaaaacaaaacaaaacaaaacaacauacaccaggcgauucagauucauuuuguuaagcaaacauguuucaagaaauccuuucucagggacuugcuuuagagucuugcaauggacuuuccagcauauagagguaagugaccacccaaacaaccuuucaaaaaugaaccaacaggccagccacaguggcucacaccuguaauuccagcgcuuugggaagcugagacggauggaucacuugaggucaggauuuugagacuagccuagccuaacauggcgaaaccccaucuuuacuaaaaauacaaaaauuagucagguaugguggcguacacccguaauuccagcuacucaggaggcugaggcaugagaauagcuugaacucgggaggcugaggcaugagaauagcuugaacucgggagguggaaguugcagugagcaacacggcacuccagccugggugacagagugagacucugucuuacaaaaauaaaauaaaaauaaaccagcaagucacauuaaggaaaagagggauaagaacaguagacugguacaguggcucaugccuguauuuccagcauuuuggaaggcugagggcuggagaauugcuugaggccaggaguuugagaccagccugggcaacauaucaagaccccaucucuauaaacaaauugaaaaauuagcuaggcauggugguggugcacaccgguaaucccagcuacucaggaagaugaggcaggaggauugauugagcccaggaguuugagauuauagcgagcuaugaucaugccacuccacucuagccuggacagcggagcgagacuugaucucuuaaaaagaaaagaaaaaaaaauuaaaucaaucaguaauuaugguguaggucaaagacuguucucucuaccaaaguauauuaaagucaaaaacauaaccccagugauagguagaaaaaucaauauuuguguauuuuaaauaugucuuagcagaaaauauuucugaauuuuuuacguguuuguuguauuuaguuuucugaaaaugguaaccagaagaauuugagaauucuaagcuuggaguugaugaaacuuagaaacaaaagagaaacaaagaugagggugagugcugcccuuggcagguuugcugugucuggaucuggggaucaguacaacuuucucauuuccuaaaacagguaucuuuguuguguaggguaugauggcuaagcaagaaggcauggagaugaagcugcaggucacccaaaggagucucgaagagucucaagggaaaauagcccaacuggagggaaaacuguaagugagugaaugugaagagaaauuguuaaguggaagcaauucuugauuugagucucuucacaaauuauuguuuacugagacuucaaccuucuguuaguacuuaucucauugccucccuccaguugcccuauuucucuuuuuaaacuagaaugagcccuaaucauucucaaacauguugugcuacaaaguuguaugagugcauuacuuuuguacaucuucuguauuauuaaugaugaggaaagauuucaugaucuuaugaaaguggucauuagauugaaauugagaaacacugguauaggaaauugugauuuaugcacaauccuagccuuugauuuugagcuuuaauauacauauaauaaaauguguggauaguaaguauucaguuuggugacuuuagcaauuguauacaccuacguaaccacuaccaaacaagauagagaacauuuucaucccuucagaaaguuccuucauaccccuucuugucccccugcuacugccuaugucauguccccauccccauaacuacuuucucacuuacaucaucauaaauuagcuuugccuuuuuuuauuuauuauuauuauuauuuauuuuuuuuuuuagagauggggcauugcuuuguuacucaggcuggucucauacuccuggacucaagugauaccacccuggccuucagagugcuggaguuauagacaugggccacuauaccuggccaguuuugccuuuuuuuaggacaugcaaaagagaaagagcauguguguguguugcuucuuuuguuugauguaauuuuucaagauucauccaaaccguucuguauacuguaauuuuuccuauuuuauuucugaguagugguucaccuuaugaauauaccuccaucucuuuacucuucuccuuuugaucauuauuugggcuguugccagugucugccauuaaaaagacugcugugaacauguuuuauguuuuuuuauggacacguuuuuauuucucagagaaauuucuaggaguagaauucuuggguaauaggguaguguauauauaauguuuuuuaaaacucagaaguguuuuugccauuuuuauacacccccuggcaauguaugauaguuucaguuguuccagauucucaccaacauuuaauguugucagucuguuugauuuuagccuuucuacuagguaggaagugguaucuccuuugugauuuuaauuuguuaccaugaauguugaccuuauuuuuaugugcuuauugaccauuuuaugugcauaucaccuuuugcaaggugucuauugaagucuuuuguccauuucuugcauuggacaguuugguggagguaaacagauaaguaauugaagaccagguagucugggacaaaagcuuuaugggcacacaaaaugcuauuuaguauguuggauggguggggaaaccaggaagaccacaaaaagaauauuauuucuaacacuugggauacuguaaugaugguucuugucaucauagguuuuuuugucaguauauauucagaaaacuuucucacuuaaauaaaaauuuuagucuucuauuuugauguaaauugugaauuugagaaauuacauaaaauaauaguuaagaguuagggcucuguagucagccugccugauacaggaguaucugguacauaagcauuauguaagauuauuaaauaacgaaacuagaauguauuaacauaugcaauuuuuguuuuaguguuucaauagagaaagaaaagauugaugaaaaaucugaaacagaaaaacucuuggaauacaucgaagaaauuagguaauaugagcaguagcuuuaaauugaaccuuauuuuuuuaauacucagucauuuucaucauuuuucuguuauuuucccugugccuaaauagaugugcuuuuuaagauaauuuguuuuaaugcaguugugcuucagaucaaguggaaaaauacaagcuagauauugcccaguuagaagaaaauuugaaagagaagaaugaugaaauuuuaagccuuaagcagucucuugaggagaauauuguuauauuaucuaaacaaguagaagaucuaaaugugaaaugucagcugcuugaaaaagaaaaagguauuacaguguuuuauaguuacuuuguuuagauaaguguuacauacaacauuuaggaaaaauacuacuaugcuaaaacaaccuuuuaaauauaauuagcuauacuaacauuuuaaauauaauuagcuauauagcuauacaacagcaaaaaccuguacugcauuuuagaauauuuuacucuuauaauguuuguuuucuguuuauuucaauacagcauauuaccugucuugauugaaauauauacagucauauaauucuugacuuuuccacuagguggcuguguaacaaucaguagauaacacagaacaagauuuguggguuuuauuauuuagcacauaguauauauuacauggaguaaugauacaaaguucacaguuuuguuuucuucuuuggaaauaccaugcuaaaagcaguguaauggaauauuaugggaguccagguuucucagucuuaauguucuuaucuaauuccaguauucuugauguuuugcguuuucuagaagaccaugucaacaggaauagagaacacaacgaaaaucuaaaugcagagaugcaaaacuuaaaacagaaguuuauucuugaacaacaggaacgugaaaagcuucaacaaaaagaauuacaaauugauucacuucugcaacaagagaaaguaauuuaccaccauauuuuuuuaaacuguucauuuugugucauacauuucccuaugucucugaacaccuuuaaauuguguauauccuuugaucuaccaauucuaucuuuagagucuuauccugaggacauaaucauggauaugcugaggauuuagcuacguauuuucacuacauguucacccuaggguuaugaauaaugugggaaaaugacaacagauacagcaaaauagggaauuuuuaaaaaauuuucuggcucauucuuguguuauuuaggcuauauaaacauuuacacuuaccuuguaaaagacugucuaauuacagaagaaacaaagcaauuuuuaaaauccagauuauuuauagaacauuuuacauaucagugagaagaaagaaaguccacugaaaaauuaugggcauaggauggaaacagagaaggagaaguucuggccuguaaauauagaaagauacuccaccuuaguaguaaccaaggaaguagaaauaauauuuuuuucacuuacaaaauuggcacaaauuaaaacauuugauaacacaaaauacuggugagaguuaagccaacagguacuuacaugcacugaugugaaauauuauaguguuggacaaccuacaacagcuaaaggaauugaguagaucuauauacacugaccuggaaagauuucagcaacagaguauauaucauuuauaucccuccccaaauguauauguauauauaaguguaaagaaaaauaccagaaggcauauauauuccaaacuaguagcuaucucugcaaugggaaaacuaaaauuagggggggaagucgucaaagauaauauuaacaucauuuguaauguuagaauuauuucacaauggugauguauuuguauauuguauagcuuaaaaaauaauuuuauguaauauggaaaucaccacacacuuuuuacauaauaugugaaaaauaauguuaauaucaaagccaguuguaaaacagauauauauauauaaaauauaauuuuagauuaagaaguuucugcaugugcguugcauagaaaaaagccuaagaugauauuugccacaauguuaacaagguauaggaaauaaucuaugaaaacaaauaugcuauuucuauauuguuuuaaguuuccuugaaucuguugaauuuagguuucauccuucuuuaucuguacuuuuuuuugucuccuaguacaaccucacaaugccauuccaaauuauuuuggugguuuucuguuuggauauaggaauuaucuucgagucuucaucagaagcucuguucuuuucaagaggaaaugguuaaagagaagaaucuguuugaggaagaauuaaagcaaacacuggaugagcuugauaaauuacagcaaaaggaggaacaagcugaaaggcuggucaagcaauuggaagaggaagcaaaaucuagagcugaagaauuaaaacuccuagaagaaaagcugaaaggguuuguauuaauaggaucucauguuuauguaugacuucagauguauuuauuuugaguacuuuuuuuaguauucucuuaucaaucaugugagcguguuagguuggaauuauuuuauaauuaaguaguaauuauuaauuauuuuacaauuaaguaguagacacagaaugugaacacaaaauguacaugcaaacaaguaagacagcccccucuuuuaaguuaaaaguuaaagguuuugcccccuuuuuuuaaggccaaagagaguuuaaauaaacaaaugacaaaaguuuuacacuucuuuacuacucugcuaauuucugaaauuuauugaacaucagcauuagaacaauaaucaacucagggcuggaugugguggcugaugccugcaauucccauacuuugggaugccaaggugagaggacugcuugagcucaggaguuugagaccagccugugcaauauagugagaccucgucucuacuaaaaauuaaaaaaaaaacuagcugggcacgguggugugugccuguagucccagcuacuuagaaaguugugggaggagaaucacuuaagcccacgagauuaaggcugcaguuagccgugaucacgucacugcacucuagccugagcaacagagugagacucugucucaaaaacaaacaaaacacaauaaugaacuugggggaaaaaaauaaagaaucccucccauuaauaaauagcauucccauuuuugucuaugcacuuacauaguguaaguuauaccuuuaauuacauuuuuccgggagcacaaacacuucagaaauagcaaucaaaaugcaaagcaggcuggcacaauggcacaugccuaaagucccagcuacucaggaggcugagaugggaggaucuuuagagcccaggaguuugaggcuguaaugcucaacgauuauaccuguuaauagccauggcacucuagccugggcaacguagcacaagaugccaccucaaucaauaacugauaaaaagcaaaugagaaaaaauaauuauaacugggaaacauucagaaguaagaaaucucuuauuuacaguagaaagacugaaaucuuggcugggugcgguggcucacaccuguaaucccaccacuuugggaagccaaggcagcgagaucacaaggucaggaguucgagaccagccuggccaacauggugaaaccccaucucuacuaaaaauacauaguaaauuagccuggcaucguggcgcacgccuguaaucccagcuauucaggaggcugaggcaggagaauugcuugaacccaggaggcggagguuguggugagcugacaucgcaccacugcacuccagccugggcgacagagggagacugugucccaaaaacaaaagaaaaacugaaaucucacuuuuuucccgaacucuaguuccuuauaauuucugccacauuauguuuccuucucccauacacuuauuuauuucauuuuguuuuguuuuguccauaguaauugcuaauuuuuuauuuauuaagagaaacuauuccuuagccuacauauucauauuucauaguucaggaacacagguuagugacaaacacuacuacauuuauuuaaauuaaaaagucugauuugauucuugaguucaaauugcaaauauuuaaauccuugggaucugaucauuaaaacacuuguugucaaaggacugugggcuagauaugaguuuguauuauuguaauauaucucacaccuguguaucugucucaguggauacuuuuguuauuaaucuuuucuguuuucuuaugauuagugaugcaaaugaacagcaagguuuuucauaucccugcuuuugggggaacaauacaaaauuguaauuagggguguuguucuauacuacagccaaucucagggaacaggaaucuugggaaaauaagauaaugucauuuuaagagaggaaagaaaauugagauaauuuuuuauuccaacucaaaaaacugugguccaauggucaagagauaaggauuuuuauuacuaauucuguuagcuagcugguugauucugagcaaaacaaucuuaguuucuuugaucuucuacuucauuagauauaaaagaguuuuauuagauggucucuaagaucccuucuagccuggaaauuucaagcuuaagagaaaaacaaacuaagaauugaaaauaauuccucuaggggacagggaagaaaauauuuuuauuauaaacucuuuagucauauuugauugcucuugcugugguguguauauuuuugaaauccggcacuuguuacagaaugaauuugaucagcuauuuuucuuaucucaguguccaacuuagucuauaaguacacaaugcuuauuuacaauuuuuaguucuguauauucuuuaaaagaucucucauaagcucauaugcauaucuaaaaauuuuaucaccacuuuggaaauauauuauuuccaaaauaucccugagauuuaauagcauauguauauaaaaaugacuuaaaacccauucugucuaugcaaaauaauccauuaaagaaguuauuaagucuuucaguaauagaguauuauguggguuauucauauaaucagaauaaauccacaaagucuuguaacucuguaguuuaaaaugaaguggcuuuaauuguucaugguauuucucaagugucuaaauggagagaaugaaacuuuauucaauccagauguuuuuugacugguaaucuuuugcagucuuuaguccuggcuaguaucuuaagauuugguuuuauagucuuuuauauccuacuaccuucuucacccaaauuuuuaaaguaaaauaagcaggaaagauaaguugaagcuaguagaaaaaugcauaaaaaacaugcuuucgagguaagucauaaauuaggaucugagcuauuuagcagguaaugcaguggugaagauaugagcuauaugauucacaguuucaaagguaaauacuauuuucuuucuuaggguaguaauuguagguggcauuuuaucuuucaauuauuucuuuuucuuaggaaggaggcugaacuggagaaaaguagugcugcucauacccaggccacccugcuuuugcaggaaaaguaugacaguauggugcaaagccuugaagauguuacugcucaauuugaaagguauuuuucuugggagccugcacucuuaaauaugaugugugcagaaagggguguuuaccccaggaaauaugugagcaaagcagucacacaaaggaugauucauacuaguuuaaauuccauaaucaccaaccguaagugggcauuuagcauuaucugguaaucuuauuguauuuauauaauuccccuuuauaauuuauagaaauuccccuuucucaccauccacuucaacuuuuaugugcugagccaggugcggcagcauaugccuguaguccuagccacugcauaagcugaggugggaggaucaagucauguacuuagaagcauuuggugcuucugcccuacucucuugauguuaucauuuucauaaagaauucagaaguuuuuaucucuugcuaaaccuauaaagagacccacauuuauacucauccuaucuucccaccuauuacagaugaaauguccuagucuuuuaaucuucagugaccucauucuaucauuuuguuuucucauaauuugaaaccuuuuuacuggaauuuuuccaaucaauauuaaaacauguuaauguacaucugucuguaaaauauauuaauuagcuggccacuguggcucauaccaguaaucccagugcuuugggagaccaaggcaggaggauugcuugaggucaggaguuugagaccagccugggcaauagaguaagaccuuguuucuacaaaaaaaaauauuaagaauuagccaggcauuguggcacaugcuacuugggaggcugagggcaggaggaucaccugagcccaggaguuccaggcugcacugagcuaagaucacaccacugcgcuccagccugggugacagagcaagacugucucaaaaacaaacgaaaaauaaauaaaauacauaaguuguuuuaaauacuucucugacccuaacuuccuuuuguagcugucucacaccaccagucauucccuucuuaaccccaaauucuacuccuuuucaguccuuuuccuucuccuccuuuuucuucucuugacagagaagauugucucuauauccacuuccucaccucccaugccuucuacuuauuuucuccuuaaauaaaaaguuuauuuuggguggaacuacaaauuacaaaggccaauauaaugaauaccuauauauuaauguuaacauuuuuauuuaucacauuuacuuuagcucauuuugggggagaguuuccuuucuuuuauuuaauaaauacaaaagaaugcauaacauguacauaaacuguagagcuugaagauaaaacugacaugcaugaaccuauaaaagacaaccaguaagccaaaagauuuucaacaacuuaguauccauauguaaguuccucugccaucccaugaaaaugggacagauaacacuguccugaagucuacacuaauuauuuccuugcuuuuuccccccuguguauuauaauuuuaugacacguauauccauacaaauaaugcauuauguaauuuuccuucuccuugaacuuuaccaaaaaaugucaucauaguauaugccguuuccugggacuuauuuuuucauucugcauuauguguguuuucaggauugaauuguguugucugaggcuaugguuuguugauagucacugcuaugaguauuuuauuguaugaauauaccacaacuuauuuauucauucuuuggacuuugaguuguuucccauuugguuaguuauuauuaguuauuuugugacuauaagaauacauguauguaagaauuucucuaaagccaaagguauaugaauguucaacucuaaaacuuaauaucaaaucacuuuccaaugugggaguaagaaucuacacucccacuaguguuguauaaguuuccauuuaucuucuuugccaaagcuuguuagacuucuuaaacuuugccaguguacuuaguguaaaauggcuucuuauuguggauaauucaucuuuccuuuuccauaaaaugcuuguuuaugacuuuuguuuauuugucuauaggguuaucaucuuuuccucauugauuuguagagguuuucuuuaucagccauauggguuacagguaucuucugccaguuuagcuuauuuuuuuauuuucuuuuugguuucuucugaugaguggaaauucuugauuucaauaugguuaaaauauuuaucuguauguggguacuuuugcuucucauuuaagaacuucuuucuaucucaagguguaaagauauucaaccaguuuucuucuaaaagucuuaaaauuucacuuuccauuuuuccaccuagaacugauuucuguguguguagcaauauagggaucaaauucauuuuuuguuuucccuauggacaaccaacugccuaguuuaauuuaauucauuaaauuguaccuuguuuccccagugaucuguucccacaugugauacauuaugacagacacauagauaaauaauuuauaaguguauauguuuuauuuauaauuuuuauuguaucagaacauauaaaucauauaaauauauguaaauuuuauauauauauauuuauugcuaauaucaauccuguaaaggaauuucccuucucguuaguuugaagaauagugcuucaggggguuuuuaucuauucugugauuuuagucacuauccauauacucguggcauuaaaauuuauuucaucaaaccagaccuuucuuuacagcuccauauucacauauccaguuacccacuugacaucuucaaguagauaucacacugucuuuuaauauuaaccuguccaaaccaacucuugauccuuccauugcuuucuaccccuagucucucauuguuuuuauuguaaucagugacaucaucuucccagcuuuucauucuguaaaucuuagagucauccuucaucauucucucuuccuuacccccaauauucagucuaucucuugaauuuuccuacucugcuuccaaaagagaucuugugucuuuccauugccagcuccuuagucuaagccuccuuuaucacucaccugggcugauaaauaauuguuuuggaguugauccuucaauuuuccauucuuuuccccugcccuaauccaucuuccucauagcucuagagugagcuacacauuuaauuaaacaccuuuuuauuuuauuuauuuguuuauuuugagucggaguuucgcucuuguugcccaggcuggagugcaauggcacuaucucaggucacugcaaccucccccucccagguucaagugauucuccugccucagccucccgaguagcugagauuacagguguccaccaccacgcuuggcuaauuuuuuguguuuuuaguagugaugggguuucaccauguuggucaugcuggucucgaacuccugaccucaggugauccacccgucucggccucccagagugcugggauuacaggcaugagccaccacgcccagccuacuuggacaccuuuaaugguucccgucuguccgccagguaagcccacugugcccugcggugaugacccucaugccaccagcuucugcuccagccuuucuuacucauuaggcucuagucucacuucuuauuuuuuaaauugugaguaauuuucaugcuugguaguugauuucuuuuccaucucuguaugcauacuuccugcaccuaguaggcacuugauuuuuuuuucuuugaauacacagcagaugccauguaaacucauuaguacuugccucagaacacugaauucuuaccuguguuaaaugcaugaauacauuaaaaacuuuuuaguuuuacuuagaaguauauaaaguguaaacuaaucaguuaugauugucauacgcaauaguuagaaaacuacuuugacuuuuuuuucuuuuuaauaagcuauaaagcguuaacagccagugagauagaagaucuuaagcuggagaacucaucauuacaggaaaaagcggccaaggcugggaaaaaugcagaggauguucagcaucagauuuuggcaacugagagcucaaaucaagaauauguaagguauauagagcaaauaauggccuuagaaccauuaagacaauuuaauguugaaagccagcuaguaacugucccuuggcuugcuuuuggccaucuuauacugcaaauuaagaauuuacucaguuaaaaaaugacacuucuugaagaguuccuugagguuuaaagaaaaaaaaaggaaaaauuaaugaaaguggcuauaaaauguuuagugaccucuucucucucaaaccaaaggaugcuucuagaucugcagaccaagucagcacuaaaggaaacagaaauuaaagaaaucacaguuucuuuucuucaaaaaauaacugauuugcagaaccaacucaagcaacaggaggaagacuuuagaaaacagcuggaagaugaagaaggaagguaaucuaugauuagaaccugagugccuuguuaacucaguuacgaugugauuuuuuaaauaacuauguuuuucucaauuuaauucuuccaugcagaaaagcugaaaaagaaaauacaacagcagaauuaacugaagaaauuaacaaguggcgucuccucuaugaagaacuauauaauaaaacaaaaccuuuucagguuugucaguuaggaguaaacuuacuuguguuuauuuuagggacucacuuuguucccuauuauagugaggacagugacucggguuuucugcaagaucauuuugcucugcacuuacagugccaauuuagcucacuauuaaagguuuauacauuuuauuaaauuaugcauaauuuuuucccacauuauugaaguauaauugacaaauuuaauugacauaauuuuuucaauggacccuuugugguuuaaaaaaaaacuuuguaauguggaacuuaaaaguuuggcucagagggcuugccugguaugagcuuuugauaauuaaccuauuuuaauuugugguaugacuuauugcaaauacucauuguuucucaauauacugaucuuuuaaaagaaaaaagaauaaaugcugauuuuggaacuuagaaguacaguauugguuauaaugugguaaucuaacugauacagauaaaacuggccagcuggcuuuuuuaccuuguuucuuuuccucuguuuuaaugaucuuuaaaaugaaaaauacaaaguuuaaaagauucucauagagaaucuauggagagcccugagaauaugugaacauaccuuguuuucauuuguguuuuuaauuuucuuuaguguuuaugguuuauaugaaacuaguaagaucaaacuguuuuaagucuuaacuuuauuuaaaaaaucuuuuucagcuacaacuagaugcuuuugaaguagaaaaacaggcauuguugaaugaacauggugcagcucaggaacagcuaaauaaaauaagagauucauaugcuaaauuauugggucaucagaauuugaaacaaaaaaucaagcauguugugaaguugaaagaugaaaauagccaacucaaaucgguuuguaaaaugacuuuucauuuuauuaaagauauuggaguggggguuauucuaacuauaauacuuaaauaaaaugaauaucuuugguaucagaaaaaaauaacuguuuauagaggaaaauugagcugugauuuaguggauuuauuuuagaguguugaccagaugggcauucaauguucuaaaguuuucuagcuaccuucuuaauauauugaaaauuacuugaguaauuggaugaauucauuaagcuuuacauaucuauuuccauuugcaaaacugcaaacuccuugauguaaaaccauaaagagaagcaguguucaaaaauauuugggcauuuaaauuuuuuaacauauguauugagauauaauugacaacccauacaauccacccauugaaaguggacaauucaguguuuuuuaguauacucacagauuugugcaaccaucaccauagucaauuuuaggacauuuucaucaccucaaaaugaaaccuuguuauccuuuuccuaacacucuccuaucuccucaccccaccccacccuucagcccuaagaaaccacuaaucuacuuucugucucuguugauuucccuauuguggaccuggcauauucauggauucaaauaauauguggccuuuuguuacuggcuucuuucagucaauuagcauaauauuuucaagauucaccuguguuguagcauggagaguacuuuauuuuuuuuauagccuaauaauucauuauguggguauaccacauuuuauuuauucguuugucaguugauaaacacuuguuugcacauuuuuggcuauuaugaauaaugcuaccauaaacauucauguacaaguuuuuguauggacauuuguuuuuuccugggacauauuauuucccugggaaauaauaggagggaaauugccagaucauuugauaacucuacauuuaaucauuucaggaaguaucagacuacauucagaugagaucgggugcguucagggugguauggccauagaaaggucaggcuguauucaaaaguggcucauaccaaucuauauucuacaggcgguguacgaggguuccaauuucuccacauucuuaccaacauuuguuauuaucugacuucuuuauccuagccauuguaguggguaugaagugguaucucauuaacuuaacuugcauuuucuuaauugguaaugauguuggucaucuuuucaugugcuuacuggccauuuguauaucuucaugaaagaaaugucuguuuauacucugcucauuuuuaaauuggauuauuagucuuuuuauuauugugagaauucuucaucaauucuggacacaagucucuuauguauuauuugcgaauaucuucucccauucugugcauugucuuuucacuuucuugaugauguccuuugacccaaaaaacuuuuaugacguccagugugucuauuuuuuuguuuguucguuccuugguaucuaucuccucugccaaauucaaggucaggaagauuuaccccuguguuuucuucuaagagauuuauaguuuuagcucuuacauuuagauuauugauugauuuugaguuaauuuuuguauguggugugagguaaggguccagcuucauucuuuagcauguggacaugcaauaguccccacacuauuuuuuaaagagaauauucuugccuccaguuaauggaguuagcauccaauuaaaaaaucauuuagacuguacauguauggauuuauuucuagacucucaacugucuuccauugaucuauacaucuauccuugugccaccacacugucuugauuacuguuguuuuguaguaaguuuugaaaucaggaagcgugaguccucuuuguauuuuucaauaugguuuugucuauucuggaccucuugcaauucuauauuaauuuuggaaucaguuuuucuacaaagaaaccagcugggauucugaugggaauugcauugaaucuguagaucaguuugggacauauuauuaucuucacuagguuaagucuucuaauacaugaauaugggauauuuuuccaauuauuuagaucucauuuaauuucuuucaacaauguuuuauaguuuucagaguauaaguuuuccacuucucuuguuaaauuuauuacuauuuuauucuuuuugauguuuuguaaaugaaauuguuaauuucauuuuuggauuguugauugccaguguauagaaauacaauugauuuuaauauauuuaucuuguauccugcacccuugcuaaacucauuuuaguucuaauaguuuuuuaguggauuccuuaggauguucuuauagaucaugucuuuugcaaauagagauaguguuacuuauuuuccaaucuggaugccuuuuauuucuuuuucuugucuaauaucucuggcuaaaaccuguaguauaauacaguguugaauuuagaaguaaugaaaauggauggacagccuugcuuuguuccugaucuagggggaaagcauucagucuuucuccaugauauaugauguuaccuguaugauguauauagcgugacauuauuagauguugauuuguuggccagccgagguggcuuacgccuauaaucccagcacucugggaggccaaggcagguggaucaccugaggucaggaguuugagaccagccuggccaacauggugaaaccucgucucuacuaaaaauacaaaaguuagcuagguguggcggcgggcgccuguaaucccagcuacuuggguaggagaauggcuugaacccagaagacagagguugcagugaaccgagauggagccauugagccugggagacaacagcgaaacaaucuaaaaaaaacaaagaugucgauuugucauagaugcucuuuaucaaguugaggaaguucccuucuguuuccuaguuuguugagcauuuuuauaugaaaggguaaugaauucuaucaagugcuucuucuauuucuauugagauuaucauguaauuuuuuuauucuguugauaugauguauuuuauuaauugauuuuuagauauuaaucuaaccuucugagauaaaucucacuugguuauggcauauaauuauuuuuauauguugcugagggguuuuuuucagccauauuccuaagauauacuggucuguagguuuucuuugcuuuguuuuuguuuuuuuaaugucugucucauuuugguaucaggguaauggugacaucacaaaaugagugagaaauguucccucuuuucuauguggaaugguuuuugaauaauugguauuaauucuucauugaaugugugguagaauuuauuggugaagccaucuggaccuugguuuuucuugugaauauuuuuugguuacuaauucaauaucuuuacuugauauaggcuuauucagauuaucucuuucuucuugauucgguuuucuucuugaguaguuuaugucuuucuauaaaugugccuaauuuguugguauauaauuguucauaguauuccuuuauaaucuuuuuuuuauuucuguaaggucaguaguaauggcuucucuuuauuucugauucuaguaauuugagucuuuuuuuuuuaaguuucuuucuuuuuuuaaauuuuuaguggagaaagaacuuuauuuuuuuguuugguuuuuggguuuuuuuagagacaggaucucacucugucaccaggcuagagugcagugaugcaaucacggcucacugcagccucaaccucccugggcucaggugauccucccaccucagccucccaaguagcugggacuacaggcgugcgccaccacauccggcuaauuuuucuacuuuuuguagagacagaguuuugccauguugcccaggcuggucuggagcuccugggcucaaggaaucuaccagcuuuggccucaaaaugcugggauuauaggcuugagccacugcaccuggccaagaacuuuucuuuuuuauaauuucaucuuuuauuuuagauguggggguacauaugcagauuuguuacaugggugcauugcaugauacugagguuuaggguaugacaggucccgucagccaggcaguaaggauaguacucaauaggugguuuuucagcccuuguuuaauggcugaaaaauccaacauccgauuacucucagacauuuuuucuccuuguguccaaauguauagguuauacuuuucuguuuauuggcaugccuuguaauuuuucauuggaaaguaaauuuuuagaucauauauuguagcauuucuggguacagcucccccuccuuuugggggcuuuuuauuugcuuguuugcuuaaugaguggcucaauuauuuuagggaaacauaucccacuaccuccccagaccccaacaguauugugccucugauguugcuguucagggagguacaguuuuaggugugcccacaauuacccugggaugacacuugcuuugguagggcugccuuccucucuuuccgugaacauagugacuguaaacuccaguagaugcuggcuccuugcuugauuauuugcaacagugccuuagggcauaaauugcucuauaaacuaauccaaucaaauucuggcuccuuuguagggauugcauacgagagcagugcuggauauuuauucugacuacagaagggcucgucccagcugucauauucccuaguuuucuccugcaaacuaacuagccuacuguucagccuguaucuuaaaucuccucccauuucucucucacuauaaccaccacuguucuuuaaugguuccccaaccuuuuuggcaccagggaccaguuuuguggaaggcaguuuuuccacagaccggaucacccagcuugugauggguuuauguggaugguuucaggauuaaaguguuccaccucagaucaugaggcauuagauucucauaaggagcaugcagccuagaucccucacaugugcauuucacaauaggguucacacugcugugagaaucuaaugccgcagcugaucugccaggagggggagcucaggggguaaugcuuaugcuuccuggcucaccacuuaccuccugcucugcagccggguuccuaacaggccuuggauggguauuggucuguagcccggagguuggggaccccugcuuuagagcacccuuaggcuucagcuucuccaagcucuguugcaggugaagucaguuccuuugaaaagaaaugaggagcucccuguuuuauggccuacuugucuuuuccgcccuccuuucccccucccccgacaauaucccugagccaggacuagagcugaaauuggggacaauggcaguuuucucucugagugacauccucugcccuaggagcugaguuuucaguggacuuguggggaagagaugaggaauagccucaggcccucuugaguaaccuccugguguagaaccaucccccucaugagccagagaaagagucaucggggcccagcauuuucaacacacugugcccaaggugagccccuguuccaugaauggggcugacuggaggaagggaucccccaccucacaauugcauuuguccaggauauaacugcagccacagggagcuggggacaaaaugagaaacucugauguccugguccuccugggagggaagcuucugacucggaguugggggaaaagagggcccugugcuuuuggcuguagccgucuggcguggacuuugccuugcuaagcugggagugggaagaggggaaggaguuuuggcuuaaacacugcagacucucuuuuucaccaaauuuuugcagauuuucuugaauagauguuucuucauuugcuauuuuucccuuaggucaauuuucagaggcuuuaacugguuaauauuuuauaacuuuuaguuucacuagggagcaggucagcagaacuuucaugcugucaugccagaaguccaucucagcaauuacuuuugaguugaacuuuuaucagaaaaauagcuuuguagcugaggaggggcaaggagauuuaaaagacuguaucuccuuugucacagcuguuucaugucauuuuguaauucagucuuaaagccugugucuaguagugauuuuugcuguugagugugauaauacauaaacaacuuuggaauuugcccgcaacauugguaacacauuucacugacauacucuuuaauaauuguuuauuaccuauuauuucuuuuuaccuaggaaguaucaaaacuccgcugucagcuugcuaaaaaaaaacaaagugagacaaaacuucaagaggaauugaauaaaguucuagguaucaaacacuuugauccuucaaaggcuuuucaucaugaaaguaaagaaaauuuugcccugaagaccccauuaaaagaagguaagacaugaauaaauguauaaaaguguccucuuccuuuggauuugcuuuuauagcauuuagcaagucauccauuuuaugaacugugaaaauuuguugacaccuucugauaaaagcaguucuuacugagauuguuguguacaaugacuguuuucuuccuccuucuacgcuuucuuuucuguauaccuggauucugccuguucuucaaggcaaaucucaaaucuuccuugaagcuuugcaugacuauuuugucccuguccacacaccccaaauuacucccucuauaauacccuuagcauuuuaaccuaaaugucucuuagguccuuaaucauuuucugauuuguaguuuuagagaaguaaauuucuuauuucuugacugugaauguuugucuuucacgauaaauuaaaguugguugaaaugauaaaucuaaaaauuaucuuacagaauauauugcuucaucugccuuaaagaagauacaaggccuguuuuuaguuuauaaugauggauaaauucguuuuaaucuagauuacuaauccuucuuuucaauaauucuucuaggcaauacaaacuguuaccgagcuccuauggagugucaagaaucauggaaguaaacaucugagaaaccuguugaagauuauuucauucgucuuguuguuauugauguugcuguuauuauauuugacauggguauuuuauaauguuguauuuaauuuuaacugccaauccuuaaauaugugaaaggaacauuuuuuaccaaagugucuuuugacauuuuauuuuuucuugcaaauaccuccucccuaaugcucaccuuuaucaccucauucugaacccuuucgcuggcuuuccagcuuagaaugcaucucaucaacuuaaaagucaguaucauauuauuauccuccuguucugaaaccuuaguuucaagagucuaaaccccagauucuucagcuugauccuggaggucuuuucuagucugagcuucuuuagcuaggcuaaaacaccuuggcuuguuauugccucuacuuugauucugauaaugcucacuugguccuaccuauuauccuucuacuuguccaguucaaauaagaaauaaggacaagccuaacuucauagaaaccucucuauuuuuaaucaguuguuuaauaauuuacagguucuuaggcuccauccuguuuguaugaaauuauaaucuguggauuggccuuuaagccugcauucuuaacaaacucuucaguuaauucuuagauacacuaaaaaucugagaaacucuacauguaacuauuucuucagaguuugucauauacugcuugucaucugcaugucuacucagcauuugauuaacauuuguguaauaugaaauaaaauuacacaguaagucauuuaaccaauuaauu

SEQ ID NO: 192221 - RNA, 6882 nt, Homo sapiens
gcggccucagaugaaugcggcuguuaagaccugcgugagugaaugggagggucgcgggugguuaguugagccggcuccggcggggaaggaggcgggcugcggcugcggcuggggcugaagcuggggcugggguugggggacugcccggggcuuagauggcuccgagcccguuugagcguggucucggacugcuaacuggaccaacggcaacugucugaugagugccagccccaaaccgcgcgcugcucgggaccuuagagccucugacucaggcuggaagauuugagagcuggauuaaguacuuguuggcucacgcccgugacuguuccgcuguuuagcucuuguuuuuuguguggacacuccuaggauagaaaguuugguauguugcuauaccuuugcuucucccaccuuccccaauaucuaauauguauuucucauucuuagaauaauccagaauggcuacucugaucuauguugauaaggaaaauggagaaccaggcacccgugugguugcuaaggaugggcugaagcuggggucuggaccuuguaaguauacaaggcugcagucggauacacugguauuguggacguggccuggagcuggacgagacauuuaguguacuuuuugggcaauuggagucguuuguuauugguccuuuuucauuuuuaauaucuuaaugagaugauuuaaggaaguuacugaaucucugcuauuaggccuaucauagccaugccacuaccaaaagugggggguggguuugggggugagaggucaaguuuauauacacaguauuuaaguuguacagguauuuugcugcuggaauauucuuaugguaagacuuuuucuucagcaaucaaagccuuagaugggagaucucaaguuucaacaccacguuuuggcaaaacguucgaugccccaccagccuuaccuaaagcuacuagaaaggcuuugggaacugucaacagagcuacagaaaagucuguaaagaccaagggaccccucaaacaaaaacagccaagcuuuucugccaaaaagguaaguguuggcuauaaagacacuguuuaaacacuuaagcacuuuugacucuuaaaaugacuauuggcaucauccuacguagcuuucuucccucugaguagaagggaaauagagguuagcaagcagaguaguggaggagacucagauuguccuuguggacuucuugguaccuugagauuggaaaucucagaugcagcuaaugcauauuuuugccucaugcauauuuuugccucaccuguccuucacuagugucgugaaacugguugguggugucuacuuacagauacauacugagagagagggugccuuaagagaaacugguuggugguauccacuuacagauacauacugagagagagggugccuuaagagguucuguugcugcuuuaauagcacaggugcugccauucucuuagccuuccagggcaagcagcagcuuguuaggugacaauuugcuagcauguugaucuucgugugagugugagucacaagcuacaggucuguguaucccagaugagaggacuuugcugugaaagaugacauuagcauguggauuaacacuuuauuugaauaacuguuuuguuuaauuugcauuaggaaacaacuagugaauuacauauagugcaacuuaggacaaagaugucuucuuuaaaaagugaauuaacuuaaagaaaaauauuaaauacaggaauugcaaagacauggcaaaaacaaugagacacagaaccgaagugugagaaccccauagggaauucuaggcaugcauaugugaggugagauaaagcaggaacaugccggcuuccauuguagcacccuucuauaguagacuguaguagaccugucaacuccagacuagaagauugcccaugguguuuauucuaaaguccuugacagugucuugcugccucuuacucaguguguguauuugaggaacacaaacuuguuuuuaauauuaaccaagcaaauaauuuaagguaacacuuguggaaaaaaucacacuccuauaagccaaaaauggcuuugaugauuagcuacuauccugggugauucaugcccauuuucuccucuguuagguugaauaauugcauugauuagcucugaauuaacugcauucuugaucacuuaugcugacaggugcugguacuuaaauuucagauuuuaacuuuugagucaugcuacucgaauuacauuugaaucauauuauuugaaguauauuuaggugcaauuaugaaaacuaaggauuauggcuucuuagaaggcagcaugaaauugacaaauuuaaaaacuaaucagcuaauaagacuuccacugucacuaacccauauuuucuuuggcuguucuagaugacugagaagacuguuaaagcaaaaagcucuguuccugccucagaugaugccuauccagaaauagaaaaauucuuucccuucaauccucuagguaguaucuuuugcaauugcgaaaagugcuuuuggccuuuaguuucuuaguauucagcucagcuguaacuuguuaugaauauaauauaugaccaaaaacuaugaugagacugucugaaucuggguugcuuuggacaaguguacuuguugauggaauuauuugcaagguaucaucuuaggucaggaggggaauaggaacaaagauguagaagacauuguuccugucuguaaaagcuuaucaccuagaggagguaagauguauucaugaacauugaauaagucccauuguggacagucuuucucacaaggcuuuuagaagugagcuuuaugucaaguugagcaaugccugagaguaauuugguaggauuauuucuuugguuugaaaaaucuacauaagacagugaagacauguuuuucaaauuucuucaaccugcuacauguaucugaaguauuuucuguuuuggaaacagcuuuucaagcuuuaauuuacucaaccauuucaggagaagcuacugugugucaggcauccuuagguccuggacacacuguuuaacaagaugggcccugccuaugggagcccauaauuugaagggaaagucagaugcuggacaagucaucucacugugagugagccagaaaaaacagcauuguaggucaaaguggugcaaagaucgugagguaggaaaagagacuaaagugguucuaggaaaaauacaggcaggguaaaggaggauacaggugaggugugggaucagaucagggagggccuuacggauuucugagcuggaucuuuuacccuuuuauuuagccaaagaggucauguaguuauuuuacuaauuugcauucagauuguucuggcuuuuagaaacuacaaacauuucuaugauuaguauucuugaaaugaucuuguuguaaguuugugaguacaucuggagggaaacuuugagaaggauugcugaguucaagggcuugugugauuaaguuuuaaaauuauaaaauguggugcauccgugcuaauaauuaccauucagccauugaggaaaaugagguagauuuaugcauauugaugaagaaugaagaccacaauauccuguguuacaggaaagagauauugcuaaguggcccuucaaaauaguguaaauuguuaaauccgucuacaguggaugaagaugucugcuuccuccagguucacuaucaauguuuuaaaacucuaaucuuuaucagaaaagaaauauuucauuguuuuaaauuuguuguguguauggugaacauauuugauuauuggccacuuacaguuuuucuuuuuuuauuaacuuccgguuuguguuuuucuuugauuaaagagcucuuuguagauaaaauuagcuccccuuauauugcaaacuucuuuccucuggagucuucugucuaugguuuccuuuacaauucagugguuuuaaguuaaauagucacauaucauucaauuccuuuuugacuucuggguuuuaccaggcuuguaaaagagcagacuaauucuugaguacuuaggcuuuagagaacuuucacaccuacggacaaagauaaggaaaaccaugauuuucuaaucuuuugagaaaacagcuccuugaagaaaauucaguguuaaauccuacuuuuguuacuguacagaaaaaucacuuuuuaaaaauaauugcuaagaaguaagguacuuggauuuuaagaaugaauguuaccuaacacaaugguucuccauuuuuuuuuguuuuguuuuaaagacccuuuuacacucuuagaaauuauugaagaccacuuuugcuugugugaucugcucuuuucuguauuagaaauuaagacugagaaacuuaagauauuuauucacuaaguaaucacauuacauuaauguaaauuuuuuuuuaacauaaaauauuuuuuguucuggaaaaguuuggagaagaauggcaugguuuauauuuuugaaaauuugcuuuauuuggcuuaauacaagacaacuggauucuuaucaaauucuauauucacucuuacaucuguuaaaauauacgaagaaaaccuggcuucacacagauacguuuuuaauagucuuuucagauaaguguggauagguuuuuuugccacuacacuaaaacccacaaguggcuguuucugaauauaaaauugcaauguggaaucugaaaccguaucaaugagcauuuuguaucuugacaguaaaauccauuggucuauuuugcacuuggaauguaucuuauauucuugcaucuaucuugcauugaccauucagaaauacugguucacugagauauguagauacccacauguugagaugcuuuauuauacaauaucaaaagcacauuaauaccacaacugaucucaucagaaaagucuaagcaccugucaagcuaaugacugcagauaaguuuuccaaaauuccuuuuuuuggccagaugcaguggcucacgccuguaaucccagcacuuugggaggcaaggcgggcggaucaccugaggucacgaguucaagaccagccuggccaacauggugaaaccccgucuguacuaaaaauacaaaaauuauccggguguggugggcgcaccuguaaucccagcugcuugggagacugaggcaggagaaucgcuugaacccaggaggcagagguugcagugaacggagauugugccacugcacugcagccuaggugaaagagugagacucugucucaaaaaaaaaauauucauuuuuuaauuuuugacaaaauuuuaacguuuuauauucugccauuggcaacaaaggcugucaguuuuccuugaggugauagacuucuuucauuccuuuaagaaaaagugugacaagcacccaggucugagugaccaugggauuucuugcaguuguuaauucaaguaaaaacaguauuccaggaaaauguucucuaguuuuagcuugcaacucauauaguugcacaaauccuuuuaaucguauuuugguguacaguggaagugcuuuauggcauacuucucauuuuaucacacagaacauuaaaaagacaucucaaggauggagagcuaauaaaauuaauacuuucuacugcauauggugaagugacaguaagugaaacuggcauuuuuaaacuacaagcgaagaaggaugcagaacagagagacugcuaauaugguuuacugucacugccuugauuuguguugaggcaccagcagcuuucuccaccgcugccuugguaccaucauuacaaaugucaacccaguggaaaaaggugugaauauugucuugaaaauaguuuugaccucauggacccccucaaagggucucagaccacaagggaucuacagcccacacuaagaacugcugcccugacaaaaacgcuuucucucuguaacagacuuugagaguuuugaccugccugaagagcaccagauugcgcaccuccccuugaguggagugccucucaugauccuugacgaggagagagagcuugaaaagcuguuucagcugggccccccuucaccugugaagaugcccucuccaccaugggaauccaguaagugagcaagugcccuucuggaagggcugcaaacaauuuguuucauaacacuuccauuaccaugggaagaguugugcgggaggugagccugugaguaauuucuguccuucaaaugacaaggauuaguuuucagaaaaauaaacuauucucgauuaauauugcuuuucagucccaaaugccccaguaaaauuguuauucuggaaacuggauagucuuacuacagccaaaagauuaauucucacuuacaucuucuuaggcuauaaguugaagcauauauaauaaacuugcuuggaaugaugauuccauguuauauccaaagcuaauauaagaucaaaacaccugugcuguagcauagacugacaauaacuucuuacugcagaaggucugaggucuucguuugaacugguagucaaagccaacauuauguuuucuguuuguucugaugugggauaauuuguccuaauaaguuacauuagugagacuguuaacucuuacuuuggucucuaagaacaauagagauucagauacuucuaaaacuuacuuccuaaugaaagucaauucuggggccacagacacauuccaaaaaaugugucaggaggggaugcaggugauugauuugacaaagggaaaaacaugaauuuuugauugacagcuaaugucuauguugauauggacaaugacucaaggauuugcagaaauuuuaauaagagauuccuguuuucuagaucuguugcagucuccuucaagcauucugucgacccuggauguugaauugccaccuguuugcugugacauagauauuuaaauuucuuagugcuucagaguuuguguguauuuguauuaauaaagcauucuuuaacaga

SEQ ID NO: 192222 - RNA, 32710 nt, Homo sapiens
uuacuagggcucaugagguuuuauuuuaaaaucaagagaaaacaacaaucaaauaugucuucauacaaacgcagcagaaaaauacaaauccuaauguuuuaaauggagaaagugggccaccaaggcaaaagugccauaaugcaguccugcuuuuuuuuuuuuagcauucaaacaaauuuuacaccagaacuaaacuauuucuuaauagaaaaaauaguaacuaggagcacuacauucuguguacauacuuuucuuuaguauguaaucuaaaaauuuaauagcacauaaaaaacugggcuaacuuucaaaaauaccccuaaaguauuuaaguauauguaaaauaauggagucugauucugaacaaauaauuuucuaauaaaaauuucaaaguucaaugguuccccuaagucuuaaagaauauuaucuacaaauuaucaguagcauucccuccuuuucugagcugcuguccacacuauuauacaacagaaacuacugcaccgcaaucacaugggcaggaagaggcaagggcuagacagaaaagacugcaucaaacucacguggugagauaaaagucauuauuucacuguccauaauaguuucugccuaguagugaacucucacauaguggccaauuauacgaagaucaacccacuaauugaacauagucacacacacacacugaagguuacuaugaagaaauucagucaaaagcagacacuuaacacagggcuuuaauguaacaccauuuaguaacaugacaaauugaaaagugaggaguacuuuguggauaagaaaauggaggaacacaucugauggagagugggcauuugacaacaauggaacagguaaccagcauguaaaaucaaaauauaagugucuuuuuaagagcugaaagcugcugcuggucauucauuaaugugucagacauuuaaucaggaugcuggaccuucaaaauaacugaaaaaagaaccaagaaaaggcguuuuuguuuucaacaaacuuuacuaaauaacccuggaaaggcaaugaacgaucugacaauuuaagcucuaaugauuuaaagcucagcuagaagaaagugaggcaugacauauacugucaacggagggugaaggaggcagauuucuggaaaugcaaugaucccacacauuugcuucaaggagaaaccugcagacauauuuucaggucuugcuaaguaacaacuguuuauuuguaaucaauacauuugggaaagucugcuauguagcuaaggucacugugaccacagaacaacagaugaaaaggaaaaagcacugaacagcaagaaaaauacaucccauccucaaaagaauuuaagugaacaaacuuuaaaaagaaaaaaaaauagauacagccuucaucuuuuacaaauauauuuccuucccaauaucuucccaauauaaacacuguggaguguuuauauauucagugcaagaaacaguaucaucgguacauuugaaagccucuaaagaacaacugaagcuaaaauaauaucuaacucugaauacguuucaguguagaguaauaauaacauuauuacacuauaguggugugggagaggcucugauagcacccaucugcaucccgcaugaaaaaacaaaccuaagaucacuuuuuuaaaaauucuacaagccacguuaaaaaaaaauuugaacaggacugcuuuauuguguaauuuaugacacaacuguuacaugaauugcaaaugaaggcuuaaaauauauagcagcuacaaaaaaaaucagauaacucaugcuucaugucacuccucccacaaauacuucuagucuguucaacugcagucaauucuguauugguuugccugugaauuagacuucucaagucuuuacacagaguaaaagaaauggauaaaaaucaaaguauuuuucuguacuuuguaucaauguauucuauucuguacuuugacccuggaaagguaugggucugcuuaaaagaaagaagaaacauacacguaaucacaauaaagcuuaacauuaugcagggcuuauaaucauuuucagcaacggacugcaagcugcacugugaagaaaaugcauagcagaggagaaagcuggggaucugaggaaauagguaaggaaaacagugucaacacacaguggaagaagugaugaagacaucuauuccggagcucacgugccaugcccugcuagcauuccuuaacaagccaccugcuccagaaggccacagccugacccucccaaguggaauauaaaugcccaagugccacaugaagccaccuccuccacuaccuaaaaagcugucugggaacugagcuacagaacacacacacuuucuggucuaacaaacaucaagugaaagaauuuuuucuuauauaucuauuuuuaauacaacuuaaacgcaacuuuuauaugaauuugggcuucuauucagucccucuccucaauuuccuuaggaggaacucaauaauggaagcaaacaaaacaagauucuaaccacaaaugacugcacuuuaaacguaauuaucaauuuugagggacagaggugugaauguuuuacaauaccaaacuuuaaaaaaaaucuauuauaaaaacugcaacucaucucccuaacauuuuuaaauggugguauuauguuugcacaaacagauuaauacauuaaauuaagccaagaucuuaaagacuggcaaaguucuaucauucuauuuuaaaaacaaagauguuaaaaaaaaaaaaguuaguuugcuucauguuacauuucacaaccauuauguuaaauguuuucuuuucuacagaaacaggguccuuuauaucacaacugcaaguauuuacugcuagauguuuaaaguuacacagacuaguguucaacuggagccugcugauggugaugucuugaaguuuucugaaugucaaccuaaggugugccagguccucuccuaggaccacucuugcaggggaggagggagaagaaaucacagaucaagcucuuaagauuguuucacucucuucguggcuuucuguuucuuggugaucuguucaaaauuucauccuccuauugauugaaaagaaauucauuauaauuagcacauuuaaaaaauaauaaaaguucaccauauuuucaagaucagccagacugaggguaacuuauuugaggaaaaaaaugaggaaaaugaugagaagaaaaugcaccaagaagaaugguugucucagaggugguggaauuaugccuacucuaauucaguuuagucuuuauuguuuucuauaaacauacacuuuucucaaucuaacccauaaacauuuucuuaaaaaaggaucagacacugugauuucuuaaucuugcuuaaucccaaacaaucuacuggccuauggcacacuagccccauucugaggauaagaaaccaaggauucaugaagauggaaggcuauccaaguagacugacuccaaggcugcugcucuguacucuaucacaaguugcuaagauuguaaauuacccuaugaaaauauucccuuuuuuuaaaugcaccagcaacuuuuuaacgugugagggaguuugggggaaacauggucucuacuuuuaagaauugcauucuaguuaagacagaacauauccauggaaaauauacaaaagauacagauagcaaugaucuuuauuaauaggaaggcagaguuguagcugaaaguaaaaccugaggagagcuuuccgggagagaccagauuuagacacagaggugcuggguaaaggacuuuaguaagcaaugguacauacagacagugacuguucccuuucucucauacucuauauauccaaucuaccacaaaaccaagauccagaucuccaacuaguucucauacccucuguuccucuccugucacccuuuguggggccaccguaucuuuccuagaugauuacagggaccuccuaacuggucgcccugauucucccugguauauaggaaacacagcagacacagucaucauccugugacaccuguguccaguagccugugauggcugcccgcuucacuaggagggaaagccaaguccacacaacagccugucuaaccuggagccuucuccacccuucuuuucuccacucucucuguccacucaccauacuggccuuguagacaaccacuuuaggccucaauacuggcuguucucugugccuggaaugcucuucccacuuacauccccauggaaaaguucucuaccucuuucaaguguuugguucgaugucaucuuucgaguaagguuuuaacauggugacccgccuaccucuagcacuuuuaguaucuuuuccuguuuuaauuauucaucguuucuuacuuccuaauacgcuguguuguuuacuuccuuaaaauguuuacugcucauugccuguuucccccaaguagaauuuaagcucccuaaaggcagaguaucuuugucugucuuacucacugacaaugccuggcacaaaaugggcacucaacaaaugucaguuaaaugaaugaaugaacccaucuauggacaacggggacaaaaaguuuagaacacagugauuuguauaagaaauacuuuucagggcacagugaggagaggcaaauagacuguuaaugacccgaaguuuccuucuuagcaagcauuuuauuuucccccuauaaccuucugcuuauuucagaaaaugauuuucagcuaaaaagauacuucugagauuaauauguagcuuaaaauuaucaaacaaaacacugaccuguaucacaaagaaucccacuucaacaaaauuggcuuuaacagaauuuuuacugccauaagccacuguaaacuacccuauuaaaauauucccuuuacauaaauguaccuucagcuugguaaaacaaaaugugugaccccuuuccuuuaccucugcuuuagguuuucugucuuccuccucuugacugacagugccaccaucuucuucagcaucacuuuucuguuucucuucuaagacagaaguuaaacaacugagcaaaaccuuauuauuuuuggugauuauauauuagcauuagaacacaucucuagaucuacaauuuuuuuuuuuuuuuuuggagacagagucuugcucugucgcccaggcuggagugcaguggcgcgaucucggcucacugcaaacuccgccucccggguucacgccauucuccugccucaguguucugaauagcugggacuacaggcgccugccaccaugcccggcuaacuuuuuuuauuuuuaguagagacgggguuucaccguguuagccaggauggucucgaucuccugaccucaugaucuccucgguggccucccaaagugcugggauuacaggcgugagccaucgcgcccggccacuauuuuuuuugagaucgacuuugcuugucacccagguuggagugcaauggcaugaucucggcucacugcaaccucugccuccagguucaaguggaucuccuaccucagccuccggaguagccgggauuacaggugcccaccaccacgccuggcuaauuuuuguauuuuuagugaaacgggguuucaccauguuggcgaggcugaucucgaacuccugaccucaggugauccacccaccuuggccucccaaagugcugggauuauaggcgugagccaccuugcucggccaacaauuuuuuuuuuuuuuugagacucagucucgcucugucgccaggcuggagugcaguggcgcaaucucggcucacugcaaccucugccuuccggguucaagugauucuccugcuucagccucccgaauaggugggacuacaggcgcccgccaccaugccuggcuaacuuuuuuauuuuaaguagagacggggcuucacuguguuggccaggauggucuugaucucuugaccucgugauccacccaccucggccucccaaagugcugggauuacaggcgugagccaccaugccuggccaacaauuuuuuuuuuuuuuuuuuuuuugagacagagucuugcucugucacccaggcuggagugcaguggcccaaucucggcucacuguaagcucugccuucccagguucacgccauucuccugccucagccuccugaguagcugggacuacaggcaccugccaccaugcccggcuaauuuuuguauuuuuaguagagaugggguuucaccauguuagccaggauggucucgaccuccugaccucgugaucugccugcuucggccccccaaagugcuggaauuacaggcgugagccaccgcaccuggccaacaauuuuuuuuuaagagacaggaucucgcugggucugguggcucacgccuguaaucccaacacuuugggaggcccaggugggagaaucgcuugaaucugggaggcaaaggcugcagugaaccgagaucacaccacugcacuccagccugggcaacagggccagaccauaucaaauaaauaaaucaauaaacaaacaaacaaacaaacagcugagcaugguagcgcaugccuguggucccagcuacuuggaggggugcugagguaggaggaucacuugaaccuauaaggucaaggcugcagugaacugugacugugccacuguacuccaaccugagugacagagugggaccuugucuuaaaaaauaaaaaagagagagagagagagacagggucucacucuguugcucagcuggagugcaguggcacuauccuggcugacuacagccuuaaacuccugggcucaagugauuuuccugcuucaaccucccaaagugcuaggauuacaggcuugagccaccacgccuggcuaaaaacaauccuuaacuugacuguaaagguuuaacaacaucguagggucuuggcuuaaagcagauuuucuggacucuguuucuuaccaaguuucucuucuccuuccuccuccucaucucccuuguccuuuuccucuuccuucucuucuuccucuuccuucacauccgguugaggugcaucaguuuucuuauacuccauaccacuggucuguuucugaaauguuccccaaaguacaauuuuguuuacauguucauguauuauguuauauaauuccugaaugccuacaggcaaaguucuguuccaggcuguauacagggauagauauacagaaacgaauaggauguaauuccuacccugaagagcguguauguacguguguguaugcacaugugcuuguguguuucaagguagaacaauaaaaacaaaagggccaggcaggaaaauaaaggucaaaaaagucaaggugacugaggcaccgauacacagaauaguggcagaggcugaggcuggaaaaggaacuugggauccaguuacaaagugcuaugaaugccagaugaagcauaauccucauuuagcagaaguagaguccaaaauaagacuuucuuuuuuuaugauagcaugcaaaaaaaaaaaggcuaaacaagaaaaacuaacaauaaggcugugguaccccaacauacuguuuugagaguggggaaggugaaggcagaauggauaaugaggaaucaaagacugaauuacaaagaauagaaauagcuaugccagcaggcaaagcugauuauugcccaaguggcuaguuugguaucuaaguuuauuguuuuuuuuuagaaaguugcugccgaacacuauggagaguaacagauuaggauaaauaauaauagcaaccaaggggcuauaaauccugcucccaucugggcacaauaaacggccacugaggaacaguaaguaagguuucugaagucaacaccaaacauggcuuggucauuacugagccacuacaaagaaaaccucaggcaacauaucuuaguuauuuuuaauaaucacuagagugaugucucuaaaauugauucuaaaaaaaaaaacuuccuaccuuuccagaacagcagaagaggauaaccaggaacacaggaagggcuacaguuagaauauagacuacccacagccacgggcgcucuucagcugccucgaucaucugccccacaacgccuggcugaaaaacaagacagggcugauugaaaguuccagcuuuugacaccaaacauaggccgugcuguuuuucugcaguucaguuauggcauggcacuacgcaggaccuucuuuuucagagaaaaugcucauaaaauguaaaaaagaaauuagagaaagccuccauccucuugcucuccuuauaaucaagaugauuucacucucauaggugcaaaagcuggcuucuacaucaccugcaaaaggcucccuuaaccucaggauccagugaauuucuuaucucaguaucccuggcucuccaauucuuaaaucggccacaugaccaguuguuugaaaauucuguauguaguguaaaccgagauucaacauauaagaguguauuaaaauauagccuaaaugacaaauuucgaaauauauacccagacaaauaauaaaaaaaaaacccugaacacaaacagacucuaaagccacuacauuagacuaaugaaaucaugccccaaaacccaauauugugucuuuugcaggcauaugguuauacuuuuuaugccaauauugccaaaugaagaaaaaaaaccuuaacacagacuuucacaaaauaacagcuccuuacaauaacagacacaaaugcacaagcagcaaacacgaaccucagcagccccaucagcagcuuucuucaggccccauccaucauuggcccaaucaucaacuauucuucgaucagcacaaaugauaaaguugucaaaaaaaaugucagaggucauggaccacagcuccaaaccaauagcacuaaaaggagucauucugaaagguuccagaucuucaaagaaaucuggauuugguauuuuccuggguuuccagauucccuagaaaaaaaaauguuucagaaaaucauuucagauaaugaucaacaaaaguuuauggugaaucuaccguaagagaaauuuugcaugaacaauggagagaaaugccaacuucaugaaacuugaaauaagcaacaggaaaauaaauaacaaaugcuacagauuauuuuacgcacucugccucuaagacugcaggauuccaacuacuuccaauuucuacugucacccaugaccuugguccaaaccaaccccucaaguuccuggcccauucaacagccuccacucuuagcaacugcuaaugagagugggagcauaagucaguacguacuucuucaguggugauuuaaaauaaaacgcacaugaucaucaaccagcaauucacuucuagauaacuaccuagagaaauacucacaacauacacccagacauguacaaggauuauuacagcagcagugacucugaaagcaaaagugacaauccaccuaaauggccaccaacaggagaacaacuaaagggcaacuucuuuuucacuguaacuucugccuccuguguucaagugauccuugugccucagccucgugccuaagcagcugggacuacaggugugugccaccauaccaggccaauuuuugugcuuuuaguagagaugguguuucacuauguuggccaggcuggucucgaauggcugaccucaggugauccacccaccucagccucucaagugcugggauuauaggcgugagccacuacgcccagccuaaagggcaacuuuuuuaaaguaaaacuuuuaucuuauuguuugacuacacaauuaaaaauacauucacauaacaucuuuaacgacuaugaggaaaaaaauaaaaaauuuacaaacagaaaaacauauauuaguauauguauauauacauauacuaugccaagauccugcugaaauguuuucacaguaucagaccagcuucuccuguuucuguauauguauauacauauauuaguauuuguauauaaauaaaguagaaauuaaugauuauaaauaauuuuaauugccacucuuuguagagauuauaaauaauuuuacuuggcuagaaagauaaaaggaacaaaggucugaggguguacauuuuugcaugaggccuaaagccucacaaccuuacuacuuguauccuuaccaucucuuuugggccucagucuuuuuauaguugcaagcauugaggccaagcagugagcugacuugauguagucaagaugcugacucaaaccacaguccucuacccaccacaucacagauuguccagacucagcuguggauccuauggcugaagcaacccuagcacccaagagcaggguacccaaaucaacaguuuuccauuucucuuuuguuuuuaaauauaguuacaaagcaacuaugaaaguuauucuuggcugggcacaguggcucccgccugaaaccccaggacuucgaaaggcgaaggcagguggaucaccugaggucaggaguucgagaccagccuggccaacauggcgaagccccgucucuacuaaaaauacaaaaaaucagccaggugaggugagcacaccugugagcacaccugugcucccagcuacucgggaggcugagucaggagaauugcuugaacccaggagguggagguggcagugugccgagacugagccauugcacuccagccuggccacuagagugagacucagucucaaaaaaagaaaguugaccagaugcaguggcucacgccuguaaucccagcacuuuaggagguugaggugggcggaucgcgaggucaggaguucgagaccagccuggccaacauggugaaacaccaucucugcuaaaaauauaaaaauuagccaggcgugguggcaggcaccuguaaucccagcuacucgggagucugaggcaagagaaucgcuugaaaccggaaggcagagguugcagugaggcgacaucacaccacugcccuccagccuggguagaagagcgaaacuccaucucaaaaauaaauaaauaaauaaauaaauaaauaaaguuaaagaaaguuauucacuccaguuucuagguuuaucuuugcaauaccuaacccauuaagcucucuuucaacuuaggaagucuacuuucugcuuuuaauucaacagcuugaauauaaugaccaaccuggcagccuuacucuagauaaaacuucuaucugaauacaaacagauuaaugaaagcaacucaaccaucaagaggcacaaaccugguaacugggauugucaaucauaggaggcuuccauuugccuuuauaauugggguugucaaucacaggucgcugccagacaccacauccaggagcugacucacaucuaggguuggcaaucugaggagccucccauucuccauccaugucuucaucccuacggagguacaaacaacaaauuauaaacagguucugugaugcaggacuaugaacagcuggcuggcccagggcugccaagauccugcugaaauguuuucacaguaucccagaccagcuucuccuguauuuccaguaauaacaguuuuucaggaaaaauuuauuuuuuaaaaaagaagaaaauauaauuaaaauugucaaauucuacccugaaauuagggaacuuggcuauauuuaaguauuaagauugacuucaauaaaaacagguaacuuaugcugggugugguggcucacgccuguaaucccagcacuuugggaggccaaggcagacagaucacuugaggucaggacuuugagaccagccuggccaacacggugaaaguccgucucuacuaaaaauacaaaaaauacaaaaauuugccgggugugguggcacacaccuguaaucccagcuacucgcaaggcugauggaggagaaucacuugaacccaggaggugaaaguugcagugagccgaaacugcgccacugaacuccagccugggagacagagugagacuccaucucaaaaaaaaaaacaaacaaaaaaaccagguaauuaaaaaaaguuaacugaaguucuuaccaauccucagguuucucugcgucuggaucagguacguacucaggcucaucaucuaaccagccuucggguuuuguggccucuucaucuggaaucuuagcaggggcaucuucaucccuuaaauacaaaagaaaaagccaguuaugacaacacuggucacaguauaguaccacuuuguggaucagaacagaguauucuaaaaaaauuuguuuuuaaucucaaaauuuaaaauaauuccucuuagaaaauacuuguaaaucauauaucugcuaagggccuaguaaaauaacucuuuacaacucaauaauauaaagacaacccaauuuaaaaaugggcaaaugauuuuaauagacauuucuccaaagaagacauacgaauguaaaaauauacaauaugaacauacaauaagcacacgaaaagaugcuuaacaucauuagccaucagggaaauggcaaaucaaaacgauaccacuuaguaccaaguuggcucuaauaaaaaagacucauaaaaacaaaugcuggaaagaacgcagagaaacugaaacccucauacacugcuggugggaaaguaaaaugguacugcucauuuggaaaacaguuuggcaguuucucaaaaaguuaguuaccacaugacccagcaauuccacuuuuagguauauauacccaagagaaaugaaaauauauaucuauagcuagacagaguggcucaugccuguaaucucagcacuuugggaggccaaggcaggaggaucacuugaggccacaccagccugggcaacaaggugaaacccagucucuaguaaaaaaaaaaaaauacacaaggccaggugcgguggcucacaccuguaaucccagcacuuugggaggccaaggcggguggaucaccugaggacaggaguucaagaccggccugaccaauaugacgacacccugucucuaccaaaaaauacaaaaauuaagccagguguaguggcucaugccuguaauccuagcacuuugggaggccaaggugggcagaucaccugaggucgggaguuugagaccagccugaccaacauggagaaaccccaucucuacuaaaaauacaaaauuagcugggcgugguggcacaugccuguaaucccagcuacucaggaggcugaggcaggagaaucacuugaaaccgggaggcagagguuguggugagccaagaucacgccacuacacuccagccugggcgacaagagcgaagcuccgucucaaaaaaaaagaaaaaacaugcacagccaggcacgguggcacacgccuguaaucccagcacuuugggaggcugaggcugguagaucacuugacaucagaauuuugagaccauccuggccaacauggugaaaucccaucucuacuaaaaauacaagaauuuuuuguaguagugcgcgcuuguagucccagcuacuuggagggugaggcacgagugcaguggugcacgcuuguagucccagcuacuugggaugcugaggcacgagaaucguuugaacccgggaggcagagguugcaaugagacgagaucgugccacugcacuccagccugggugacaaaacgagacucugucucaacaaacaaacaaaaaacccauaaaaauuagccaggcgugcauaccugcagucccagcuacuugagaagcuaaggcgggagaggaucgcuugaccccagaaaguggaagcugcagugagccgugaccguaccacuguacucccaccugggcaacacagagaucaugucuaaagaaaagaggccaggugugguggcucacgccugcaaucccagcacuuugggaggcugaggcggguagaucaccugaggucaggagaucgagaucagccugaccaacaugguaaaaccccgugucuacuaaaaauacaaaaauuagcugggugugguggcaugcgcuugugaucccagcuacuugggaggcuagggcgggagaaucacuugaacucgggagacagagguugcagugagccgugauggcgccacugcacuccagccugggcgacagagcuacacuccaucucaaaaaaaaaaaagcaagaaaagaaaaaacauauuuauguaaaaaccaguacaugaacauucauagcagcauuauucauaaucacagacaaaaaggagcaaacaaccuaaauguccaccaaaggauggauaaauaaaauguggcauuaucaaaacaguagaauuuauucaaucauaaaaaggaaugcaguacugauacaugcuucaacacagauaaaccuggaaaacacugugcuaaaugaaagaaacuggacagagaaagccacauacuguaugauuccauuuuauaugaaauauacaaaguggacaaauguagagaggcagaaagcagguuagugguugcugggaguugggggaggaaacagggaguggccgcuuaauggguacaggggccuucuuaggugauaaagcuaguuaaggaauauaauacugaacaaggcuaaguccaaaucuaauauacaccaaauauacaaguaaacuuggcauuuauacuagugcaguacaaaaguucaguuauauguaucuuaccuuucaaggaggaaaaagauaaucuagaauguaauugcuaagcauaggaggauauuuuacaaaggguaagaauuucuuuguucacuuucugacauuucuggagucacugugugaaguugcaaguucaaagacagccauauacaagaauacagccccagcuaucuucauuucuccucacucuucaaugugcacccuacauaaaaggccauguaauuucucccucgcaugucaagcucauugcugcuccucuacuucugcauacgacauucuucaaucagaaacaccccuucccauauucaccaacuccuuaauucucaccucacugccaagucucaaucugauuugccuugcuccaagaaaccaugccuaguuuagguacaccuggugcucuggucuccuguggcaccuucucaugaacccuuacgauaccacaugccaacaucaugccucacaacuggacuucaagcucuguguaggcagauggugguguccuuguggcuuuguauucuaccacccaacccacagcagagaauugacuguuguuuaaauaggaaaaagguuauuuuucaaauuaaaauuuagcauuucagaacuuuggcuuuaaaugugaguucacagaagcccuggaguagccagguuaaaggaccugagauucugccacaaaccaacagugucaccacagacaaacucuuaucaaguguggcauucuguggcuuguaaaauggugagucaauccagaugauuacacuauggccccuuuccagcuauaguacucuauauuuucccuacagauuagacugcaucauggauuacugaaauuaucagagcuuacucaaccaacauuucguuguucaagccacauggaauauaugaaaugcucccuuacacuugaagacaguuccccaagacucaccagucaucuggcuugacagcuucuggaucugggauuuuuggucuuucaucccaauccucgggcuuccggucuucuggguccucaauuucacgugaaggauuuacaggaggagucaugucauugagcagauuuccacuauucaccacagauuggucaaccaguauuucaaaacuauuaucuggauucaagacugaaagaaacauuaaauggaauuaaaaguacuuaauuuuccaagcucccuuuaccauaauacaaaagaucaugacuucuaacgugaagcagcagaagucugaccugaggcuuugggguaagaacaaugccuggcuccuggggucuuggggaagcuaacgcccauuuccuuaugcacgaaacauaaaugauuagucccucggcuuucuaagaauuacagcaaaugauaguuaaaaucuuuaacaccaaagacuugacuuauagacacuaaaaaaaaaaaacaaaaaaaacaagaaacuacauaaacuaacacaauuauugggcuuacacauauacaccagugagaagacaaauacguggacuuacaacuacuucccaguacaaaagguccauuucuucauuuuuaauagagcugguauuauuacguuacugaaauuacacaaaccuccaauuuauuaaaacgcauguccacucaugauucuacuuucuacuuuuuaacucccauggagaaugaaaaaacaauuuuaaauccauaaaagcauuuuuuaaaauuuuauuuuauuuuuuugagacagagucucgcuuugucucccaggcuggagugcaguggugugaucucggcuaacugcaacgcccgccucccagguucaagcgauucuccugccucagccuccgcaguagcuggaacuacagacggccccgugccaccaugcccagcuaauuuuuuguauuuuaaguagagaugggguuuugcaauguugcccaggcuggucucaaacuccugagcucaggcaaucugcccaaccucagccucccaagguguuaagacuacaggugugagccaccgugcccagccacaugggccccauaaaagcaucuuaagugugauguauauuaaagcccagauuccacaccuagauaucuaauacacaggagacugaguuacagcacauccaaacaaggaauccuaugcugcugugucagugauaaugaaaaugaauauuucugugaggaagaacuucacacucuuuuguuguuaagaaacgggugugguggcucaugccuguaaucccagcacuuugggaggcuaacgcagguggaucacuugaggccaggaguucgagaccagccuggccaacauggugaaacccugucucuacuaaaaauacaaaaacuaggugggcauguuggugcacaccuguaaacccaacuacuugggaggcuaaggcacaagaaucgcuugaaccugggagguggagauugcaguguuucugucucaaauaaaaaagggccgggcgcaguggcucacgccuguaaucccagcacuuugggaggccgagacgggcgaaucacgaggucaggagaucgagaccauccuggcuaacacggugaaaccccgucucuaccaaaaauacaaaaaauuagcccagcgugguggugggcaccuguagucccagcuacucgggaggcugaggcaggagaauggcgugaacccgggaggcggaguuugcacugagcggagaucgcaccacugcacuccagucugggagacagagcgagacuccgucucaaaaaaaaaaauaaaaauaaauaaaaaaauaaaaaaguuagauauagcauguaaaguuguauauguguauauacacauauugacaaauauauaucacaaugcugauguuuaagauaauuuuaagugacuucuuuguguauguuuuuauugacauaucguacuuguacauauuuucgggguacgugugauauuuugauacauguauauaauguguaaugaccaaaucacagucauuggacgggcccaguggcucaugccuauaaucccagcacucugggaggcugaggcaggcccaucauuugagguugggaguucgagaccagccugaccaacauggugaaaccccaacucuacuaaacauacaaaaaaauuggccgggcaugguggcgcaugccuauagucccaacuauucaggaggcugaggcaggagaaucgcuugaacccgggaggcagaaguugcagugagcugagaucaggccacugcacuccagccugggcaacagagagagacucccaucucaaaaaaacaaaaagaacaaaacaaaacaaaacaaaacaaacaaaucacaguaauugaaauaucuguaaccuuaaacauuuaccuuuucuuucuauuuuauagagacagagucucauucugugacccacgcuggagugcaguggcccaaucauagcucacugcaaucucgaauccuggacucaagggauccuuuuauaccacagccucccgagcaccugggacuagagguacaugcuaccaagccugaauaauuauuuuuuuguaggaacaaggucucacuaugcugcccgggcuggucuagaacuccuggccucaagugauccucccaccucagccucccaaaagcgcagggauuauaggccugagccacugcaccuggcuccauuuacuuuuucuuuguauugggaacaguacaauucucuuccagcucuucugaaauacaccauaaauuguucuaacuauaauuucccuacuguacuaucaaauauuagaauuuauuccuucuaccuuauuucuguaccaauuaaccaacuugucuucaaccccucucccucgcuuuaaguguuuucuuuuugcuuacuuauggcuucugaauuucuauaccuuaaauauguauuacuuuuggaaauaacaaaaaaagguuaagcugggcucaguggcucacgccuguaauccuagcacuuugggaggccgaggugggcggaucaacagauggccaagaguuugagaucagccuggccaacaaggcucuacuaaaaauacaaaaauuaguuggacaugguggugugugccuguaaucccagcuacuggggaggcugagacgggagaaucacuggaaccugggaagcggaggcugcagugagccaagauggcgccacugcacuccagccuggaugacaaagcaagacuccgucacaaaaaaaagaaaaaaagguuguuauauucuaggcuggguacagugacucacaccuguaaucccagcacuuucaggagcugaggcgggcagaucacuugaggucaggaguucgagaccagccuggccaacauggugaaacccggucucuacuaaaaacagaaaaauuagcuggaaaaaaaaaaaaauaauaauaauaaaaaaaagaaaaauuagcugggcaugguggcacaagccuguaaucccagcuacucaggaggcuguggcaagagaaucgcuugaacccgggaggcagacgucacaguaggccaagaucacgccacugcacgcccaccugggugacagagcaauacuccgccucaaaaaaauuaaaaagguaguccaggcgcgguggcucacgccuauaacccagcaguuugggaggcugaggcgggcagaucaccugacgucgggaguuugagaccagccugaccaacauggagaaaacccaucucuacuaaaaaaaaaaaaaaaaaaauuagccaggcgugguggcacaugccuguaaucccagcuacuugggaggccaaggcaggagaaucgcuugaaugcaagaggcagagguuguggugagccaagaucacacaauugcacuccagccuggggaacaagagugaaacuccaucucaaaaaaaaaaaagguuauuauauucuucagaaagaggcaugccuauuuaugaucucaaacuagcaggaaaagcuucaauaaacaaacaaaccaaaaaaaacccuguaucaaaaugauucaacucaauugucaauuguccagguauuggagcauccaaauaaguucaacuacaagauacuucugaaaaacuauuuuuauuggauuuauguauaauuauaaauauaacuuauucuauuauucaacauuucucaacaacaacaacaaaaaaaaggaagaaauuagaucagcaaagcucuuuguagaaaaaaaaaaaaaaaacaccuuuuuuuuuggagugggggacggagucucacuguguugcccaggcuggagugcaauggcaugaccuuggcucaccgugaccuccgccucccggguucaagugauucuccugccucagccuccugaguaucugagauuauaggcgcccaccaccccacccggcuaauuuuuguauuuucaguagagaugacguuucaccauguuggccaggcuggucuugaacaccugaccucaagugaucugcucgccucagccucccaucgugcugggauuacaggcaugagccaccauguccagcaaaaaauaccaauuuuuuuuuuuuuuuuuuugagacagagucuuccugucgcccaggcuggagugcagugucacaaucuggcucacugcaaccuccgcuuccaggguucaagcaauucuccugccucagccuccugaguagcugggauuacaggcacccuccaccaugcccggcuaauuuuuguauuuuuaguagagauggggcuucaccauguuggccaggcuggucuuaaacuccugaccucaggugauccgcccaccucggccacccaaagugcugggauuauaggcacgagccaccaugccuggccaaaaacaccuauucuauucuuaaaauuaucucgaaccucaguuccuguggaaaagaaguuuuuuggguuuuuuguuuuguuuuuugagacagcaucucacuuugucacccaggcuacagugcaguggcaagaucauggcucacuacagucucgacuuccugggcucaagcaauccucauaccucagccuccugaguagcugaaacuacaggcacaugccacuauacucaguuaauucuuaagauuuuguagagacagggucugacuauguugucaggcugguuuggaacuccuggacucaagcaauccauccgauucagccucccgaaguguuaggauuacaggugugggccaccauacguggccaagaagcuucuuuuaaugcugacaaauuaaggucauuucccaacuaagauacuaaagugaagagauucuuuucuuucguggaggggguacagaaucuuccucugccacccaggcuggagugcagugauacaaucuugacucaacugcaaccucugccuccuggguuaacguaauucugcugccucagccucccgaguagcuaggauuacaccagcuacucaacaccacgcccagcuaauuuuuguauuuuuaguagagacgggguuuuaccauguuggccaugcuagucucgaaugccugaucucaagugauccgcccgccucagccucccaaagugcugggauuacacgcaugagcaaccauaccaggcugagauucuucuuguuuggaggcugggguacucuccagauauacaaucuuuuuuuuuuuuuuuugagauggagucuugcucugucuccuaggcuggagugcaguggcgcgaucucggcucacugcaagcucugccucccggguucgugccauucuccugccucagccucccaaguagcugcgacuacaggugcccaccaccacgcccggcuaauauuuuuguauuuuuaguagagacgggguuucaccauguuagccaggauggucucgaucuccugaccuugugauccacccgccucggccucccaaagugcugggauuacaggugugagccaccgcgcccagccuuuuuuuuuuuuuuugagauugagucucacuuucgcccaggcuggaaugcuguggcacaaugaucuuggcucccucccagguucaagcaauucuccugccucagccucccaacuagcuucgguuacaggcgugcaccaccaugccuagcuaauauuuguauuuuuaguagaggugaaguuucaacauuuuggccagacuguucucgaauuccugaucucaggugaucugcccaucucggccucccaaagugcugggauuacaggcgugagccacagugcccggccagauauacaaucuuuaaauuaaauggaugauauauauguaauaccauaagcccccaaacuaaugcuuuuucuuacuuaguguguaaagauguguuuucuuaucaguaaaauaggucuucagaucugcaucuggccucuuagcauguuuuucuucauagauacccguuuugggguuuuugugucggaagaugaagugcaguuuauaguccucuccacauuuaucuggaccaaacauaaucguauaaggggucuugucauggaacugauccuucaaaaacaaaaaaggauuauuugaagucacuguacucaaaguguucaaaagcaacguuucaaaaguguaugauaauuccucuuauaaaauuccaaauauauuagugacaguuaaaggaaaagcuaacuacaaguuuguuuaguaaaaaggaauaaccagcaaucaucaguaaauuuaaaauaacguuuaagugucuaaaaaaaaguaaugcacacaucuagacaguuauugcuuccucauaaaacaaagaaauaagcuugccaaaacuaaaacuuacacagaagcaaaaccagaaauucagauaaaaacaguugguaacaacuuuguaauuuacacuucaaauaaaaagcacguuagcgucaaagucaauuuucccaacucaucaaaagaguuaaacagcaggggaggaagccuuuauuuucacaauuauuacaaaauucucuuuuuuuuuuuuuugagauggagucucgcucugucgcccaggcuggagugcaguggcgcaaucucggcucacugcaaguuccgccucccagguucaugccauucuccugccucagccucccaaguggcugggacuacaggcgccugccaccacgccuggcuaauuuuuuguauuuuuaguagagaugggguuucaccauguuagccagauagucucaaucuccugaccucgugauccgccugccuuggcuucccaaagugcugggagcuaggauuacaggcgugagccacugcacccggcccaauuacaaaauucuuacaagguaauaguggguguccagccacauuccagaaaugggaauuacauaccagguugaguucugguguuuuagaaagcaguuucacauaggcaccaccacauucuauuccauuuuggaaauuaaccucauaccuaauaucagagagaaaagcagaaaacuguauggcauuuugaaagaucgaaacucucuuaauguauuuccucucucccucaucuuagucacguuuuaucauaggucaaauguuuacccuuacaaaggauuccaucuucuauuguuuuugaauaguuaucaaaugccacaaaaauaaauaaaauuaaauugaacauuaaugcagauuuccaguaaauuuguucugcaaaaucuacaaguuauuuagagucaggaaaaugaguaaccaguuucuuucaaaauaaugcauuaggcaggaaaaacuauuaauuacuaguuuuguaauuaauuaauuacaaaaacuauuaaugcagauuuccgguaaauuuguucugcaaaaucuacaaguuauuuagagucaggaaaauaaguaaccaguuucuuucaaaauaaugcauuagccaggaaaaacuauuaauuacaagguguuuaaauucacccaaaaaucccuaccaccacuuauauaaucucauaauuuuuuaacauagaguaaaaguuacauaaugucuucuaagauuacccuuugcagaaagcuuuuauccaacaagcauuucacuuacugaacaaugagaggcuuggugucaaacaggaagggcuuguucaguuuagcagagauggcaugaugcuuggcccgagacaucaacacaaguccuuuaucaccuggaagcuuugacuccuucauuuccucuaccucccacuuuccuacaagacaacacaaaaaaguuccacugcuuaacucuaccucugaagguccuuuaaaugccaaaaaaaacaccuccuaguugcauaaauauauuauacuggggcagccguggucgcucacaccuauaaucccagcacuuagggaggcugagggcaggcggaucacucaaggucaggaguucgagaccagccuggccaacauggugaaaccccaucucuaauaaaaacacaaaaauuagccgggcguggugaugggcaccuguaaucccaacuacucgguaggcugaggcaggagaaucgcuugaacccaagaaacagagguugcggugagccaagaucacgccacucuauuccagaagccuggguggcaagaaugagacuccgucucaaaaaaguaaauaaauaauaaauaaacacacuuuauuuggcaaauauuauucagauauggcuuuuuaaaacuguaguguauuauacuacugucuagaaauuuccaacauucaguagcacaggugauuaaacagaucuaauccuauuaaauauaaggcuacacaugcaccccugaaccuuaaauaaaaaaaaaaaaaaaaaaaaaauuaggcaacacacaaagguggcaaaacuuccauggaaaaaucuuuuuuuuuuuuuuuuuuuugagacggagucucgcucugucacccaggcuggagugcaguggcgcguucucggcucacugcaagcuuggccucccggguucacaccauucuccugccucagccuccccagcagcugggacuacagaugcacgcugccacgcccagcuaauuuuuuguauuuucaguagagacgggguuucacuguguuagccaggauggucucgaucuccugaccucgugaucugcccgccuuggcuuccgaaagugcugggauuacaggcgugagccaccgcaccuggcuggaaaaaucuuaaagccuacuauguccuuuuaaacuagucuuaggaaaugccauggagacaacaugucaaaccucuaucugcuauuauaucuaaaccaaaugggauucucaccaucauauuuggcaauuucaucaucgguaucgucuuucuuggcuuuggauaaaauccaccuguaaauaacaaaucccaaaaucagucuuaaaaugacaguugacuugugagggaaaauuauguaaauacucauuaaaguaggaccuauucugcucuuagccuauuuaaccacucuacuuccaaccuuuaaaucugucacacaacuaaugauaauacauuaucuucaacucacaaaccuauaugaaaaaguaccaaaccuaugagauaauuccacugauguuuuaacaucaagagaaaauuuuuuuccucaaucaaagaacaaaauauaggguagagugggggagggaaagaaguggaaguaaaaaccacaaauuccaaaagacuauuuuccugcauggauguuaacacugaagauauuaaagcuagaaauuucaggccaggugcgguggcucaugccuguaaugccaacaauuugggaggcuaaggcaaguggaccaccugaggucaggaguucaagaccagccuggccaacaugucaaaaccccaucucuacuaaaaaaauaacaacacacacacacaaauuagccagcaugguggcgcaugccuauaaucccagcuacuugggaagcugaggcaggagaaucacuugaacccaggagacggagguggcaaugagccgguaucacgccauugcacuccagcccaggcaaaagagcgaaauucugucucaaaaaauaaauaaauaaaauaaaauaaaguuagacauuucacuauaaaagaugcuauccaaaaaggaaucuacuaucccaucuuauuuacaugucugccucuaacauauauuucucuggaaaacacuuacccugacagaguuccucugucaaaagaaucagcaaaauauacuuccccuguuggaacuggagcuuuguaaguaaccuguguuaaauacauaaaugaauuaaaaauuuaaauuuucagcaacaugccuuuuuaucuagaaucuauucuccugguuugcuuucaacugucacaaaaauuucauagcuggccuucaaauucaacccauauaauuggccucuagcaagacaaaggcugccagagagaucaauaaguauuuucacgaauuuugcuuucccuuugaaaacguuccaaauuuaucuucaccauguuuuucuuuuauauuuuauuagagaugauaucucccuguguugccaaggcuggacucacacuccuguccuaggccuccugaguaguugagacuacauuucccugcacccggguaucuucauaauuuuaucaucucaagacguaaaaggaauagauucaaagaccauuucaaaccuugggagaugaaggaggagcagugguaucugguuuugagucuucuaccucuucaaugacaucgucaaggucauccucaauaucaaucacaucaucaucauguccaucaugagccucaacaauagcaguuccaagcaccaguaacauacacagcaaccacuucccuuccaugaucuacacauaaagagcaaaaucaguuaaauguauugccaccuaucaaacuucaugaagaucacuaaccacucucucauuuaaaauuaaagcuuuuaaaucgcagagcuaaaaagaacuuacuauuucauuucauagauaaagaaaggcagccuagagagauuaaaggguuucccuaaaaucaguuaaaagauuccauuucuggaaaauuucaaaauaaaacugaaacauacacaacauccucauauagagaggauugguuacacagauguggggcauucaaauacaauuuccaacaaacuuuugcauuuguaaagugcuuuacaacagacaaaagcccuuucauacacuaauuuacaggggguacccguuaaaacauuacaaugaaauaacagagauggccgggcgccguggcucacgccuguaaucccagcacuuugggaggccgaggcagguggcucacuaggucaggaguucacaaccagccuggccaacauggcgaaacucuucucuacuaaaaauacaaaaauuagcugggagcgauagcgggcgccuguagucucagcuacuugggaggcugagucaggagaacugcuugaacccaggagguggagguugcagugagcacgccacuacacucuagccugcgugacagagcaagaguucgucucaaaaaaaaaaauuaacacagaagauaauuccucucauauuaaggcuuaauauggauacgguugcucaaauaucaucaauagacauguuuucaaauuagcguuuuagaacucaaaaagaauauuaaacuaagaacaagcuacuuuuuaaaauuuauauauuuuauuuauuuauuuugugauggauucucccucugucgcccaggcuggagugcaguggcaccaucucagcucacugcaaccgccgccucccagguucaaguaauucucccaccucagccucuugaguagcugugauuacaggcacccaccaccaugcccggcuaauuuuuguacuuuuaguauagacaggguuucgccauguuggccaggcuggucucgaacuccugaccucaggugauccaccugccucagccucccaaagugcugggauuacaggcgugagccacugcaccuggccaaaacaagcuccuuuuuuuuuuuuuuccugagaugagucuugcucuaucgccaggcugggaugcauuggcacuaucuuggcucacugcaaccuccgccuccuggguucaagugauucuccuaccucagccucccaaguaggugggaugacaggugugcaccaccacauccagcuaauuuuuguuauuuuuaauagagacaggguuucaccguguuggccaggauagucucaaucucuugacgucgugaucugcccgccucggccuuccaaagugcugggauuacaggagugagccaccgcacccggcuuaucucuucuuuucuaaccacguaagcgcccuguguauuauauuagaugugucuugggguaguggcucucuuuccacggaggaccacagaucuaaagaaauaaaaacugagcuacacagaugcacaagaugaugugguugguagcagguaaauuuucauuuuugggcuugagaaaguacagguacaaggugggggagaaaacaaguagaagauacacaacuaaaaaugugugcgcacacacacacaagauguccuuuucuccucacauccucugcccacacagucacccaaucaaucauagucuuucacucuucuccauuacugacaucaggauacuuaauguuaccuuauauuaccagggccucuaguuuccuccuccucuuucaagcuauccuacaagaagacucaucacccaaaaacuaucaugaguccauguuugcaaaaauuucuaagucuuuuagcuaguaaucagcacccucucccucuauagcugcucuacaugcuauucccccaggaaucuucaacuuccucuauuaagaccuuauuucccagccuggccaacauaaacauagccugacccugucuauacaaaaaaaaaaaaaaauuauccugucucuacaaaaaaucaaaaaaagaaaaauuuagccagguaugguagcacacaccuguugucccagauacuaagaaggcuaagguaggagaagccugagucugacagguugaagcuaagugagucguugggcagggugggguggcucacgccuguaauccuagcacguugggaggcugguagacugccugagcucaggagaccagccagggaaacaugaugaaacuccguuucuacuaaaauacaaaaaauuagccgagugugguggcgcacaccuguagccgcagcuacucaggaggcugagggaggagaaucgcuugaaccugggaggcggaggaugcagugacccgagauggcgccacugcacuccagccugggccacagagacuccaccucaaaaaaaaaaaaaagacuccaccacuccaccaggcgcgguggcucacgccaauaaucccagcacauugggaguccaaggcaggcagaucaucugaggucaggaauucgagaccagccuggccaacauggcaaaacccugucucuacuaaaaauacaaaaauuagcugggcaggcugggcgugguggcucacaccuguaaucacagcacuuugggaggccgaggcagguggaucaccugaguucgggaguucaagaccagccugaccaccacggagaaacccugucucuacuaaaaacacaaaauuagcugggugugguggcagaugccuguaaucccaguuacucaggaggcugaggcaggagaauagcuugaacccgggaaguggaguuugcagugugaguugaaaucacgccacugcacugcagccuggccaacaagagugagacugucucaaaaaaauaaaaaauaaagugagcuguaauggcaccacugcauucaagccugggcaacagaguaagacugccuuaaacaaacaaacaaacaaacagaaaaagaaggcagaguuucagagauauuugcagacccguguucauagcaguacuacucacaacagccaacagucagaagcaacccaaguguccaucaauggaugaaugauuaaaccauauguggcauaggcauacaauggaauacuauucaaucucaaaaaggaaggaaaucccaucaccggcuauaacauggaugaacuuugaagacaauaugguaaguaaaauaagcaauucacaaacagauaccacaaaguuuuaaaaaagaaggaaggaaggaaaggagggagggagggagggaagaagggagagaaagaaagcugagcuuaauuucuggucuccugguuggcaucguggcucgcgcguguaaucccagaacucugggaguuggaggaagcaggaugaucgcuugagcucaggaguucgagaccagccugggcaacaaagcgaaguaucuaugaaaaauuaggaaaaaaaaaaaaauuagcugaguguagcgucauccgccuguggauccagcuacucaggagacugaggcaggaagaucacuugaaccaauaacagcaggaguuugagacugcagugagcaauaaccacgccacugcacuccagccugaugaagagcaagacccugucucuaaaaaaauaaguaaggcugagcgcgguggcucacaccuguaaucccagcacuuugggaggccgaggugggcggacugccugagcucaggaguucgcaaccagccuggacaacccggugaaaccccgucucuacuaaaauacaaaaaaccgggccgggugugguggugggcaccuguagucccagcuacuugggaggcugaggcaggagaauugcuugaacccaggaggcggagguugcagugagccaagaucacaccacuguacuccagccugagagggagacuccgucucaaaaaaaaaaaaaaaaaaaaaaaaaaaguacaucuguuggaguaacaaagaauucaaccaggacuuuccugaaaaguuuuaccaaaagcuguauagguuuuaacuguuuagguacuuuuauuauuuccuaggaguuauuauaaacggcguauucuauuugcacaguucauuacacuuuuuuuuuuguuuuuccugagauggagucucacucugucacccaggcuggagugcaauggaaccaucuccgcucacugcaaccuccgccuuccagguuuagugauucuccugccucagccucccgaguagcuggagguuaauuuucuguauuuuuaguagagacaggguuucaccauuuuggcgaggcugguuaccaacuccuggccucaaguaauccgcccaccucagccucccaaagugcucgaacuacaggcgugagagccaccgugcccagccaauucauuacacuuuuuaaaguaguuucauguucaccauuuuaucugccccucccaauugcccccuaaaggugaggaacccaggagacuucucauuccuauuuugaaguuacggaaaccaaagugggacaaaagcuaccacacugggccgggcgcaguggcucacgccuguaaucccagcauuuugggaggccgaggugggcggaucacgaggucaggagauugagaccauccuggcuaacacggugaaaccccgucucuacuaaaaauacaaaaacaaaauuagccgggcgugguggcgggcaccuguagucccagcuacaagggaggcugaggcaggagaauggcgugaacccgggaggcggagcuugcagugagccgagaucgcgccacugcacuccagccugagugacagagcgagacuccgucuaaaaaaaaaaaaaaaagguuaccacacugggcacacaauucaaguuucaugagccugcaauucaugcucaccaacugccacuucauccccuuaagcugucuuccagggcaaagagaacucuaacuaaaaggaugcaauagugugauugccaaaacggcagcaacgacuucugucaaaacacuuaucccuuguggcccugagaagauaaugcgcuaaaugaacuggggaguaaggauaguaaggugucggggaaugcugacagccauuugcagauaagucagaaaauuucuguugugcaacacugacccccacacacaguucacucgagcauucucaugauccaguuaccuggcuugugugugcacccuggcugaugcacaggagaacucccacauaguccuuuaccucugcucuaaguauaauuauaccaaauguacaacaguugauccauauggcaguugcuucuauucaugacccucaaacaauguugggaaaagacugagauacagaaugauuuuaaagaucaauaaaauucuucccccuuaaaaaaaucuacuuauuaaaaaauuaagcaaaaucuuccauuuccuaaaucagagguaaaaagacuuaacuaugguuaaucuuguccucucaaucuuuuaauauuaagcucaguuuaacuucccucaaccagcaaucacuugugucaugcccagcgguaauacacaaugcccgguuucuucuaucaccauaacugugaccucagguccugcgaaacaggacugaaccaguucacuaggauggcaguguauugguccaaaggcauucagauuauaauaacguaccgcaaugaucaucgagcaguuacuaaaugucggacuucccugucuuauuguauacauaucuuaauuuaauccucacaaauccaucggguauuauuauauccauuacuugacaagaacgggggcacaaaggguaagaaaacugccgaaguucacagagcaaccaaugaccaaucaaagacucgagccagggccuuagcguuaaccacugcacggucuaucccugaacuauaaucccagcaccaucaguacacuaaucgcaugaccuugggccagucauuucauaccuccaggccuccgguguggaaagagaugcacuuagaugagcuuucgggggcuuuccugcuuuuaacgcccugucccucuccaacuggauuacucgccuccagaauaggugcuguaacugcuaaguuucucaaccacugcguguucuccuucugguacauuccccuuucucuucagggaacuaggguccagucuccgcuuuggauuuucaaauauuaaacuguaacgcuaguuguaaacauucccucucggucuaauaccacccuucccuacuacuagggguaccuaguaggcccgauuccacccuauacuuuuacccaguuacuccagcccaccucgcggcugcccaggcagccggcaaagaggccuaagaaagcccuagaagcaaagccauaggaauaagucagcuuucccagaggucaaagaaggcugucgggccaccugccacgccucccgaccccggcggcgcggccugggcccgcaacccaaccaaagacgcccggauucgggccuccucgcucacggcgggcgcgucggccagggccugggcccucaagagccagcccgaccccucagucgccggccacgcccgaccccucagccgcagaggcgcucccagccccccgagguccucacaggcccgaggacgcgcucaggucuccccucucaccucuagccucccggggaccgcgggggugcccgugccccuucccgcccgcacaccuugccccgcgccgcaguaaagagagaggcggaggcggcccgaccgucacgugccgcagaaccaagaggccucggccaccgcugccgcgcgagcgagccccaccgcacgaagcccggcccu

SEQ ID NO: 192223 - RNA, 32710 nt, Homo sapiens
agggccgggcuucgugcgguggggcucgcucgcgcggcagcgguggccgaggccucuugguucugcggcacgugacggucgggccgccuccgccucucucuuuacugcggcgcggggcaaggugugcgggcgggaaggggcacgggcacccccgcgguccccgggaggcuagaggugagaggggagaccugagcgcguccucgggccugugaggaccucggggggcugggagcgccucugcggcugaggggucgggcguggccggcgacugaggggucgggcuggcucuugagggcccaggcccuggccgacgcgcccgccgugagcgaggaggcccgaauccgggcgucuuugguuggguugcgggcccaggccgcgccgccggggucgggaggcguggcagguggcccgacagccuucuuugaccucugggaaagcugacuuauuccuauggcuuugcuucuagggcuuucuuaggccucuuugccggcugccugggcagccgcgaggugggcuggaguaacuggguaaaaguauaggguggaaucgggccuacuagguaccccuaguaguagggaagggugguauuagaccgagagggaauguuuacaacuagcguuacaguuuaauauuugaaaauccaaagcggagacuggacccuaguucccugaagagaaaggggaauguaccagaaggagaacacgcagugguugagaaacuuagcaguuacagcaccuauucuggaggcgaguaauccaguuggagagggacagggcguuaaaagcaggaaagcccccgaaagcucaucuaagugcaucucuuuccacaccggaggccuggagguaugaaaugacuggcccaaggucaugcgauuaguguacugauggugcugggauuauaguucagggauagaccgugcagugguuaacgcuaaggcccuggcucgagucuuugauuggucauugguugcucugugaacuucggcaguuuucuuacccuuugugcccccguucuugucaaguaauggauauaauaauacccgauggauuugugaggauuaaauuaagauauguauacaauaagacagggaaguccgacauuuaguaacugcucgaugaucauugcgguacguuauuauaaucugaaugccuuuggaccaauacacugccauccuagugaacugguucaguccuguuucgcaggaccugaggucacaguuauggugauagaagaaaccgggcauuguguauuaccgcugggcaugacacaagugauugcugguugagggaaguuaaacugagcuuaauauuaaaagauugagaggacaagauuaaccauaguuaagucuuuuuaccucugauuuaggaaauggaagauuuugcuuaauuuuuuaauaaguagauuuuuuuaagggggaagaauuuuauugaucuuuaaaaucauucuguaucucagucuuuucccaacauuguuugagggucaugaauagaagcaacugccauauggaucaacuguuguacauuugguauaauuauacuuagagcagagguaaaggacuaugugggaguucuccugugcaucagccagggugcacacacaagccagguaacuggaucaugagaaugcucgagugaacugugugugggggucaguguugcacaacagaaauuuucugacuuaucugcaaauggcugucagcauuccccgacaccuuacuauccuuacuccccaguucauuuagcgcauuaucuucucagggccacaagggauaaguguuuugacagaagucguugcugccguuuuggcaaucacacuauugcauccuuuuaguuagaguucucuuugcccuggaagacagcuuaaggggaugaaguggcaguuggugagcaugaauugcaggcucaugaaacuugaauugugugcccagugugguaaccuuuuuuuuuuuuuuuuagacggagucucgcucugucacucaggcuggagugcaguggcgcgaucucggcucacugcaagcuccgccucccggguucacgccauucuccugccucagccucccuuguagcugggacuacaggugcccgccaccacgcccggcuaauuuuguuuuuguauuuuuaguagagacgggguuucaccguguuagccaggauggucucaaucuccugaccucgugauccgcccaccucggccucccaaaaugcugggauuacaggcgugagccacugcgcccggcccagugugguagcuuuugucccacuuugguuuccguaacuucaaaauaggaaugagaagucuccuggguuccucaccuuuagggggcaauugggaggggcagauaaaauggugaacaugaaacuacuuuaaaaaguguaaugaauuggcugggcacgguggcucucacgccuguaguucgagcacuuugggaggcugaggugggcggauuacuugaggccaggaguugguaaccagccucgccaaaauggugaaacccugucucuacuaaaaauacagaaaauuaaccuccagcuacucgggaggcugaggcaggagaaucacuaaaccuggaaggcggagguugcagugagcggagaugguuccauugcacuccagccugggugacagagugagacuccaucucaggaaaaacaaaaaaaaaaguguaaugaacugugcaaauagaauacgccguuuauaauaacuccuaggaaauaauaaaaguaccuaaacaguuaaaaccuauacagcuuuugguaaaacuuuucaggaaaguccugguugaauucuuuguuacuccaacagauguacuuuuuuuuuuuuuuuuuuuuuuuuuuugagacggagucucccucucaggcuggaguacaguggugugaucuuggcucacugcaaccuccgccuccuggguucaagcaauucuccugccucagccucccaaguagcugggacuacaggugcccaccaccacacccggcccgguuuuuuguauuuuaguagagacgggguuucaccggguuguccaggcugguugcgaacuccugagcucaggcaguccgcccaccucggccucccaaagugcugggauuacaggugugagccaccgcgcucagccuuacuuauuuuuuuagagacagggucuugcucuucaucaggcuggagugcaguggcgugguuauugcucacugcagucucaaacuccugcuguuauugguucaagugaucuuccugccucagucuccugaguagcuggauccacaggcggaugacgcuacacucagcuaauuuuuuuuuuuuuccuaauuuuucauagauacuucgcuuuguugcccaggcuggucucgaacuccugagcucaagcgaucauccugcuuccuccaacucccagaguucugggauuacacgcgcgagccacgaugccaaccaggagaccagaaauuaagcucagcuuucuuucucucccuucuucccucccucccucccuccuuuccuuccuuccuucuuuuuuaaaacuuugugguaucuguuugugaauugcuuauuuuacuuaccauauugucuucaaaguucauccauguuauagccggugaugggauuuccuuccuuuuugagauugaauaguauuccauuguaugccuaugccacauaugguuuaaucauucauccauugauggacacuuggguugcuucugacuguuggcuguugugaguaguacugcuaugaacacgggucugcaaauaucucugaaacucugccuucuuuuucuguuuguuuguuuguuuguuuaaggcagucuuacucuguugcccaggcuugaaugcaguggugccauuacagcucacuuuauuuuuuauuuuuuugagacagucucacucuuguuggccaggcugcagugcaguggcgugauuucaacucacacugcaaacuccacuucccggguucaagcuauucuccugccucagccuccugaguaacugggauuacaggcaucugccaccacacccagcuaauuuuguguuuuuaguagagacaggguuucuccgugguggucaggcuggucuugaacucccgaacucaggugauccaccugccucggccucccaaagugcugugauuacaggugugagccaccacgcccagccugcccagcuaauuuuuguauuuuuaguagagacaggguuuugccauguuggccaggcuggucucgaauuccugaccucagaugaucugccugccuuggacucccaaugugcugggauuauuggcgugagccaccgcgccugguggagugguggagucuuuuuuuuuuuuuugagguggagucucuguggcccaggcuggagugcaguggcgccaucucgggucacugcauccuccgccucccagguucaagcgauucuccucccucagccuccugaguagcugcggcuacaggugugcgccaccacacucggcuaauuuuuuguauuuuaguagaaacggaguuucaucauguuucccuggcuggucuccugagcucaggcagucuaccagccucccaacgugcuaggauuacaggcgugagccaccccacccugcccaacgacucacuuagcuucaaccugucagacucaggcuucuccuaccuuagccuucuuaguaucugggacaacaggugugugcuaccauaccuggcuaaauuuuucuuuuuuugauuuuuuguagagacaggauaauuuuuuuuuuuuuuuguauagacagggucaggcuauguuuauguuggccaggcugggaaauaaggucuuaauagaggaaguugaagauuccugggggaauagcauguagagcagcuauagagggagagggugcugauuacuagcuaaaagacuuagaaauuuuugcaaacauggacucaugauaguuuuugggugaugagucuucuuguaggauagcuugaaagaggaggaggaaacuagaggcccugguaauauaagguaacauuaaguauccugaugucaguaauggagaagagugaaagacuaugauugauugggugacugugugggcagaggaugugaggagaaaaggacaucuugugugugugugcgcacacauuuuuaguuguguaucuucuacuuguuuucucccccaccuuguaccuguacuuucucaagcccaaaaaugaaaauuuaccugcuaccaaccacaucaucuugugcaucuguguagcucaguuuuuauuucuuuagaucugugguccuccguggaaagagagccacuaccccaagacacaucuaauauaauacacagggcgcuuacgugguuagaaaagaagagauaagccgggugcgguggcucacuccuguaaucccagcacuuuggaaggccgaggcgggcagaucacgacgucaagagauugagacuauccuggccaacacggugaaacccugucucuauuaaaaauaacaaaaauuagcuggaugugguggugcacaccugucaucccaccuacuugggaggcugagguaggagaaucacuugaacccaggaggcggagguugcagugagccaagauagugccaaugcaucccagccuggcgauagagcaagacucaucucaggaaaaaaaaaaaaaaggagcuuguuuuggccaggugcaguggcucacgccuguaaucccagcacuuugggaggcugaggcagguggaucaccugaggucaggaguucgagaccagccuggccaacauggcgaaacccugucuauacuaaaaguacaaaaauuagccgggcaugguggugggugccuguaaucacagcuacucaagaggcugaggugggagaauuacuugaaccugggaggcggcgguugcagugagcugagauggugccacugcacuccagccugggcgacagagggagaauccaucacaaaauaaauaaauaaaauauauaaauuuuaaaaaguagcuuguucuuaguuuaauauucuuuuugaguucuaaaacgcuaauuugaaaacaugucuauugaugauauuugagcaaccguauccauauuaagccuuaauaugagaggaauuaucuucuguguuaauuuuuuuuuuugagacgaacucuugcucugucacgcaggcuagaguguaguggcgugcucacugcaaccuccaccuccuggguucaagcaguucuccugacucagccucccaaguagcugagacuacaggcgcccgcuaucgcucccagcuaauuuuuguauuuuuaguagagaagaguuucgccauguuggccaggcugguugugaacuccugaccuagugagccaccugccucggccucccaaagugcugggauuacaggcgugagccacggcgcccggccaucucuguuauuucauuguaauguuuuaacggguacccccuguaaauuaguguaugaaagggcuuuugucuguuguaaagcacuuuacaaaugcaaaaguuuguuggaaauuguauuugaaugccccacaucuguguaaccaauccucucuauaugaggauguuguguauguuucaguuuuauuuugaaauuuuccagaaauggaaucuuuuaacugauuuuagggaaacccuuuaaucucucuaggcugccuuucuuuaucuaugaaaugaaauaguaaguucuuuuuagcucugcgauuuaaaagcuuuaauuuuaaaugagagagugguuagugaucuucaugaaguuugauagguggcaauacauuuaacugauuuugcucuuuauguguagaucauggaagggaagugguugcuguguauguuacuggugcuuggaacugcuauuguugaggcucaugauggacaugaugaugaugugauugauauugaggaugaccuugacgaugucauugaagagguagaagacucaaaaccagauaccacugcuccuccuucaucucccaagguuugaaauggucuuugaaucuauuccuuuuacgucuugagaugauaaaauuaugaagauacccgggugcagggaaauguagucucaacuacucaggaggccuaggacaggagugugaguccagccuuggcaacacagggagauaucaucucuaauaaaauauaaaagaaaaacauggugaagauaaauuuggaacguuuucaaagggaaagcaaaauucgugaaaauacuuauugaucucucuggcagccuuugucuugcuagaggccaauuauauggguugaauuugaaggccagcuaugaaauuuuugugacaguugaaagcaaaccaggagaauagauucuagauaaaaaggcauguugcugaaaauuuaaauuuuuaauucauuuauguauuuaacacagguuacuuacaaagcuccaguuccaacaggggaaguauauuuugcugauucuuuugacagaggaacucugucaggguaaguguuuuccagagaaauauauguuagaggcagacauguaaauaagaugggauaguagauuccuuuuuggauagcaucuuuuauagugaaaugucuaacuuuauuuuauuuuauuuauuuauuuuuugagacagaauuucgcucuuuugccugggcuggagugcaauggcgugauaccggcucauugccaccuccgucuccuggguucaagugauucuccugccucagcuucccaaguagcugggauuauaggcaugcgccaccaugcuggcuaauuuguguguguguguuguuauuuuuuuaguagagaugggguuuugacauguuggccaggcuggucuugaacuccugaccucaggugguccacuugccuuagccucccaaauuguuggcauuacaggcaugagccaccgcaccuggccugaaauuucuagcuuuaauaucuucaguguuaacauccaugcaggaaaauagucuuuuggaauuugugguuuuuacuuccacuucuuucccucccccacucuacccuauauuuuguucuuugauugaggaaaaaaauuuucucuugauguuaaaacaucaguggaauuaucucauagguuugguacuuuuucauauagguuugugaguugaagauaauguauuaucauuaguugugugacagauuuaaagguuggaaguagagugguuaaauaggcuaagagcagaauagguccuacuuuaaugaguauuuacauaauuuucccucacaagucaacugucauuuuaagacugauuuugggauuuguuauuuacagguggauuuuauccaaagccaagaaagacgauaccgaugaugaaauugccaaauaugauggugagaaucccauuugguuuagauauaauagcagauagagguuugacauguugucuccauggcauuuccuaagacuaguuuaaaaggacauaguaggcuuuaagauuuuuccagccaggugcgguggcucacgccuguaaucccagcacuuucggaagccaaggcgggcagaucacgaggucaggagaucgagaccauccuggcuaacacagugaaaccccgucucuacugaaaauacaaaaaauuagcugggcguggcagcgugcaucuguagucccagcugcuggggaggcugaggcaggagaauggugugaacccgggaggccaagcuugcagugagccgagaacgcgccacugcacuccagccugggugacagagcgagacuccgucucaaaaaaaaaaaaaaaaaaaagauuuuuccauggaaguuuugccaccuuuguguguugccuaauuuuuuuuuuuuuuuuuuuuuuauuuaagguucaggggugcauguguagccuuauauuuaauaggauuagaucuguuuaaucaccugugcuacugaauguuggaaauuucuagacaguaguauaauacacuacaguuuuaaaaagccauaucugaauaauauuugccaaauaaaguguguuuauuuauuauuuauuuacuuuuuugagacggagucucauucuugccacccaggcuucuggaauagaguggcgugaucuuggcucaccgcaaccucuguuucuuggguucaagcgauucuccugccucagccuaccgaguaguugggauuacaggugcccaucaccacgcccggcuaauuuuuguguuuuuauuagagaugggguuucaccauguuggccaggcuggucucgaacuccugaccuugagugauccgccugcccucagccucccuaagugcugggauuauaggugugagcgaccacggcugccccaguauaauauauuuaugcaacuaggagguguuuuuuuuggcauuuaaaggaccuucagagguagaguuaagcaguggaacuuuuuuguguugucuuguaggaaagugggagguagaggaaaugaaggagucaaagcuuccaggugauaaaggacuuguguugaugucucgggccaagcaucaugccaucucugcuaaacugaacaagcccuuccuguuugacaccaagccucucauuguucaguaagugaaaugcuuguuggauaaaagcuuucugcaaaggguaaucuuagaagacauuauguaacuuuuacucuauguuaaaaaauuaugagauuauauaaguggugguagggauuuuugggugaauuuaaacaccuuguaauuaauaguuuuuccuggcuaaugcauuauuuugaaagaaacugguuacuuauuuuccugacucuaaauaacuuguagauuuugcagaacaaauuuaccggaaaucugcauuaauaguuuuuguaauuaauuaauuacaaaacuaguaauuaauaguuuuuccugccuaaugcauuauuuugaaagaaacugguuacucauuuuccugacucuaaauaacuuguagauuuugcagaacaaauuuacuggaaaucugcauuaauguucaauuuaauuuuauuuauuuuuguggcauuugauaacuauucaaaaacaauagaagauggaauccuuuguaaggguaaacauuugaccuaugauaaaacgugacuaagaugagggagagaggaaauacauuaagagaguuucgaucuuucaaaaugccauacaguuuucugcuuuucucucugauauuagguaugagguuaauuuccaaaauggaauagaaugugguggugccuaugugaaacugcuuucuaaaacaccagaacucaaccugguauguaauucccauuucuggaauguggcuggacacccacuauuaccuuguaagaauuuuguaauugggccgggugcaguggcucacgccuguaauccuagcucccagcacuuugggaagccaaggcaggcggaucacgaggucaggagauugagacuaucuggcuaacauggugaaaccccaucucuacuaaaaauacaaaaaauuagccaggcgugguggcaggcgccuguagucccagccacuugggaggcugaggcaggagaauggcaugaaccugggaggcggaacuugcagugagccgagauugcgccacugcacuccagccugggcgacagagcgagacuccaucucaaaaaaaaaaaaaagagaauuuuguaauaauugugaaaauaaaggcuuccuccccugcuguuuaacucuuuugaugaguugggaaaauugacuuugacgcuaacgugcuuuuuauuugaaguguaaauuacaaaguuguuaccaacuguuuuuaucugaauuucugguuuugcuucuguguaaguuuuaguuuuggcaagcuuauuucuuuguuuuaugaggaagcaauaacugucuagaugugugcauuacuuuuuuuuagacacuuaaacguuauuuuaaauuuacugaugauugcugguuauuccuuuuuacuaaacaaacuuguaguuagcuuuuccuuuaacugucacuaauauauuuggaauuuuauaagaggaauuaucauacacuuuugaaacguugcuuuugaacacuuugaguacagugacuucaaauaauccuuuuuuguuuuugaaggaucaguuccaugacaagaccccuuauacgauuauguuugguccagauaaauguggagaggacuauaaacugcacuucaucuuccgacacaaaaaccccaaaacggguaucuaugaagaaaaacaugcuaagaggccagaugcagaucugaagaccuauuuuacugauaagaaaacacaucuuuacacacuaaguaagaaaaagcauuaguuugggggcuuaugguauuacauauauaucauccauuuaauuuaaagauuguauaucuggccgggcacuguggcucacgccuguaaucccagcacuuugggaggccgagaugggcagaucaccugagaucaggaauucgagaacagucuggccaaaauguugaaacuucaccucuacuaaaaauacaaauauuagcuaggcaugguggugcacgccuguaaccgaagcuaguugggaggcugaggcaggagaauugcuugaaccugggagggagccaagaucauugugccacagcauuccagccugggcgaaagugagacucaaucucaaaaaaaaaaaaaaaggcugggcgcgguggcucacaccuguaaucccagcacuuugggaggccgaggcggguggaucacaaggucaggagaucgagaccauccuggcuaacauggugaaaccccgucucuacuaaaaauacaaaaauauuagccgggcgugguggugggcaccuguagucgcagcuacuugggaggcugaggcaggagaauggcacgaacccgggaggcagagcuugcagugagccgagaucgcgccacugcacuccagccuaggagacagagcaagacuccaucucaaaaaaaaaaaaaaaagauuguauaucuggagaguaccccagccuccaaacaagaagaaucucagccugguaugguugcucaugcguguaaucccagcacuuugggaggcugaggcgggcggaucacuugagaucaggcauucgagacuagcauggccaacaugguaaaaccccgucucuacuaaaaauacaaaaauuagcugggcgugguguugaguagcugguguaauccuagcuacucgggaggcugaggcagcagaauuacguuaacccaggaggcagagguugcaguugagucaagauuguaucacugcacuccagccuggguggcagaggaagauucuguacccccuccacgaaagaaaagaaucucuucacuuuaguaucuuaguugggaaaugaccuuaauuugucagcauuaaaagaagcuucuuggccacguaugguggcccacaccuguaauccuaacacuucgggaggcugaaucggauggauugcuugaguccaggaguuccaaaccagccugacaacauagucagacccugucucuacaaaaucuuaagaauuaacugaguauaguggcaugugccuguaguuucagcuacucaggaggcugagguaugaggauugcuugagcccaggaagucgagacuguagugagccaugaucuugccacugcacuguagccugggugacaaagugagaugcugucucaaaaaacaaaacaaaaaacccaaaaaacuucuuuuccacaggaacugagguucgagauaauuuuaagaauagaauagguguuuuuggccaggcaugguggcucgugccuauaaucccagcacuuuggguggccgaggugggcggaucaccugaggucaggaguuuaagaccagccuggccaacauggugaagccccaucucuacuaaaaauacaaaaauuagccgggcaugguggagggugccuguaaucccagcuacucaggaggcugaggcaggagaauugcuugaacccuggaagcggagguugcagugagccagauugugacacugcacuccagccugggcgacaggaagacucugucucaaaaaaaaaaaaaaaaaaauugguauuuuuugcuggacaugguggcucaugccuguaaucccagcacgaugggaggcugaggcgagcagaucacuugaggucagguguucaagaccagccuggccaacauggugaaacgucaucucuacugaaaauacaaaaauuagccgggugggguggugggcgccuauaaucucagauacucaggaggcugaggcaggagaaucacuugaacccgggaggcggaggucacggugagccaaggucaugccauugcacuccagccugggcaacacagugagacuccgucccccacuccaaaaaaaaagguguuuuuuuuuuuuuuuucuacaaagagcuuugcugaucuaauuucuuccuuuuuuuuguuguuguuguugagaaauguugaauaauagaauaaguuauauuuauaauuauacauaaauccaauaaaaauaguuuuucagaaguaucuuguaguugaacuuauuuggaugcuccaauaccuggacaauugacaauugaguugaaucauuuugauacaggguuuuuuuugguuuguuuguuuauugaagcuuuuccugcuaguuugagaucauaaauaggcaugccucuuucugaagaauauaauaaccuuuuuuuuuuuugagauggaguuucacucuuguuccccaggcuggagugcaauugugugaucuuggcucaccacaaccucugccucuugcauucaagcgauucuccugccuuggccucccaaguagcugggauuacaggcaugugccaccacgccuggcuaauuuuuuuuuuuuuuuuuuuaguagagauggguuuucuccauguuggucaggcuggucucaaacucccgacgucaggugaucugcccgccucagccucccaaacugcuggguuauaggcgugagccaccgcgccuggacuaccuuuuuaauuuuuuugaggcggaguauugcucugucacccaggugggcgugcaguggcgugaucuuggccuacugugacgucugccucccggguucaagcgauucucuugccacagccuccugaguagcugggauuacaggcuugugccaccaugcccagcuaauuuuucuuuuuuuuauuauuauuauuuuuuuuuuuuuccagcuaauuuuucuguuuuuaguagagaccggguuucaccauguuggccaggcuggucucgaacuccugaccucaagugaucugcccgccucagcuccugaaagugcugggauuacaggugugagucacuguacccagccuagaauauaacaaccuuuuuuucuuuuuuuugugacggagucuugcuuugucauccaggcuggagugcaguggcgccaucuuggcucacugcagccuccgcuucccagguuccagugauucucccgucucagccuccccaguagcugggauuacaggcacacaccaccauguccaacuaauuuuuguauuuuuaguagagccuuguuggccaggcugaucucaaacucuuggccaucuguugauccgcccaccucggccucccaaagugcuaggauuacaggcgugagccacugagcccagcuuaaccuuuuuuuguuauuuccaaaaguaauacauauuuaagguauagaaauucagaagccauaaguaagcaaaaagaaaacacuuaaagcgagggagagggguugaagacaaguugguuaauugguacagaaauaagguagaaggaauaaauucuaauauuugauaguacaguagggaaauuauaguuagaacaauuuaugguguauuucagaagagcuggaagagaauuguacuguucccaauacaaagaaaaaguaaauggagccaggugcaguggcucaggccuauaaucccugcgcuuuugggaggcugaggugggaggaucacuugaggccaggaguucuagaccagcccgggcagcauagugagaccuuguuccuacaaaaaaauaauuauucaggcuugguagcauguaccucuagucccaggugcucgggaggcugugguauaaaaggaucccuugaguccaggauucgagauugcagugagcuaugauugggccacugcacuccagcgugggucacagaaugagacucugucucuauaaaauagaaagaaaagguaaauguuuaagguuacagauauuucaauuacugugauuuguuuguuuuguuuuguuuuguuuuguucuuuuuguuuuuuugagaugggagucucucucuguugcccaggcuggagugcaguggccugaucucagcucacugcaacuucugccucccggguucaagcgauucuccugccucagccuccugaauaguugggacuauaggcaugcgccaccaugcccggccaauuuuuuuguauguuuaguagaguugggguuucaccauguuggucaggcuggucucgaacucccaaccucaaaugaugggccugccucagccucccagagugcugggauuauaggcaugagccacugggcccguccaaugacugugauuuggucauuacacauuauauacauguaucaaaauaucacacguaccccgaaaauauguacaaguacgauaugucaauaaaaacauacacaaagaagucacuuaaaauuaucuuaaacaucagcauugugauauauauuugucaauauguguauauacacauauacaacuuuacaugcuauaucuaacuuuuuuauuuuuuuauuuauuuuuauuuuuuuuuuugagacggagucucgcucugucucccagacuggagugcaguggugcgaucuccgcucagugcaaacuccgccucccggguucacgccauucuccugccucagccucccgaguagcugggacuacaggugcccaccaccacgcugggcuaauuuuuuguauuuuugguagagacgggguuucaccguguuagccaggauggucucgaucuccugaccucgugauucgcccgucucggccucccaaagugcugggauuacaggcgugagccacugcgcccggcccuuuuuuauuugagacagaaacacugcaaucuccaccucccagguucaagcgauucuugugccuuagccucccaaguaguuggguuuacaggugugcaccaacaugcccaccuaguuuuuguauuuuuaguagagacaggguuucaccauguuggccaggcuggucucgaacuccuggccucaagugauccaccugcguuagccucccaaagugcugggauuacaggcaugagccaccacacccguuucuuaacaacaaaagagugugaaguucuuccucacagaaauauucauuuucauuaucacugacacagcagcauaggauuccuuguuuggaugugcuguaacucagucuccuguguauuagauaucuagguguggaaucugggcuuuaauauacaucacacuuaagaugcuuuuauggggcccauguggcugggcacgguggcucacaccuguagucuuaacaccuugggaggcugagguugggcagauugccugagcucaggaguuugagaccagccugggcaacauugcaaaaccccaucucuacuuaaaauacaaaaaauuagcugggcaugguggcacggggccgucuguaguuccagcuacugcggaggcugaggcaggagaaucgcuugaaccugggaggcgggcguugcaguuagccgagaucacaccacugcacuccagccugggagacaaagcgagacucugucucaaaaaaauaaaauaaaauuuuaaaaaaugcuuuuauggauuuaaaauuguuuuuucauucuccaugggaguuaaaaaguagaaaguagaaucaugaguggacaugcguuuuaauaaauuggagguuuguguaauuucaguaacguaauaauaccagcucuauuaaaaaugaagaaauggaccuuuuguacugggaaguaguuguaaguccacguauuugucuucucacugguguauauguguaagcccaauaauuguguuaguuuauguaguuucuuguuuuuuuuguuuuuuuuuuuuagugucuauaagucaagucuuugguguuaaagauuuuaacuaucauuugcuguaauucuuagaaagccgagggacuaaucauuuauguuucgugcauaaggaaaugggcguuagcuuccccaagaccccaggagccaggcauuguucuuaccccaaagccucaggucagacuucugcugcuucacguuagaagucaugaucuuuuguauuaugguaaagggagcuuggaaaauuaaguacuuuuaauuccauuuaauguuucuuucagucuugaauccagauaauaguuuugaaauacugguugaccaaucuguggugaauaguggaaaucugcucaaugacaugacuccuccuguaaauccuucacgugaaauugaggacccagaagaccggaagcccgaggauugggaugaaagaccaaaaaucccagauccagaagcugucaagccagaugacuggugagucuuggggaacugucuucaaguguaagggagcauuucauauauuccauguggcuugaacaacgaaauguugguugaguaagcucugauaauuucaguaauccaugaugcagucuaaucuguagggaaaauauagaguacuauagcuggaaaggggccauaguguaaucaucuggauugacucaccauuuuacaagccacagaaugccacacuugauaagaguuugucuguggugacacuguugguuuguggcagaaucucagguccuuuaaccuggcuacuccagggcuucugugaacucacauuuaaagccaaaguucugaaaugcuaaauuuuaauuugaaaaauaaccuuuuuccuauuuaaacaacagucaauucucugcuguggguugggugguagaauacaaagccacaaggacaccaccaucugccuacacagagcuugaaguccaguugugaggcaugauguuggcaugugguaucguaaggguucaugagaaggugccacaggagaccagagcaccagguguaccuaaacuaggcaugguuucuuggagcaaggcaaaucagauugagacuuggcagugaggugagaauuaaggaguuggugaauaugggaagggguguuucugauugaagaaugucguaugcagaaguagaggagcagcaaugagcuugacaugcgagggagaaauuacauggccuuuuauguagggugcacauugaagagugaggagaaaugaagauagcuggggcuguauucuuguauauggcugucuuugaacuugcaacuucacacagugacuccagaaaugucagaaagugaacaaagaaauucuuacccuuuguaaaauauccuccuaugcuuagcaauuacauucuagauuaucuuuuuccuccuugaaagguaagauacauauaacugaacuuuuguacugcacuaguauaaaugccaaguuuacuuguauauuugguguauauuagauuuggacuuagccuuguucaguauuauauuccuuaacuagcuuuaucaccuaagaaggccccuguacccauuaagcggccacucccuguuuccucccccaacucccagcaaccacuaaccugcuuucugccucucuacauuuguccacuuuguauauuucauauaaaauggaaucauacaguauguggcuuucucuguccaguuucuuucauuuagcacaguguuuuccagguuuaucuguguugaagcauguaucaguacugcauuccuuuuuaugauugaauaaauucuacuguuuugauaaugccacauuuuauuuauccauccuuugguggacauuuagguuguuugcuccuuuuugucugugauuaugaauaaugcugcuaugaauguucauguacugguuuuuacauaaauauguuuuuucuuuucuugcuuuuuuuuuuuugagauggaguguagcucugucgcccaggcuggagugcaguggcgccaucacggcucacugcaaccucugucucccgaguucaagugauucucccgcccuagccucccaaguagcugggaucacaagcgcaugccaccacacccagcuaauuuuuguauuuuuaguagacacgggguuuuaccauguuggucaggcugaucucgaucuccugaccucaggugaucuacccgccucagccucccaaagugcugggauugcaggcgugagccaccacaccuggccucuuuucuuuagacaugaucucuguguugcccaggugggaguacagugguacggucacggcucacugcagcuuccacuuucuggggucaagcgauccucucccgccuuagcuucucaaguagcugggacugcagguaugcacgccuggcuaauuuuuauggguuuuuuguuuguuuguugagacagagucucguuuugucacccaggcuggagugcaguggcacgaucucgucucauugcaaccucugccucccggguucaaacgauucucgugccucagcaucccaaguagcugggacuacaagcgugcaccacugcacucgugccucacccuccaaguagcugggacuacaagcgcgcacuacuacaaaaaauucuuguauuuuuaguagagaugggauuucaccauguuggccaggauggucucaaaauucugaugucaagugaucuaccagccucagccucccaaagugcugggauuacaggcgugugccaccgugccuggcugugcauguuuuuucuuuuuuuuugagacggagcuucgcucuugucgcccaggcuggaguguaguggcgugaucuuggcucaccacaaccucugccucccgguuucaagugauucuccugccucagccuccugaguagcugggauuacaggcaugugccaccacgcccagcuaauuuuguauuuuuaguagagaugggguuucuccauguuggucaggcuggucucaaacucccgaccucaggugaucugcccaccuuggccucccaaagugcuaggauuacaggcaugagccacuacaccuggcuuaauuuuuguauuuuuugguagagacagggugucgucauauuggucaggccggucuugaacuccuguccucaggugauccacccgccuuggccucccaaagugcugggauuacaggugugagccaccgcaccuggccuuguguauuuuuuuuuuuuuacuagagacuggguuucaccuuguugcccaggcugguguggccucaagugauccuccugccuuggccucccaaagugcugagauuacaggcaugagccacucugucuagcuauagauauauauuuucauuucucuuggguauauauaccuaaaaguggaauugcugggucaugugguaacuaacuuuuugagaaacugccaaacuguuuuccaaaugagcaguaccauuuuacuuucccaccagcaguguaugaggguuucaguuucucugcguucuuuccagcauuuguuuuuaugagucuuuuuuauuagagccaacuugguacuaagugguaucguuuugauuugccauuucccugauggcuaaugauguuaagcaucuuuucgugugcuuauuguauguucauauuguauauuuuuacauucguaugucuucuuuggagaaaugucuauuaaaaucauuugcccauuuuuaaauuggguugucuuuauauuauugaguuguaaagaguuauuuuacuaggcccuuagcagauauaugauuuacaaguauuuucuaagaggaauuauuuuaaauuuugagauuaaaaacaaauuuuuuuagaauacucuguucugauccacaaagugguacuauacugugaccaguguugucauaacuggcuuuuucuuuuguauuuaagggaugaagaugccccugcuaagauuccagaugaagaggccacaaaacccgaaggcugguuagaugaugagccugaguacguaccugauccagacgcagagaaaccugaggauugguaagaacuucaguuaacuuuuuuuaauuaccugguuuuuuuguuuguuuuuuuuuuugagauggagucucacucugucucccaggcuggaguucaguggcgcaguuucggcucacugcaacuuucaccuccuggguucaagugauucuccuccaucagccuugcgaguagcugggauuacaggugugugccaccacacccggcaaauuuuuguauuuuuuguauuuuuaguagagacggacuuucaccguguuggccaggcuggucucaaaguccugaccucaagugaucugucugccuuggccucccaaagugcugggauuacaggcgugagccaccacacccagcauaaguuaccuguuuuuauugaagucaaucuuaauacuuaaauauagccaaguucccuaauuucaggguagaauuugacaauuuuaauuauauuuucuucuuuuuuaaaaaauaaauuuuuccugaaaaacuguuauuacuggaaauacaggagaagcuggucugggauacugugaaaacauuucagcaggaucuuggcagcccugggccagccagcuguucauaguccugcaucacagaaccuguuuauaauuuguuguuuguaccuccguagggaugaagacauggauggagaaugggaggcuccucagauugccaacccuagaugugagucagcuccuggauguggugucuggcagcgaccugugauugacaaccccaauuauaaaggcaaauggaagccuccuaugauugacaaucccaguuaccagguuugugccucuugaugguugaguugcuuucauuaaucuguuuguauucagauagaaguuuuaucuagaguaaggcugccagguuggucauuauauucaagcuguugaauuaaaagcagaaaguagacuuccuaaguugaaagagagcuuaauggguuagguauugcaaagauaaaccuagaaacuggagugaauaacuuucuuuaacuuuauuuauuuauuuauuuauuuauuuauuuuugagauggaguuucgcucuucuacccaggcuggagggcaguggugugaugucgccucacugcaaccucugccuuccgguuucaagcgauucucuugccucagacucccgaguagcugggauuacaggugccugccaccacgccuggcuaauuuuuauauuuuuagcagagaugguguuucaccauguuggccaggcuggucucgaacuccugaccucgcgauccgcccaccucaaccuccuaaagugcugggauuacaggcgugagccacugcaucuggucaacuuucuuuuuuugagacugagucucacucuaguggccaggcuggagugcaauggcucagucucggcacacugccaccuccaccuccuggguucaagcaauucuccugacucagccucccgaguagcugggagcacaggugugcucacaggugugcucaccucaccuggcugauuuuuuguauuuuuaguagagacggggcuucgccauguuggccaggcuggucucgaacuccugaccucaggugauccaccugccuucgccuuucgaaguccugggguuucaggcgggagccacugugcccagccaagaauaacuuucauaguugcuuuguaacuauauuuaaaaacaaaagagaaauggaaaacuguugauuuggguacccugcucuugggugcuaggguugcuucagccauaggauccacagcugagucuggacaaucugugaugugguggguagaggacugugguuugagucagcaucuugacuacaucaagucagcucacugcuuggccucaaugcuugcaacuauaaaaagacugaggcccaaaagagaugguaaggauacaaguaguaagguugugaggcuuuaggccucaugcaaaaauguacacccucagaccuuuguuccuuuuaucuuucuagccaaguaaaauuauuuauaaucucuacaaagaguggcaauuaaaauuauuuauaaucauuaauuucuacuuuauuuauauacaaauacuaauauauguauauacauauacagaaacaggagaagcuggucugauacugugaaaacauuucagcaggaucuuggcauaguauauguauauauacauauacuaauauauguuuuucuguuuguaaauuuuuuauuuuuuuccucauagucguuaaagauguuaugugaauguauuuuuaauuguguagucaaacaauaagauaaaaguuuuacuuuaaaaaaguugcccuuuaggcugggcguaguggcucacgccuauaaucccagcacuugagaggcugagguggguggaucaccugaggucagccauucgagaccagccuggccaacauagugaaacaccaucucuacuaaaagcacaaaaauuggccugguaugguggcacacaccuguagucccagcugcuuaggcacgaggcugaggcacaaggaucacuugaacacaggaggcagaaguuacagugaaaaagaaguugcccuuuaguuguucuccuguugguggccauuuagguggauugucacuuuugcuuucagagucacugcugcuguaauaauccuuguacaugucuggguguauguugugaguauuucucuagguaguuaucuagaagugaauugcugguugaugaucaugugcguuuuauuuuaaaucaccacugaagaaguacguacugacuuaugcucccacucucauuagcaguugcuaagaguggaggcuguugaaugggccaggaacuugagggguugguuuggaccaaggucaugggugacaguagaaauuggaaguaguuggaauccugcagucuuagaggcagagugcguaaaauaaucuguagcauuuguuauuuauuuuccuguugcuuauuucaaguuucaugaaguuggcauuucucuccauuguucaugcaaaauuucucuuacgguagauucaccauaaacuuuuguugaucauuaucugaaaugauuuucugaaacauuuuuuuuucuagggaaucuggaaacccaggaaaauaccaaauccagauuucuuugaagaucuggaaccuuucagaaugacuccuuuuagugcuauugguuuggagcugugguccaugaccucugacauuuuuuuugacaacuuuaucauuugugcugaucgaagaauaguugaugauugggccaaugauggauggggccugaagaaagcugcugauggggcugcugagguucguguuugcugcuugugcauuugugucuguuauuguaaggagcuguuauuuugugaaagucuguguuaagguuuuuuuucuucauuuggcaauauuggcauaaaaaguauaaccauaugccugcaaaagacacaauauuggguuuuggggcaugauuucauuagucuaauguaguggcuuuagagucuguuuguguucaggguuuuuuuuuuauuauuugucuggguauauauuucgaaauuugucauuuaggcuauauuuuaauacacucuuauauguugaaucucgguuuacacuacauacagaauuuucaaacaacuggucauguggccgauuuaagaauuggagagccagggauacugagauaagaaauucacuggauccugagguuaagggagccuuuugcaggugauguagaagccagcuuuugcaccuaugagagugaaaucaucuugauuauaaggagagcaagaggauggaggcuuucucuaauuucuuuuuuacauuuuaugagcauuuucucugaaaaagaagguccugcguagugccaugccauaacugaacugcagaaaaacagcacggccuauguuuggugucaaaagcuggaacuuucaaucagcccugucuuguuuuucagccaggcguuguggggcagaugaucgaggcagcugaagagcgcccguggcuguggguagucuauauucuaacuguagcccuuccuguguuccugguuauccucuucugcuguucuggaaagguaggaaguuuuuuuuuuuagaaucaauuuuagagacaucacucuagugauuauuaaaaauaacuaagauauguugccugagguuuucuuuguaguggcucaguaaugaccaagccauguuugguguugacuucagaaaccuuacuuacuguuccucaguggccguuuauugugcccagaugggagcaggauuuauagccccuugguugcuauuauuauuuauccuaaucuguuacucuccauaguguucggcagcaacuuucuaaaaaaaaacaauaaacuuagauaccaaacuagccacuugggcaauaaucagcuuugccugcuggcauagcuauuucuauucuuuguaauucagucuuugauuccucauuauccauucugccuucaccuuccccacucucaaaacaguauguugggguaccacagccuuauuguuaguuuuucuuguuuagccuuuuuuuuuuugcaugcuaucauaaaaaaagaaagucuuauuuuggacucuacuucugcuaaaugaggauuaugcuucaucuggcauucauagcacuuuguaacuggaucccaaguuccuuuuccagccucagccucugccacuauucuguguaucggugccucagucaccuugacuuuuuugaccuuuauuuuccugccuggcccuuuuguuuuuauuguucuaccuugaaacacacaagcacaugugcauacacacacguacauacacgcucuucaggguaggaauuacauccuauucguuucuguauaucuaucccuguauacagccuggaacagaacuuugccuguaggcauucaggaauuauauaacauaauacaugaacauguaaacaaaauuguacuuuggggaacauuucagaaacagaccagugguauggaguauaagaaaacugaugcaccucaaccggaugugaaggaagaggaagaagagaaggaagaggaaaaggacaagggagaugaggaggaggaaggagaagagaaacuugguaagaaacagaguccagaaaaucugcuuuaagccaagacccuacgauguuguuaaaccuuuacagucaaguuaaggauuguuuuuagccaggcgugguggcucaagccuguaauccuagcacuuugggagguugaagcaggaaaaucacuugagcccaggaguuuaaggcuguagucagccaggauagugccacugcacuccagcugagcaacagagugagacccugucucucucucucucucuuuuuuauuuuuuaagacaaggucccacucugucacucagguuggaguacaguggcacagucacaguucacugcagccuugaccuuauagguucaagugauccuccuaccucagcaccccuccaaguagcugggaccacaggcaugcgcuaccaugcucagcuguuuguuuguuuguuuguuuauugauuuauuuauuugauauggucuggcccuguugcccaggcuggagugcaguggugugaucucgguucacugcagccuuugccucccagauucaagcgauucucccaccugggccucccaaaguguugggauuacaggcgugagccaccagacccagcgagauccugucucuuaaaaaaaaauuguuggccaggugcgguggcucacgccuguaauuccagcacuuuggggggccgaagcaggcagaucacgaggucaggaggucgagaccauccuggcuaacauggugaaaccccaucucuacuaaaaauacaaaaauuagccgggcaugguggcaggugccuguagucccagcuacucaggaggcugaggcaggagaauggcgugaaccugggaaggcagagcuuacagugagccgagauugggccacugcacuccagccugggugacagagcaagacucugucucaaaaaaaaaaaaaaaaaaaaaauuguuggccaggcaugguggcucacgccuguaaucccagcacuuugggaggccgagguggguggaucacgaggucaagagaucaagaccauccuggccaacacagugaagccccgucucuacuuaaaauaaaaaaguuagccaggcaugguggcgggcgccuguagucccaccuauucgggaggcugaagcaggagaaucacuugaacccggaaggcagagguugcagugagccgagauugcgccacugcacuccagccuggcgacagagcgagacugagucucaaaaaaaaaaaaaaauuguuggccgagcaagguggcucacgccuauaaucccagcacuuugggaggccaagguggguggaucaccugaggucaggaguucgagaucagccucgccaacauggugaaaccccguuucacuaaaaauacaaaaauuagccaggcgugguggugggcaccuguaaucccggcuacuccggaggcugagguaggagauccacuugaaccuggaggcagagguugcagugagccgagaucaugccauugcacuccaaccugggugacaagcaaagucgaucucaaaaaaaauaguggccgggcgcgauggcucacgccuguaaucccagcacuuugggaggccaccgaggagaucaugaggucaggagaucgagaccauccuggcuaacacggugaaaccccgucucuacuaaaaauaaaaaaaguuagccgggcaugguggcaggcgccuguagucccagcuauucagaacacugaggcaggagaauggcgugaacccgggaggcggaguuugcagugagccgagaucgcgccacugcacuccagccugggcgacagagcaagacucugucuccaaaaaaaaaaaaaaaaauuguagaucuagagauguguucuaaugcuaauauauaaucaccaaaaauaauaagguuuugcucaguuguuuaacuucugucuuagaagagaaacagaaaagugaugcugaagaagaugguggcacugucagucaagaggaggaagacagaaaaccuaaagcagagguaaaggaaaggggucacacauuuuguuuuaccaagcugaagguacauuuauguaaagggaauauuuuaauaggguaguuuacaguggcuuauggcaguaaaaauucuguuaaagccaauuuuguugaagugggauucuuugugauacaggucaguguuuuguuugauaauuuuaagcuacauauuaaucucagaaguaucuuuuuagcugaaaaucauuuucugaaauaagcagaagguuauagggggaaaauaaaaugcuugcuaagaaggaaacuucgggucauuaacagucuauuugccucuccucacugugcccugaaaaguauuucuuauacaaaucacuguguucuaaacuuuuuguccccguuguccauagauggguucauucauucauuuaacugacauuuguugagugcccauuuugugccaggcauugucagugaguaagacagacaaagauacucugccuuuagggagcuuaaauucuacuugggggaaacaggcaaugagcaguaaacauuuuaaggaaguaaacaacacagcguauuaggaaguaagaaacgaugaauaauuaaaacaggaaaagauacuaaaagugcuagagguaggcgggucaccauguuaaaaccuuacucgaaagaugacaucgaaccaaacacuugaaagagguagagaacuuuuccauggggauguaagugggaagagcauuccaggcacagagaacagccaguauugaggccuaaagugguugucuacaaggccaguauggugaguggacagagagaguggagaaaagaaggguggagaaggcuccagguuagacaggcuguuguguggacuuggcuuucccuccuagugaagcgggcagccaucacaggcuacuggacacaggugucacaggaugaugacugugucugcuguguuuccuauauaccagggagaaucagggcgaccaguuaggaggucccuguaaucaucuaggaaagauacgguggccccacaaagggugacaggagaggaacagaggguaugagaacuaguuggagaucuggaucuugguuuugugguagauuggauauauagaguaugagagaaagggaacagucacugucuguauguaccauugcuuacuaaaguccuuuacccagcaccucugugucuaaaucuggucucucccggaaagcucuccucagguuuuacuuucagcuacaacucugccuuccuauuaauaaagaucauugcuaucuguaucuuuuguauauuuuccauggauauguucugucuuaacuagaaugcaauucuuaaaaguagagaccauguuucccccaaacucccucacacguuaaaaaguugcuggugcauuuaaaaaaagggaauauuuucauaggguaauuuacaaucuuagcaacuugugauagaguacagagcagcagccuuggagucagucuacuuggauagccuuccaucuucaugaauccuugguuucuuauccucagaauggggcuagugugccauaggccaguagauuguuugggauuaagcaagauuaagaaaucacagugucugauccuuuuuuaagaaaauguuuauggguuagauugagaaaaguguauguuuauagaaaacaauaaagacuaaacugaauuagaguaggcauaauuccaccaccucugagacaaccauucuucuuggugcauuuucuucucaucauuuuccucauuuuuuuccucaaauaaguuacccucagucuggcugaucuugaaaauauggugaacuuuuauuauuuuuuaaaugugcuaauuauaaugaauuucuuuucaaucaauaggaggaugaaauuuugaacagaucaccaagaaacagaaagccacgaagagagugaaacaaucuuaagagcuugaucugugauuucuucucccuccuccccugcaagagugguccuaggagaggaccuggcacaccuuagguugacauucagaaaacuucaagacaucaccaucagcaggcuccaguugaacacuagucuguguaacuuuaaacaucuagcaguaaauacuugcaguugugauauaaaggacccuguuucuguagaaaagaaaacauuuaacauaaugguugugaaauguaacaugaagcaaacuaacuuuuuuuuuuuuaacaucuuuguuuuuaaaauagaaugauagaacuuugccagucuuuaagaucuuggcuuaauuuaauguauuaaucuguuugugcaaacauaauaccaccauuuaaaaauguuagggagaugaguugcaguuuuuauaauagauuuuuuuuaaaguuugguauuguaaaacauucacaccucugucccucaaaauugauaauuacguuuaaagugcagucauuugugguuagaaucuuguuuuguuugcuuccauuauugaguuccuccuaaggaaauugaggagagggacugaauagaagcccaaauucauauaaaaguugcguuuaaguuguauuaaaaauagauauauaagaaaaaauucuuucacuugauguuuguuagaccagaaaguguguguguucuguagcucaguucccagacagcuuuuuagguaguggaggagguggcuucauguggcacuugggcauuuauauuccacuugggagggucaggcuguggccuucuggagcagguggcuuguuaaggaaugcuagcagggcauggcacgugagcuccggaauagaugucuucaucacuucuuccacuguguguugacacuguuuuccuuaccuauuuccucagauccccagcuuucuccucugcuaugcauuuucuucacagugcagcuugcaguccguugcugaaaaugauuauaagcccugcauaauguuaagcuuuauugugauuacguguauguuucuucuuucuuuuaagcagacccauaccuuuccagggucaaaguacagaauagaauacauugauacaaaguacagaaaaauacuuugauuuuuauccauuucuuuuacucuguguaaagacuugagaagucuaauucacaggcaaaccaauacagaauugacugcaguugaacagacuagaaguauuugugggaggagugacaugaagcaugaguuaucugauuuuuuuuguagcugcuauauauuuuaagccuucauuugcaauucauguaacaguugugucauaaauuacacaauaaagcaguccuguucaaauuuuuuuuuaacguggcuuguagaauuuuuaaaaaagugaucuuagguuuguuuuuucaugcgggaugcagaugggugcuaucagagccucucccacaccacuauaguguaauaauguuauuauuacucuacacugaaacguauucagaguuagauauuauuuuagcuucaguuguucuuuagaggcuuucaaauguaccgaugauacuguuucuugcacugaauauauaaacacuccacaguguuuauauugggaagauauugggaaggaaauauauuuguaaaagaugaaggcuguaucuauuuuuuuuucuuuuuaaaguuuguucacuuaaauucuuuugaggaugggauguauuuuucuugcuguucagugcuuuuuccuuuucaucuguuguucuguggucacagugaccuuagcuacauagcagacuuucccaaauguauugauuacaaauaaacaguuguuacuuagcaagaccugaaaauaugucugcagguuucuccuugaagcaaaugugugggaucauugcauuuccagaaaucugccuccuucacccuccguugacaguauaugucaugccucacuuucuucuagcugagcuuuaaaucauuagagcuuaaauugucagaucguucauugccuuuccaggguuauuuaguaaaguuuguugaaaacaaaaacgccuuuucuugguucuuuuuucaguuauuuugaagguccagcauccugauuaaaugucugacacauuaaugaaugaccagcagcagcuuucagcucuuaaaaagacacuuauauuuugauuuuacaugcugguuaccuguuccauuguugucaaaugcccacucuccaucagauguguuccuccauuuucuuauccacaaaguacuccucacuuuucaauuugucauguuacuaaaugguguuacauuaaagcccuguguuaagugucugcuuuugacugaauuucuucauaguaaccuucagugugugugugugacuauguucaauuaguggguugaucuucguauaauuggccacuaugugagaguucacuacuaggcagaaacuauuauggacagugaaauaaugacuuuuaucucaccacgugaguuugaugcagucuuuucugucuagcccuugccucuuccugcccaugugauugcggugcaguaguuucuguuguauaauaguguggacagcagcucagaaaaggagggaaugcuacugauaauuuguagauaauauucuuuaagacuuaggggaaccauugaacuuugaaauuuuuauuagaaaauuauuuguucagaaucagacuccauuauuuuacauauacuuaaauacuuuagggguauuuuugaaaguuagcccaguuuuuuaugugcuauuaaauuuuuagauuacauacuaaagaaaaguauguacacagaauguagugcuccuaguuacuauuuuuucuauuaagaaauaguuuaguucugguguaaaauuuguuugaaugcuaaaaaaaaaaaagcaggacugcauuauggcacuuuugccuugguggcccacuuucuccauuuaaaacauuaggauuuguauuuuucugcugcguuuguaugaagacauauuugauuguuguuuucucuugauuuuaaaauaaaaccucaugagcccuaguaa

SEQ ID NO: 192224 - RNA, 37295 nt, Homo sapiens
gcuguaagcgccggucgcggcugugucggucgccgcugcucccgcuccugcugggagagggugagugcggggccgguggcgggggcgcgcgccauccgugagucuuguaggcccccgcaggaggagcuccggauugcggggcgaggccccagcuuccugaggguugaggggcgggcccgcagcagaugggccgggggugcggccucacugcgccuguggagcgccgggccuccggcuccaggugcgcucccucuuccccaggagcuggcggcgggagcacgcuggcagcugaguguccuucggcgcuguccugggcaggcgccgagguggaaucacagccccggagcagcggggaugggggcucgaacaagggccacgccggccaccacgggucagggaggggcccaagguuccaagagucgcucggacccggguuccucccuggcuuuccccagccgcgcgcagcuuugucccgggacacgcugcgaccguggagcgaaccuaacccgcggacaucccggggauucugggccagaggcugggucucccugugcagcaucugcccuuuguguaaaccgggucuccggacccgcccucuggaucucauuccgagagcgcuggcgugggcuccccucccaucucacaauaagaauggggaggccaaccuggugcagguuucgaccucggggaaucuuuucuuuuuuuccuuaagcgauuucacuguagcacaacuggaaaauugagauuaaaacaaucauucaaaaucuaucuccaucugcauggcagcguggauauguguauaagcauagaaacacuuuguacuuuguuuuuaaacagaaauaugaauauuagcagcuuuuucuccaucuaucuuuuaaaacugagucaugagaugcauuugguaagggguuugaagugcacaaaucuuaagccuuguaauuuuuuacuggccuaaacacccaaugaagauagagaauacaucugaaaaaaacauuggaauauguugacaccaucuacuuauaccagauuuuaaauagagcuacgucauuuuaaugagugugagggaaaguauggaugugucguauugaauccucuccuuagguuuuuguguuaggguuuucuuuuuucuuuuuuuuuuucaguauuauaaacaguauaggccaucuggcuacauacaucuuugcauuuugucuuauucuauaaaucucuuaaagugaaauuucuagguccaggguacaguaaggauuuugauaccuccugucuuauucccuccagaaaaguugcaguuuauauaaacacuugcaguguaagagugccagauuuacccacaccaacugugaauguuaguauucucuugaacuucugagaggugcaaaagauaggauuguuuacauuugcauuuugaacacuaaugaauauuuucacgcaguuugcauuuuguauuuuaauuuuguaucugauacauaagcauguuuccugacugugcagaaacgucacagguucuuauggucacacaugaaaaccuuuucuucacguuuggguguuugacaucacuggcagagaagcugucugucccacgagauuacaaaaauguuuguaguuucucuuaguacuuucauuuuuuguguacauuuuuauuuuuuuccaaaugguaagccuuuguuacaaguuacuuaguaauuuuuucuucguugauaugaaaugucacuuauuucauaucuugaaugaaauauauauauacacacacauacauaaauacauguguauuugaaccauuuagguugguagaauuuuaauuuguuccauugaugcuuuucccuguucggcuauaacauccaugauugcggagaguuuaucuguuuuauuuacagcuguauccaccccuaccccaugcaauggugccuaguauacaguagguggucaacaauguaucugguaaauaagucaguaauauuguguuccaauucuuguagcuuuaugaauacuggugggcaaguugucucucaucaguauucuuuuuuaaaaaagucuuaguuguuguaacacacaacuuaaauauuuuuuccauaauuagugaacuucuuuuuuuuuauugagacggagucuugcucugucaccgaggcuagagugcaguggugugaucucgacacugcaaccucuaccuccccgguucaagugauucuccugccucagacuccugaguggcugggauuacaggcgcccaccaccacucucuaauuuuuguauuuuugguagagacaggauuuugccauuuuggccaggcuggucucgaacuccuggccucaagugguccacccaccuuggccucccaaagugcugggauuacaggcgugagccaccgcgcauggcccauauuaacuguaaaauauuguuacuuaggcauaacuuggcugggaauguguuaaguuuaugaauuaaagaaaugacauccugguauauugagacauauugugcaagaauaugucaugucucucugucuuucgucuuuguauagcuaaauaggcauaaugaagugaacuuaauacaugaaaaucauuuucuuuauguagcuacuauccaggucuuauuuaguuuauuuauagguauuuucauuguugcuguugcaggagucuuguuucucauggcuucuuucccuucccucagcucugccuccuuuggcuucugucccuccccaaggaagaaccccacaggaaggaaggagaaggcaauggcugcuuggccucugccauugggagcucgggugagcucauuuuucccucucaaaccucccccuuccuccuguacugcaugugggccucacugcucaggacaggguuauugaaauagcagaaugcuggauauuuuucacaaagcccccucuguguuccugaccucuguuccuagcugccacuuacucagcuggauacccuggccugcuguguucuuggugcuguucaagggucagaaagggaaaaaaguuauaugcaagcuggugcuggugcuuauagggcuuaugggcucucagggaucauaaaagagggcacaucugcaugguauacagucauaauugcaccugaauaugguaauaagaacaagugugguuagggacccaguuuauccguauuccaagcuggagugaaggggaggaucagggugguggccaggagaaguagguaguguuugcccaucucagggguugggaagggauaacuggagaggauuuguuauaagggagucaguguguccagaguuuaaaucccagcucuaccauuuaauagcuacauugucuuggcaagaggcuuggcuuuccugaaacauuauuuucucauggucauaauaggaauuacagcauuaccugucugccauauaggugacaugaagaacgucaccuggcugauuucauuuaauaguaauagcuacuucauaggucuguugaaaguucaaauaaaauaauaaaaguaaaaaaugccuggcauggcuccuggaauguugaaguuauucaguaaguuguaggcauucuuaguaucaucccagccaagagccuguguauagacuuuuagagguggacugaagggggcagugacugauagugagaaaugcucugcuggaguagaagaaaucggauaaaaauuuuaggaccaagugucgggaaggaggaguuuguguguuuggcagggugguggccauggggguggaggucagucugaggaauuuugauaagggaguucgcacaaucaaaacuuuccuaggaaaaaguaguguccgugagauggagggaagcauggagcugggauaguaggugaggauuccaggcuucucugaaaaagaaaauaaggcaucagaagacuuggcccuaacuucuuuuuuuuuuuuaagguuaaacuuacuuagccuuguugucuggaauacugaagacuuaacggcauuuucucuucucauaaaaguauguauuaggggucguugauuuauuaggaucacuuguuuauuuauuagagaccaguuuaaagaaagcuucguggaggcaaguauaaacuguugugauuuccauuuguacugcuuucuucaguauuaucaaacucaguuauaaaaggcaaaauaacuuuuaaaauggggguauuggacaaagggaguuucuggaagagggaaauguugaaaggggaagcauuaagaagauuuugguugaugacuguugugguuugguugucaguaaccuacauuuuaauuuauguagccaaaauaguguuaauuuuuaaaucagcuuuuucugaggcacaguuuaauaaaauaacccaauuuaagcauagaauucauugaguuuugacaaauuuaugcaccaacauagccaccaccucagucaagguacagaacuuuugcaucaccccagccagccaguguccucgugccacuucuacuccacgucccccuccccagccagacaguguccucgugcuacuucuacuccacgucccccaccccagccagccaguguccucgugccacuucuacuccaugucccccaccccagccagccaguguccucgugccacuucuacuccacgucccccuccccagccagacaguguccucgugccacuucuacuccacgucccccaccccagccagccaguguccucgugccacuucuacuccacgucccccuccccagccagacaguguccucgugccacuucuacuccacgucccccaccccagccagacaguguccucgugccacuucuaccccacgucccccaccccagccagacaguguccucgugccacuucuacuccacgucccccaccccagccagacaguguccucgugccacuucuacuccacgucccccaucccagccagacaguguccucgugccacuucuacuccacgucccccaccccagccagacaguguccucgugccacuucuacuccacgucccccaccccaggaagucacugguuugauuucugucccuacaguauugcccuuuguagaacuucaugucaaugaaaucaaacaguauauauuaugccuggcuuuuuuugcucaacguaauguuuuucaggucuuuacaugauauuguguguaguaauaguuuguuccuuuuugucuuaaguaguacacaguugaauauaccaccuuuuguucauucacuugugacagacauuucaaguuguuuccuguuuuuagcuauuaugaauaaaacugcucuguacauucauguaugagucuuuuuguggauauauacuuuaauuucucuuggguaaauaccuaggucaaguguacauuugacuuuguaacaaacagcuaaacuguuuuccaaaguauauguaccauuguacauucccuccugcaguauuugagaauuccagucgcucuacaugcucuuccauacuugguguauccauuuccaagagcugcuguaauaaagugccacaaauugaguggcucgaaacaauagaaauuuauugucucacaguuuuggaggccagaagucugaaaugaaggcauuugcagggccuugcucucugaaacuggugggggaauccuuccuuuacucuuccuagcuucuagcuucuggugguuugcuggcacucuuugguguuccuugguucauggcugcaucgcucuaauccuuaccuccuuugucaucugauguuauccuuauguguucaugucuucaaauagccguuuuucuuauaaggauaccagucauauuugagacaaccuguuuucagaugagguccuauugcaagguacuagaagcugggacuucaacauaccuuuuuugggggacacaguucauaacacuagguauuauaagcuuuuuaaauuuuaguuauuuucaaggguggaaaaugcaucuugugguuuuuugguuuguuuuuuuuuuaacuuuuauuaugaaauaauuucagacuuuaaaaacugcugcaaggccgggcacgguggcucaugccuguaaucccagcacuuugggaggccacggcagguggaucacuugaggucaggaguucgagaccagccuggccaacauggugaaaccccgucucuacuaaaaauacaaaaaaugaaccgggcgugguggcacacaccuguaaucccagcuacucaggaggcugaggugggagaaucguuggaacccaggaggcggaaguugcagugacgugagaucacuccacugcacuccagccugggagacagacugagacaacaacaaaugcugcaaaaauaaaacaauuucuggauagucuucaucuaaauuaacauuuugccauuuuucucuuccuguauacacacacauguuuguguauauauauuucugaaccauuugagaauaaauuacagacaugcccauuucacucuaaguguccgugugugcuuucuauuaucauaccuagcaaaaauacaguuaucaaaauaaggaaaacuuacaucgauacaauacuauuagccaaacuacaaaccuuacuuggauuuugccaccuguccuacaacuguccuuuaucuggugcagaauccaauccacaucacacauuguauuuagcugucguaucuccuuggucuccuuuuaucuagaaaaguucauuauugaucuucaaugacuuggauacuuuugaagaguacaggccaauuauuucauagaaugauccucaauguggguuuguuugauguuugcugauaauuugauucagauugugauuaauuaaaauuugaauggcugauacagucaguguucagaauucaaaaauaagcauucacuuaaaauaaaucuucuuccuacucuugucuccaagcucccuauuaucucuucucauaaaaagguaaugauucucauuucuuauguagcuuuccagagaugacuacaaaagcccauaaaaguauguauuuucccaauuuuuaauccaguugauaacagauaauauuuacucaggagucugcaccuguucuauuuuuagcuauuuugcauuucacaauauaucuuggagaccuguccauaucaguacaucggggcuucuuucuuugauuaugugggcauaucauaguuuaguuaaccagucugccuuaagggacauuagucuagacacuugauagcagcugaugacaggcauuuugucacuuuuguugcugcuucucugaauuacugaugaaucacuuggaacuguacaguagaugagaaaugaguaacucagauguugagaaauaaaguguaauugucaacuagauguguuuauaaccuguaaauggaaugcaauuacgaaguacaguaauagacuugggacauaucaaugcaacauuagagcuguuuuccuuuuuucaucuuucuccguaguuucaucuuucccauauuggccagugaugguaguaugaauugucuagguguuacuuuuauuugccuuuaaauuuaauauuuuuuugaauauaaauauugggcauauagacuaaucauaucuacuaucccuuuuuaaaaauuuaaaggcaaugagagagaauuccaaguuuccaacccucagaaacaacuaugauguacauucuuccagccuuuuaaaauaccugucuacacccuuugcccauuuuuauauugaguuauuuacauauaaaagaggucuuuccuauaaaguggauaguauuccuuugcuauacguugccaguauucugucauguuucuuuuaaauuuguuuauaauauauuuugcuacaaaaaaguuuugaaguuuuaugcaguuaaauuuccuuucucuuuacuuggcuuugggaucaugcuaugaaaaggagccuggcaugguggcucacgccuguaaucccaacacuuugggaggccgagguggguggaucacgaagucaagagauugagaccauccuggccaauacggugaaacuccgucucuacuaaaaauacaaaauuacaaaauacaaaaauacaaaaauuagcugggcaugguggcacgugccuguagucccagcuacuggggaggcugaggcaggagaaucgguugaacccgggaggugaagguugccgugagccaagauugugccacugcacucuagcccggcaacagagugagacuccaucuccaaaaaagaaaaaagaaaaaaaaaagaaaaguuuucuguaccccaagauaauauaaaucuuuuucuguguuuucuauuaguuuuauaauuuuaaauuuacauccuugugcuaucuggaauguauugucugugaugugaaguagggaucuaacuucauuuaacaugauguggugaagcauuucauccauccauccacucauuaaacauauuuagcgcuucucugccauguggugugccguguucuggauacugggaguguugcagugaguaagagaggcaagaucuccuucucugagcucuuauuuuccacaggggaugcagacaauaaagaggaaaugugguugaggauaguguuaggugcugugaugaggacgcagcaggggaacaugguagagugucacucagggcuguuuuagcucagcagaggaguggccccucucaggagauggcauuggagcugauguuaucuacugaaauaaucugcucacucuccguggacuugaaauggaaccuuuaaaauaugccaaauugucacauauauaugaaauauauaugagaguuuauauuauaauauaguuuacauauauuuauauaugaguuuauuuuuaaaauuuauauauauguuuauuuuucuggauucuauuccauuguucuauuucuguuguaguaccacacuauuguauuuguugucucagaauucauuuugcuuuuuuuuuuuuuuuuuuuuuugagagacagagucuugcucugucucccaggcuggagugcaauggcaugauuuuggcucacugcaaccucugccugccggguucaaggcauucucuugccucagccuccucaguagcugggacuacaggcacgugccaccacgccuggcuaacuuuuuguauuuuuaguagagacgggguuucaccaugcuggcaggcuggucucgaacuccugaccucgugaucugccugccucagcuucccaaagugcugggauuacaggagugagccacugcgcccggcccauuuugguauuucguaaagcaacucuucccucauuuuucguuucaaaaguuucguuacuguucucguauauuuauccuuaauagucgaauuuuauuaugaaguuccaacaguaauaguaaaaaaguaaaauuaugcaguucugauuugaauuucaaaguguguaagucaguuugaggaagauugccaucuuuacgauguuuauucuucauauuaaguaaaaaaaugauacuuuauucuauucagaucuuucauuauggccuuuaacucuuuacagaccaaucaugaagaucuugcauauuucucuuaaauguauucuuagguguuucauuuucuguugcuguuguaauuggaguuuaaauaugauugugauuuuguaaagaaaaaauguggauugcucaguaucauaucugaagacacuuugcugcugcagugccuaaaacuucaucacuaucauauuuuacuuauaaauuaugcuuucaucauuuauaauguccuuauucuauuugauaugcaguuuuuucaaacaauaacuguaucaaaaagccuuuguuuuuagguuuaagaaaaccucuguaugaguaagauaaacccaugaagcuccuuaaacacuaugagguauccuguacugaauguagugcuagggggaaaaugacucauacuaaauggaaaggaggaaaggaauaaaacaucuuaaggaauugaugacaaauguauauuacuaaguuccauguucacuuucuuuuuuuuuuucuuuuuucuuuuuuuuggagacaaggccuggcugaauugcccagacuggacuacaguggugugaucucagcccacugcaaccucugccuccugagcucaagccauguucccaccucagccucccgaauagcugggaccacaggugcacacuaccacgcccagccaauuuuugucuuuuuuguagagacaagguuucgucauguuacccaggcuggucucgaaccccugagcucaagccauccgccaccugccuuggccucccaaagugcugguauuacaggcgugagccaccaugucuggccauguucaccuuuuaagaagccuuuuguaguuaccuaaaucagcacuuuaccagcccacagcuggcacggggaucugcagugcauuucacaauagaagcucugcgcaugcugagcacagagccaggacuuaagguggugaggguuuagggaagcaaggaagaccagcacauagcaaccuggauuuggacuuuuauuuugccuucuguauucagcuaacaagguaauuuguugaaaaaaguggaugauuuuuggaaggggaaucuugcauuucugauuugauaccuucuuucaccaaaaagaggcuuauuuuuguuuucacauauauucucccuuaucugauaacguuauucucacugcuuucuuuacauuugcauuugccugcuauauccugugucugcccuccucuuuugaaauuuuaaacuuuuugguuucuguuuuacguauaucuuuuguagguaccauacagcuggauuuuaaaucaauuuuagaguuuuugucuuuauuuauuuauuuuuuuuugagacagagucucacucuguugccuaggcuggagugcaguggcccgaucucggcucacugcaaccuccgccucccggguucaagugauuuuccagccucagccucccaaauagcugggacuacagguacacgccacugugucuggcuaauuuuuuuguauuuuuaguagagaugggguuucaccauguuggccaagcuggucucgaacucaugaccucaagcaauccacccaccucagccuccgaaagugcugggauuauaggcgugcaccaccaugccuggcugaguuuuugucuuuuuuuuuuuuuaauaaguuuuuauuuaaaagauucccuuuuuaaucuguuccaaaguguuggaagcugaacuauacaaguuccugccacccauccuuccaguaaaguuuucugaggacauacuuuuuaaauggaaaaauaacaggaggauccucuaacugaaaccagguaggaccagagucagcuccucaagccccugaggcagucuggccaaagcuggccuuauggagcgagcguguggagaagucuggggaacuggacccucuugugaggaaagggcugaacaagcucauguucucuuuagugaaagugguccaaauucagacccaaaagccuccauuauggcauucccuggcacucuuccuauacuuuauacauugaaggcagcucccucuuuuauggccaguauaagcaggcaaagaaacaaaggaauauagauacauauauguguacacauauauauuuuauauaguuaaaauauauacauauuuuauauauguauauauacauauuuggggguagggaaaggagaggaggguccuguaaaccuaaacagucaucacauuaccccacaugagccugacuuuaacaaaaaguugacuccuggggguuaagugacaacaugggugcagcaagaagggaaagggcacaaauuuaacuauuaaauauacuuugauauuuguuuggcacaauucaggcccacuccaggcuucugccuuugccagacaaguaagcucaugauauucaaagagauaaauaaauaaauaaauaacaauucaagcagagcugcauaccacaguuuuccuuaaagucaguuggccggcacacaguuucccaaccaccaggaacagaaacuuuggcuccaaggcaaacgaaacaaacaaaaaaaauuauuuccacuuacaacaugaaaauacagaaacuucaucaaagaaagaaaacuaucaaagaagucuacuuccagcaaaacugagguagcacugcuuucucugcauucaaugcuuaagugguucucaguacaacguguucuuaaaaaaugcucacuugacugacaggugcagcauguugauggauaaacucaacaugaaaugcaauaggucaaagaaggaaugagcaagaagugagggaaaucagaguucuggauaaauuagcuuaaaaggggguugucaccagacuacaaaugcucuuggcuggccuuggcucuccaagagcucuaaaucgccuggaaauuaaugcagugugauuaaguuaacacuccuauucaaaucuguguaaaucuuuaaaaauaauuauuacuggcugggcgcaguggcucacgucuguaaucccagcacuuugggaggcuaaggugggcagaucaugaggucaggagaucgagacaauccuggcuaacauggugaaacccugucucuacuaaaaauacaaaaaauuagcuggugugguggugguugccuguagucccagcuacucaggaggccgaggcaggagaauggcgugaaccugggagguggagcuuguagugagccgagauugcgccacugcacuccagccugggugacagaggaagacuccaucucaaaaaaaaaaaaaauuauuacaaccuaauuucaaccauguaaauagcgcuacacacaguacagaccugcccuuagaaacaauaugcaaaacagaucuggcacuguaucauuuuauaaugugaauucacccuaaccaucccaucccccccucccugcucuaugccuuccccuaccaaaaaaaaaaaaaaaaaaccuaauuugugcaagaaauggcaggcuuauucuaucugaaggcuacaaaaaaaagauaacauguagccagguucaaauauuuugggagauucccccaaaacaagaaauaaccaaaauaaccaaaaaaugaagaaagugccuaaaacaugguacagcauuuuagagcccuuucagauacaaagcagagaaagcuauguugggagaaaagcugaguguugggaaaaaaagcugaggcagggcuugcaugucugacauaguguaaaagagucuuggaacgugucuggggucuggggucuaaaaccccucguggccuuuggaauaccaaguuuagugcuaaaggguggaaggcugcccugccgcaccguuaucuaagcccagggcguaaaaccccucguggccuggauggaauccagggcucagggcguaaaaccccucguggccuggauggaauccagggcucagggcguaaaaccccucguggccuggauggaauccagggcucagggcguaaaaccccucguggccuggauggaauccagggcucagggcguaaaaccccucguggccucuggaaugugucuacacuugcuggcuccuugcuucuagcacucccaggcucauaguucgauuguaucguaaacuagaagaacguguuucccauuaucucaagcagcagaacauguuccauaugcuucaaagaaaaugguaaaccaucucagcuguagaucauugcuugauaaaugguuuucuuucaacccccacauccucaccaccugcugcuuuguuugaucaccaguaaauagugcuugcuuccagagcuuggggccuuugcagccuccauacuagcauuggcccccuggucccacuuucacucuugacuucucuuugcucauuccuuugacucugcuggacuuguagcccccacggccugguguugagucugaucaccccaacaaaggugugaaguagaaacuauccugaucuucaguaauuucccaaaagguccaauuccucaguuggcugcagggcagcgggcagauccuugcugcugcuccugggacagagccacuaagucugcuccucaggacacaagcccucgggccuugagcugagugcaccucucccuuccucuucucuuuuccuucgcuucauuucccacuccacaaaggugucgaagagauuuggccaggccucaucuucacugugguugcugaggucagggccaaucaccugagugaaguuaaggaacauguuccaagagucccgggagaugcccuugauccucaagggguucucuguuaggaaguucagccauugguccaauacuggagaauuguucuggguagagacuaguuuccauagggugauggcuauuugccgaugcagugaccacugcccuucuucagaguccaggccaaacugaaauguaaacugguagagauccuugaauuuauucuccuguuuggcuucuguuaagaggcuggagaaccgugcacagauucugucacugcugucugcauuuaaugcuuugcagccaucaaaaaucuuucuggugaauuugcacaugguugcagccuggaacuuccaagccaagagcagcacucggaauucuguggggucgacacauaggucauugcaaaagugcuccaugccuuccuccaaaauugcaucuucccacucauccuuguagcaccugaacaguucuuccaaccccugcaaggaagacuccucggcacuggaguuggacucccucccaccaucuccugaggauguuggcagcuggcagccucggccuucuuggucccauugacaaggcuaucucuacuuggcaugccacagggugguacuugcuccucacaguggccugcacccugccugcugugugacuucuugcuggggucauggucugcauucuugcugcccagggucaaugagggauucuuacacuuggugacacacuggcccaugguacuggugucccggccucuagaauggcccccucuggaucaguugcccucacugccgcuggcccaugcaccucaacaugucaucagucagaggagcuagccaacagcugcuccagagguuccuccagucaaacccuuucuggaaacgauggcagcauggcggguccaacccuccuaccauccccgcugggguuuccaggcucccuaccccugccgccaccaccccuucuuccaccacugccaccgccuccuucaucugccaagggaagugaaccacuggguucauuuuuagggacugaaccuuuuuauagggaaaaaagguuccuuuuaauagggaaagcgaaccauugguguuugucacuauauguguguuaaguauuuuucugguuauuaugcggucuuauuuccuuuauucuccuuucuuuacguuuguugaacaucugaugauuuucuuaguucccuuucuccuugguuaaaauggaaauucugcacuuuuccugaaaauauuugucagugauuuuuaauauauuuuuguaacuuugaaauauugauuaaauaaaaauuagggagaaaaugauguagaaagaaagguagacaaugaacucugugccugaguguugacacuuuuucuggaguuccuagucuuggaugugaaguacacaaauuucuuggaaauugauuuugcccucugucucguauucaguccuucuuucuccacuacgguugacccuuaaauaacacaaauuugaacuacacaggcccacuuugauguggauuuuuuccaauaaaaauuacacugagugugccugccuuuccugccaccugcucuaccuucgccaccccugagacagcaagaccaaccucuccucuccuuccuccuccucugccgucuguaugugaagacaaggagaaagacuuuuaugaugauccaguuccauuuaaugaguauaugugaaauaacuguuacguuauuaguaaggcuuccagucaacacuaggcuauuaggaguuaaguuuugggggagucaaaaguuacacauggauuuuagacugugagggagguuggugucccuaacccccauguauucaagggucaguuguacuuucucccuuuuccuuauuuacauaucaaaaugcucucuguccuuaaaugaugaaaaccuuuucuauugcuuuauuucuauuaucuauucuuauuuccauagucuuacucucauuuucuuuacaaaaaguuuuaaguaauuuaucuggccggacacgguggcucacuccuguaaucccagcucuuugggaggcagagguggguggaucacuugaggucaggaguuugagaccagccugaccaacauggugaaacuccaucucuacuaaaauuacaaaaauuagccaggcguggugggcaccuguaaucccagcuacucgggaggcugaggcagaagaauuucuugaauccaggaaguggagguugcaguaagccgagaacgugccacugcacuccagccucggcuacagagcaagacucggucucaaaaaaauaggaaagagaaagaaaagaaaagaaaagaacgagggcugggcugugacuguauguggcugauaaauugcuaucgaccucaucuguugagugucaaguguccuguguuuggucaucauguaccauuuggggcagggauuccuuccuucaccaaugaggugaauaggaggugaucacaacaccacuccuuccucucccaugggaaucuagagccgccuuuagugccuuuccuuauuucucacuuauaccuacucuuccuguccuuaccucccaaaacacuuuuuauauuaugucucugguuauuucgugauugguggcagacauuuucuuccaucuggagggcagcauguuuucucaggcagaucuuuguccuuucagugcugcugggauuuucacuccccucagaggguuugguuggcauaaucccuuauugaggaauuuuuaguuucaggagucagugaccuucaaggauguguccauagauuucucuugggaagaguggauucaagcagauucugcucagaggaugaccguguauggggaggugaugcuggagaacuacaggaacccggucucacuggguaaggacuucuuguaacucaaaacccaccucuugacaaucauaaggccugaucauaaggcauuguuuuaggguguuugcuugguguccucucuuucaaggcagaagauugaaauuuucuguagagaauggaaaauggggaacuucauaagccacaccuuccuuguuucagaagcccugaaggagaaaugaucagaacucugcuaggauugguuuuuaggcucaguucagaacccaaauuuaaugucucuccucuuaagcaggaaaucaccuuuccaaacccaaugggacuucccagcuggaacgagaacugagucugaugcaaaaagaaccgccugaggguggcuuucgagguaagugccaggcugugcagacuuguuaaaugagugugucuuuggggaaaaucacuucagagauuguugggucucuggagagacuagggccacuggauguguguucucagaugacaccuccgcauuacugaugggccucuuuucucuagggcucacuuaugucaucuugcagggaggugguggauuaugaggaguaaaugaguuuuuacauuuauggcacuuacccacugcguggaacauacugagcauuugguaaauguuagcaaccacuauguccucuucugucuuccucugcauucugaauugaaacccugucuuuacgcaucuucucugggcuuuuacugucuuucaugaguguuuccucucaaccauaacguauauccauagcuuccuuucugucauucauguaaauauuuguaagcuuuuucuccuucaaaggaaacuaacauuucucuuccucugcauugugugagagaguuuuagacagucuucauuuaaaaacaugaaaaaugauguuagccuuguuuucauuucuagcagccuuacauuguguauauuuucuuucucauucccaaaauucuaaucugcauuacuacccauucaaugccauuuaccucaaaauguugaaugcuccuuuaucuuuguuaucugguuucuaauccuuaucacaacugaaauuucuguuuuagguguuauuacugacuuuucucugcaaaaaaaaaaaaugcauuuuacaucuuuaucuucucuaccaugugcaaaaguaccaaucauuucuuuuuuuuucuuuuuuuuuuuuuuuugagauggagucucgcugugucacccaggcuggagugcaguggcacaaucucagcucacugcaagcuccgccucccggguucacaccauucuccugccucagccuccggaguagcugggacuacaggugcccgccaccacgcccagcuaauuuuuuguacuuuuaguagagacgggguuucacuguguuagccaggauggucucgaucuccugaccucgugauccgccugccuuggccucccaaagugcugagauuacaggcgugagccaccgugccuggcccuaaucauuucuuuguauauuuuuuuuaaauuaaagagauaggcaaauauuuaaucucuagauaauauaaagcuaucuaagauaaaacaaugaaagaaaucauuaaaggaacacaauuauaggaaaaacauugccuguaaccaucacugcugguuucccacaaguuuuuuuaaagaaugggauucugggagaggaaucacugggucaaaggauauauccauuuuuuauggucuugcuacauauugcacugcuuuagauacuauuuuguguuuaaugauaauuucuuugguauaaaaugaaagguaguguuaauuacuuuuauuacagauuucuauggauuuuauuacuauugauauuuguauucuuauguaaauaaccuauuuauucaacaaauaucuauugaguacuauucuuagcacugggacuacagcaauaagcacagcaggcaaaguguuuuugaggagcuuauauucuaauggggagacaauaaaggaagaagggagggggggacagaagggaaaggaaaggaggcaggaagggaggaaaugaauauaacacagugauaggugcgguguggaaaaauaaagcagcauaagagaaugacauuaguuaacaggagugugauuuuacagggagggcuucuccuuuaaugagacuuuugagcaaauacucaaagugaugggccacaugggagaacauugaggacauagggaacagcaggugcgaaggcccugagguaggagauuguguggcauuguuugaaggggagugugcuagcagauacgaagauuucuguaaaccuuacguuucaguccuucuguaaaaagaucuauuuguacuaucauuuuuuaaauuucugugagccacucauugucugaauguucuucuuaaauagcagucuuucuaacgcauacacuaacuucacucaucuguuugggaguauuucauuguuuuuguuucugguuuucugguauguaugugcagcaguuuuuuccuugcucccuagauuauuuuauugaugccauuuucauugcuuauugucauucugguggguuuucuggaagcagcagaagcaaacacauauauuuugauacuguguuuucaucucccacuucuuuaccccauucgugcuucccuacuggguuagaaccuaaagguuuuucuuucuuuuuuuuuuuuuuuuuuuuuuugagauggagucaggcuggagugcaguggugcagucuuggcucacugcaaccuccgccuuccagguucaagcaauucuucugccucagccuccugaguagcugggacuacaggugcacacugccgugcccggcuaauuuuuugcauuuuaguagagacaggguuucacuguguuguccaggcuggucucaaacuccugagcucaggcagucugcccaccucagccucccaaagugcuaggauuauaggcgugagccauggcacccagcucacuuguuuuuuuuuuuacugcaugugacacuguauuuugcucaucauuuuccaugucugucugucuuuagccgggcaugguugcgugcaccuguaaucccagcuacucgggaggcugaggugcaagaaucacuucaacccgggaggcugagguugcgguaagcugagauugugccacugcacuccagccugggcagcggagcaauacccacuaauauguaggcucaccgaauugucauugaacauguuuuucuuuacauucccugacuaugacauugcuugcuggaguaaguacuuaaauauuuguugagugaauauuuaaugacaucaauuagaauuuucauaaaucuggugaaaauauaaauuugaauuuaugaaauucauaucaauacagauuggauaauuauugggaugaaugaaugagugggcagggcaaaacagcaaaggugggacccucaggacaauaacauagugagggggccaaggaugcucuggugaaggugagugguccaaggaggaggagagggcccagcaggagaacauggucgaagggagagaggagagucaagguagaguaugacagugccaaguagggaaugaaaaugccuguuggauuuggugaugagggaguggccugggacccagggaagagcccauuuagugcugagagaaauacgcugugggcagaaaagugaagaggaagcaagcaagugaagacuuuuaaguacagacugucguuucaacaaggccagcuucuaaggaaaaggaagaaagaguaagaacucagaagaagccugugguuuguuuuuuaacaaggaaaagacuugaguguaucugaaagagcagagagguguccauugcagugggagaaacuaaagauaggcgaaaguugaauggaaaggagcccauagaacaugaugauuugcaaacuccagaucuuguucuuuccagauuuucuuggauauugcugucagauuaaucugacauuuaguccucucauuauccugucccagucaaggggagaaaguauugacugagugcugugcucagcucuuccacagccagcaucucacuuacuugacacaaaacaucuauagguaaguacugguacuccucuuacgguggaagacauuggcucugaaaggugaaauaacaugucagaaucugaacacauaucuuuuguuuuguugguuuuuuacuuugaguuuaaugguaauucucgcuuucuucccuugcccugcuguguuguuauuuccuaguauauuuaguaaaacuagaaacuucuguauccuggccuaauuuucuuuucagcaucauuucuuuucucuguacuaaagcuuuguacaguugaaagcauuguuagauuuuugcuccuguuuuacaaaagaugaauagaaacugcaaauccagaagugcugucccuggugccaguauuuucauuguaaacugacuaauuuugagaaaagauagaaauuuuuaguaauguggaaagcagugucuuuuagccucucaucaauagcaauuagauuuaaaucauuuaaucauauucaguuaugaaggagauaaaaauuaagaacaugaauaaaguacuaucaaagauuauguguaaaaauacaguuggggauucuauaaucuuuuuagcucuccaggaagccacccuaaccaucccuaaacauaggagccugcugucuguguuucacacaugauuuuuaaaaauguggccgggcgucguggcucacaccuguaaucccagcauuuugggaggcugaggcgggcagaucucuugaggucaagaguucgagaccagucuggccaacauggugaaaccccgucucuacuaaaaauacaaaaauuagccagguaugguggcacguaccuauaauuccagcuacucaggaggcugaagcgugagaaucacuugaacccgggagguggaaguugcaguaagccgagaucaugccacugcacuccagccugggcaacagagcaagacuccaucucaaaaaaaaaaaaaauuuucagagauguacuggauaacuacuucugcauauauguaugucuguccauguaaauauauguguacauauauagagaaacauacacagagaauuuauauaguuaagagucucuaucugccugcaugcucacaugagccucacugauguuuaauacguacacauaucuuugcuuucguuacuaggaaaacugaucuaaaauacuauaaugaauguagaaguauucaaaaaguucauucuuccuuaaauaagacaggcccacugcugccucagggccuuagcacuggcuguuacccugucugggaagcuuucccuuagauaguccuaugacuuccucucuuagucccuuaaagucuugguuuaaaugucaccuuuucagugaggccuuuucuuaugacccacuuuaaaauugcagacguuuucucucacccaucauguucccuauauccauuuaaaugcuuuuauuguuuuucuguaagguauaccacuuacuuauugucucccuuucucuugcuaaaauauguuucauaagggcagacauuuuuucuguuuauugcuauauccugagcacccagaacaguaccuggcuugauaaguauuuauugaaugaaugauuuaucguguucauaaaaccaguuugacugcuauauggagagaaugcauuguaggguagcaagaguuuaaauagaaaauccagacagguggguauagaaauagucuaguuggguguuaggaguagcuaacuguuacccagaggauggaagaaauauaaaaggagaaaauaaauaaaucaacuugcccuuuucaagaagcaugggaccugcuugcugcccagucccaucccacacacccauacugugcaagcucccagccucugcuauggcuugugccagccguguguacuaaggggucugugacagaccagacaccuuggucuggagacucuaguucauguccuggugaguaucagaguuauauaaauccuauaaguuaacgagugaaggcagaaaaagcauuccaagccguuaagggaguauugaguauuuccaguauuauuacucaaaagucuuguuuaggaaaaaaggaaaggcagagagaacuguauguugcuuaauguaaaauaguaaugaugguaaugauaacagcuaauaaucacuggauccuuauuacauccaagcauaaugcuuugugcuuuauaaaguccuuauuuaaugagauaguaaaaugucaaggaucugaaacauuguuuaauccuggaagagcuacaguuucugaccuauacugcucaggcuccaagcccacaauacuccaucaauucugaguaaagccccccuaaccguuuuucauuuuguagguagacaguuauauaaucugggaaaaauuaaaaauuuccccccaucucaguggccauauuggucacacuucuggaauaacauuaaauaguaguaguaauaguaagcaccuuuuccuugguucuguuauuagagagaauucuucuagggcuuuauuuguauucuuggugcaaugcuaauauuuuuguuuuugaacacgaauggaugaaggauaccaguugaauacuucugaaccaucuaucagguugaucauaugaccuaugaccuauuaauaugauaguaauagauucuuaauagugaaccauucuuuauuuccuggauaaauccuucuucgugcuaguuauacucuugaugucuaaguaaccagcauuguuuaaaaacauuaagaguucuggcucugauauuacaaugacuuaacagggugggucugcuggugacaaauucucuuaguuuucuuucauaugagaaugucuuuauuucaccuucauuccugaaagauuuuugcuaauauagaacucuagguuuaugguuauuucuuucagcacuuugaaauaauuaauccacuuccuucuggcauccaugguuucugaugagaaauucaguuauucacauuuuugcccugccaccaaguaguguaucaauuuucccugguugcuuucaagauuguuuuuuacuuccauuuuuagaauuuaauuauggcugggcauagugguucacaccuguaaucucagcacuuugggaggugaaggcagguggaucacuugaggccaggaguuugagacuggccugggcaaaacauggcgaaacccuuucucugcaaaaaauacaaaacuaccugggugugguagugcaugccuguagucccagcuacuugggaggcugaggaggcacgggaaucgcuugaacccaggaggugaagguugcagugagccaagguuguaccacugcacuucagccugggcgacagaguggacucugucucaaaagaaaaaaaaaaaaauuugauuaugaugcaucugggcguggauuucuuuggguuuacccuguuccuauagguugaaaucuucugucaaauauaagcuuuuaaccaugauuucuucaaauacuuuuucagcaccaaacauuuucuccuucucugggacuccagugagacauauaugagaucuuuuguuguugucccauacaucccugaggugcucuucaucuuuauuuuuucucaaucuuuucucucuguguuguucagauugaauaauuucuuuuaaucugucuucaaguuaauucuuuccuuuuuucacccuucugcuguuggaccuauuuagcaagauuucuauuuucuauaucaauaaauaaguguuuauauauuaaaaauacuguagggcuaggugugguggcucacaccuguaaucccagcacuuugagaggccaaggcuggugggucacgagguuaggauuucaagaccagccuggccaacauagugaaaccccgucuuuccuaaaaauacaaaaauuagccgggcaugguggcguguaccuguagucccagcuacucaggaggcugaggcaggagaaucgcuugaacccgggagguagagguugcagugagucgagaucgcgccacugcacuccagcuugggcaacagagugagacuucgucucaaaaaaaaaaaaaaaauuguauauuuuucacuuccagaauuuccacuuaguucuuuuuauaugcucauuuucuuugcugagauuuuauuuccauuucuuuagaguguguucacucugacuuguuggaacaaguaaggcagaugcuuuaaaguccuuguaagauaauuguaucaucucacuugaugucuguugguuaucuuuucccauguaaguugaaauguuccugggucuuuauauucucagugacuucaaaagguaucaugggcauuuagaauauuauguuauaaaacucuaugucuucuugaaauccaacagaaaauguugauauuucuguguuagcaggcagucaaccugguugagcucagacuacaaaguccaaccagcuuucuguggguugugguuucugugucaguuugguugucagagacuucacauuguugcuugaaucuugcucacaugugugucacucuguggccaguauggaauuuaagcagcggucccucuuauucucaaaguccacgugugcugcuuagggggucagauucaugcauauguaucucgcaggugagcccaggaguucuuaaauaacuuccaaggucauguucccgaauucuccccugucuauguccgcaguaguuucagcuucccuguggcuguccuuuugacucuucuggcuacaaggcaggggccuguaguugccccgcucugcugugacuuccagugaccaucccuauguagagccaagcagcaggaggacaaagaaaagaugaugaaguggggcuucuugcuacccuucuugggaccacagaucccuugcuuggggaagaaggacccucuccucauguuuuugagcuccugucagcuugcaguggcacugcuguugcagcagccaccagaggauugcuuaagugcuggggugcaauagaacagagaaaggggaaaaaauaggcaauucccccugcucucucuaagcauuagaaguccuuuuccugcuccaugaaccggcccuagagcuuuuccuggagaaccuccucugccuucuccugccucagugccuguuuucagauggcuguauaaguuuaguacagaagacagcugaggaaaaaaaggaagcucaccacugguucagugguacuuuggauuuugguucucuuccccaauucaccugcuacuguuuacuucucagggccuucaaauaauugcuucaugcuuucuguucggguuuaucaguggaagagacaugguggaauaggccuacuccaccuuaucaggaagaggauccucuacuuugguuuuaauuugaucuuugucuaacuucuuaagguggaaacauaggucacagauuaugggccauucuuauuuacuguaaaaacauuuaaagcuccuuccgcaggcaggagagucagcuagccacccaagaaaacaucaugaaagauaccgauaucaagagacuacuguauacccaucuuuuaugcauauuuucaauuauccuaagugucuucauuccaucacucuucuuggagaacuccucaauauuggaaacacacuugacaugguugugcgucuguucugguuuuguaacugcugucagucuaguacuauauuuaguagugaaaccaaauacauccucuaaaauaaguucauuaucauacaagguaaccagauuuuugaaaugcuguaucuacuuucuuaugucuuguuucuccuuucauguaauuuuuguucuauauggagcaccacuaauagaguuggcauuggaaacauuuuuauuugcaguuauuuugucuacuuuuacuauugugccuuacuuauguuuguuaggaccaaaccucaaagcauggcuaagaguuuucaguagaaauggaguuacauccauaugggagaauagucuccagaucacugcaaugucuaguuuuguaggagcauggcuuggagcacguccuauuccuugacagggcaagagcauggcagguauggcccaucuccuguacgcuuggagcgaccuuuguccacguggcuggccuuguuauuucaccacucuggauauacuggaauagaaagcaacuuacauacaagaacaauuaacuggagcaaagggagauauuucuuugugcagauucuguaagggcugugcagaaauguguguggucaaagccaagcaguuccauuuacagcacuguuuuuuauguaguuacaacaugaugugauuguagcuuuuuaaacuaugaaaccccugagagauuguaccuucuaguugaaauaaaguauuuauaauagaaaaaaaaauauugaaagcuauauaauuuccucuaagcauugcuuugguuguaacacauaaaauauuaucucauuccauugugauuuccucuuugaccucucagaauuuacaaauucacugcuuaauuuucaaacaugaggauuucccagauaguugaaauguaauucuuuaggugucuuuuuuuaauuguaauguuuuguguuuguguguauauguguacaauauacguaacauaaaauuugccauuuuagccauuuuuaguguaucauuuggaggcauuuaaauacauucacauuguuguggaaccagcaccgccauccgucuccagaacuuuuucaucuuuccuaaugaaaacucuauauccuuuaagcaauagcaucccauuccccgcuuccgccagccccugguaaccuccgcuuucugccucuaugaauuugacuacucuagauaccucauaugaguugaaucaugcaauauuugucuuuucgugacuggcuuauuucacuuagcauaauaucuucgagguucauccuugaaguggauucagcaugucacugccagucuuuuuauacccaaacuaacuuccccauucauguuuauuuuuuauucaaauugaauauuuaaauaauagcagaaaugguuuaggaguacuguuauuacugaaucuucauauuuaagacuguguuuugccuuucucugcacauguguggagugcugaccauguggaguucuugagucacaucaguucuugcaggcauggccccauugucuuucggcauccuguguuccugagaaaaucucuucugccaguuuuuuaaaaauuuguagguaaucuuuuuuuuuuuuucuuucguaagcaucaacuccucagaacuaacuuuuaagucuaaauuccaugaagguauacugaauccuacuauuaaguuuucuguaguacaaaaauauguuugaacuuaaaaugauuaauauuuuccagaauagcaaauacuuuguucuuuuuguaauuugauuuuugaaauacauacacagaagaauguguaaaaucugacuguucaacaaaaaccuacauacucuucuaagcccuuuauuaacuaacuuuuguucuuauaucagcacuauaagauagguaccauuuaacaaauuuggacaauagagcacagagagguuaagaaaccuacgcaaggugugguggcucaugccuguaaucccagcacuuuuugaggccgaggcgggcggaucacgaggucaggagaucgagaccaucuuggcuaacacggugaaaccccgucuguacuaaaaccacaaaaaauuagccgggcaugguggcgggcaccuauagucccagcuacucgggaggcugaggcaggagaauggcgugaacccaggagguggagcuugcagugagccgagaucgcuccacugcacuccagccugcaugacagagagagacucugucucaaaaaaaaaaaaaaaagaaaccugcccaaggucacacagcuaauagugguggagcuccagaguucauuuugaguucauuaacucaaaaguccgaaguuucaucuuaguguuaucguaaccacugugcccuucugcuucucuuuuuaguuaauaaugauaaagacaaaugaagaaaaaagaaagcaggccaggcacaggggcucccaccaguaaucccagcacuuugggaggccaagguggguggaucaccugaggucaggaguucaagaucagccuggccaacauggugaaaccccaucucuacuaaaaagacaaaauuagccaggcauggugguacaugccuguagucccuguagucccagcuacuugggagacugaggcaggagaaucaccugaacccaggaggcggagguagcaguaagccgagauugcgccauugcacuacacccugggcgacaagagcaaaacuccaucucaaaauaauaauaauaauaauaaggcagauauccaguuaccagagcccagaucaagaaacagaacauugcuagugccauggaaaugcuuugugugcaucuccucauucacauccucuuaccucucucuacccaagauauaaccaguauucugacuucugugauaccuccuuucccucucuuuauacuauugccauuuaucauugaaucucuaaacaauauaucugguuuuggucuguuuuaaaacuuuaaauugaaucuuuauauauauauauauauauacacacacacacacacacacacacauauauauacacauauauacauauacauauauauuaugugccuuugcuuauucauucauauugauauguguagcuuuaguuuauuaaugcucacuguugucaguuacuccauuguaugaacacuugacgaucuuguuauccauuuuuugaugaugggcauuugugauguuuccaguuuuugcuguuguacacagugcugugugaagaaucaugaauucucacacuguugcaagguggaguuacuaguggaguuacuaagugcaugcaccuagugguagacuugcuguaucagcccaugugcuugcucuaggcuguacuaaacuauuuuuccaaugcuugaaucagauuggauuuccaccaggaguauguggaaguucccacuauugcaucuuuccaaaaucugaagcugucaguuugaauuuuuacauuuuguuacuugggcggaugugguaauggcaucuuguugcggcuuuaaucggcuuucccuugguuacuguugagauugggcaucuuugcuuacguuugcagaccauucaggcuuccuuuccuuaagugcuuauucaagucuuuugcccauuuuucuagugggcuugguguuucauaagcauuauuuuccaagucuccauucuaguuuuuugugggucauguguugcaaauaucuucucccaguagguaguuucuauuuuuuuagcuuuuauuuuuauuuuuauauuuugagacaggaucuugcucugucucccaggcugaagugcaguagcaugaucacggcucacugcagacuugaacucccgggcucaggcgauccucccaccucagccuccgaguagcugagaccacaugugugcgccaccaugaucugguaguuuuugaauuauuuguagagaugggcucucacuauguugcccuaggugauuuaaaauuccuggucucaagaaauccucccacaucaaccuccuaaagugcugggauuacaggcgcgagccacugcacucagcuuuuuaucuuuuuuuaugaugucuuuugaugacuagaagcacuuaauuuucucccaacauuuuucuuucuucuuuuggucuuuauacuucuuuuuucuucucauucucuguuuuaauuauuuuuaaaauuuauuuccugaacuucuucauaguuuccaaacuuaauauuuucuguguauaauuuaucuuuggauagaagcaguucugucuggacuuuguauuugucuaauaguguaaauggauucuccuuugcuuguuauguuguuuaauacauagcaccuuaaauguucccaaagaacuugaguuggcuggcugaccccuguacagaggugaggcaacagggagcugccaauucacaugucaccugcugguauuuucuuuuuuuuuuugagauggagucucgcugugucgcccaggcuggagugcaguggcacgaucucgacucacugcaagcuccgccucccagguucacgccauucuccugccucagccuccugaguagcugggacuacaggugugugccaccaugcccggcuaauuuuuuuguauuuuuuaguagagacaggguuucaccguguuagccaggauggucuagaucuccugaccuggugauccguccaccucggccucccagaguucugggauuacaggugucagccaccacgcccggccaccugcugguauuuucauacucaguuugacaguuccucuguuugggguuacuugguuguauguguuuuggaaguggagccugguugucuuuccacuuuuucucucuuuucacuuaagcagaucagguuggaagaaagaggccugguuaaugcuuauuucuugcuucacaggaaagccugugcccauaggccuugguuuguuuguucaguguugaucucucucuguugacuucgaucagcaaucggaaagcugauucucagguugcagugccaguccucuaccccuuauuuugucugggauaagaaauaggaucuaagaaaauucaagucugaguagcuacaagguccuuuuccagccuccucucaaacaguuuagcagauccccuggccugucccuaccaccaguucucaucuuuaaggaaugcguauuuaggaaaugguaguaucccuuaggacugucuuaccccugugaauaaauuacagccugcuuaaaguuuaaggggaagaaaccucuagauugugucauccuccuuuaagaguuuaaguuucauguauguucugguacuuuauguuccagaggaguauauucucaaaggguaguuuacauacuguguuagucuguucucacauugcuauaaagaaacaccugagacuagguaauuuauucauuuauuuauuuuugggguuuuuuuuuuuugagacggaguuucgcucuugucgcccaggcuggagugugauggcacaaucucagcucacugcaaccuccaccucccggguucaagugauucuccugccucagccuccucaguagcugggauuacaggugcacaccaucauaccuggccaauguguguguguguguguguguguguguguguguguguguguguguguguuuuaguagagaugggguuuugcuauguuggccaggcuagucucgaacuccugaccucgggugauucugcccaccucagccucccaaagcgcugggauuacagccgugagccaccaagccuggcugagucuggguaauuuauaagaaaaguuuaauuggcuuaugguucuacaggcuguacgggaagcauuagugccagcaucugcuuguagggaagccucaggaggcuuacagucauaguggagggcaaaaggggagcaggcauaucaaaugauaaaaccaggagcaagagagaguggcagggggaggugcuacacacuuuuaaguggccagaucucaugagaacucacucaugauagggaggacaguaccaagagggagggugcuaaaccauucauaagaaaccacucccaugauccagucaccucccauaaggcccaaccuccaacacuggggauuacauuucaauaugagauuuggguggggacacacauccaaaugaaaucauaucauucugccccuggccccucccaaucuuaugucuuucucacauuucaaaauacaaucuugccuuuccacuaaucccuaaagucuuaacucguuccaacauuaacucaaaaguccacagucucaucuuagacaaggcaagucccuucuaccuaugagccuauaaaauaaaagacaaguuaguuaccuccaagauauacuggggguauaggcauugggucaacacuccuguuccaaaagggagaacucucugccaaaagaaaggggcuauaggccccaugaaaguccagaaaccaucagggcagucauuaaaucuuaaagcuucaaaauuauuuucuuugacucuguaucucauauccagggcacucugcugcgagggguggagucccuaggccuugggcagaucugcccacauggcuuugcaguguucagucccugcagugcucucauggguuguaguugaaugucucuggcuuuuccacaugcagggugcaaacugccagugcaucuuacauucuggagucuggagggcaguggcccucuucucacaggcagugccccaguggggauucuacauggcggcuccaaugccacauuucuccucugcacugcccuaguauagguucucuguguggccucugccccugcagcaggcuucuaccuggacaccuaggcuuuucuauacauccucugaaaucuagauagaguuucccaagccuuaacuguucaacuguguauacccacaggcuuuauauaccauaucaaagcugccaaggcuuacagcuugcacccucugaagcagcagccugagcuguaaccuggccccuuucagccguggguggaucuggaguagcugggaugcagggagcagugucccaaggcugugcagggcaccgggcccugggccuggcccaggaaaccauucagucauccuaggccucugguggaaggggcugcugugaaggucucugaaaugccuuugaggccuuuuccccauugucuuggcuuacuaguacuuggguccuuuuuacucaugcaaauuucugcagccugcuugaauuccuucccugaaaaugggcuuuucuuuucuaccacauggccaggcugcaaauguuccacuuacucccuuuuaaauaccaguuccaguuuuaagucauuucuuuguucucacaucugagcauagauuguuagcagacaacccaccucuugugugcuuugcugcuuagaaauuucguccaccagaugcccucaaucaccauucucucaaguucaaaguuccacagaucccuagggcaggggcacaguacagccaaggucuuugcuaaagcauagcaaaaaugaccuuugcugcaguucccaguaaguuccucauuuccaucugagaccuuaaccaagacuucacuguccauaucacuaucagcauuuuggucauaaccauuuaaccaguuucuaagauguuccaaacucucucuuaucuuccuaucuucuucugggucuuccaaacucuuccauccuuugccuguuacccaguuauuccaaagucaccuccacauuuucagguaucuuuauagaaauucuccacuuccccguaccaauuuucuguauuacucaauucucacauuguuaugaagaaauaccucagacugggugauuuauaagaaaagagguguaauuggcucacaguuccuguacaagaggcauagugccagcaucugcuugacggugggggggggggcucaggaggcuuacagucauggcaguaggugagaggggagcaggcacaucaaauggcaagagcaagagugaggagggagguguuacacacuuguaaauaaccacaucucacaagaacucacucaugauagggaggacaguaccaagggggaugguguuaaaccauucauaagaaaccacucccaugauccaaucaucucccauaaggccccaccuccaacacuggggauuacauuucaauaugaaauuuggguggggacacacauccaaacuauaccaccuagauuauguuacuuacuuccuaucauauuucauuuuauuuacuuccuauaucauauuucuuucuuuuuuuuucccuuuccuuuuuuuuuuuuuuuuuuuuuuuugagacagagucucacucugucacccaggcuggagugcagugguacuaccucagcucacugcaaccuccaccuccuggguucaagcaacucucccaucccagccucccaaguagcuaagacuacaggcgccugccaccaugcccagcuaauuuuuguguauuuaguagagaugggauuccaccauuuuggccaggcuggucuugaacuccugaccucaagugauccgccugccuuggccucucaaagugcugagauuacggccaugagccaccacacccgggcuugaccauauuucuuaauccucauuuuauaucugugacccucagagccagugagacaaguaacuaguuaagaugguguuaagagccacgguuugaauccaaguuugucugacuuugagucagcaaucuuuacauugugucacacugugacauuuuaggaagauuaauuugguguaggauucuagguggccucguaggaggaaagaaacuucuggcaggaauaccagguacagugugcaggguuuccugaucugccuuucccaaucccagcucuucugcauguguuuccuuaguuccaucuucauuauguagccuacuccaguggucagugccuucacuguccaucccuccugaaugggcucacucuuuucucugcuuaugcaguacaucugccauccccugcuuucaguuccccuguuaucuuuggaucaguucacuguuguuucucucccuuccuauuucucuaccuaauuuuggguacauguuugaaagcucucaaaugugcucagcaguuauuuuaguugauagcuaguuuaauucucucauuccuaccuuaugcaguuuccagucuccuagcacagaaaccaaugugcauuugaauuuuuuuuuuuuuucagacugggagacaagacuugaaaccaaagagccaacuccgaagccggguauuacugaagauuuaugccaugggguaacaauggaaagggaagguaucuggcauucuacucuaggggaaaccugggaaccuaauaauugguuagagggacaacaggauagucaucugagccaagugggaguuacccauaaggaaaccuucacugagaugagaguauguggagguaaugaauuugaaagauguuccagucaggauucaauccuugauacacagcaaagcauuccuaugguaaaaaggccccauaacuguaauucacauggagaagaugccacacaaaauucugaguuaauuaaaacucaaagaauguuuguaggaaagaagaucuaugaauguaaucagugcagcaaaaccuucagucagagcucaucccuucuuaagcaccagaggauucauacuggggagaaacccuauaaguguaauguaugugggaaacacuucauugaacgauccucccuuacuguacaucaaagaauucauacuggagagaaacccuauaaauguaaugaaugugggaaagccuuuagucagagcaugaaucuuacuguccaucaacgaacucacaccggagagaaacccuaucaguguaaagaguguggcaaagccuuccauaagaauucaucucuuauucagcaugaaaggauucauacuggagagaaacccuacaaauguaaugaaugugguaaagcuuuuacccaaagcaugaauuugacaguucaucagagaacucauacaggagaaaaacccuaugaauguaaugaauguggaaaagccuucagucaaagcaugcaucuuauuguacaucagagaagccauacuggagaaaaacccuaugaguguagucaauguggaaaagccuuuaguaagagcucaacucuuacccuacaucagcgaaaucacacuggagaaaaaccuuacaaauguaacaaaugcgggaaauccuuuagccaaaguacauaucuuauagaacaucagagacuucauucuggaguaaaaccuuuugaauguaacgaguguggaaaagcuuucaguaagaauucaucucuaacucaacaucggagaauucacacuggagagaaaccuuaugaguguaugguguguggaaaacauuucacuggacgaucaucccuuaccgugcaucaggucauucacacuggagagaaaccuuaugagugcaaugaauguggaaaggcauucagccagagugcuuaccuuauugaacaucaaagaauucauacuggugagaaacccuaugaaugugaucaguguggaaaagccuucauuaagaauucaucccuuacagugcaucagagaacucauacaggagagaaacccuaucaguguaaugaaugcggaaaagccuucagccggaguacaaaccuuacacgacaucaaagaacucauacgugaggaauguuuucacuggcccuuaccucaugauuaacucuucaguaauaaucauaugagacauacaauguagaaaccuaauaaauguaaugauugugggaaucuuucaguugaaguacaauaugucauaucagauaauaccacugcagagaauccaucuaaaaguagagaaaucuugauucagaauguauaauuuccuuuauaucagaagguuuaaauagcuaauauaaacaaugaagagucaugcugaagauaaguucuguuauaucauaccgcacauucuccuuuggcuaucagagacuuuacacuggagagaaaaaugugagaguguuuaacuggacagcccagagaccugguauguaguccuaaucugccacugccuuggacaacuugccuacuuccaccagguuaugguucuuuauuugguaaaugaaugauuuuggaguuagaaaucuuguaggagcucuguuagcucuaaaaugcuacaacucuauaaauauaaugaaugcuggg

SEQ ID NO: 192225 - RNA, 19182 nt, Homo sapiens
ccggcgcgccgcggggugagcggcgccgggccugaggucgcccagacgccgucggggcggagccgggucgcgaggcugcaucccggccggcgguuccggagccucgcggcuggggaggcgcggcccgggacgcucgagcuuagggaggugagcgucggcggcaggccaagccgguaggaggcggcgcccggcacggggacugccugcggcugccgaggcuccgaaagccuuugugggcgcuggcgggcacccccgcgucugucaccggcccccgcgccgggaucuggacucucgcccccccgcggggcgcucccucgccguugcuggugcacccgcguccggcucgccguggacgccgggccuggcguuuccucccgggcccguccugcccacuccaugugggccucgcggacucggggcaccgggaccccgagggcagggcggacgcagccgggccccgguuuccgaguccguccccaggacggccaccccucccgccucgggacacccagcgcuuuccucuucagagcugguguuuggccgggcgcgguggcucacgccuguaaucccagcacuuugggaggccgaagcggguggaucacgaggucaggagaucgagaccauccugacuaacacggugaaaccccgucucuacuaaaaauacaaaaaaaauuagccgggcguaguggcgggcgccuguagucccagcuacuugugaggccgaggcaggagaauggcgugaacccaggaggcggagcuugcagugagccgagaucaagcccugcacuccagccugagcgacagagcgagacuccgucucaaaaaagaaacaucguguuagaaaugggauacauggggucgggcgugguggcucacgccuguaauccuagauuuuugggaugccaaggcgggcagaucaccugagaucaggaguucgagaccagccugggcaacacggugaaaccucgucucuacuaaaaauacaaaaaugagccgggcgccuguagucccagcuacucgggaggcugaggcaggagaauggcuugaacccgggaggcagagcuugcagugagccgagauccugccacugcgcuacugcacuccagucuggccaacagagcgagacuccgccucaaaaaaaaaaaagccguuuuccguggagucgggagaugauucguuggcgggagagagaggaaccggcugggaaaggcuugaggcggagggaagucgucccggggccgucguggugggagucccggcccgccucgcagcggcgugaacggggcaggugccccggcgcugccucaguuuccugagcggugcagugggugcuggcagugccagcuggcgccgaggaacucagcggcguggggcgagcccuggcccuggugggcucagcgggucgcugcugccacugcggcuccagcguccccuccguaagccccaagccuguggggccugggccuggccgggcggcccagcgcugcucugguccgcgggcuccuggcuccucccgaaucccugugagggcgcgcgggguccuucucagcgggagucgggguuuuagagcugcggauuccagggcuggaaagcagaagggguucuuccuggcucccuuuuucuucucagaucugccuucuggagacugcgccguccucccgggagagccagaaagaggacauggcugcugggcagcgggaagcgaggccccaggugagcucauugcccucccagaucccaguggauggauuuuccccacuaacuggaguucuucacccgggaccaucuccagccaggauggagcccaaguccuuuucucuuggaggagcugguccgcccucaugagugguggauucuguagggaggaccacccacccuccccacccgugucuagugguucucuuuuuuuuuuuuuuuuuugaaucucgcuuugucgcccaggcaguggcgggaucucggcucgcugcaaccucugccucccagguugaagcaauucuccugccucagccucccaaguagcugggauuacaggcucccgccaucacgcccggcuaaguuuuuuuuuuugugcuuuuauuagagaugggguuucaccacguuggccaggcuggucucaaacuccugaccucaggugauccacccgccucagccucccaaagugcugggauuacagaugugcgccacugcacccagcccgaauaaaucauuuucuguacacauuuauuuguguguguguguuuguguaugcauguuaccaucuauguuaccauuuuaaccuuuuuuuauuguggcaaaauauauauaacauaaaauauaccauuuuaacuuuuuaaguguauaauucagugguauuuuagguacuuccgcauugcugugcagccaucaucgcuauccaucuuuauuguguagauuaucacauuuauuucuuaacccuaaggggcaggcauuaaaaggcaguuuuacagaguaguuaagaaugcaagcucagugagacaucugcuggauuugaauuacacaagaaaaaacaaagucacagagaggauacaaaauuuguagaagucagccggccacaguggcucacaccuguaaucccagcacuuugggaggucgaggccggcagaucgccugagguuaggaguuugagaccagcaugguggaacccugucucuacuaaaaauacaaaaauuagccgggcauggugucuagcaccuguaaucccaccuacucaggaggccgaggcaagagaaucauuggaacccggaagguggagguuacaguaagccaagaucaugccauugcacuccagccuaggcaacaagagccaaacucugucucaaagaaaaaaaaaaauguguacaagucacacagcuggucagugacugugucugugugaccuggacaaauuucuuaucuugucugugacuuuguuuucucuuguguaaaguggcaacaauaaugguaucgucuugauaggauuguugugaauguuaaauaaagauuauacacugcaaauuaacauaaagcucuaagaucaauacuuggcccauagaaagccuucaauaaauuauagcuauuuuacuuuucgucauuacuauccuuaagcuugaguaagcacauagagaguaccuucaguugcuuaaccuaaccuccaucauuaaguauuuagauuauuccugguuuuuugcucuuaaaaacaccaugaauauguuuguguguacuuuugugcacuguucauuaucguacaaauagaguaauugguacuuuaaagaguauacuuugaggguucuaauauguauuagcaaaucgccaucagaaagaguuuucuaauuaacacucccacuaauggccguaauuccucuacccaucucuuacaguggcugcacuaggccugaaucucacugugugcugcucaguauacauuuguuacuggccaauuauucauuaaacgaaugaucuggaaccuucagaagcuugaauaguaugggaaguguuucacggguagcgugucuuucccacugccgcccccucugcucugugagggugguccugggugagcuggaacgacuuguccuuacaggugucacugacguuugaggauguggcugugcuguuuacccgagaugaguggagaaagcuggccccuucucagagaaacuuguaccgggaugugaugcuggagaacuauaggaaccuggucucacuggguaaggaaauuuucccucuagaaacagaauucaaaaauugggauaucucagcaccuccuucccugaauaaaagcgguuggucacugaaaaauuugagcugagugugugaggauuguacaaaucagaucuuuauaaauaaacauuaaaaaccuauucccccuuauaggcaugaaauugcccugugucugggaauggaagaggugguauugauaaucauuccucucucucuauguaaucacacacuccaaguuuguccaugauucaggcaucguuucccaacgauucuguaguuugcuugucucccaacagggagcuucauucagccucuaggccuaccaccugccuuucccacuugucuuuuccagggauuagcaaacuuuuacuauaaaaagccauguaggcugggcaugguggcucacaccuguaaucccagcacuuugggaggccaaggcgggcagaucaugaggucaagagauagagaccauucuggcuaacguggugaaagccugucucuacuaaaaaacacaaaaaaaauuagcugggugugaugccgggcgccuguaguccccgcuacuuugaaggcugaggcaggagaauggcgaggagcuugcagugagccaaguucccgccacugcacuccagccugggcgacaaagcgagacucugucucaaaaaaaaaaaagccacguaguaaagacuuuaggcuuugugggcugcguaauggucuccguaacauauuucucuuuuuuuuucccaccauucuuugcacagggccauacauaaacaggcaguggucugaauuuggcccaugacccguaguuugcugaucacugccauccuuaaaagggagucacauaggccgggcgcgguggcucacaccuguaaucccagcacuuugggaggccgaggcgggcagaucacaaggucagaagaucaagaccauccuggccaacauggugaaacccugucucuacugaaaauacaaaacuuaggcgugguggcauguuccuguaguccccgcuacuugggagacugaggcaggaaaaucacuugaacccgggagacggagguugcagugagccaagauugcgccacugcacuccagccuggcaauagagcgagacuccuccucagaaaaaaaaagcggagucagauaguguuuucucguuuuagacaagcuaccugguacauaauccuuuucauagauaaccuacuuagaaauucuaaucagucuguauaucuuaacauuuccucuucuauagaaagcuagugguauccuauuaccaauacugcauguugaucauauuuuccuaaccuauaauuaauugucccagagucauguccuacaagucacuugucuuuuccucacccuaccgccuuacccccuuaccucccaggggcacaacugaagcccuacacagaagcucuuuguaccauccugugaguucuguauuuaaauuugggauaacuguaucaauacaaaaccaagucugauuuguuugguugugguuuuuuguuuaugugcagggcucccauuuaccaaaccaaaagugaucucccuguugcagcaaggagaagaucccugggagguggagaaagacgguucuggcgucuccucucuagguaaguggguggcccgaggugcggaauggccgcagacaauggucugguuaaugagaggagguaggaacguugguugggaaacucccuugagaauucucaggccucaagaagugauggggaagcggaagcccaggcucuuaggcaggauucacuuccccaugaaucucucagaaucucuuucuuacucuuuccuguuguuuuagaauagggcuguauuuucauguauucauucagcaaacauagucuauuuaaggaauuucaaauaaucacucuggcugaagcucaggguguauuugggaaaggaggaggugaggaaggaaauagccuagaaagcuagggaagggccgcgugguaagugcuugggcacgguucuaagagguggaaacugucccauggagcacuggaaauaauggaaggauuugggcaggaaucauaugguccuugguaucuuagaaaaguuggugugaaucagaaacagcugagucuccauccguguaagaacagcuaagggaccugugagcaucaccacccugaaaacaagaguccagggacguggacagagcucccaaaaaguuacagagcauuguuaggacgccaccauuuaugucuaaugaaaauuauguguauguguaaugugcacauaagcagagagaaagguuaggaggacacaccuuagcugaugacauuaguuacacuuggaaugggauugagaauggguccauggaagggggcauuacuuacauguaguauuuuaauguuucacaaagagaauauauuugugacguucuuaugugauuugaauucacaagaauggucacuuuggaagcaucguguuugaaagugaggcagaacgcugggcacgguggcucacgccugucauccuagcacuuucagaggccgaggcgggcggaucaccugaggucaggaguuugagaccagccugggcaacauggcaaaacccugccucuacuaaaaauacaaaaauuagccaagcgugguggggcaggccuguaaucccagcuacuccggaggcugagacaggagaaacacuugaacccgggaggcggagguugcagugagccgagauugcgccacuucacuccagccuuggcgacagagugagacucugucuuaaaaaaaaaaaaaaaggcgggaagccuugcagagcgauugcagucauggagggaggcaggagguggaagggccuggaugaaggcacuugccgugaguucgugagggaggaggcggcgcccacgugaucaggguacaggagcaguugggugugggauggauuucacuugagaugugagugaagucgucagguggggaacccuggugggcagguguguaagugacagggccgagacucaagggaggucagggagcccauuagcaugaugggcauuagaagcuuggagcuggccaggugagggggccaaguggaggcccgaauuucaggaaacagcauuugcgaggugcuuaagcaggaggaaucugacagagcccgagaaguaaucagaguagagaaacggggaggggccaucguggcagugggggacugagagugguugaacugggggggcucuggcucugggggaucaagguugaacccucgcccacagcuuuguauagcauugggcagaaagggacacaggucuccugcuucuggagugcacgaucuagugggggacaaggugaacacacucauugcacacaaggcacagaaggacacauuccagugaggaccacgugggaaagacacucggugcugugagagugcagagcaggcagguggcgucagcaaaggcuucccuguggaagggccugggaucaaaggacugaagaauugcucaggccuaaagaaagguguucaugaagguccagagaagcaaagccagcgaggagaagguggagcacccgagagagagccacgggcccugucacaggguuugguuggugcuugagagccaggcacagguucugaggagccguaaguagcccagggcaggccuaggcugcuuucugcagccgccagcccauguggagaaccugacggccacagugcagggcuugucagguccagagggcucagugauggccccuuaugccaugggcccagcaaggagcugcagggcaggcagccucgguccccacagccccugugcuggggagagcuuucuccucccugaagaaaggugagauuuuuuuauaugggaaccacacuuguuuaucuuuuuaacucuccuuugggagaaauacacuacguggucuggcccuggcuaccucuucacucucagcuccuuccacucugcccuucauucgaggccucugaucacccuuggccgcccugcagugugucauggggggcgccaagcaggcccccacucagggccucugcccugcuuuuucugucugggacuguucuucguggcggucaugcguccauguggcucgcucacuuccuugugcugcacaggcuucggcucacacaggcacagaucaucugacacgcagcccugcagcccccacgccaucuccucaccgugcuuuauuuucccuccucgugcuuagcgcuguguaauagaucuguuucuucaugaucugucucugccucugcauuguaagcugcugugggagggguugccuguuucauucacuccuguuuuccaagaaccuaaaacagucccuggccaggguaugcguccaguuguauaaugaaugcacgagugacuuggacuagguuagugguguuggagacagaaagaagugaaccagucccagggauguccaggagauacagccagcaggacuguuagacauggaagauagaggagaugggguaacaaagaaaauaaaagcaaacaaaagggagaugggguugucagggaugcuugcuugguuucugguuuguucugugacgguuggugaugucauucagugagauaggaacacuagaaggagaucagauuuggagaugauguaaauuugguuuuagauuaauugagcuguuuuugguugaccuaguuaucccaguggcgaugacaaguaguguugauuucggaguacaguaccucaaaauguagacugagcuugaaauguaaauuugggagaaccugaucaauauagggugauugaaauaaugggagaggaugaguuggccuagggagaguguucacauuacaguaagaguaagaaagagccuaagacugaaucuugaggaacuccagcauuucaggaagccaggcagagagaaaugaacccauagggaagacagguaaaagcguacuguaaggaaaaucaggagaggcaggugacauuggaggcaaggcucaugauggaaugguagcaguagauggggaaaaguagacgaaugugaggcagauuuagauggcagaauaaacaggucuugguaauugauuagaugagggggcugagggagggagaauuauuaaggauaacucuuaagguuuugauucagagguggugccauuuacagagacaagggguugaccaggucggagggaagaaucgugagugugguuuuagguguguugacuuugaggcaucugaacugcucuuuugaguaggucgucuguaagggggagucgaguaugggagauaucuugcuuagaggaugagucuaugauugaaguugccuguggaaagaugcagagugagaagaacugggggccuagaacuaaagcuaaggcacuccaaggaugauaaacugugguacguccacacagcuguaaaguggaaugaggaggaccucuguaacuucuacuauggagugaucuccagaaugugagaauaagugcagaacagcacaguuaguacuguuaucuaagaaaggugggugggaauaccaagaaaaguguguguguauuuacuuacacugucauggagcacauaauguuucagucaaugauagccuacauauaugaugaugcucccauagaugauaauacugcauuuuuccugucccuuuucuauguuuuaauauguugagaugcacaaauacuuacaauuguguuacaguagccuacaguauucagcuaaguaacaugcuguauagggguauagccuagguguguaguagccuauaccaucuagauuuguguaacacacucugaugacugcacaacaucgccaacaacgcguaucucagaacauaucccagucauuaagcagugcaauuauuuuuuuuagaaagauaaaagcaaaagaaaaaaaaggagaucaauaaaaaugguuaucucuaaggugaaggaagaaaaaggauggaacagggguagaaucuaugacuuuuugaggucucaaaauuuugacuucagaacuauaaaaaugguuuauaaaauuauaagacaaaauuaaacaaaaaugagaaaguacccccuacauauugaaagcagaaugaaacaacccuaauuguguuccagguugguggcuuagccacaaaaagaauuauuugaauugccuuuacauugcagcaguuugacuuauuaguguagguauucuaggggcaaaaguaacugcaagcagugguguuaauuuugauggaugugcuaagagcgguuuugauguuuuuacagaugaaaugauuuugcugucugggaugugcucuagcauaaccuaguggacgagaugaaaggguuuguguuaguuugcuagggcuccauacugaaguaccacaagcuucguggcuuaaaacaguagagauuuacugucucacaguucugaaggucaaaaucaagauauucgcagggccccgcucccucugagacucugcauagaauucuuccuugccuuuugcuagcuuguagcgauggccaacuuggagaucuccguggccugcagcugcaucaguccuaucugugccuccgucuucacacuguguucgcccggugucuucacaucaucuuuccuucuggaugccuguguccaaauuuccccaguuuacggggacagcagucacgcuggauuagggcucaccccaaugacuucaucuuaauuugauugaacgugcaaagaccauauuuuaaaguaaggucacguucugagguccuggaaguuaggacuucuacgucucucuuuugaaugaugcgguucagcccauaacaagguugucaauagaauaguguugcugguuauugaaacuggcuggagauucacuguacaauucacacuacuuuuacauaugcugaaaauuucuauguuaaaagcuuuaaaaauaagaguuaccacaacaacauuucuaaaacagcuuuucucuuuuccaccagcacaaagaugauagaggauguuuacaaauaggcaguacuacccccaucaugguuuaugugcaguucccagcagauugcuccuugaguucucugacucuagaaaaccuugugagacugcaaaugcaagugacauuuuuuuuuuuuuuugagacggagucucgcucugucgcccaggcuggagugcgguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccgcaagugacauuuuuauagguggagcuuuuacucugacuagcuauaggauaagguggggguggauacuucagcaaauaagucuggaaaacugacuugcauucaaagacuugggugcugccuucagcccuugugcuaccccuucaucuagccuauggcgauuccuuucacauccuaucuuauaugucaauucuuacgaaacacuccagcagcguccugcugcaccccuuuucuaccugcacccucacuaucuaaggacaguuggauaugauucuaagcucguguucacguccauuucuagcuuauguuucuauuguagaaauugucacauuguauugugauuaccuacugaugucuucauuucuaaugucugacuauaaacucucugaagaaaucaacuguuccuuuuaauuacuggauccguagggaacuguggaucaccgaugccuaggauagagccuaauacauaguagguacuuuuuaaauauuugauaaauuaauaaaguaaggcgugaccaaugcuuuuugaaauaacaugaccaauucuguguauuaagagggguaaauccagugggaaauaauacuggaaaggcaagaaacaggucaaaggaauaacuuaagaucaggagcaagucacucuacagugaggagauccugaacuuagacauauucacgauggcuuauuagagacauuuuagugaugagauuuaagagaaugugcagccugggcaacacaaugaaacccugucacuacgcaagauaaaaauauuagccaagcuuggcagugugcacccguaguuccugcugcucaggaggcugaggugggagaaucgcuugagcccuggaguuugaggcugcagugagcuaugauggcaccagugcauuucagccugggcaacagagcaagacccugucucucaaaaaacaaaaaaaugaagauuuugaugacugccuagggaagagaaauucuaagauaaaacuaagaauuuacgguaaauuaacugaagagaugauggugucauuuugaacuggaaaacauauaaaaaagguuugaaaaggaaugcucuggguucagauuuggacaggcugaauuuaaaaagaaagauacacaaguggaaauucuaaccggcaguuggaaagaccucuguaaaguauuuuucaggauagucguacacauaagaggugugggaguaaaugaaaucauccagggagauaggguugaagaaacacucucuggguguagugagaguccagguggaagagucuagaccugauaacaggaaguggucagggcaguggccaucagcaagaugauucuggcuucucaacuucugaccuaggucuucaccuuguuuaacagguagcugaggacugggcuugauucuaggaggaagcaaagguugaacugcaccucaggagaccuauuuguaggccucuagaaaguucuaaacagaucauaaggaagagucaggauauccacaauccaaaacuuacgucugcuucugugaaaaacaugauuucaggacuaaaauauuggcacuuuagaguugggaugaguuuuccagaauugauaauggacuuccgagucguaaucauauccauuaaaaaauaaaagcuccccaugucacauuugcuuacucuccuuuagaaacuguugaaaaggguuucugcucuugauguuucuauuuucucaccucccauuguuuccuccaugcacuccagcugggcuuucuuccuuauaauuccacugauagcucuguuauuaaaucccaaacaaccuccgucuugccacaaucaggauuaaguuuuuaguccucaaauuauuugccacaguuauucacuccucccugaaguacuucuucccuuggcuucuggaacacuguacucuccugauauuauucuucuuaaccucguaauauuucagugucuaagugauuccuuucaguucuucagcuuuaaaucaaacccacaugcugcugacccccaaaugccugucuauagcucugaccucccccagaucuccagaauaauaaauacaaucuaguauuucaguaucuuccugcaacucuauuaaggcaucucagccaucacaaacauaccagaaacagaaugcccccucagccuugccccuuuccuggucuuccccuucuagccuugccccuuuccuggucuuucccuucuuggugguugguggcagcucucagaauucuggcuagaaaccuaggcaugaucccuaacuuuccuguuucccucucagcuuccugggaguccugagucuuguuauucuuggucccgcuagcucuuccuucacuguacagccuggcauagucaucuguaccuccagcccuuucucacgugaagagcugcaguagcuucuucaguagccucuccccucccugcuuccacuggugccccagcguagucgguccacgcagcagccaacucaaaugaacacauaauuccccaguggcuucccguaggcuuaaauuccaguccuuaggaugaccugggccuuagaggauuugucccccaccuccugcuccacucuuuuguuuuuuauuuuuuguuuacuuuuuuuuuuuuuuuuuuugagauggagucucacucugucgcccaggcuggugugcagucaugugaucugggcucacugcagccucugccuccuggguucaagcaauucucugccucagccucccgaguaccugggauuaugggcgugugccaccacacccggcugauuuuuguauuuuuaguagauaacagauuucaccguguuggccaggcuggccuugaauuccugaucucaggugaugcacccaccucggccucccaaagugcuaggauugcagcugugagccaccacgcccggccccguuccaggcuuauuuuaucauuucaccauuuucccucuucucgcucuacucuggccagucucucugcuguuccuaagucagccucacuuuuguguguguugguuccuuugcccagggagcucuugagcacuuucuucagcuauccacaugacuuuuauuacguacuuguuauuugucccuucaucccccuccuuccccagcacaugcgcacacuccaaaguauaagcuccuuaaaggcuggaacccugucuuauugaauacauuaucugcauuccccagaacauuaccuggcccauaguaggcacuuaaugaguacuugugaauggaaaggaugcugccagcauauguaaagauaaacaagucaagucauggagugcuccugaagcugcauguaguucagcauaccuggcaagaagccagggaagagggggugaggacagguggauaaaggucagaucagauaguacucuauucaccauguuaaggacgccuaagagucuucaagacucuuaagagacuucagaugugaaucauugaaaaucuauuggaggaccuuaaggaaguuugccacauaguaaaauauugaucuuagaaagauuggccgggcaugauggcucacaccuguaaucccagcgcuuuggggaggcugaggugggcggaacaugagaucaggaguucgagaccagccugaccaacauggugaaacccugucucuacuaaaaauacaaaaauuagccaggugugguggcgcacaccuguaaucccagcuacuuaggaggcugaggcaggagaaucacuugaaccugggagggggagguugcagugagccgaggucgcgccacugcacuccagccugggugacacagugagacuccaucucaaaaaaaaaaaaaaccacagagauuauucuggcugcaguguggagacugaauuggcagagggcaagacuaguuaggagauuaugguagagauaguaaugcauggcaaacaaaauaccacuuaaguaccugauccccgugcucagggcuguagcaaaggugagggaccuuucuuuacacuaggccuaaggcagguucuguaucauugccuuacaagcuagaauccaaguugcagaaucuugcugcugccuucuucccagcacauauauuaagccuagaaacaacgaccgauauucacagggaaaaagcacuucauuuuugccacugcccccuccauauauuuggccuaaauaauguauuaaaauuugaucacuuaauuuagcaagacugaaacggagaaggaacuaggaagguguuaagcauaaaguuaagaaacucugcuuucccuuacaguaaauaguauaaagauauaaggcaugugaaguuagucagggaggguguguggagugaaaaaaaaauccaaaacccuagggaauaccauuauuuaaagaaggaauggaagaagaguuauccaugaagggaacuaguaagugaacacuaauaagggaaaagcaagauguauuguguuuguuaagcagaaguaauuuguagaugugugaaagugacugucauacaggaaucgcaaauacagugagacacaaauggucccuuuaaacaguuaccucuaccccaagagaagaugcuaagacuaugugcauaaccguuccccugagagaauuuacuaucuauugaauuguguucuuauccaauuuuaauauuucuucacuucuguucuuuacuuuuccauguuaaccaugcuuuaucuuauauauccaugccugucuuauuguugaucuuugacucuuuucagccaucccauguaaccucucuugcuugaugcaugaguaggcugccuuccuaucuugcaccucuuggcucuaggccugucuuguggcaccucuugucgauuaauucaauaacagggcccuccuguuugaacuggcccugaaaccucucuaaucacccauguacuggccuaggaggcaacuucuacaagggucugaaauguguauguguauguauguauaacacaugugcauauuuguauauauaugaaguauguauguguauguauguauaacacaugugcauauuuguauauauaugaaauacguaagaauauuugacauuguuccaguuaggaauguauaaguaauuaaggcagauuaacaaaacauacaacuuuuguauauaauuggagugcugucaagaggaucuguaggaaaauagggcauucugaucugcuugugaagaacaguuacuucagaaaaggaaagugagauacauacagacauagauauagaacuauaauauacuauauaugugugcauauauuauaaaggucaguaauacauauguuuaauacucugguaagugcuauaguaaggagaagggaccguggcugcucagagucaaaggauugagagaguccauuuuugaacugaaucugaaggauauaagggaauuugacaugggguggagggacuuuccagauuaagaauaauuauauaaaggcugagcacaguggcucaugccuguaauccaagcacuuugggaggccgagguggguagaucacuugaggucaggaguucaaggccagccuggccaacacggugaaacccugucucuacuaaaaauacaaaaauuagccaggcaugauggugggugccuguaaucccagcuacucaggaggcugaggcacaagaauugcuugaagccaggagaccgguugcagugagccgagaucgcgccacugcacucgagccugggcgacagagugagacugucucaaaaaaaauuacacaaagaagauaaaugucaaaaaaaaaaaacaaaaaaaaauuaggauuccaucauggguuuuggguccuaaccccaaacuuccucuuucaacucaugaucccuuuauaacccuuuucucuguucuucauuagccaauucuucuggucacucuuucucacccucuuuaaauggguuugcuuuauuuuauucuucacccuaguacuuaaauugcugucaauuauauuuuauuauacugucuaacuguccuauuuuuucuuuuugcaauuuuuuucauacagauaucagggucuuauuuaaaugucaccaauauuuauuccuucuacacuuuuagucucaguagucagaugcuaugauaucacaugaaacauuuuugauuuuuuuuuucccuccaggaucgaagagcagucauaaaaccacaaagucaacgcaaacacaagacucuucauuucagggacugauacugaaaagauccaacaggaauguaccuugggauuugaaauuagaaaagccuuacauauaugaaggcagauuagagaaaaagcaggauaaaaagggaaguuuucagauaguuucagccacccacaaaaaaauccccacuauagaaagaagccauaaaaauacugaauugagccaaaacuucagcccaaagucagugcuuauuaggcaacagauacuucccagagaaaaaacaccaccaaaaugugaaauacaaggaaacagccucaaacagaauucacaauuacuuaaucaaccaaaaauuacagcagauaaacgcuauaaauguagucugugugaaaaaaccuucauuaacacuucaucccuucguaaacaugagaaaaaccauaguggagagaaacuauuuaaguguaaagaauguucaaaagccuuuagccaaaguucagcucuuauucaacaucaaauaacgcauacuggagagaaacccuacauauguaaagaaugugggaaagccuuuacucucaguacaucccuuuauaaacaucuaagaacccauacuguggagaaauccuacagauguaaagaaugugguaaauccuucagccgaaggucaggccuuuuuauacaucaaaaaauucaugcugaagaaaacccuuguaaguauaauccggguaggaaggcaucuaguugcagcacaucccuuucuggaugucaaagaauucauucuagaaagaaguccuacuuauguaaugaauguggcaacaccuuuaagucuagcucaucccuucguuaucaucagagaauucacacuggagagaagccuuuuaaauguagugaaugugggagagccuucagccagagugccucucuuauucaacaugaaagaauucacaccggagaaaagcccuauagaugcaaugaaugugggaaaggcuuuacuucuauuucacgacuuaauagacaccgaaucauucauacuggagagaaguuuuauaauuguaaugaaugugguaaagccuuaagcucccacucaacacuuauuauucacgagcgaauucauacuggagaaaaaccauguaaauguaaaguauguggaaaagccuucagacagaguucagcucucauucaacaucagagaaugcauacuggagaaagacccuauaaauguaacgagugugggaaaacauucagguguaacucaucacuuaguaaucaccagagaauucauacuggagagaaaccauaucgaugugaggaaugugggauaucuuuuggccaaaguucagcucuuauucagcaucgaaggauucauacaggagaaaaacccuuuaaauguaauacauguggaaaaacuuuuagacaaagcucaucacguauugcacaucagagaauucauacuggagagaaacccuaugaauguaauacaugugggaaacuuuucaaccauaggucaucccuuacuaaucauuauaaaauucauaucgaagaggaccccuagaaaguagauuuguaugugugaaagccuuaaaccaaagcucaucgaagaauacauccuugagagagauguaauaaauguaauggaugugaaaaaaacuguaauaauuuagcccucauuagguauuuaauuccauggauaaaccucagcuauauaauagauaugaggaaaguguuugugccugucagacacuuaaaaaaauaaccugagaugaagaauuuacaauugaagacauugacuuuagccauuugugaaauggguuugcuuuuucccuuuuccuacagacguauaugcuagaugucacgugaucaucagaaacagauauccgaguggguggggaggugugcuuuagauuucucauuagaagaccaccaaacugguaauauuuuuauagcauuuuaauagcuugaucaaauuguaccuuuuuagagaaaaggaccaaaauaaaagaaaaaugaauuaugaacuaccucucagucucugggguuuguccuuuuccuacccugaugucaaacuuaugcauggauuucauuaaaaaagaa

SEQ ID NO: 192226 - RNA, 17452 nt, Homo sapiens
gaagccggggccggggcugcggggcgaggugagagcgggcgggcuugggagccggcaggugcgggccgagggcgggcacagcggccggcggagcugaggcgcgcggcggggaaagcucggccggccucccgggccccagccuucuccagaaccccugcuacccacgacuaagccccgaacaaucugcccuugggcuuguucucuucgcaguugucggcccugggccgggagcuggagucccagacucauaggucccggcccagcccccgaagagccgccucagccggggggaguugcucggacucaaacguccaguccucgugcgaccgcgcugggucggaagugagcaggugcgcaccgggcucggcagggcuauggagcagggucuuuggaaggaugacuaggaguuugccugucguuugcauguuaaugcgggugaaacucccaguaggcgcugcuguccagggaaaaugaugggcuuuuuccucccuccaguuuugguuaaugagaaaagaaagauuagaaacuucaaguaggacuguauaguaaaaaaaaaaaaaaaauggaggagggcgauaugacacgguaacuggugugaggguggggcggaggggucaguauuagauacuguggucuagcagagcaucucugaggacgggacauuugcguugagacccaaauuaggaggcaggcuuaggaagauacgggaagagagugguccaggcagcgggaacagccagugugaaggcccuagggcagaaaucaacugagaguauagucaaggaacagaaagcaagcuaguguggcuaaaguaugguaagaaagggaaagagugguaggagaugaggucggauaauugggguuuggucacauagagucuguaggucagagagaggaauguggaguuuuuucuaaguacaguggaaaucuuuugguuuuaagcagaggagugacauguaggguagagaguggauggaggucgcggcugcaaaagcauaagaauuggcugggcacggugguucacgcccguaauuccagcacuuugggaggcugagacuggcagacggcuugagcucagcacuucaagaccaaccuggccaacauggugaaacccugucgcuccaaaaaauuaggcugggcgcaguggcucacgcuuguaaccccagcacuuugggaggccaaggcgggaggaucacuugaggccaggaguucaagaccagccuggccaacauggugaaaccccgucucuacuaaaaauacaaaauuuagccgggugugguggcaggugucuguaauuccagcuacuugggaggcugaggcaggagaaucgcuugaaacugggaagcaaagguugcaaugagccaagaucgugccacuguacuccagccugggcgacagaguaagacucugucucaaaaacaaacaacaaaaaaauuagccaggugugguggggagagaggggaagaauagggacaaaagggaauacauaaauaaacacaaaggagaaaaggcccugcauggaccacuuacaugugucaugaacucaggaguguucauggugggacuacauggugcaccuguagucccagcuucuugggguggggggcugaggugggaggaucacuugagcccaggaggucgaggcugcagugagcccugauuguaccacagcacucuggccugggaaacagauugagacccugucucucucuuuuuuuuuuuuuuuuuaagcaacccuauuaacugaagagacccugccucacaaaaaaaaaaaaaaaaaaaaaaaagcguuaagaauugggucaauggagguugucuaaucuuuuuuuuuuguuuuuguuuguuuguuuguuuuuuugagacagucucacucugucgcccaggcuggagugcaguggcgccaucucagcucacugcaaccucugccuccuggguucaagcaauucuccugccucagccucccgaguagcugggauuacaggcacgcaccaccacgcccagcuaauuuuuguauuuuuaguagagacaggguuucgccauguuggucaggcuggucucaaacuccugaccuugugauccgccugccucggccucccaaagugcugggauuacaggcaugagccaccacgcccagccgauguugucuaaucuuugucaggcaaaagggaccuuuaugauuugcucaaacuuccuuucuccuuacacaggagccccuuguuucaggaugcuaaauacuccaggauaaaccuccauacaugccuuuguggagauuuuaauauuucacucaugucucuuuucuacccacuccuacacauuugagcucagguucuccagcgcaguuaggaaauggaugugucauuuaaucagcaaauguguguguguguuuuuuuaaauuugagacggaguuuuugcucuuguugcccaggauggagugcaauggcguggucuuggcucacugcaaccuccaccuccuagguucaagcgauuguccugccucagccuccugaguagcugggauuacaggugcccgccaccacgccucgguaauuuuuguauuuuuaguagagacgaaguuucaccauguuggucaggcgggucucaaacucuugaccucaggugagccacccaccucagccucccaaagugcugggauuacaggugugagccacugcgccggccaaucaacaauuuuuuuuuuuuuuggagacggagucucacgcugucucccaggcuggagugcaguggcacaaucuuggcucacugcaagcuccaccucccggguucacaccauucuccugccccagccucccgaguagcugggacuacgggugcccgccaccacacccggcuaauuuuuuguauuuuuuuaguagagaugggguuucaccguguuagccaggauggucuugaucuccugaccucaugauccacucgccucggccucccaaaguguugggauuacaggcgugagccaccgcgcccugccccaaucaacaaauguuuacugagcaucuaccauggaccaggcccuagucugggcacugagggggagaaaggacaagacuacauuccagccaucgagcagcucacagaccaauggaggaggcugacguggacaggcuguuacugugcugcaguagcugaggacucgaugggugugguguggccacucuugccagguuaugaagcagaaaaggaggcagggagauuucacugagggcucaaggggaggugauaauuuaacuacagcuuacguacucuauacaaagaagugcagagggcacucuaaaaaugggaacaacuugugcaaaggaagcaaauacauuauugcaaaggguuuauaugucaaccaugguaguguugggcaaaagguaacaggaucugcuauguguuucggagggucauccugguggauaauuucuguauaugugagaccuuggggaggaaggcuuaggaccaguggacaugaaauuucaaucuauuaaucaugaaguuugucaaagacaaacacaauuccuugcgccuggugaagaugacugacugauucaggcagaguggcuugcucuagacagacugaauuaaccuccugcauuuuuuggauagaauacccacgaacaguucuguuuucucaguucauuuauuuuacuuuuaaaaauuuggccaggugauuuggcucacaccuguaaucccagugcuuugggaggccaaggcagguggaucacuugaggcuaggaguucgagaccagccuggccaaaauggcgaaaccccgucuuuacuaaaaauacaaaaaugaaaaaaaaaaaaagccaggugugguggugcaccuguaaucccagcuacuugggagaccaaggcauaagaauugcuuggacccgggagguggagguugccagugagccaagauagcaccacuguauuccagccugggcaacagagcgagaccgucuacaaaaaaaaaaaaaaaauuacugaguuaaucacacuccucaguucaugauacauuuaacugguccaugcagggccuuuuucuccuuuguauuuauauucccuuuugucccuauucuuccccucucuucucaccacaggaaaccauucugauguguuugguguauaucuucuuuuuguuuuuuguuuuuuugagacagggucucacucuugcucaggcuggaaugcaguggcauaaucauggcugacugcagccuugaccucccgggcucaagcaguccuccgucccaccucagccuucugaggagcugggaccacaggcgugugccaccaugcccagguaaauuugccguguugcccaagcuagucucaaacuccugagcucagcagucugccugccuugaccucccaaaaugcugagauuacaggugugagccacugcucccagccuauaugcauauacuuuuaauuuacauaaauggauucugccuagaccucauuuuuuuccaccucagugccauguguggagcuugucgauguugcucuggguauauuugggaugcaguuucuaaaugcuccacagguuuccauagaugcaucccccacauuuuacuuacuugauuccucuagugaugaggucccuagauuguuucccacuccuugcuacaaugcaaucccguacccaucuccuuccucagcuuuguaaauagaauuuuaucgcuucucagccuuuucgcugagaucaaguguaguaaauacaauuucaagaugcugauuugagcuuggcuuugauaagccugguagcucuuggugucugacagggccggauuguuugaccuucgugagguccuggcuuuuuugagccauguuuauuuuugauaaauugugauucuaguucccagacacucuuggccaacauucuaguguccugccaucuuccccaguugaucauucucacgagcucugugguuaauuuucuguuucucaucaucauuaaugguugcuguacacucauuccaacacagauauuugcucuuuccuuuccuggugaaacaguggccugugaagcugguccugggaguaccugugaugugaaguacguagagaaggacucugaggccagagccagacugucuggcuucaguucaguucccagcuccuccacuucccagacgccugaccuugggcaacugauuuaaucuuugugucucauuuucucaucugcaaagugggucuaaucauuguaccuaccucauaguguuuucgugagcauuagguaaaugaauuaauguaugcaaagucauuagaacggugccuggcacauaacaggcuccuauuuggaaugucagcuguuaauaauagcaauaauaauaauuacgucauuucagauaggagacccuguuauauuuugccauaaugggucacauucaguugcaggguguuuguucagaggggauggugggggguggguggcauagcuucuggacucucugacuauagauuccagcguaauagcauuagcuguaaggaaaaagggaagaaacacagcccccaaggcccugggugccuuuucacugucacuuguugccugucagguugggagacaguggcuacagaugggucaaggugcugaggccgggacucaugcuggugggaaugagggaaugagugaagagagccugugaaacugggaggaucuugguggucaccuuggacauaggauucucuuucucuuugauguuccucuguacccuucuugagaaugggcauugggcuagaucagcucugucacugacauucugagguuugcccacguguucagugucaaaggcugcucugaaauggaaaggagcaguggcccaggguagaaaggacacagaaggaagccccagugguagggagaggagauaggacaagaaaagucaacuuucuuucaaugguauaaugaggagggaagguuguguugcagcaagagagguucuggucuggugggggaggcaggcccagugaccaaaacugaaauagaagggugcaaagugagaguagagggagcuaggugggcacaggcuagagacagcugcugaagacgcugacgucugagcuaacucagaagugaugggccagccucucaaguagucgaggagguaagggugauggagagcaggccaggugaggaagcagcauguaccagggcacgcagcuaugagacagcaaggguucugugccuguccucgggugugcggcgggugagggugaggcaggagugcugggcaaguccgucaggccagcaugguuggcaguuauuccccaagcuguguuuccaaauaucagccacucaaggacggccuuuaugguuuauguuacuauaguacguagaaaagcaguuccucuaacuguaagaauguggccauaauaacucuaugaaaauacacgggccgggcaugguggcuuaugccuauaaucccagcacuuugagaggccaagguggaaagaucguuugagcccaggaguuugagaccagccagggcaacacagagagacccgucucuacgaaaaaaaauuuuaaauuagacagguguagaagcacacuccuguggucccagcuagucaggaggcuaaagugggagaaucccuugggccuggggggaucaagguugccaugagcugaguuugugccacugcacucuagccagggcaacagaacaagagccugucucaaaaaaagaaaauacauacguguaauaugacauuaugcaguauauggauuucuaguuagauaguauugccagcuaagggcucugugaggccugcucucuauucugauuuaaaagggagaugaacaaaaauuaaggcaugaaaagaguugaaaauggaauaauaauuuucucaccaugauuaagaaaaaccucguccucacaccagccugcauccuccacugggcaccccaguggagugaggagaugggauguuauaugcuuaccaaaacauagguacauauauacauauauguacaaaacauauaacauugauacaugaugugggaauggugagagggaucugaagagguggucugggcacccugccugccaugccaccguggcccagauggggccugacccagcugacccuccccaggcugaggccaccauggagcagugugcgugcguggagagagagcuggacaagguccugcagaaguuccugaccuacgggcagcacugugagcggagccuggaggagcugcugcacuacgugggccagcugcgggcugagcuggccagcgcagguggguggccacccuugcaagugcccugcgacagccucccugaggacaugggagacccgaagcuacugagugacaggguuccggaaggacgaugaugaggauguugguaccugcaucuguaggccuccuugaaaccggguaaugacagucucugagcuacuucaaaaagcccaacaaauuauuaauuuaccugagaugauucccauuuacauuuuguuuucaacuuacuuuucuauuuuuaacuuuuuuucauuuuauaauuguguguguguguguguguguguguguguagaaacagugucuuuguugccuaggcuggucuuuaacuccuaggggcucaagugauccuccugccucagccucccaaagugcuggaauuauaugcgugagccaccaugccuggccuauuuuuagcuuuuaagauuuuaaagauaauuucaaauuuacagaccaauuccaagaauaguauaaagaacugauauauacccuuuacuuggauucaccaacugcucauauguugccauauuugccgugaucauuacuuuuuaaccauuugaaaauaaguuguagauaacauagccccaagccuucaguguguauguccuaaaaucaagggcauucucuuacauaaaaacagcguaguuauuaaaacccagaaauugccaggcacaguggcucacgccuguaaucccagcacuucgggagcccgaggccgacagaucaccugagaucaggaguuuaaaaccagccuggccaacauggcaaaacccugucucuacuaaaaauacaaaaauuagcugggcaugguggugggcugcagugagccgaggucacgccacugcacuccaaccugggcaacagagcaagacucgucucaaaaaacaaaauaaauaaaucaauccaagaaaugaaacauugauauaauauuaccuaauaacuauaguucacauuucuuuuuuuuuuuuugagauggagucuuacuguugcucaggcuggagugcaguggcgugaucuuggcucaacugcaaccuccaccucccggguucaagcaauucucgugccucagcuucccgaguagcuggaauuaaaggcgcaugccaccaccugcagcuaauuuuuguauuuuuuaguacaggugggguuuugacauguuggcuaggcuggucucgaacuccugaccucaagugaucugccugccucggucucccaaagugcuaggauuauaggugugagccaccauacccagccaguguagucaacauuucaauuuugccauugucccaggaauuuuuuuuuuuuuuugauauagaguuuugcucucauugcccaggcuggagugcaauggcgcaaucucgguucacugcaaccuccgccucccagguucaagagauucuccugcuucagccucgcaaguugcuggguuuacaggcccguaccaccaugccuggcuaauuuuuuuuuuuuuuuuuuuggauuuuuaguagagacaggguuuugccauguuggccaggcuggucucgaacucccgaucucaggugauccaccugccucagccucccaaagugcugggauuacaggugugagccaccaugcccggcuguucaggaauuuucauaaagcauuuuaauuuccaguccaagaaccaauccaagaucacacacugcauuuaguuucuccugucuaaucuuuacuuuuuuuaaucugagacauuucuucugucuuccuuuaucuuccaugacauugguauuuuugaagcauuaaggccaauuauuuugcagaacgucucucaauuuggaguugucugauguuuucucauuacuuagguuuugcauuuuuggcaguacuucagaagugauuuguuucucagugcaucacacuggaagacacaagauguugcuuuauugcauuauugcuguuguucacuuuuauuuuggagacaaguucucacuuuguugcccaggcugcagugcaguggcacgaucuuggcucacugcaggcuugaccuccugggcucaagugauccuaccaccucagccucagaaguagcugggaccacagcaguacacuaccaggcccugcuaauuuuuuuuuuuuuuuauuguagagacagggucucccuaugcuguccaagacggugucgaacuccuggguucaagugauccucccgugucagccucccaaagugcugggauuaugauccgcugcaccuggccugaucuucacuuugaucacuuaguuaagauggucgcugcuaagguuuuccacuguaaacuuccuaauuuuucuuuguaaucacuaaguaguuugugggcuguaauccuagcacuuugggaggcugaggcgggcggaucacucgagcccaggagguugagaccaggcuggucaacauggcaaaaccacaucucuacuaaaaauacaaaaauuagccgggcaugguggcacaugccuguagucccagcuacuugggaggcugaggcaugagaaucgcuugaacccaggagguggagguugcagcgagccaagaucgcgccacugcauuccagcaugggugacaaagcgagacugucucaaaaaaaaaaaaaaaguaguuuguggggagauacuuugauaccauauaaauguccugcucuuuaccaaauuucagccuacuaguuuuaguauccauuaaugauuguugugugaauuauuacuaagcugucugcaacauggugauuuuuccugcuuugucauucuuuauacauuuauuaguugacauucaacugaaaagaagcuuucccuucuccuuucauuauuaucacuucacacucauauucuuauuuuauucaauagguuauaauccauugcaguuauuuaauguucaaauugucuuaggucugaccagagggagucccugguuccuaugucuuuuuuaaaaauugagcuauaauucacuuaccauuaaacucacucuuuuaaaguacucuguccaggugcaguggcucaugccuguaaucccagcacuuugggaggcugaggcagguggaucaccuaaggucaggaguucgagaccagccuggccaacauggugaaacccugucuguacuaaaaaauacaaaaauuagcugggcguggugucauguaccuguaaucccagcuacucaagaggcugaggcaggagaaucgcuugaacccaggaggcagagguugcagugagccaagauuaagucacugcacuccagccugggugacagagcaagacucuguaucaaaauaaauaaauaaaguacaacucuggaugggcaugguggcuuaugucuguaaucccagcacuuugggaacuugaggcggguagauugcuugaguccgggaguuugagaccagucuggguaauaugguaacccugucuaccaaaaauacagguauuagccagucucauaacucggucucaaaauaaauaaauacauacauacauagaugaaaauuuaaaaaauaaaguccaacucagcgguuuucagcauauuuacagaguuguacaaucuucaccacuaucuaauuucagaacauuuucaucacccccaaaagaaaccuaacccauugacugucucuccauuuccucccucucccuagccucuggcaaccacuaaucucuuuuuugucucuauagauuugccuauuuuggacaguucauauacaaggaaucauaccacauguagccuuuuguguccggcuucuuugauuaauagaauguuuucaaggcucaucuaugcuguagccuguaucagcacuucauuccuuucuauggcugaauaauaguccacuguagggaugugccauguuuuuccacuagcugauggacauuuggguuguuuccaccuucuggcuauuauaaauauugcugcuauaaauauucacuuacaaguuuuuguguggacauauguuuuuauuucuucugguauauccuucggaguggaacugcuggaucaggugguaacucuaggucuaaccuggcaguuaaacagaauccuaugcaugcuguaguccaugaguugaaauaaacacuugacccauaguaagugccagaucaucuucauuucacagcaaccaguaauuucacagaugaggaaaugaaggcucccagaggugaacuggcuuuucccauuugagcaguuccaagucagacaguuaaaaaguggcaggaccuggaagagaagcuaguucuuucacccuggcauucagggcugccuccugggcuacggggcuggcauuuagaauagagcuaaggucugcugccaaggcaggugccccagucugccuccucuguguccuuauuccacuuucucugcagcccuccaggggaccccucucucagccacccucucucuggugaugucacagugcugccggaagaucaaagauacggugcagaaacuggcuucggaccauaaggacauucacagcaguguaucccgagugggcaaagccauugacagggugagcacguggccggcuccaggcguggggugggagcacccugaagcugggauguacaaggacucgaaggagagccagcaagagugcccgcaucaccaggcccugucucuccuccuucgucagaacuucgacucugagaucugugguguugugucagaugcggugugggacgcgcgggaacagcagcagcagauccugcagauggccaucguggaacaccuguaucagcagggcaugcucagcguggccgaggagcugugccagguacagucgggcugggcgggcgcaacaaccugccugcucugccuuucaccugcuaguuuucacuguaugaagucccuaccauucucaaauccauuuauuuccuaaaggaaaucagcaccucugccagaagcagaagguagcuuuaaaaacauauaugaugaaaagagaaguuacucauuuuuaguuagaguugguugccagccagggcucugagcugaggccucauaucccuuuauugaaaagggagcugagugaaaugacaaaguaguacuuguuagguguuaaagacacacuggugguaaaaguaaaagauuuucccuacuguacuaggaggauugaagaggaguaauuuucucgccaugcaacucagugcguagccuggggacugucuccacugcuacgguugugggguggggucugcagucugcacucgaggucagcaugucauacucagccuccccaggacugagaugggaacaagagaggcccaaguggcuggcaggagaccaagcuccucaagcaaagcccagcucucuggccugucuuuggcgggugagcuuuuauuaugugcauagcagagaacuuuggaaacaccaucuuccaguggugggaucucuucucucucuccuuguaggaaucaacgcugaauguggacuuggauuucaagcagccuuuccuagaguugaaucgaauccuggaagcccugcacgaacaagaccuggguccugcguuggaguaaggaggcccuugggugggccagcagcauucugcuucgaccucucagggcacagggcuugacuguggucuucauuucacccagauguacuugacuugccugcagcccugucucaagagccucacacaggcuuuuggggcccuccucucaggugcuggcucucagguccuagcccccaccagcucuacacuaaacuggccccuuucuucccagaugggccgucucccacaggcagcgccugcuggaacucaacagcucccuggaguucaagcugcaccgacugcacuucauccgccucuuggcaggaggccccgcgaagcagcuggaggcccucagcuaugcucggcacuuccagcccuuugcucggcugcaccagcggggugagugcccaggcagcugggguugugcugccuggccugacacaugucuggaugugguagguuacaucaggcugccagucccugcacccauguggggcugucuguuacacagaugccucuccccaacuagaaacuucucugaccccucguguccaggaugaacucuagacuccuccucucucacaucugccauaccuuuaguuuauagcuucagcgcagaccacccaggguccucgugccugcuaugcgccacaccacacucauuuagagcaugccaugcccgucccaccuguucugccucguaugccucccugaccuguguggccuauggaaaaguccuuuaagaaaaaaaaaaaggccaggcacgguggcucacgccuguaaucccaauauuuugggaggccgaggugggcggaucaugagguccaucuuggcuaacaugguaaaaccccaucucuacuaaaaauacaaaaaaaauuagcugggcguuguggcgggcguuuguagucccagcuacuaggcugaagcaggagaauggcaugaacccgggaggcggagcuugaucgcgccacugcacuccagccugggugacagagugagacuccgucucagaaaaaaaaaaaaagacuugucugggugcgauggcucaugccuguaauugcagcacuuugggaggccaaagcaaagggcggaucacuugagcuggagaccagccuuggcaacauggggaaccccugccccugcucccaucucuacaaaaaauaaaauaaaaaagacucaguugagcacucuuccugucaugcuagaauuuccaaaccuggaaucugagucucaccuaugcuuacaaguaguaaccuguacuaacuuguuuuuuuaguuccaccucauauuuauuauuuuaaauuuuaucucaaaauaaauaugaaaaccaagccaugauuuauuauuuauuuuugagacaaagucucacucuguugcccaggcuggagugcaguaaguggugugaucccggcucacugcaaccuccaccucccagguucaagcgauucuccugccucagccucccgaguagcugggauuacaaaugccugacaccggccgggcaugauggcucacaccuguaaucccagcacuuugggaggcugaggcggguggaucaugaggucaagagaucgagaccauccuggccaacauggugaaaccccaucucuacuaaaaauaugaaaaauuagccgggcgugguggcgggcaccuguagucccagcuacccgggaggcugagguaggauaaucacuugaacccgggaagcggaggcugcagugaaccgagauugugccacugcccuccagcacuccagccuggcgacagagcgagacucugucucaaaaaaaaaaaaaaacacacaaaaaacacacacaccaaaaaaaacaagugccugacaccacaaccacgucuggcuaacuuuauauauuuuuuauuagagacgggguuucaccauguuggccaggcuggccucaaacuccuggccucaugugaugcacccaccuuggccucccaaagugcugggauuauaggcaugagccaccacgcccggccccaaaacaugacugaaguuuuagcuagauacugcugccuguugaaagcucuuaaccugggguugcucuaaauggagauuaguguggagacaccagugccaaccugaggacuuauuugauccuugaugcagugggggaggaaagagaacuggaaaagaacuguccucauuccugauucuguguuaguaaugccuguucucauccugcagaagcagccuggaccuccaccuccccaguggauuuuacagucaaauuugccugagggcauuuucaucccugcucagucuccucaggggcuugggagccaccgggcucagcauauugugcugugcugcacaguccugcugcccgcuuggggguggacccagagcccugcacccccugagcugcccccucugguugccuuguagagauccaggugaugaugggcagccugguguaccugcggcugggcuuggagaagucacccuacugccaccugcuggacagcagccacugggcagagaucugugagaccuuuacccgggacgccuguucccugcuggggcuuucuguggaguccccccuuagcgucagguacaacccagcccugugagggcagcacaggugggaggguagagagguaaucaucauuugccaaggcccugccaugugccaggaacagugcucggugcuuucagagaccgaaacuggcuuucuuagucauucuucaggagaggaauuaccuguuuuuacaguuaaacugagacuaggaagaguuauggcccgaggucaccaugaggucaguggcauggucaagguucccauuuuguaaggucuccugaaugaggucccugccucucuugcaccucacccuggaucauugcaagaccuucccagcuaacccacgccccucugcagcccgccuuccucaugaccuaaugucuuaaacaccacuugccuucaggggagaugugagugguugaguaauauguauucagcacugcugcugacaccucccucagagcucccagcaacccugggagggagagccacguuauccuccuucuacagaugaggaaauggaggcccaagaugugcacgcacuugcccaaggccucgcagggaauaaugggcacuugaaccugaccccagagccacacacuccgccacaguggacagcugucacuguguauuuagacuguugauggugucugaguacagcaccucaauauaguggacugauucuacgcucaucugauuuguuaccauggacucaguuuauagaacgucauuucccagcaagaacaacaucagcaccuuaggaugauucuguugcgcaggacuacccugugcacugugggguauucagcaccugagguuccagccaguaggcucccuuccccaugcaacugucacgagaagggaaccccaaccuccauuuguuaggcggccuaguugauagccaccauuauaaagauguguuaugacuacacagcaggguacguccuacaggcaggcuggggcccuuuggaacugcucacuguucccuagucacaccaaggacuuuucagucauuaggaugagcagauaucugccccuagagcuauaggaagucuucccuguagguucucaaauuuuggggugcauuagaaugagucuguagagucagacauacauaaguacauaugugacaucuuaugaacaaugugagggaucuuugaggaccgauuugaccgugcaccauuuuagagcccugucucaagguccaugcugaagcauggcgcgcuggcccuuuuugccugucugcugugaucugagccacucuagccccuguuccuugucugcagcuuugccucuggcuguguggcgcugccuguguugaugaacaucaaggcugugauugagcagcggcagugcacuggggucuggaaucacaaggacgaguuaccggugaggccuggucuggggaaucgugggcaagagguacuggggaggacagccaugacaggaaguggaacucacccgcuucgcugcccuucccagauugagauugaacuaggcaugaagugcugguaccacuccguguucgcuugccccauccuccgccagcagacgucagauuccaacccucccaucaagcucaucuguggccauguuaucucccgagaugcacucaauaagcucauuaauggaggaaaguaaguuccccgugcucuacuccaccuuggcuuggcucuccuacuggccaccccugagacguucucgguucuccucccuuugcaggcugaagugucccuacugucccauggagcagaacccggcagaugggaaacgcaucauauucugauuccuaccuggaaggaauuuuguugaaagggguuuucaccugugagccuuggucugucucgguaggguggucaacuucaguggacugugguugguuucagagcgccuggcugaggaguuccacugaggggagcacuggagcagcccuuuggcagaggcugaggagggagauggaccagcccacgccuggcaccuggcuccauggcauaaggaaagggagaugcuggccucugugcuccugcugucuuuuccuguuucuguuugcguuugacuuaguagcaaccgacagaguggcaagggauuuggucuucagcaguagacauccuuccaccccugcccucagccaagucucuugcugccaugccaaugcuauguccacccuugccccucggcccaagaguguccagcgguggcccaccucuuccucccacuacagccucaacagua

SEQ ID NO: 192227 - RNA, 79123 nt, Homo sapiens
ccggccagggccucccuccuucucucuagguuuggcugccgccuucuagccgggcguucgcggccccgccggcccgacucucaagccucagcucccaggcuaggcuguggccgccgguggccuggggagagugcggcgccaugccucgggcuuaaugcgccccccccucuucucccagucuucagucuuaagucguuagccuccucccuccgcuuucagcaguggucuuucagcucucuucuugugcgcuguugucgaccccgaccagccccuuccaacccagucaucaugucccagccgggaauaccggccuccggcggcgccccagccagccuccaggcccagaacggagccgccuuggccucggggucucccuacaccaacggugagugcuguccggggggagggcgcagccuggccagggcugacugaccuuugcgugccacugcugcuugaggcgacauagauagagagagugaccuccuuaccggguucuggcgcggaugguggugggcggcugggccaggggaccacggcaguugugcaccuguagccccaggcucgucucagucuuucacauuuauuuagucggucaccaaaacaguaaaugagcaccugcuguaugcaacgcccugggugaaacacgggugagaaaaugccucaaaacucgaauauaaggaucauaguguuugugugccuucgccuuccuugccaccucaccccagucuccuagagagcaggauguggggucugauucuucuggguuccgcaggcccugaaguggggugggggucguacucagucugaguuucuggagaugaaugcaugcuuuugggacaccccuuuagggccuacucaucucucccagaaccuucccagaauuguaccuacaacagcuguucaauguuucagcuguggaaaaaccaaauagaagggaggaucuccugguugacuucuagaugucuggacagcauuuggaaaguggguggacacaacucucugaaucucugacaagagucuacauguacauuauaguuugucauuugaugugagaaugucuuauaauuuuauaccucuucuaggauuccuuaaaucguccuacauugugauuugcuaagauuauuucaguuguuacaauagacaaagacuuucugccgacagauugccuacuuaccaauuuacuuacaaaucuuugguuuacagaaauaagacuaguagaauaaugcuaaagaacuuaaguugcccauuagagucuaagaguucugugaaguuggagaauacagacagugacuaaaaucucuaauuuacauuguuuuuagagaagaccgcuguuuucuuuacaaagauggcucuaaaagacuuuuaaaaaugucugugaguaggcaacuaugugggcagaagaaagaauaaguggaggaaagccacugaaaggguacugaguuaaccauucuuucucaaaauuaugguaacagauuauguacacuacauuuuauucuagaauauuuaguaacauuuacacugaggaugagaaaaaauguuacauggcuauggauuuuucuuauaaucuauaaauugcaguuuuacauuaacuuuaaaugacaaauccucaaaugugcuucaacauuuauauaugaguguaguugucauaauauugaaauguuaaagggauuugaccacugugguaugcuguauuagagauacugucacuauguugauuugauacaguccaacagacauuuguuccacaucuuuuuuuuuuuuuuugagauggagucuuguucuguugcccaggcuggagugcagugguggugaucuuggcucacugcaaccucugauuccuggguucaagcgauucuccugccuccuuaaccuuccaaagugcuguaauuacaggccugauccacgguacccagaccucuuuuuuaaaauauaauuuucauagucuuuuuauaaguuccauuucuacaggguuuuuuguuuguuuguuuguuuguuuguuuuuugagacggaguuuugcuuuugucucccaggcuggagugcaauggcgcuaucucggcucacugcaaccuccuccucccagguucaagcaauucuccugccucagccucugaaguagcugggauuacaggcacgugucaccacacccagcuaauuuuuauauuuuuaguagagacgggguuucaccaugcuggucaggcugaugucaaacuccugaccucuagugauccacccaccuuggucucccaaagugcugggauuacaggcaugagccacugugccuggccucuacagguuuuuuguauuuugccuuuuuuuuuuuuuugagacaggaucuuacuuaaacugucccucaagcuggagugcaguggcaggaucacaacucacugucacuccugggcucaagcaauccucacaccucagccuccccaguagcuagaacuacaggugcauaccaccaggccccauuuuuuauauaaguauauaauauauauauauaauguauauauuuuauuauuauuuuuugagucagaguuucacucuguugcccaggcuggaguacaauggcucgaucucggcucacugcaaccuccaugucucagguucaagugauucucgugccucagccucccgaguagcugggauuacaggccugugccaccacaaccggcuaauuuuuguauuuuuaguagagaugggguuucaccauguuggccaggcuggucuugaacuccaaaccucauaaugauccgcccacccuggcaucccaaagugcugggauuacaggcaugagccaccacgcccggccuaauguaaagauauauguauauuauauauauaauguuuuauauauauuuuguagagaugagucucucuauguugccuaggcuggucugaaauuccugaccucaagugauccuccugacucagccuuccaaagugcugggauuagaggcaugagcuaccaagccuagccuggguuguuuuauuguucauccugcuaauaauacagagaguagggauaugguaucaaguuggagaacaggauauuuuucaagaaggugagaaaacguuucaaugcugggaucuaguuuugcuuaacuauuccaaagcaguaguugaugcuugcauauucuguugaaaacucuuuuuuuuuuuuuuuuugauggaguuucacuuuuguugcccaggcuagagugcaauggcucauugcaaccucugccucccagauucaagcaauucuccugccucagccuccugagcaacugggauuacaggugcaugccaccacacccggcuaauuuuuguauuuuuaguagagacaggguuucaucacauuggucaggcuggucucaaacuccugaccucaggugauccgcccgcgucggccucccaaagugcugggauuacaggcgugagccaccgcgccuggccgaaaagucuuaaguauuuaaugaaguuugcuuaaauuacauauuacaguauaauuagaucuucaguuugcuuuuguuuuuuguuuuugagauagucuuucucuauugcccaggcuggagugcaguggcgugaucuuggcucacugcaaccuccaucuccuggguucaagcaauucugccucagccuccugagcaacugggacuacaggcaugcgccacuaugucuagcuaauuuuuguauauuuaguagagacgggguuucgccacguugcccaggcuggucucgaacucccgagcucaggugauccgcccaccucggccuacuaaagugccgggauuacaggcgugagccacugugccuggccaguuugguguuuuuuguuuuugagacggagucuugcuguguugccaggcuggagugcaguggugcgaucucagcucacugcaaccuccaccucccagguucaagcgauucuccugccucagcuucccgaguagcugggguuacaggcaccuguagcacaugccaccaugccuggcugauuuuguauuuuguuuguuuguuuuguuuuguuuuuguuuuuguuuuuuugagacggagucucacucugucacccaugcuggagugcaguggugcgaucuuggcucgcugcaagcuccgccuccuggguucaugccauucucuugccucagccucccgaguagcugggacaauaggugcccgccaccacacccggcuaauuuuuuguauuuuuuuuuuuuuuuuaguagagacagcguuucaccauauuagcuaggauggucucaaucuccugaccucgugaucugcccgccucugccucccaaagugcugggauuacaguuaugagccacugugcucggccuaauuuuuguauuuuuaguggagacgggguuucaccauguuggccaggauggccucuaucugcugaccucaugauccuccugccucagccucccaaagugcuggcauuacaggugugagccaccauacccguuccaguuucguuuguuuguuuguuuuuuaaagagccugggucuugcucugucacccaaguugaaguguagucacuugaucauggcucacugcagccucgaaccuccuggcugaagugauccucccacgucagccuccugugaagcuaggacuacaggcacaugcccugaaaccuggcuaacuaaacaguuuuuuuuagaaaacagagcugcacucuguugcccaggauggucuugaacuccuggacucaaguaauccuccugccuuggccucccaaagagcuaggauuacaggcaugagccacaacaucuagcacagauauuuuauauauuauagucaaaagaccucaccaggugugguggcucacaccuguaaugucagcacuuugggaggccgaggugcuaggauuguuuuagcccaagaauucaagaccacccucggcaacauagugagaaccugucucuacaaagaauuuuuaaaaaauaggcauggugcgggcccaguagucccagcuacuggggaggcugagacaggaagaucacuugaccccaggaggucaagacugcagugagcuacaauugcacaacugcacuacaaccugggugacauggcaguaucuugucucaaaaauaaauaaauaggccgggugcaguggcucacaccuguaaucccagcacuuugggaggccaaggcaggagggcugcuugagccuaggaguucagaccaggguaggcaacauaggaagaccccauaucuauaaaaaaguaagaaaaauuaguccaguguaguggugccagccuguggucccagcuacucaggaggcugagguaggaggaucaccuguguccaggagguuaaggcugcaaugagccaugaucaugccacuacccucuagccugggcaacagagugagaaccugucacaaaaauaaauaaauuaauaaaaaacaaaagaccuaacaguagccuuuuucaaaaaaaaaaaauauauauauauauuuuuugagacggagucucacgcugucacccaggcuggagugcaguggugcagaucuuggcucacugcagccucugccucccggguucaagugauucuccugccucagccucccgaguagcugggacuacaggcgugcaccaccaugcucagcuaauuuuuguauauuuaguagagacgggguuucaccauguuggacaggguggucucaauuuccugaccucgugaucugccugccuuggccucccaaagugcugggauuacaggcgugagccacugcgcccagcugagagguuuuucuaagucuuuguguauacauauuuccuuugcaaaaauugauagcagacuacaagaccuuaaacuaauggaucuuaaucugauuaucauguauuaacgcuaaaggcaaauaaugacucccaccauuaauuagugccuuuauugacugaaucaacuugcaaagccaguuagaaacugcaguuuuguuuuguuuuguuuugguuuuucagaaauggucucacuuugucccccaggcuagaguacaguggugcagucuuggcucacugcagccuuaaccuccaugguucaagcaauccuccugcuucagccccugaaguagcugggauuacaggugugcgucaccaugcuugucuaauuuuuuugugucuuuaguagagauggguuucaccauuuggccaggcuggucucgaacuccugaccucgugauccucccaccuuggccucccaaagugcugggauuacaggugugaaccacuacgccuggcccaggcuuuccuaaagaaacguacagcuuuuuggccaggcuggucucaaaauccugaccucaggugaucugcccgccugagccaaagugcugagauuacaggugugagccaccgcacccggccacaugagauuuuuuacuaaugcagauucugggauccuuuugaauccuaugaaauaggauuuuacaaaggugggaccugggaucucaauuuguaccauuauuauagcagguuccucugauucugaagcugcugguugggugggaagcacucaucugcauucauucuugccucuaacuuucuaauuuagcuucuuuacccacacaucccaaaauuguccuuaauaaggccacaaggcugggcgugguggcucaugccuguaaucccagcacuuugggaggucaaggcggguggaucacaagguccggaguucaagaccagccuggccaacauggugaaaccuugucucuacuaaaaauacaaaaauuagccgggugugguggcgugcgccuguaaucccagcuacucaggaggccucagccuccugagugauucucagcaggagaaucacuugaacccgagagguggagguugcagugagccgagaucaugacauugcacugcagccugggcgacagagcaagaauucaucucaaaauaaauaaauaaauaaauaaggccacaaauggcuuccugguuauuaaauagaaaaauauuuuucaguucucauuuuccgagcugcauuugauaccuuuggcuguuauuuuguuuuuacaacaauugcuuucuuugguuucuaggauaucaccagaaggguaguuaugguuuucuuucuuuuuuuugguugcuauuucucaacagcaguauucucaauauuucuuccauuucugauuguuuuuuucucucuccuccuuaaauauugguguucuucaaggugaccuauuuuucuuacucuuauauacucccugggugucuuuaauucccaugguuuuaaaucuuaugcauagaucagugacucccauaauuauaucuuaaggugaaaucugucacuuuggcugcagcuaaauaucuuuuuuuuuuuuuuuuuaagacagagucuugcucuguugcccaggcuggagugagguggcacgaucuuggcucacugcaaccuuugccuccuggguucaagcgauucuccuuucucagccuccggaguagcugggaccaccggcaugugccaccacacccggcaaauuuuuuguauuuuuagaagagaugggguuucaccgucuuaggaugguguugcucuccugaccucaugaucugcccgccuugaccucccaaagugcugggauuacaggccugagccaccgcgcccagcgcagauaaauaucuuuauacuggacaucuccacuuagauuucuugguggcaccugaaaauuaguguguuuaaaauaacucuucgaucucucuucccuuugccauuccccaccuuuguuuuuuugagacagagucuugcucugucaaccaggcuggagugcaguggcacgauauccgcucauugcaaccuccgccucccagguucaagcaauucuccugccucagccucugaguagcugggacuauaggcgugugccaccaugcccggcuaauuuuuguauuuuaguagagacgggguuucaccguguuggucaggcuggucucgaacuucugacuucaggugauccacccaccucggccucccaaaguguugggauuacaggcaugagccacugcauccgacuuuuuuuuuuuuuuuuuuuuuaaagacagcucucauucugucgcccuggccggaaugcaaugaugcaaugauagcucacugcagccuugaacuccugggcucaaguaauccuugauccuugaucaaguggguggaguggcucaugcuuguaaucuuaguacuuugggaggucgagucaagaagaucccuugagcccaggaguucgagaccagccuggacaacuuagggagaccccaucucuacaaaaaaauuuaaaaauuagccaggcauaauggugcacgccuguaggcccagcuacucaagaggggaggugggaggaucgcuugagcuugggaggucgaggcugcggugagcugugacacuucagccuggguggcagagcgagaccucauuucugaaaaacgcacacacacacacacacacacacacacacacaaccaaaacuuauauuuuguagagauagggacuugcuauugcccaggcuggucucaaacuccuggccucaagugauccucccaccuugacuuucuaaagugcugggauugcaggcaugagccaccgugccuggccuacauuucuauucuuuucucuuucuguucaaaugaauaaacacggccauccaccagguugcucaggucagaaaccuaggagucauccuagauuuuuuccucucuucaucacccauauucaauuccacauaaaaucccaugaaugcuguuuccucaaaucaguuuuuaaaaauuugaguaauguauagauacuaaauauuucucugcugucccaauguuaaauuauuuauuuauuuauuuuacuucugacacagguucucacucuguugcccaggcuagagugcaggggcaugaucacagcccacugcaggcuugaucucuuggguucaagugauccucccgccucagccucccaaguagcugggaauauaggcacgugccaccacaacuggcuaauuauuuauuuuuuuguagagacgaggucucacuauauuacccagguuauucuugaacuccugaggucaagccgugcucccaccuuggcuuuucaaagugcucggauuacaagaucaagccaacaugccuggcaaaaauuauuuuuauuaaauguguauaugcaaacacaaaacuagauguaaacuucauaggguuauagcuauuguacuauuguaaaaccaaacauuaaaaauaucaacauauggcugggcaugguggcucacgccuguaaucccagcacuuugggaggcugagguggccagaucacuugaggucagaaguucaagaacagccuggccaacauggugaaaucccgucucuacuaaaaauacaaaauuagccagcgugguggugcacaccuguaauccuagcuacucgagaggcugaaugaggcaggagaaucgccugaacccaggaggcggagguugcagugagccgagaucgcaccacugcacuuuagcuugggcaacagagcgagacucugucucaaaaaaaaaucaaaagcaauauaauucaauuuuaaaacauuaaacaauaugcuacauuuuguuugaaaccacaguugauuugauuguuuuaauuuugaauauguuggaacauuacuugggugacuaucaugcucacuuuuuccuuuuuguuuuugagacacguucucacucuguagcccaggguggaaugccuaauuauagcucacugaagucaaacuccugggcucaagcaguccucuugccucagccuccugagaagcuagaucuacaggcaugugccacaacuccuggcuaauuuuuuaauuuuuaauuuuuuuguguggaaauggagucucgcuguguugcccaggcuggucuccuacuccugagcucaaguaguucugcuuuggccucccagugugaugggauuacaggcaugagccaccaugcccaaccucuacacgauuuuaauaggggaagaauggggugggggagaggacauuuacuggaaaacagacgacuuauaggaaggauaaaugggcuuuuagaauagauaugauaguuuugugaugauaucuguuuaggugugguguggaaauuucucaucucaggucaugagucagauugacaucuuuccugguugccccugggaaguagauuaugacaauugaguucuuuuggaaggcucuguuuuaggcagauaagagauuuuaggaacucaaaugccuucugcuuaaaauaauuuuuaugccauaguagcguauucuggaccccuucacaaucacugacccauuuauuuuuauuuauuuauuuauuuauuuauuuauuuauuuauuuauugagauggaaucuugcucugucacccaggcuggagugcaguggcgcgauguuggcucacugcaagcucugccuccuggguucacgccauucuccugccucagccucccgaguagcugggacuacaggcacccgccaccacgcuccacuaauuuuuuuguauuuuuaguagagaugggguuucaccauguuagccaggauggucuugaucuccugaccucgugauccgcccgccuuggccucccaaagugcugggauuauaggcgugagccaccgcgccuggccucacagacccauuauuuugaugggcuacuuaguaaugacuucagaauuuaaaaaaauuauccauuuagugaaggugucauuauauauuuauuacuacacuuuuugugaacuacuuguaauugauccauauaugauuuucacauaguggggagggaugucagaaaaaaaaauuuucauguaauaguuacucacaauaggucuaugauggugacuaccacaaaacaaguucuuuuguaucugucuuccugccaguuggccuuaugaccucauauucuuuuuuuuuuuuuuuuuuuugagacaggauacagggucucacuuugucacagaggcuggagugcaguggcgugaacgcagcucccugcagccuuaaccuccugugcucagugauccuccugccucagccccaaguagcugggacuuacaggcaggcgccaccacacccaacuaauucuuauauuuuuuauagagacgaggucuuacuauuauguccaggcuggucucgaacuccugagcucaagcuaucugcccgccuuggccucccaaaguguugggauuauaugugugaggcaccaugcccagcauguuuucaucuuuauuggccugucaaauuuuugcuuauuuuguacauuuugaugguauuuggcuuucacuuggcuguaccuggcuugaaggcaccucuuuagcguauuagcuugugauaagauuguaaauacaaccuguuugcucacgccuguaauccuagcgcuuauagaggcugaggcaggaggauuacuugagcucaggaauuugagaccagccugggcaacauagugagucucugucucuacaaaaaaaaaaaaaaaaaauuaggccggcgugguggugcaugccuguagucccagcuucucaggaggcuuagaugggaggaucgcuugagcccaggaggucagagcuacagugagccaugauugugccacuguacuccagcuuggaugacagaguaaagugcugucucaaucaaucaaucaauccauaaguaaguaaauaaaauuguaauacaaauaugaaacuaggccaggacaucuuguggcaacauugggcugugagauggccuauuuuuauccaagugacccaacauaugcuuauauauuauuuuuuuacaaauguuuucauuuauugagacaucucuguauucccucuguuacuugcuacuguuuaguccaucuuuuuuuuuuuuuuuugucacccaggcuggagugcaauggugugaccuuggcucacugcagccuugaccuccuggguucaaguaauccuccugccucagccccccaaguagcuaagacuacaggcgcauaccaucaaggcuggcuacuuuuuguuuuuuuuuauaggcaugggguuucaccauguugcccaggcuggucuugaacuccugggcucaagcuauccaccugccuuggccucccaaagugcugggauuacagaugugagccacugcgcuggccuucauugugguuuugauuuacauuucuguuaugacuaauuauguuuguauuucucuaaugacugaugauguugaauguuuuggcaugugcuuauuagcuaucuucuuuggaaguauguuugaaugucuauuuaaguccuuugcuuauuuuuuaauugaguuauguguuuuuauugcugacuguaagaauauauguuuuacuuuauuucuuaaaguauugcuauauucguugguaagacuaauuuuuccuccuuuuauuggaagguccuguccaaaaugcauugcugucuucacaagagucagugagccaaggauacaauuuccagcuuccaggauccuacccucauccaauaccagcaaagacuuugaauccagucucuggacagucuaacuauggugguucucagggaucugggcagacucuuaauagaccaccuguggccucuaauccagugacaccuucgcuucauagugguccugcuccccgaaugccauuaccugcuucucagaacccagcuacuacaccaaugccuucuaguagcuuucuuccugaagccaaccugccaccaccuuugaauuggcaauauaacuauccauccacagccucacaaacaaaccauuguccucgugcaucaucccaaccaacuguaucuggaaauacaaguuuaaccacaaaucaucaauauguuucuucuggauauccuucacuucaaaauagcuucauaaagucagguaguauucuuauagaagugcuuaaaauguagaaaugugaaacuuuugcuuauuuagauguuugaaauaauacuugaaaccugaaaaccauauggaaaaugugacuuuuaaaauuauuaguaguuuuuuguuguuuuuuguuuuucggcuuuccagcaaaaaccagaaagccugcuagacaaauuaaguaagcuauaacacucauuaguaguuuuuuuuuucauucuuuuuucucuuuuuuuuuuuuuuuuuugagauggggucuugcucugucacccaggcuggaaagcaguggcacaaucucagcucacugcaaccucugccucccugguucaagcaauuuuccugccucagccuccagaguagcugggauuaugggauuacaggcacgugccacugcacccagcuaacuuuuuguauuuuuaguagagaugggguuucaccauauuggccaggcuggucuugaacucccgaccucagguaauccgcccaccucagccucccaaagugcgaggauuacaggcgugagccaccacaccuggccacauuuauuuauuuuauuuauuuauuauuuauuuauuuuuuugagacggagucucucucugucgcccaggcuggagugcaguggcgugaucuuggcucacugcaagcucugccucccggguucacgccauucuccugccucagccucccgaguagcugggacuacaggugcccgccaccacgcccggcuaauuuuuuguauuuuuaguagagacgggguuucaccguguuagccaggauggucucgaucuccugaccucgugauccgcccgccuugaccucccaaagugcugugauuacaggugugagccaauauuucuuugaaaagcauuuaaaauucuguauugggaucugcagguugauacuucucagcagacagccucaaguuuaugaaauaguguaggcuuccaagugaaauaguaauaucaauaguuaccuuuuuaaccuuauguauguuuauauggcauauacuccaucaggcuuguaaauuguuaauggcugaaacuuuauuuuuccaagccuuugaucagacauuggcccuggugaaugcauuuuggccuuguaaagauuaaagcugcuucuagaaacuuaaguuucuuuguggaaaucuucugaccugcaauuaguagagcuaaaauccuucauguuacuuuuguucuaauucauuugauaccaugagugagcaucaaucacuugaaaugaaugaauaugguggcacacaucaaucacuugaaugaaugaauguguggucccagcuacucggggggcugaggugggagaauugcuugagcucuggcaauugaggcugcagugagcuaugauugugccacugcgcuccggccuaggugacagagugagacuuggucuaaaaaaaaaauuuaaguguuaaaaaaaauguuaucuauauuauuuuccaggcucuaucaaacuuugauaucauuaucuguuuuucuguuuugcuuuuuauuuuuuagagauaggcugucucucuguuucccaagcuggagugcaguggugcaauccuagugucaucaaacugcugggcucaagcuauccucccgccucaccucccugaguaggcgugccacagugccuggcuaaucuuuuguucuuuauuuuuuuguauagacagggucuuacccugucgcccaggguagaguaggguaacacgaucauagcucacuuaacugcaacauagcuugcuguaacugcugaccucaagccauccugcugccuggauuuccuaaaguucugggauuacaggugugagccaccuagccaggccugcauuaucuuguuuaaucuucguaacagucucuuacagaucuaaaguauaagacuugaauaauuugcccaaagccacaguaaaauaguuugggaaaacauuuauuuaaaaacuauuuaagggccaggcgugguggcucacgccuauaauccuagcacuuugggaguccaaggcaggaggauccacuugaggccaggaggccaggaguucacuagccugagcaaaauagcaagaccccaucucuauuuuuuuaaauaauuuuauuuaaaaauaaauaaauacuaagaguagguguagcuucucuuaaaaagguacauuaucaauaaucugaaauuucuuuagcuauaauagaaacccucagagcaccuugucuccacuacagauuuggugagagagacauaaauaagugcugaggcugggcaugguggcucacgccuguaagcccagcacuuugggaggcugagucggguggaucaccugagggcaggaguucgagaccagccuggccuacauggugaaaaccucgugucuacuaaaaauacaaaaauuagccaaguaugguggcacgugccuguaaucccagcuacucaggaggcugaggcaggagaagcgcuugaagcugggaggcggagguugcagugagcugagauugcaccacuaccuucagucugggcgacagagcaagacuccaucucaaaaaaaaaaagugcugaaacuuaugaaagaaggggaaauaaaaacauauaaacuaauaaaaugaaccuaaaaaguaaccuucuuuuuucucauuugaaccuucaaagaaccuucaaauuccucauuuuuuuucuuuuuuccaacucauaacugagaguugguaccugauagucugguaucaaagcugugaguauuuagguuauacuaaguuuuuaguucauauauuaaauuuuccugaauuuuuuuaauaggucaccuuuaagcaucauuauacucauuuaggggcugagagggcagacucugaaacucuagcuaucagugucguaaauaagaauucuucaacuugaaaaaauguucauuuuaugaaauauaugauuaucuguucaaaaauagucuucuaaaagcugugaaaaucucuguaaguuuacuuuuauucguuaaacauuagguuguagguuacaucuuuguggccagauguauuuuacauucuuguucaugcugaguuggccauguaccuugccccuuuguuccuuugacuugucuauacugccauagauaugugugaccacuucuuugauaagggaguuacauggcaauaaucuuugucuucacuuuugucaacaaggcacugauagucuuguuagcaguuguaagauucaguaauaggcaauuuuucuuuuucuuuuuuuuuuuuuuuuuuuuuuuugagacggagccuuacucugucgcccaggcuagagugcaguggcgcaaucucggcucacugcaaccuccgccucccagguucaagcaguucuucugccucagccucccuaguagcugggauuacaggcaugcgccaccacgcccagcuaauuuuuuguauuuuuaguagaaacgggguuucaccauauaggccaggcuggucccaaacuccugaccuugugauccaccugucucagccucccaaagugcugggauuacaggcgugagccacugcacccagccuaauaggcaauuuuucaacuugauacuggaguauuuaacaguauuggugaaacauuuugaaaaauuucaggcugagcgugguggcucacgacuguaauuccagcacuuugagaggccgaggcggguggauuacgaggucaggaguuugagaucagccuccagccuggccaauauggugaaaccccaucucuacuaaaaauacaaaaauuagccgggcgugguggcgcgcacuuguggacccagcugcugccggaggcugaggcaggagaaucgcuugaacccaggaggcggagguugcagugagccgagauugcgccauugcacuccagccugggggacaagagugagacuucgucucagaaaaaaaaaaaaaaaguguuccuucugccucggucucccaaaguccugguauuauagacaugaaccacugcuccuggcccccuauuuuuauuuuuauuuauuuauuuauuuauuuugagacagagucucgcucuuguugcccaggcuggagugcagugacgagaucucagcucauugcaaccucugccucgcagguucaagugauucuccugccucagcuucccaaguagcugggauuacaggugcccaccaccacaccuggcuaauuuuuuguauuuuuaguagagaugggguuucaccauguuggcaggcuugucuugaacuccugaccacaggugauccacugugccuggcccagcccucuauuuucaggcucacucuaaacuuaguugauguuaauggaacagacuauguugguaaacaaaauuaacaaaauauuacaaaauuaauaacauugaaauuuuauucauguuaauuuguacuagaauaugacacauggccuauugaaucuaaugaucaguuaaugaaaaauuaauaaacagggcuggccagguacaguggcucacgccuguaaucccagcacuuugggaggccaagacaggaggaucacuggagcaccggaauucaagaucagccugggcaacaaaaugagacccccgucucuauuuuauuaagauuuaaauuauuaauaauaaaaacaaacagggcaauguaucuacucuaaaagugauuuaauccaaauuuuauauuuacucugcuuuaauaauugacagguaagaggccugguaggggagaguuagaaauuuguaaaauaugguccgggcacaguggcucacgccuauaaucucagcacuuugggaggccaaggcgggcgaaucaccugaggucaggagcucgagaccagccuggccaacauggugaaacccuggcuguacuaaaaauacaaaaaauucaccgggcaugguuucacaugccuauagucccuccuacucaggaggcugaggcaggggaagcucuugaacccgggagguggagguugcagugaacugagauagcgcuaucgcauuccagccugggcgacaagaaagaaaacaggaaagcaggaaggcaggcaggagaaaagaaagaaagaaagaaagaaaaaaggaaggaagggagggagggagagaaggaagagagagaaauuuguaaaauaugcauguagauugaaaaauuguaaauuuaggaaguuaacauguuucugguaacucuuugguuauuauaauuuaaauguaaguuuggaaguuacucagcuuugguaaaaggcugauuuuggccauagucuugaguucucaagugacgugugaaaaaccaauguuuccauagguccuucuguaccucccuuagugaauccaccucugccuacaacuuuucaaccaggagcuccucaugggcccccuccagcuggaggcccacccccagugagggcccucacgccccugacaucaucauauagagauguaccccagcccuuauuuaauucagcugucaaccaagaagguaagugaaccaagaaacaaagucaaauccucaaguuuugacuuaggguagaaagaugaauauuagcugaauucugugcauuaaaaucacauuuuuuccagaaaaucuaguuuugguuagggaugggcuacaggaauuuacaauuuaaaguuccucaggaauuccauugccauccgcugggcugugacuaccauugggaaaaaagcucuuaguguuuuguuacuuuuuuuguugcuaugcggauuuuuuaaaaaucauggcuauaaagucagguggcuuuuggaggagaauuacuacuuuucuugacaugauguuagaauguuaggaauauccuuuuaaaauauugaccuuuuucauucaagacguauuuugagccaggcgcgguggcucacaccuguaaucccagcacuuugggaggcugaggcaggcggaucacgaggucaggagaucgagaccauccuggcuaacauggugaaaccccaucucuacuaaaaauacaaaaaaauuagccaggcgugguggcaagcgacuguaguagucacagcuacucuggaggcugaggcagaagaauggcgugaacccgggaggcggagcuugcagugagccgagauugcgccacugcacuccagccugggcgacagaaccagacuccgucucaaaaaaaaaaaaaaacaaaaaaaaaaaaacaagauauauuuugauugccacuauuaucguaaauguuaacacauacuuaugaaacuaaauaaaagucauuuauacaagcaguggaaaaauacaagcuuuugaaauuugauuuuccccucccuggaaucaauguuagcuacaugcaauuuuauguaaguaaaauauguuaaagcaucaucuugggauguaauggaaauaagaguguucauuuaaauaagauauuuuauaaaguaagaaauuugauuuuaggcugggcacagugucuuaccccuguaaucucagcacuuugggaggcugaggcaggcagaucacuugaggucaggaguuugagaccagccuggccaacauggugaaacccugucucuacuaaaaauacaaaaauuagccuggugugcuggcaugugccuguaaucccagcuacuugggaggcugaggcaggagagcuuuugauuuuagcaguaauauaaucguugcagcaagauguagaaaacagaugaggggguaaaaccauugcccauauucuacuacugaauacaaucaauauuaucauuuuuguguuuucuucuagcauuacauuaaguauuauaagucgggaaaagaauaauguuagcaacgaguaacaaggccgggcgugguggcucaugccuucaauccugacacuuugggaggccgaggugggcaggucaccuuaggucaggaguuugagaccagccugaccaagguggugaaaccccaucucuacuaaaaauacagaaauuaaggccaggugcgguggcucacgccuauaaucccagcaauuugggaggccgaggugggcggaucaccuaaggucaggaguuccagaccagccuggccagcauggcgaaacccugucucuacuaaaaauauaaaaauuagccgggcauaguggcgggcaccuguaaucccagcuacucaggaggcugaggcaggagaauugcuugaaccugggaggcggagguugcagugagccaagauggcaugaucgcacuccagccugggugacaagagcaaaacuccaucacacacacacaaaaaaaaccaauuagccaggagugguggugggcgccuguaaucccagcuacucgggaggcugagacaggagaauugcuugaacccguaaggccacuccaguguugcccacugcacucuagccugggcaacagagcaagacucugucucaaaaaaaaauaaaaauaauaaaaaauaaaaauacaaaaauuagcuaggcgugguggcaugugccuguaaucccagcuacuugggagacugaggcaggagaaucucuugaacccgagagguggagguugcagugagccgagaucacaccacaguacuccagccugggugacagaguaagacucagucucaaaaaaaagaguaucaaaaugaugaggcauugucucauugguugccacaguauuacuuugaaaaucaaguuacauuaaauauuuaaauaagaaaaaaaaauuuuuuuuuuuugagagggaguuucauucuuguugcccaggcuggagugcaauggugcgaucucggcucaccgcaaccuccgccuccuggguucaagugauucuccugccucagcuucccgaguagcugggauuacaggcaugcgccaccccacccagcuaauuuuguauuuuuaguagagaugggguuucuccauguuggucaggcuggucucgaacuccugaccucaggugauccuccugccucacccucccaaagugcuggcauuacaggcgugagccacugugcccggcagaaaaaaauuuuuauuuauuuauuuuuuugagauggagucucacucugucugccaggcuggagugcaguggcacgaucuuggcucacugcaaccuccgcucccggguucacgccauucuccugccucagccucccgaguagcugggacuacaggcgccugccaccacgcccggcuaauuuuuuuuguauuuuuaguagagacgagguuucacuguguuagccaggauggucucgaucuccugaccuugugauccgccugccucagccucccaaagugcuaggauuacaggcaugagccacugcgcccggccccagaaaaaaaaaacuuuuaagagauagaguuuacucugucacacaggcuggaaugcagaggugcaggaggcuacagcugcagccuccuggucuggaacuacagguguguaccaccacaccuggcuaauauuuuauuuuauuuauuuuugagacauaagucucacucuugcugaggcuggaguucuguuuuccaggcuggagugcaguggaaggaucuuggcccacugcagcuuccgccucccagguucaagcgauucuugugccucagucuccugaguagcugagauuacaggcaugugccaccacaaccagcuaauuuuuguauuuucaguagauacaggguuuucccauguugcccaggcuggugugaacuccugagcucaagugaucugccugccuuggcucccaaagugcugggauuacagguguaagcguccacgccuugccuacauuuuuuuaacaacuaaaaauaauucacaauaugcccaguguuuuuguuucuccuaaaaguuuuacugugguuuucuguuacaaauucauggcuaaaaucauguuggucuugagaacuggaaagaaguuacugacuuuaaaccauuaaauguaucuacuucguguuaauacagcuauugaaguuagcaguuuuguacuuaggugcuagagguuaaugcuauucacugaauuaagugucuucuauuccugaauuagagcucauacuuaguagagguaacuagaaauaaauauuuaguucucauaaacagaugucccuggcauuugucuuuaauccuguauaauuuugggagaagagauguuaagauuuuaauucuauuuuagugguuguccucuggacuuaaagcaguuguucuaauucauuuaugucaucuucaaauuaauuuggauuccacucucauuguuagauauuuugaaaauaagggcugggcacgguggcucaugccuguaaucccagcacuuugggaggccaaggcacgcggaucacgaggccaggaguuugagaccauccuggccaacauggugaaccccugucucuacuaaaauacaaaaacauuagccaggcguggugacgggcacauguagucccagcuacaugggaggcugaggcaggagaaucccuugaacccaggagguggagguugcugugagcugaaaucgcaccacuucacuccagccugggcaacagagugagacuccaucucaaaaaaaaagaaaagaaaagaaaguaaggucuuugcuccucauaauuuuacuuucuuuuuuuguuuguuuuuuugagauggaguuucgcucugucgcccaggcuggagugcaguggcacgauuuuggcucacagcaaccucugccucucagguucaaggaauucccugucucagccucccgaguagcugauuacaggcaugugcugauuacaggcacgcgccaccacacccagcuaauuuuuuuuguauuuuuaguagagacgggguuuccccauguuggccaggcugaucucugacuccugaccucgugauccgcccgccuuggccucccaaagugcugggauuacaggcgugagccaccgcaccuggccucuuuuucuuuagguaguuuugauuuugauaauuuuuuuucauuguguacugcuccuuagagguuuuuaaugcagcucucacaacugcugaaaucuuucagaugguauauaauuuuauaaacuucauaaagaaccaucuuuugcuagaaguuauuuugcuggaguagguuuugaaaaagccuuguuauuugggccuuuggcuuagguacaauguaaggugaaaaaagacucuuuccaaagacucauguuuccuuucccugaaguugcagcuaaauuacuugaaacuaucguauauguaaaaacuuggauuuuuuauguuguuaauaggcugugguuuuaaauuauuuguuguuuagaaaauuauuuaaaauuuuggauauuaguuaaaaucauacagagauuguaauaaucauucuaauuaaaaucuuguugaugaacuuccuucuuagguauuacaucaaauaccaauaacggaucuauggugguccacaguaguuacgacgagauugaaggagguggcuuauugggugagaugcuaugaaaguuuuuuuuuuaaucucuuuuuucugauuauagaaauaauaugugguaauuguacaaauauauaggaaacuaagagggaaacuucauaaucauguagccauacauacuauuaacuuauuuauuuauuuauuuggacacagggucucacucugucgcucaggcuggagugcaguggugcgaucauggcucacugcagccucagucuccugggcucaagcaguccucccaccucagccuccugaguagcugggaccauagccacgugucaccaugcccagcuuuuuguuuuuguuuuuguuuuuugagacugagucucgcucuguugcuuaggcuggagugcaguggcaguaucucgguucacugcagccucugccuccuggguucaagugauucucccacuuaagccucccaguuagcugguauuagaggcacccgccaccacacccugcugauuuuuguauuuuuaguagagacaggguuucaccauguuggccaggcuguccucuaacuccugaccucaagugaucugcccgccucggccucccaaagugcugggauuauaggcaugagccaccaugcccaggcccuggcuaauuuuuguauuuuuuguagaggcaggguuucaccauguuacccaggcuggucuugaauuccugggcucaagcgaucugcccauuuugccucccaaagugcugggauaauaggcaugugccauaacaucuggcucuauuauuuaacauuuuuuauuucuaugcauuagauuuuuuguuaaguuuuucuucugucagaauugggaucauggauuuauuauuauuauguuuugacuauagaguacuuuuaggauuuuuuuuuuuugagacagggucucugucacccaggcucaagugcaguagcacuguuauagcucacuguagccucaaacuccugggcucgugcgaucuucuaccucacccucccugaguagcagggacuauaggcauaugguaccaugccaggcuaguuuuuuuauuuuuguagagaugggggggugggucucaauauauugccugggcuggucucgaacccuuggcuugaagagaucccuccugccuugguuccccgauuugcugggauuacaggugugaaccaucucacacggcccauuuaggauuuuuuuuuuuuuuuuuuuucugagauggauucuugcugugucgcccagauuggagugcaguugugugaucuuggcucacugcaaccuccaacucccugguucaagcgauucuccugccucagcuucccgaguagcugggauuacaggcacgugccaccacgcccaguuaauuuuuguauuuuuaguagagauaggguuuaaccacguuggccaggauagucucgaucuccugaccuugugauccaccuaccucggccucccaaagugcugggauuacagguaugagccaccucgcccugccaggauguuauaauuaaaguuguuuugaauuaaaauuuuagucugaauacaaaauuuaguacaugauaugaaaguaaauuaacuguucuuuuguuuuguuguuuuuguuuuuguuuuuguuuuuguuuuugagacaguuucccucugucguccaggcuggagugcagugggcacaaucucggcucaccuccaccuccuggauucaagcaguucuaccaccucagccucucaaguagcuggaacuacaggcacaugccaccacaucuggguaauuuuuguacuuuuuaguagugaugggauuucacuguguuggccaggcuggucuccaacuccugaccucaaagugauccacccaccucagccucccaaagugcugggauuacaggcaugagucaccacacccagccgacaugaaaguaaauuaacugugcaaacuaguuuuugugucuacuacuauaguauaaaauauuaacuaguguaaauccauuaacaagauuuuuggccgggcacgguggcucauggccuguaauccuaucuucgggaggccaaggcaggcagaucaccugaggucaggaguuugagaccagucugaccaacguaguaaaaccccaucucuacuaaaaauacaaaaauuagguggugugguggcacacaccuguagucccagcuacucgagaggcugaagcaggaaaaucgcuugaacccgggagguagagguugcagugagccaagguugugucacugcauuccagccugggcgacagagugagacuccaucucgaaaaauaaaaugauaaauaaaauaaaauaaauagauuuuagucauugcuauuuguuacugguguuugucuuauuuuaaaaauuugauaaaugaaaguauuaaauuauccaaagaauuuuggaguuauaauaccuauaacuuauuagauuuauguguugauuuaaagcauucugggccaggcaugguggccuacgccuguaaucccagccuggacaacauggugaagucccgucucuacaaaacauacaaaaacauuagccgggcaugauggcacacaccagucauuccagcuacuugggaggcugacacaggaggaucacuugaaccuaggagguuaaggcugcagugaggugugauugcaccacugcacugcagccugggcaauagugagacccuuucuccaaaaaaaauguuuuuuuaaaauaaauaaaucaaguauucuggaguauaaaauagaacuuaaaaguuaccuuguuucuagcaacaccacagcuuacuaacaagaaucccaaaaugagccgaaguguuggauauucauaucccuccuuaccaccugguuaucagaacacaacaccaccuggugcaacuggaguaccacccucuuccuugaauuacccaagugggccacaagccuuuacucagguaaacuuuuugggauuuucuuuaaccuauuucuccauuugguuuaaacuguauacacaugaagaaaguuuuaggaagguauauuauacauuuuuauaaccauuuagaauaauaauggauauuucauaaagccuuugucuuuauacauuuuuccagaaccaaaagauuggccaagagaucuagauuacacuuuuguuauuuacagagaaauuaaccacuucccuacacacuuaauaaaaguuacuuacuuuaaaauuauguaucuguagacucccuuaggugcuaaucauuuaaccacaagcaugaguggauuaagucuacaaccagagggucuaagaguugucaaucuucuucaagaaagaaacaugcuuccgucaacaccuuugaagccuccaguuccaaauuugcaugaagacauccagaaacucaacuguaacccagaguaaggcuucagaugugacauuaugcauguccgaaaaguuuucuagcuuuuugcagggggcacaucagguguuaugaauaagcuguacaaauuauuaauuuaugaaaguucuggauacagaugauagaacucuuuuacuuguuuacuuaauagagauuugaaaaguccuacgucaagaaauagggauguaacuccugaagugauuuuguucuuaucagcucuaaugagauuaugauauucauuaucauuauggugguuacuuucuuucuucaaaauccaaaguacagggauuuguuucuacauaauccuuuauuugcucucauuuaaaauuaauuucauaacaaacauaauaccuuuuuuuccuaaaaacuuaccauaagcuuaaauguauaugaucaauaauuucugauaaauuaaauuugguaccuuuaaauuguauuuagaaucuucagcaaaacugaacuuuuaaauaauagacuuugcaauuugggccaucaccuaaguuuaauuuaauuccagugucaacuagacuuacaaaacaaaaaauaagucauuugauaguuuagacuguuuuacacacaagccaaaaagagacuauauuuuaguuauaggauaaccauccacucuauuucugcauaggacuuagauuuaaauauuuaaaugggauaaaauuuugagacucuauugaaauauuucaucuguaaucugauccaguauuaaaauguauaccuuuuaaaucuuuguuguuguuuucuucaaaaauaaucauagcagcaacugauacauacuuuuuacuuugauauagguuauuucgaugcacgcugacuagcauuccucagacgcaggccuuauugaauaaagccaaacuuccuuuggggcugcugcuucauccuuucaaagacuuagugguauguuucuuuucuuuucuuuuuuuuuuuuugagacggagucucccucugucgcccaggcuggagugcagugacgcagucucagcuuauugcaaccucugcccuccauguucaagugauuuuccugccucagccucccuaguagcugggauuacaggugccugccaccgugccuggcuaauuuuuguauuuuuaguagagaggggguuucaccaucuuggccaggcuggucuugaacuccugaccucgugauccaccugccuuggccucccaaagugcuggaauuacaggcgugagccucugcgcccggcucuuuuuuuuuuuuuuuuuuuuuuucugagacugggucucacugucgcccaggcuggaguguaguggcgagaucucggcucaccgcaaucuccgccucccagguucgggcaauucucuugccucagcuuccuaaguagcuggcauuauaggcaucugccaccacacccagcuaauuuuuuuauuuuuaguagagaugguguuucaccauguuggccagacuggucucgaacugaccucaagugaucugcccaccucccaaagugcugggauuuauaggccugagccacuacacccggccucuuuagugaagguaaaugucuuuugugcaaaauuaucuuggugaugaaaauuuucugcaaugaugcaagaauuacauauagaauuuguuugaucugucuuuaggaagucgaugauugacagauuacuuacaauucaaccaaaaauuuuauuacuaaacacuuucaaauacuagguaaaguaaguauauugcuggaaaauucaaaaaguacugaauagaauagagguacugagagaaacuaaauaaaugaaucauacuauuuuaauagguugugaauuauuuacccauuaaaguacuuuacccuagucuccccguucugccauccuugcaguaaaauuuguuauuuuaaaaaguuguuuuaagccagacaugguggcucauggccuguaaucccagcacuuuuggaggccaaggugggagaauugcuugggucuaugaguucaagaccagcuuaguccuggcuacucgggaggcuaaggugggaggaucacuugagcccaggagguugaggcugcagugagacaugauuguacuacugcacuccagccuggguggcagagugagacccuguauccaaaaagaaaaguuauuucagaagaaaaaagaaacugaucuaccuuuguccuaaagcucuguggccacauacucuugaggauugcugacuuucccaaaacacacuacuuuuggugauaggauuuuuuugguggugauauaauuuuauugccuguauugauuuuuuuuuuuuuuuuuaagaagcagagucuuaacugcauugcccaggauuggguaugagauccuuaucuuaaaaaaaaaaaauaaaggccaggugcaguggcucacaccuguaauccuagcacuuugggaggcugaggcgggcagaucaccugaggucaggaauucaagaccagccuggccaacguggugaaacucgucucuaccagaaauagaaaauuuagccaagcauggugaugcacaccuauaaucccagcuacuggggaggcugaggcaagggaaucgcuugaacccgggagguggagguugcagugagccaagaucccacacuguacuccagucugggcaauagagugagacugucucaaaaaaaaaaaaaaagauaaauaaaaccuuucuuuaaagaugagaugcuaugucacuuuguuguccaaggcacuggcucucaguuaaguugaucaguguucaccugucucaggguuucugguaaaucaaaacaaaucuccccaaaucugauagucuuacaaagacccuucccacguauuuacuguuauuuauuuauuuauuuauuagagaccgggucucucguugucacccagguuagagugcaguuccaugaucauagcucacugcagccuugaacucuugggcucaagcaguccuccugccucagccuccagacagaguaagugguacuguaggcauuggccacuauacccagcuaagacuuuagaacuuuuaauauguaggauaaacuuuaacuaggaguguaauuccaaaguuuaacugguuauuuaaauuaaccucaccuuacuuuauuauaguugagaacuaaguaagcuucuuaauguaacaucaacaaacuuuguaauaguuucauuggucauauauuuuagaauguugauuuuuuuuucuuugccauuuaugccaaaaguacauuguaaauuuaccaucuugguuuuauuuuuuuaacuuauuauuuauuuauuuaaaaacucuuuuuuuuugguagagaugggcuguugcuguguugcucagguuggucucuaccucccagccucaagugauccuccugcuuuggccuuccaaagcacugggauauauauauauauauuuuuuuaauuuauuuccaagauggagucuugcucuguugcccaggcuggaguacagugguguaaucuuggcucacugcaaccucugccucccaggguugaagcaauucuccugccucagccuccugaguagcugggauuauaggcaccugccacuacgccuagcuaauuuuuguauuuuuaguauagacgagguuucaccacguuggccaggcuggucuugaacuccugaccucgcguuccacccgccuuggccucccaaagugcugggauuacaggcaugagccaccacgcccagccuauuuuuauuuuuaaaauagagacagggucuuacuuucuugcccagguuggucucaaacuccuggccucaaguaaucuuccugccuuggccucccaccagagugcugggauuuuagacauagguguuagccacugugccuggccugcuauuuugguuuugcaauaugaguguuuaaugaggaaaaaaaugguuuuuacauuuuuauuuuauuuuauuuuuugagacugggucuugcucuguugcccauguuggagugcaguggcucagucauggcucacugcagccuugaccucccaggcucaagugaugcucccacuucaacccagcucaccacacugggcuaauuuuuuaaaucuuuugagagggucauguuucacuauguugcccaggccggucucaaacuccuggccucaagcaauccuuccgccuuggcucccaaagugcuggaguuacacaugugagccacuguccccagccaauaauuuuuuuuuuuaagacaacuuuuaaugagaauggucuuggagcaaaauaguaggguuuaaaauuaauacauuucaacuacaugguuuuuguguauggcaguuuagauacaucuuguacucuaaguuuucucuaaaaugauaauaucccaacaguuauuuagacaggauggauucaugcuuauguuuucaacaugaugauuuuugccuuuaaaaauuuaauucuguuuuuuuuuuuccagcaauugccugugguuaccuccaguacaauugugagaugccguucaugcaggacguacaucaauccuuucgucagcuuucuugaucaaaggagauggaaguguaacuuauguuaucgagucaaugaugguaugggaugcuuuuuugaaacauuuaaacguuucuacuugcauuguagggaaaucagaugauacaaaugcacaguuaaaaaaaaaaaacccuuuuauuuaccucuagucaauccuuccacucagagaaaacuacagguaacuuuuuucugugcguuuauauuuauaaauaaauuuaauuauuuauuuuuuaagcaaaaaauaaugauaguauuacauggauaucccauuuuuacauuguauuggguauauaauaagugguauauuucaugguauuacuuaagccaggaauuuaagaaacauuuuuauuuagaaauugucccacgccuuuucucuagggugaaagaaaauaaguccacagaauagcugcccaauucauucacugcugaaugaagggaaguaggcagugcuagaagguuaguugaauguaguuuucucaguaauugaggaggaggagauuucucucaauaacuaugucacaguuuuuauuugaggacuauaauguaaucaacaggguucuguuaguauuagagaaggaaguggguaugccaguauccacagugucuauuugaaagauuugagaaauagaggaauauaagaguuuuguuuuuguuuuuguuuuugagauggagucucacucuguugcccaggcuugagugcaguggcacgaucuuggcucacugcaaccuccgccucccagguucaagcgauucuccugccucagccuccugaguagcuggaauuacaggcauccaccaccacggccggcuaauuuuuauauuuuuaguagggguggaguuucaccguuuuggccaggcuggucuagaacuccugaccucaagugaucugcccaccucaggcucccaaagugcugggauuaacaggcaugagccacugcacccggccaagaguuuguuuuuguuuguuuguuuuugagacagagucuggcucugucgccaggcuggaguguaguggcaugaucucagcucacugaaaccucucugccucccagguucaagcaauucuccugccucagccucccgagaacacacccagcccuggccaagaguuuuuaaaaaccaguuuuauuggaugggcacgguggcuuacgccucuaaucucagcacuuugggaggccgaggcgguggaucaccugaggucaggaguucgagaucaguguggccaacacagugaaaccccaucuuuacuaaaaauacaauaauuagccgggugugguggcgggcaccuauaaucccagcuacucgggaggcugaggcaggagaaucgcuugaacccaggaagcaaagguuucagugagccgaaaucgagucauugcacuccagccugggcgacagagcgagacucugucucaaaaacaaacaaaacagagccaggugcaguggcucaugccuguaaucccaacacuuugggaggcugagguggguggaucaccuaaggucaggaguuugagaccagccuggccaauguagugaaaccccaucuuuacuaaaaauauaaaaaaauuagcugggugugguggcgggcaccuguaaucccagcuacucgggaggcugaggcaggagaaucgcuugaacccgggaggcggagguugcagugaaccgagauugcaccauugcacuccagccuuggcaacaagagcaaaacuccaucucaaacaaacaaauaaaacaaaacaaaaaaacaguuuuauuguuuguguguguguguguguguguguguguguguguguguuuugaguauagaaaaguaaggauaggcuaagaacuuucucuugcacuguaacaauucugaaaauguacaugaaguauuuaguuaccuuuaaaauuuuuauguguaggugcuuuaauauacaaaaugaaauuauaauaaaaguugaagccccuuucaucugcaaaccaggcuauuuccugaacuauagcuuaaccuuuagagugcauagggauuugaauuucuaaacaauuaguaggaagacagauacaaugauaauuaauuuagaaaauacucuuugaccacuaguguauuauaagugguagguaugauguuagguuaagugauguuccauaaaguucucauuaauuaaugaaacuuacuaaaccuuaugaccuugaccucugaaauugucuuaccauagcuucuagugccagcuagugucuguacauuucauaugugaaauguuaauauccuuguauaauugggaaguuuaagaaaauaggccgggugugguggcucacaucuguaaucccagcacuuugggaggccaaggcgggcggaucaccugagguugggaguucgagaccagccugaccaacauggagaaaccccgucuguacuaaaaauacaaaaaauuagccgggcgugguggcgcaugccuguaauccuagcuacucgggaggcugaggcaggagaaucgcuugaaccuaggagguggagguugcagugagcugacauugcaccacugcacuccagccugggcaacagagugaaacucugucucaaaaaaaaaaaagaaaauaauugacauuuaaugaauguuugucaucuuuucaaggaagaaaguggccaaaugcaaaauacauuaaauucuuuucaguuuuuucaauauguguauuguuaacuuuauauaguuccugaagaauucuuguacaacccuuugaccagaguuuauggagaaccucacagaagaccagaaguucaaaaugcuacuauugaguuuauggcuccuucagaauacaugguaaacuuuuauuuuuugauacaguauacccauuuuuuauuaccagguuuuaaguaaaacaauacagcauccuguaacaaaauuuuauuuuauuuuauuuugagacagaguuucacucucauugcccaugcuggagugcaguggugcaguggcagguucaaggcucacugcagccucgaccucccgugcucaagugauccucccaccucagccuccugaguagcuggggcuauaggcacgcaccaccacaccuggcuuauuuuuauuagagacagaguuuugcuauguugcccaggcuggucucgaauuccugggcucgagugaucugcccaccuuggccucccaaagugcugggauuacaggugugagccgcugugcccagccaaaauuuuauguuuuuaaauguguaaaaguguaauacuuguuuauuacuaaaguaauuaauauauaaggguauauuugaaagguaaaaguuuauguaaagucccauuuaagugucuuaugugacauucagaaauuuccaauaugauauugggcucguauuuacuuuuuuuuuuugagacggagucucacucugucacccaggcuggagugcagugcugugaucuuggcucacugcaaccuccgccucccggguucaagcaauucuccugccucagccuccugaguagcugggauuauaggcgcgagccaacaccuggcuaauuuuugaguuuuuaauagagacgggguuucaccauguuggucaggcuggucucaaacuccugaccuugugauccucccaccucggccucccagagugcugggauuacaggcaugagccaccgugcccggccagcucauauuuacuuauaaguuacagucaguuuuuuuuucccuauugcuucauuuuuccuucauacaaauuuuuuuucuauuagaaauaaugcugugaugaagauccucuugcaaauauuguucuuuucuacacccgugagaauaucugaggucuugcauuuuaaaacuaauuacuaugccuaauuuuuuuguuuaacguuuauuucuuuuagagaggagggucuuacuuuguugcugaagcuaaagugcaguggcacuaucauagcucacuguagccucaacuucaugggcucaagcaauucuccugccucagccucccaaguagcugggacuacagacaugcaccaccaugcccugcuaauuuuuuaaaaguuuuuuagagacagagucucacuauguugcuuaggcugcuugugaaugccuaauguuuaauuagcacuuuacauuuuauaaagcacguacacuuuugaucagcacaaacaguauucugaagcaagcuagaaaaaugcuguuaauccucuuuuacagauaugaaaacagacuuagguuaagugacaugccaaauuucacuuaguaguagaacuugcauaauaauuuaggccuuuugauuugguuacucuuucaccaugccauaauuaucucuugggaaaagggaauaugaagauaacucucaacacuaccuuuuaauauuuuaguguauuuuggcugggcacagugccuccugccuguaaucccagcacuuugggaugccaagccagacggauuaugaggucaggaguucgagaccagccuggccaacaugguaaaaccccgucucuacuaaaaauacaaaaauuagccgggccugguggugagugccuguaaucccagcuacuugggaggcuuaggcaggaaaaaugcuugaaaccgaaagucagagguugcagugagccaagguugcgccaccacaccccagccugggcaaaagagcgaaacuccaucucaaaaaaaaaaaaaaaaaauuaauauauuuuugugucuuuaucugggcaguuggguccauuuuucuguaaacuuaugaggaaccagucuccuuaccacagaaaagcuucuauauagaaaacauuuuguuggccaggugcaguggcucacacccguaaucccagcaauuugggaggccaaggugggcggaugacuggaggucaggaguucgacaccagccuuaccaacauggugaaaccccaucucuauuaaaaauacaaaaguuagccagauguggugacauacgccuguaaucccagcuacuugggagacugaggcaggagaauugcuugaaccagggaggcagagguugcagugagccgagauugcgccacugcacuccagccugggcaaccgugcgagacuccaucucaaaaaacaaaaaagaaaaagaaaacauuuuguugcacuuaagugguugguaauagccaucuacagaguagauguuccuuuauuggauuaaaacaaaaaaaaccagaagcacuuguucuuuuaaauuuaccuuccuaguuucccuuuaucacccacacuuugcaaaaauugcuuccuuuaaauuuagaaacuuuccuauagcagaagguguuugcuccuuucuaucucuugaggggcagguuguguggauuuggcaagugauacaugcaaaaauauauaaaaguacaguugacucuguauccaugaguucugcauccguggauucaacuacccauggaucgaaaauguucagaaaaacacaguaaaaaauauuauaggacagacaugguggcucacaccuauaaucccagcacuuugggaagccgaugcaggaggauugcuugaagccaacaguucgagaccagccugggcaauguagcgagacccaagucucugcaaaaaauuucaggaauuguggugugugcuuauagucccagguacuugggaggcugagguggaaggaucgcuugagcccaggaguucaaggcugcagugagcugugauugcauugcaucacugcacuccagccugagugacagagcaacaccuucucucuaaaaaaaaaaaaauaauaauacaaauuuuaauauacaguauagcaacuauuuacauagcauuuauguuguauuagguauuauuuuaaaaaucuagagaugauuuaaaguauacaaaaggaugugcauagguuauaugcaaauaauacacuauuguauguaagggaauugagcauccuuagauuuugguauucgaggugggagauccuggaacuaaucucuugcagauaccaagggaagauuguauacuacauacccaguucugacuguggcuauuugaugcuuuuuacugaauugagaacaaaucuuuggauuuggaaguuuaaaauacagucuuggccaggugcaguggcucacaccuguaaucccagcacuuugggaggcagcgaaggcgggcggaucacaugagaucaggaguucaagaccagccuggccaaaauggugaaacccugucucuacuaaaaaaauacaaaaauuagccgggcgugguggcgcgugccuguaaucccagcuacucaggaggcugaggcaggagaaucucuugaacccaggaggcagagguugcagugagcugagaucacaccacugcucuccagcaugggggacacagcgagacuccaucucaaaguaaaaaaaaaaauacagucuuauguuuuuaugagauuuggcuguaauuuguuguuuaaauaaccagcugaagcuaacuuguaacuuucagagcuauaauuucccuaaauugugaaauccaacaaacauauugaaaaaucaauaaaacacaaaauauucagauuaccaaaucauuauaaacuaaacacuuuuguuaguauaacccaagccaagcaguugaaccuugcuaauacucccagaaucccuucuuuuuuuuuuuuugagauggagucucacuuugucgcccaggcuagagugcaguggcauaaucucggcucacugcaaccuccaucucucagguucaagugauccuccugccucagccucccgagaguagcugggacuacaagcgccugccaccacaucugacuaauuuuuguauuuuuaguagagacgggguuucgccauguuggucacgcuggucucgaacuccugaccucaggugaucugcccgccuuggccucccaaagugcugggauuacaggcaugagccaccacgcccagccacaggcccuucugauuacaucucuuccccuuccuguucuagagaaaacacucuucugaauuacggcaaucacagacucauuuuuccuuuaaguguacaucuauaaacaauauaguauagcuuugccuguuuauuauaaucucuacucaaucuguaaauaaugcuuuuuaaauuguuuugcuguauguguacccagcaaauaaguuuaaacuuaauccuguuaaauguacuuaacaagaucuuuuuuucuucaguuacgaccaccucagccuccaguguaucucuuuguauuugaugugucucacaaugcagucgaaacuggauacuugaauucaguuugccagaguuuguuagacaaucuggauuuguaaguuucucaauucagcuuaaauaugaaacuaauaauauuuucuaaaugaauaaguaguuuuugaaauuaaaaaauaaaagcuguauaauuauguucuaaaacuccacccaaaucaguuguuaauuuaggccucacuuucucuucgaaacauuauuuuuaaaucuauaguugguaggaagaauaauguaaugaacuuccagucaccugucacccagauucaucaucuucagcauuuugcuauuuuugcuuaaucucauccuuccccuuucaugcacauaccuuuucccaccuugaguauuugaaagcaaauuucagccagcauacuguuuuaccuauacguacuucaagacuaacuuuuauaccuaacuauaauacuaaaguauuaaggaaaauuagcaguaauuccacauaugaucuaauaccuaguuuauuuuuuguuccuaguugucucaaaaaugccuuuuuacugucaguuuauuggaguaagaauuuaaacaguauacacacauugcauuugguuaucaagugucuuaagucucuuaaaauaacuauuuccaguggugcuuagagaccuaguguaacccaucaaagcuaaugugaccuuucuauguaaugaaguauagugcuugugugugguguggaggcauauagaaggccaaauuucaucacgaguggaguaacuccuucacuuuggugaaaagcucauucuuguuccugccagcauuuguauuuuuaauguuguagauugugaauggggauugugaauugaugagauugucacugacucacccaugcaugaacaagagugaaaaacaguuuguucuuccccuuauauaauuguaguuccacauauuuguaguucuuuaaaauagaugcuuuugcuuuucuuuguucuuaaauauuagaguuucuguaucauaauauuuugaagcaugcuuuauaacuuaaaaucaucugcaaaauuucauuaauacuuuucaguauuuuuaacauacuguuuccuaagugauuauauguagcuuuacauagcuauacuugguuuuggauuguuguauuauugcuguuuuuuguuuauuguuuggcuuacauguaguguuuucccuuugagucagauauguuuucaugguaaacguugggugguuuaaacauuuguuuguguugggccaauuucuauaauauugaauuagauauuuucauguaacucuuaggacauauuuuauguguauuuguaugugguuaaaacuugauaaaauacucuucugaauuuguuuuuaggcuuccuggcaacacuagaacaaaaauuggcuucauaacauuugacaguacaauccauuucuacggucuucaggaaagucucucucaaccucagaugcuaauaguuucagauauugaagguauagauuuauugaacuacuuucauaauuuuucaguuuuagaaauauuucuugauuacuugacaaauuggauguguguuguuuguaguaugucaaggaaaaucuugaguauaaaaucaugauuguuggaguuguaagagucuuucaguucaaucucucauuuuauggaggaggaaauggggguuauggagacaacccgcugaacaaguuaacaaaaacaaguuaauguuagaacucagaucaaauuuaggcuuuuuuucccccuucuucccauuuauucauucaaaaaguauuugaggauagacauauagagcaaggaaauagaauugagagcucagaauaaagccuagcauauauagucaauugauuuuauuuauuuauuuauuuauuuauuuauugagauggagucucacucugucgcccaggcuguagugcaguggcacgaucuuggcuuacugcagccuaugccucccgguuucaagcaauucuccugccucagccucccgaguagcugggacaacaggcaugcaacaccaugcccagcuaauuuuuguauuuuuaguagagaugagguuucaccauguuggccaggcuggucucaaacuccugaccucaagugaucugccucucuuggccccacaaaguacugggauuacaggcaugagccaccacccacagccaguuaagugauuuuugacaaaggugccuagaacaaucagugggagaagagacaguuuuuucaacaaauaguuguggcaauacugccuauguaagagaaugagguuggaccuuuacuuuauaccauguaaagaaaauuaacuugaaauggacuaaagaccuaaacuuaagagcuauaaguauaaaacaggggcaaauauuuaugccacuagauguggaaacauuagaacccuggugcacugcuggucagaauguaaaauggcauaacugcuguggaaaauaccuuggcaauuccucaaaguuaauggugaauuaucacauuauguagcaauuccaccguucaauauauacuccaaaaaaucgaaagcagagacucaagcggaugcuuguacaucauuguuuauagcaauagcaaucauucacaauagccaaaagguggaaacaccccaaguagccaucaacagaugaauagauaaauaaaaugugguauaaacguauaauggggccgagugcgguggcucacgccuguaaucccagcacuucaggaggccgaggcggguggaucacgaggucaagagaucaagaccauccuggccaacauggugaaaccccgucucuacuaaaaauacaaaaauuaguugggcgugguggugcguaccuguagucccagcuacucgggaggcugaggcaggagaauggcgugaacucgggaggaggcggagcuugcagcaagccgagaucgugccaccgcacuccagccuggacgacagagugagacuccaucucaagaaaaaaaaaaaaaacguauaauggaauauuuauuauucagccuuaaaaaaacaaugaaauucucacacgugcuacaauguggaugaaccuggaaaacaugcuaagugaaauaagcaagacacaaaccgacaaauauuguaugguuccacuuauauauaguaccuagaauaggcaaauucauagagacagaaaauggaauagagguuaccaggggcuggggggggagggcgauuaauagggaguugucauaauuauuacauuuuuuuuuugagauggaguuucacuuuuguugcccaagcuggagcgcaauggcgccaucucggcucgcugcaaccuccaccucccagguucaagugauuuuccuaccucagccuccugaguagcugggauuauaggugcgugccaccacgcccagcuaauuuuuuguauuuuuaguagaaacaaggucuuaccguguuagccaggcuggucuugaacuccugaccucaggugaucugcccgccucugccucccaaagugcugggauuacaggugugagucacugugccuggcuauuacuauuuuuuuaaagacagagacucuuguugcccauguugcagugcaauggugcaaucauagcuugcugcagccuugaagcccugggcucaagcgauccuuccaccucggcuuuucaaguagcuggaaauacaggcacacgcuaccacgcccagcuaauuuuuaaaauuucuuguagaggcaaggucuugcuaaguugcacaggcuggucucaaacuccuggccuuaggcaguccuuucgccucauccucccaaaguguugagaguauaggcaugggccaccacaccuggccaggccuuauuuuuuuguaaucagaaacaaaauauagaaaucuagaaagugauuauccuuguaauccuccaccacucucuucccaguuugcucccuuucuaaggaagaauuccuaagcaauuauugaauaaaugugaauccugagaggcucaucugaaguggucagguagcauaccuucugauucacuugauuuugcagucccauuaauuuuguuuguucguuuuguuuuguguuuuuggagacagagucuugcuuuguugcccaggcugcagugcaguggcgcgaucucagcucacuggcucacuggcucacugcagucucugccucccagguucaagcgauucucaugccucagccuuccgaguagcugggauuacaggcaugugccauuaugccuagcuaauuuuugugguuuuuaguaaauaaugggguuucacuauguuggccaaucuggucucaaacuccuggccucaagugaacugcccaccucggccucccaaagugcugggauuauagcaggcaugaaccaccaugcccggccuccauagucccauucuuuuuuuuuuuuuuuuugagaaggagucuugcucugucacccaggcuggagugcaguggcgcgaucuugguggcucacugcaaacucugccuccuggguucaagcaauucucugccucagccucccgaguaguugggcuuacaggugcccaccacgccuggcuacuuuuuauauuuuuaguagagacaggguuucaccaucuuggccaggcuggucuugaacuccugaccucaugauccaccugccucagccucccaaagugcugggauuacaggcacgagccaccgcacccagcccauagucccuuuuuaaaggcacuggugugggccuucuuuuuuuuuuuuuuugagacgagucuugauugaucugucacccaggcuggagugcaguggcacuaucucggcucacugcaaccuccgccucccggguucaagugauucuccugccucagccucccgaguagcugggacuacaggugcccaccaccacgccuggcuaacuuuuuguauuuuuacuagagacaggguuucaccacauugcuccugaccuugugauccgcccgcgucggccucccaaaguacugggauuacaggcaugagccaccgugcccggccgaccuucuuuaugagaaagcaucugcuuugugaaugacagagcuauuggugagcuguauugcuuccuuaugaagacagcauucuugugugucauguuagucaaaaaaauuucuuaaugccaagaguguaucuuuggcuggcuuccagggccagccauuuaaaaaaaaaaaaaaaggucaaagcagaauuguaaauuauuaucuuuagccuaagaagcauagcacuuacacaaauucagugaguacagaucaauauuuuauuuuuuuucuuuccuuuuuuuuuuuuuuuuuuggagacagggucucaaccuccccacuagccugggagugcaguggugcaaucuuggcucacugcagccucagccucccgggcucaaggaauccucccacauagcugggacuauaggcauguaccaccaugccuggcucauuuuuguacuuuuuguaaagacaggguuuuacuguguugcccaggcuggucucaaacuccugaguucaagucauucacuuaccucagccucucaaagugcugggauuacaggcguguacuacugcaccuggcccagauaaauauuuucuaauugggaggcuguaccuuuuacaagguagcagacaagaagcagaaaauuugcaguagauaccuguaucauuguggugguuuuuuggugguucuuuggacacauguaaacagugcuauaauaguggaggagguggcuuauuuuuaaggaagggggugguuaauugcauuaguguuauauauuuggcacacuuuuaauuauuacauuuuguuuaaaauaaauauguauuucuucuuucagauguuuuuauaccuaugccagagaacuuauuaguaaacuuaaaugaaaguaaagagguaaggcacauuuuccuaccugacauguuuaauugaaauauugaaggaauauguuuuugaaaugaacuuuaaguaaaauuuugauuauuucugugacauuucuaagauguguagcauuuuauauuugcucuuauaauuagaugaacagcucuugaguucaaccuugagcugaucauuuuuaagucuaaugaagcaaguuauuuguaguaggguagaaaauaagcauauuccauaaaggaggaacacuugaaggaaaucugucuugucagccauuugggaaguugggaggguugcugagauaaagcuucuggucacuacauagaagcacauuagguaggcugcuuucagugcccuuugcuuuucugauucacagagugucauuggggucaguucagaagaaacucuuauuaccugccuggaaauugccaugagauaauacagugagaggugaacagaaugugucugaaggggggauguugucuacccuguacaugcauauaugccguagggguaacauuuuaacuagcaagucuauggucucugcuguuggcaauggugacugugccauagugcgaaguauuuuuuuccccauuaacucuauuuguacaaccuaaccuguaaagguaguuguuuuucuuuuguagugauauuacuaguuggcaaaguuacuggauaucuuagauuugcaacagggaagagcuaaacucgcuuuggaacuuacaagaauaaaguauguagaggugauggagaaggccauauuucauggcauuaaaauacaucaaaucucuaaacugugaugguucuuuuggauacauuuuggacuuauagucuugcuggacuacugcaugugcaagaacuguaaggcccaacuuugauuugucuugcuugccaauuuauaauguugacuuaaaauggcuuucuugucauuugaccaacuucauuguuuagugucuguagauucucugaccaucaucaugacucaaugucuugucuauuguaugagauacugacuuaaugugaaauaaaauuuuaauuaugacacuugaguuuucuugcuuuguuuuacaagcucgugcaagauuuacugaaaacuuugccacaaauguuuaccaagacucuggagacccagagugccuuggguccugcacugcaggcugccuuuaagcugaugucuccaacugguggucgaaugucugucuuucaaacacaacucccaacucuuggagugggagcccugaaaccacgagaggaaccaaaccacaggucaucugcuaagguuagagagucaugaaaugucugauaagguuuaugcugguguuccaucccugugaccauagaacuuguuuuuucuuuaaauuuauuugucaauuguugggaggagggacuauaaggaaguuaacuuuuauguagacauuuuuauuuuguuacauuuuucucuaccugauucacccuuccuuaauuuuuaguaucuuuagcaggccacuagcaauucagccugccuucagagagauagucugggagacuaacagaauaugcuugauagggacaaagagaaccugauugaccaguuaagaauagucuuauuuggcugggcgugguagcucacaccuguaaucccaacaucuugggaggccgaguugggcaguucaucugagguugggaguuugagaccagccugaccaacauggagaaaccccaucucuacuaaaaauacaaaauuggcugggcgcgguggcucacgcuuguaaucccagcacuuugggaggcugaggcgggcggaucacgaggucaggagaucgagaccacggugaaaccccaucucuacuaaaaauauaaaaaauuagccgggugugguggcgggcgcuguaaucccagcuacuuggagaggcugaggcaggagaauggcgugaacccgggaggcggagcuugcagugagcugagauugcggcacugcacuccagcacuccagccugggugacagagcgagacuccgucucaaaaaaaaaaaaaaauuagcugggugugguggcacaugcuuguaaucccagcuacucaggaggcugaggcaggagaauugcuugaaccugggaggcggagguugcagugagccaagaucgcaccauugcacuccagccugugcaacaagagcaaaacuccgucucaaaaaaaaaaaaaaaagaaaagaaaaagaguaguuguauuugguacauugauggccaaggugcuuaugugcaccuugugugcauaaacuuuaagguuuuugagacccguauuucccaaaagauuaugaaagagagaccuguguacuauacuggguaugguaucauuccuggagucagacugccuagucucacuguuuauuacacuugggaacuugaaaaauuaauuucuuugccccuuuguuucuuuauauauaaggugaaaauaaagggucaagugugguggcuugugccuauaaucccagcccuuugggaggcugagauggaagcaucgguugagcucaggaguuugagaccaaucugggcaacauagugagacccugucccuacaaaaauacaaaaaaaauuagccaggugugaugcugagagccuauaguccuagcuacucuggaggcugaggugagaggaucacuugagcccaggaggcugcagugagaucgugccacuacacuccaacuugggaaacaacaacaacaacaacaacaaaaaagauggcuggguguggugguucaugccuguaagaccagugcuuugggaggcugaggcaggcggauaaccugaggucaggaguucgagaccagccuggccaacacgacgaaaccccaucucuauuaaaaauacaaaaauuggccgggcaugguggcucacgccuguaauuccagcacuuugggaggccaagguggguggaucacgaguucagguguucgagacuagccugaccaacauggugaaacccugucucuacuaaaaauacaaaaauuaaccgggcgugguggcacacaccuguaaucccagcuacucaggaggcugaggcaggagaauugcuugaaccugggagguugcagugagcugagauugugccacugcacuccagccugagcgacagagugagacuccgucucaaaacaacaacaacaaaaaacaaaaauuagcuggggguggcggugugcaccuguagucccagcuacuugggaggcugaggcaugagaauugcuugaacccgggaggcagugagcugagaucacgccacugcacuccagccugggugacagagugagacucugucucaaaaaaaaaaaaaaaaagaaagaaagaaaauaaugauaguggccaggugugguggcucacaccuguaaucccagcacuuugggaggccgaggcaggcggaucaucuaacuuugggaauucgagaccagccugaacaacaugaugaaaucccgucucuacuaaaaauacaaaaaacauuagcugggcaugguggugcaugccuguaaucccagcuacucgggaggcugaggcaggagaaucgcuagaaaccgggaggcagagguugcggugagcugagaucaugccauugcacaccagccugggcaacuacagcaaaacucccaucucaaaaaaaaagaaaaagaaaaaaagaaaaugauagcacuuaccucuuaggguaguugaaaggacuaaguaaguauuacauaugaauuguuuagaacaguuuccagcauacugaacauuuaauauauuuuaguuacaauaaaaaaaucuuuaccaacuaugaaauuauuauaguagauauauuucuuuuuaaaaauaaagggaaaaaaaccuacagaaaauuuuuaaaaaacauauauauauuuuuucagacggagucucgcucuguugcccaggcuggagugcaguggugcgaucucagcucacugcaagcuccgccuccuggguucaugccauucuccugccucagccucccgaguagcugggacuacaggcaccugcaaccaugccuggcuaauuuuuuguauuuuuaguagagacgggguuucaccauguuagccaggauggucucgaucuccggcccucgugauccacccaccucggccucccaaagugcugggauuacaggcgugagccaccgcacccggccauuuuuuuuuuuuuuuaaauaaauaaagucauguugcccaggauggucucaaacuccugggcucaagcaguccacccgccuuggcuucccaaagugcuaggauuacaggugugagccaccacaccuggcuggaacuuacagaaaauuccuaagcaguacuugcuucuuaaugaaaaaucaaguaguaccacaaaggaaaaggacuuuguagaaugcccagaaauaauugcaauuguuguuaacaucaugauguauguagauguguauuuagauuuuaugacaauguaaugauuuuuuaaaaugucucuuuauaauuuauuauaaauaggauauacacaugacaccauccacugacuucuauaagaaauuagccuuggacuguucuggucagcaaguugcuguugacuuauuccuucucaguggacaguauucugauuuggcuucucuggguaaguucuucguaaugauuuuuuuuuuccguuaaaugaauaucaaaaugguccuuauaugauaguguucuaaauauagaacaaaguuaaagaauauguaugcccuugggaaaguuaaucagucaguuuagucuauuaaaaaccuuauagucuucuacucuaaacauuuaguaauagagaaauuucuauucuacuauuuaaaggaaugcaggccggguaugauggcucaugccuguaauccuaacaauuugugaggccugugcaggaggauugcuugagcccaggaguuugagaccaaccugggcaacauaggaagacccuguauuugcaaauaauauguauauuuuuuuaaauaaaaaacuagccagacaugguggcgcacaccuguggucccagcugccuggaaggcugaggugggaagagugcuugagguggagaggucaaggcugcagugagccccaugguaucacuacugcacuccagccugggugacagaaugggacucugucucaaaaaaagggaauaaaaucuccuuucugacaguaguuuaccuuggaaaguuaaagaaagauugauuccaaugucuuuaguuacuuugguguaguagaaauaguuaacggcacaguuuaaaacaguguguguucucuuccagguuguauuucucgguauucagcagguagugucuauuacuaucccucuuaccaucaucagcacaacccaguccaaguacagaaauuacagaaggaacuacagagauaccuuacucggaagauuggcuuugaggcagucaugaggauucggugcaccaaagguaggaauauuuuuuuuuugcguaggacugaauaauauuuuugguuucaguaaauguacauguuuuuaucuggucuuauaagauugcccuucugagauacuuugccuacucuggaauaugcaauuaagaggagagaagaaacacuguaaccaaaaaaagggggccuauugagaauauacucaaaagcacugacuuauauauuuuuaaauagagaauuuuauggugugugaauuaucucaguuuuuuaaaaaagaccuuaucuccggcugggcacaguggcucaugccuguaauuccagcacuuugggaggccaaggcugguggaucgcuugagcccaggaauuagagacgagccuggacaacauugcaaaaugaugucucuacgaaaaauacaaaaacuuagcugagcgugguggugcacgucuguagucccagcuucuuaggaggcugaggugggaggauuguuggggccuggccugggagucagguugcagugagcagagaucacaccacugcacuccggccugggcaacacugucuccaaaaaaaaaaaaaagaagaagauagagucuuguuuuuuuuuuuuuuuuuuugagaugguauauugcucuguugcccaggcuggugugcagugacacaaucuuggcuaacugcaaccuccaccucucgaguucaagugauucucccugcuucagccucccgaguagcugggauuauaggugcgugccaccaugcccggcuaauuuuuguauuuuuaguagagacaggguuacaccauguuggccaggcuggucucaaacuccugaccucagaugaucugcccaccucagccucccaaggcacugggauuacaggugugagugaccgcacacagccuagacccuuuuuugacagagucucauucugucgcccaggcuggagugcaguggugcaaucacagcucacuggagucuccaccucccugacucaagugauccucccaccucagcuuuccuaguagcugagacugcaggugugagccaccacaccuggcuaauuuuuuauuuuuuauuuuguagagacugggucucccuauguugcccaggcugguugcaagcucgugggcucacgugaucuuccugccuuagccucccaaaguguuaggauuacaggcaugagccaccacacccagccacagaucuugcuuuuaaacuuuuuuuuuuuuacuuguaaaauauauauaacauaagcuuuaccauuuuauccuuuuuuuuuuuuugagacggacugucucgcucugucguccaggcuggagugcaguggcacgaucucagcucacugcaagcuccgccuccuggguucaugccauucuccugccucagccucccaaguagcugggacuacaggcgccugccaccaugcccagcuaauuuuuuguauuuuuuaguagagacgggguuucaccauguuagccaggauggucucgaucuccugaucuggugauccguccgccucggccucccaaagugcugggauuacaggcaugagcuaccgcaccuggcccauuuuauccauuuuuuaauuguacaguggcaucaaguauguuuucacugugcaacuauuuauuuccaaaagugggggaucucuuaguuuguacucucuuuuuuuuuuuuuuuuuuuuugagccagaguuucacucucucgcccaggcuggaguauaauggugugaucuaggcucacugcaaccuccaucucccagguucaagcaauucugccugccucagccuccugaguaacugggauuacaggugccugacacuacgccugacuaauuuuuguauuuuuaguagaaacgggguuuugccauguuggccaggcuggucucaaacuccugaccucaggugauccgccuaccuuggccucccuaaaugcugggauuacagguaugagccaccgcacccagccuguacucuuauuuuuaguuuuucauuucuccacauuaucaaccugguggguuuuuuuuuuaagguggguuuuuuuuuccauugcugcugcacaaauugaguuuuuauuuaaauaaauauuauugcucuguaaggggguguggagcacagauugaguuuuuauuuaaauaaauauugcucuguaaugggguguagagugguaauuuucuuucuucuucucucucuuuuuucuuuuuuuggagacagaguguugcucugucccccuggcuggagugcaguggcaugaucauagcucacugcagccucaacuccugggcucaagcaauccucuuagcucagccucccgaauaacugggaccacaggcgcaugccaccacgccuagcuaauuuuuaauuuuucuguagagacagggucuuacuuuguuacacaggcugguuucaaacuccuggacuuaagcaauccuacaccucagccucccaaagugcugggauuacaggugugaaucaccacgcccaguauaauaauauucuuuucaauggaaaaauuauuuauaugaaaucuauaacaaaaaaaaaaagauaaagauccacuaaccuguuccauuacacauugaaaucuguuggucaaaccaugagcaagaugaaggucucucuuaucuauccuucacuauaauuagaauuuauuaauucuaauaguuuuuauuuauuuauuuuuuuuacuuuauuuuuuuuuuucugagaccacaucuugcucuuuuguccaggcuggaguucaguggcacgaucuccgcucacugcaagcuccgccuccuggguucacgccauucuccugccucacccucccaaguagcuggaacuacaggcgccugcuaccacucccagcuaauuuuuuguauuuuugguagagacaggguuucaccauguuagccaggauggucuugaucuccugaccucgugauccauccgccucggccucccaaagugcugggauuacaggcgugagccaccgcgccuggacuguauuuuuaguagaggugguguuucgccauguuggccaggcuggucucgaacuccugaugucaagugauccacccgccucggccucccaaagugcugggauuacaggcaugagcuaccaugccuggccuaguuuuuauuuuauaauuuuuaauuaaaauauggaacacuucacgaauuuacgugucauccuugcacuggggccaugcuaaucuucucuguaugguucuaauuuuaguauacaugcugucgaagugaguaccuaauaguuuuuuaguguuuauguuuuaaaggguauauuuguuggaucccauucauuggagacugacagaccucaaaaauguuuauuucugcagauaccuguuauaaauuaagggaaguguacauccuaaugugcuuuuaagaccuuuucuacuugucaagacagaggcuauuuuuauauguaccuuauuuugcauaaacagcuuugggauaugccaggcaacuccuuugcccucuuuuuuuuuuuuuuugagacggagucucggucugucguccaggcuggaguguaauggcgcagucucggcucacugcaaccuucgccucccgggguccagugauucuccugccucagccuuccuaguagcugggauuacaggcacgugcuaccaugcccagcuaauuuuuguauuuuuaguagagacggaguuucaccaugucggugaggcuggucucgaacuccugaccucaugaucugccugccuuguccucccaaagugcugggauuacaggugugagccacugcagcccaccacccucuuucuagagugcuuaauuuaauaaagcuuugugguuagcuugcuuagguuucucuuuuuauuuuauuaugauaaauucacuacagaucaaauacauacucuagaaaaguuaacacagaaaagauaauguacaaaaagauauaaaaugagaacucaagcauaacuucuguuccacucuacaguuaaucauauacccuucagaaacuuucccauggcauuuauaaacauauauuuuggccuuaacuucaaauaaaagcagugaggaauuauaccuggcuuuuuuauuuuuaucacaauaucuugaaaaccuuucuauuuuuauacguacagacacacauucuccuuuuucuuucuuucuuuauuaauguuguauauuucuuuuuaagagacagggucucacuauguugcccaggcuugcuuucaacucuugggcuuaagcaaucuuccugcuucagccuccugaauaccugggauuacaggcacaugccaccaugcccagcauucuuuuucauccugauuacuguuuuuaaguugguuuuuauuucacaagcaacaugugcaucuguuuuucuuguaaaaaauaaaaacauuauugauaaagcuaaagucuuccuguaucagcuugcauguguaugcgacacauacacuuucacuucauuuuuauguaguuaaaaaugguauguaucagaauuucuuauuaaaaaugguauauaucacuugguauauaccgaauuuccuauacauuugcauacuuagguacaucuccauggaaaauguaucuuauggucgauuuacauaagugacauauuguauguauuuuuauucaauaaaccuugaagauucauuaauuuuagaucauauaaauccaucacauuaauuuaaacuucugccuauucuaccuaguauucagcagacugaacaaaucacaguuuaguuuuuguuuguuuguuguuguuguuguuguuuuuugagacagagucucacucugucaccuaggcuggagugcaguggcgcgaucuuggcucacugcaaccucugccucucagguucaagcgauucuccugccucaaccucccgaguagcugggacuacaggcgugugccaccaugcccggcuaauuuuuguauuuuuaguagagacaggauuucaccauguugccaaggcuggucucgaacuccugaccucaagugaucugccugcaccagccuccgaaaguguugggauuacaggcaugagccauugugccuggccuaguuuuucuacugauacccauugaagguauuucuaaauuuuuuuugcugugacacaccagucuacuugaaauuuuucugcaugugugaauuuggcacuuaaaugaguauaucuguaggacacauucuuugauaugggauugcuaaagucaaaauaaguaucuagaauuuugauagauacugccaaauuaucguccaaaaauguuuuuuguguuucuuuuugagacagagucuugcucugucgcccaggcuggagugcaguggcgcaaucuuagcucacugcaaccucugccucccggguucaagcaauucuccugccucaaccuccugaguagcugggauugcaggcgccugccaccauguucggcuaauuuuuguguuuuugguagagacaggguuucaccauguuauuggccaggcugaucucaaacugaccucaggcgauccacccaccuuggccucccaaagugcugggauuacaggcgugagcuaccgcaccugacccaaaaauguuuuuugaaaauuaguauccccaccuucauuucaaaagccaucuguuauuccuuaaccucacuaaguacuguguauuaucuagauuucuuuacuuuuugccaaucugauaaguaacuaggauaaaauguaaauaucaguauguagguauauaaaaauaauuuuguuaccuuuuucucuucuaggucuuuccauucauacuuuccauggaaacuucuuuguuaggucaaccgacuuacugucuuugccuaacgucaacccagacgcuggguaugcaguacagaugucaguggaagagagucuuacugacacucaguugguuucuuuucagucagcacucuuguauacauccagcaaagguaaauuguuuguuuuuuuuuggauuucaaauguucaaauauugucuggauuucaaaugucaaaaugggcuauaaaauacauguagcauaucuuaugugugcuaacuuaaaauugcuguuuuuauuuauuuauuuauuuauuuauuuauuuauguagagacagagucucacucugucaccaggcuggagugcaguggcgcagucucugcucacugcaaccucugccuccuggguucaagugauucuccugccucagccacccgaguaauugggaguacaggugugcgccaccacauccagcuaauuuuuguaauuuuaguagagauggaguuuugccaugcuggccaggauggugugaaucucuugaccucgugaucugcccgccucugccucccaacgugcugggauuacaggcaugagccacugcgcccagcccuuaaaauuuucauuaccaaaagcaguaaaccaacuaaaaaguucaaaaaagagauuuuuaaaaauuuagcauauugucauuugaaugcgaucccuguucauuuaguaauaaccugaaugaaaagaauuuuauaguuaaaacaauuaaaagaaguagggucaggugugguggucuguaaaccuagcacuuuggaaggcugacuagggaggaucacuugaggccaggaguucaagaccagccuggacaacauagugagacacugucucuaaaaaaauauuuuuuuaauuagccagguauaguggcacacacugguaguccuaccuacuugggaggcugaguagggaggauuguuugagcccaggaguuugaggcugcagugaguuaugauugugccacugcaguccugccugggcaacagaaugagaccuuguuucuaaaaaaaaaaaaaaaggaugaaauuuuuaauauuuauguacuuauuuauuuuuaauagagauagggucuuacuauguuguucagcccugucuugaacuccuggccucagguaauccucccaccuuagccucccaaagugcugggugcugggauuacaggugugagccacugugucuggccaguauaaaacguuugauacugucucugcuuacuauguaacuauacuaccugguucuaaaucgaaaagaaguuauuuauauuuauauuuauauauauauauauauauauuuuuuuuuuuuuaauuaauuuauuuuuuuuuaagagauggagucucacuguauugcccaggcugcacuuaaacuccugagcucaagggauccuccugucucugccucuggaguaggugggacuacagggaugcaccacugcacccagcuaagaagugauuuuuccaagugacuuuaacauaaucuuuuguuuuauauaguugccccucacuguuguuuguguauuuuccccaaaggcgaaagaagaauucguguucauacuuuguguuugccaguaguuucgacucugaaugaugucuuucuuggagcugauguucaagcaauuucaggguuauuggccaauauggguaagaguuguuaucuguuauaaauaucuuacaaguaauaacauuaggcacauccaaacaguuuuguuuuccuuuaaauaguuagcuuuauaguuugaauguuuuagauccccugggugccugcuaaguaacuauuugaaaagaucugcugcagauaaucuuaucuuuuuuguuuguuuauuuaaacaaauuuauugagauauaauuacauaccauaccacuucacccaguuuaauugauaauucauuuguuuuuaguguuuuuacagaguuguacagcuaucaccacaaucuaauuuuauaacauuucuauugucucaagaggaaccucaugcucauuagcaguuacugcccacuucuuccucccucccuuacuggccuuaaguaaccacuaaacuacuuucugucucuauauauuuauauauuugucuacacugaacuuagcuauaucuuuuuuuuuuuuuuuuugagauggagucucgcucuuauugcccaggcuggaguguaauggcgcaaucuuggcuuaccacaaccucuaucuccuggguucaagcgauucuccugccucagcgucccgaguagcugggauuacaggcaugcgccaccaugcccagcuaauuuuuguauuuuuaguagagacaggguuucuucauguggucgggcuggucuugaacucccgaccucauguaauccacccgcuuuggccucccaaaguguugggauuacaggcgugagccaccgugccuggccaacuauaucuuauguaaugguuaauauuagugcuguuuaauacucuuuuuaugagaagcaguguaccauaaagaucauuagacuuagagucauggaauuugggauugaaaaccaguuuaccaccauacauuuguuugcagccaaaucaugugagccaauaggaaacuuacugauaucuucacguauuuauuuccaucucagauacaauuguccucuugauuuuuuugguuccuuuucaaauacauacagcuuaauaacaucauuuugauucuuguggucuuucuacuugagggaagacuucagucgguccauuuucuuucuuuuguuuuugaaaacagugucuugcucugucacccaggguggagugcaauggugugguucuagcucacugcagccuuuaccuccugggcucaagggauccucccaccucagccuccugaauagcugggauuacaggcccacaccaccacacccagcuaacuaacauucauucauucacucauucauuuauuuaguuauuuagagauggagucucauucacccucccaggauggagugcaguggcacagucucagcucacugcaaccucugaccccaaaguucaagugauucuccugccucagccucccaaguagcugggacuacaggcgcacgacaccacacccagcuaauuuuuguauuuuuaguagagacgggguuucaccauguuggccaggauggucucaaucucuugaccucgugauccacccaccucggccucccaaagugcugggauuacaggcaugagccaccacgccuggcccucaaccagcuaacuuuaaaaaaaauuuuuuuagagacagagucucaccauguugcccaggcugaucuugaauccugggcucaagcaauccuccugcuuuggccuaccaaacuguugagauuacagcugugagucaccacacccggccucaguagguccauuugcuucaaacuuaauucugucuguaucaggaauaguuacccacuuucuugaauuuccuauugggaaaaauguuuuacguggagccugguaaaggauuuacccacacuuuagucuuuuauguuguuagauguucaagauugugaccuaugaaauuugaagaucacugccuuuauuuuauuuauuuauuuuuuuuuuuugagguggagucucacucuaucgcccaggguggagugcaguggcgugaucucggcucacugcaaccuccaccuccaggguucacgccauucgccugccucagccuccccaguagcugggacuacaggcgcccgccaucacacccggcuaauuuuuuguauuuuuaguagagacgggguuucaccauguuagccaggguggucucgaucuccugaccucgugauccacccgccucggccugccaaagugcugggauuacaggcgugagccaccgcgccuggccuauuuuuuuguuuaaguuacuuuuuuuuguaacuaugauuauuauuauuauugacagcaguaacuauuagauggguuuuguggauuuuugauaaacugucacaacuuuguaaguauugguucugcuaccauauugaauguauuuuuagugccacauggauggaguuuaguuauuugagaagucuucaauuaugcuuuuuuuuuaaguauugaaagaauguuuuuaugcagaaaugcguauaaacagagugucauggcaaaugaugaaaaucugucuaaauaagaggccaacuuggugaaacccuauuucuacuaaaaauacaaaaaaacaaaacaaaacaaaacaaaaaaauuagucagguauaguggcacaugucuguagucccagcuacucaggaggcugaggcaggauaauugcuugaaccugggaggcggaggaugcagugagccaagaccacaccaccgcacuccagccugggcgacagagcgaaacucugucucuaaauaaauuaauaaauaacucuaagagcucuuucuguaaauguaaaauaaaaacucugggcugggcauggugguuugugccuauaaucccaacacuuugggaggcugaggcaggaggacugcuugaggccaggaguuugagaucagccugggcaacauagggagacuugguacaaaaaaauuguuuuaauuaauuaaaauuaaaauuucaaaagaacucuguuucgaaacauugugcauuucaggaaacacaggaaagcauuguguguuuaauugcaauguuuuucuuucucaaugguauauaaaguguuggauuacaaucaguagcauaacugaggcucaggaagguuaaguuacuugccaaaucauuauacagcuaggaaauagcagagcagcauuucaacagagguuggcucaguucuccagaccaugcuuuuagcugcuguguuuugucucauuuguguauguaguaaauuggagagauacuugguauaguuuuuaaaaauuaucucuucuauccuuaacaguggacuagcuaaacuucuaucauauuucuuuuuuguccuuacccucaccuugcuuagcuguugacagaucuaugacugccagucugagugacgcucgggaugcucuagugaaugcagucauugacucccuuucagcuuaccguucuucagucuuaaguaaccagcagccuggacucaugguuccuuuuucuuugcggcuuuucccacuuuuuguguuggcucuccuuaaacagguaagaaaaacagauauagaaacuaacacaaugauggccaggcacuguggccuacaccugcaaucccagcacuuuggguggcugacguggguggauugcuugaguccaggcauuugagaccagccugggcaauauggugaaaccuggucucugcaaaaaauacaaaaaaacuagccaggugugguggugcacaccuguagucagucccagcuacuugggaugcugaggugggaggaugguugaguccaggaggcggagguuguagugagcccauaucgugccacuguacuccagcuugggugacagagccagacucugucucaaaauaaacaaaaagaaagaaacgaacacgauggaaacaucaaaaggcaaaauuuuuauccuaugaaucccuaaacauuguauauguaacuuuaugcugguuaaauuuuugacgacagguaccuuaccucuuauuugaacuuugaaaaguuuaauaaccaaagaaacuuagagaaaacugauucagagcaaguuccuuguucauaagaugcuucucuaagcaaaguauucagugacauuauaaaaaauucaacugauaaucaguuuuccagaacaagaauuguauauuauauugcugaugcaagaaggcacacaugcacuguguguucucacuuauaugugaaagcuaaaaaaucaaacacacggaagcagaaagcagaauggugguuacuagaggcugggugguggggcaggaauggggagauauugaacaaaagguacaguguuuuaguuaggaggaauaagugauaacuauuugagguuauggauauguuaccuagcuucauuaaaucauuccacauuguauacuauaucauagcaucccuuuauaccucauaaauauauauaauuagaauuuuucaccaacaaaaaauuuaacuuuuuuuuaaaaagaagagaccauacauguuauuuuauuuuauuuuauuuuauuggcucuuuccugucccuacagaauuucagcaacauuacacuucucuuuucuuuuuugagacagagucuugcucugucacccaggcuggagugcaguagcacgaucuuggcucacugcaaccuccgccuaccggguucaagcgauucuccugccucagccuccugaguagcugggauuacaagugugugccacuauauccgacuaauuuuguauuuuuaguagagacaagguuucaccauguuggucaggcuugucucaaacuccugaucucgggugauucgcccgccuuggccucccaaauugcuaggauuacaggcaugagcuaccacauuacacuucuuaaucuucuucuuuuuuuuuuuuugucugagacagggucucccucuguugcccaggcuggagcgcaguggcacgaucucggcucaccacaaccuccgccuccuggguucaaccuccuccuccugcguucaggcaauucucucgccucagccuccugaguagcugcgauuauaggcaugcaccaccacaccccagcuaauuuuuguauuuuuaguagagacaggguuucaccauauugguuaggcugguuucuaacgcccaaccucaggugauccucccaccucauccuccuaaagugcagggauuacagccgugagccaccaugccugguccuuaaucuucuuuagauacacuuucuuauaccuguauacuugcauaccuguuuccaugaucuggauuggacuuccauauccuugucuuugaguuuaaauguuuguaggguuuuucuuuguuucguuuuguuuguaggguuuuucauuugcuacuuauuauuuauaugucuccccugccugcucuuugccuuccucccagaaaagaaggaaaacucuggucugguggaguaggcuuauuuauccaguguccaaaauugaauguccaaacuuauugccucaggauaaacuucccuuauaaaauuuuauuuaaaagcucguguuggccggccaugguggcucaugccuguaaucccaacacuuugggaggccaaggcgggcggaucacuuaaguucaggaguuugagaccagccuggccaaaguggugaaacccugucucuacaaaaaauacaaaaauuagcagggcaugguggcacauaccuguagucacagcuacuugggaggcugaggcaggagaaucgccugaacccaggaggcagagguugcagugagcugagauugcaccacugcccuccagccugggugacaaagcgagacuccuucucuuaaaagaaaaauuaaauaaaaaauaaauaaauaaaagcucauguuggccagaugccaugguucacaccuauaacccaauacuuugagaggccaagguagaaggauugcuuaaagcuagggguuugagaccagccugggcaagaaagcaagaaucugucucuacuaaaaaauuuaauuuuuuuaauuaaaaaagaaacaacucauguuaauaaagcaccugaagcagcacugcagauuccagaacuguucaaggacugcuggcugggcacaguggcucaugccuguaaucccagcaccuugggaggcaaaggcgggaggauugauugcuugagucugggaguuugagaccagccuggacaacauagugagauucuaccccuacaaaaaaaaguuuuuuaauaagaaaaauaaaggacugcucugcaucuuuuuuuuuuuuuuuuuuuuuuaacagucucgcuaugucgcccaggcuggaguggcaguggcgaucucggcucacuacgaccucagccuccugaguagcugcgauuacagguguucaccaccacgccuggcuaauuuuuguauuuuuaguagagacgggguuucaccauguuggccaggcugguuuugaacucuuuuuuuuugagauggagucucgcugugucgcccaggcuggagugcaguggcgcaaucuuggcucacugcaagcuccaccucccagguucacgccauucuccugccucagccucccaaguagcugggacuacaggcgcccacuaccacgcccggcuaauuuuuuguauuuuuaguagagacgggguuucacgguguuagccaggauggucucgaucuccugaccucgugauccacccgccucggccucccaaagugcugggauuacaggcgugagccaccgcgccuggccgguuuugaacuccugaccucaaugauccacuggccucggccuccuaaauugcugggauuauaggcgugagcuaccacaccaggccuucaucuuguauuuuuccugaacucugggaucuacuugucuguuauguguaguuuuuuccaggugagaagagcaacucauuacuuucuaguaggaguggcuuuugaaucuacaguucucauuucuuuuuuuuuuugugagauggagucucacacugucauccgggcuggaguguagugacgugaucuuggcucacugcaaccuccaccucccggguucaagugauucuccugucucagccuccagaguagcugggauuacaggcacccgccaccaugcccagcuaauuuuuuguauuuuuaguagagacaggguuucacuauguuggccauucuggucucgaacuccugaccuugugauccguccuccauggccucccaaaguacugggauuacagacaugagccaccgugcccggucucuaguucucacuucuuuaacucaaauuauuuauuucuauuucugaauauaaguacacagauuacauaaauauuuaauuuuuuuuuugagacuagucuggcucuuguugcccaggcuggagugcaguggcacaaucuuggcucacugcaaccuccgccuccgggguucaagugauucuucugccucagccucccaaguagcugggauuacaggugugugccaccaugccuggcuaauuuuuuguauuuuuaguagagacgggguuucaccguguuaaccaggauggccucaauuuccugaccuugugauccgcccaccucagccucccaaauuguugggauuacagccaugagccaccgugccuggaaauauuuaaauuuuuuuuuuuuuuuuuuuuuuugagacagagucucgcucugucgccuaggcuggagugcaguggcgcagucucggcucacugcaagcuccgccucccggguucacgccauucuccugccucagccucccgaguagcugggacuacaggcgcccaccacaaugcccggcuaauuuuuuguauuuuuaguagagacgggguuucaccguguuagccaggauggucucgaucuccugaccuugugauccacccgccucggccucccaaagugcugggauuauaggcgugagccaccgcgcccggccgaaauauuuaaauuuugacguuuaaaaaucugagcucuucuuucuucuucaggccuuucuugaaauacuuuuuucuaaagccuacauucucugaucuucccgauuuaauaugcaguaccccaaucccaccccaucccucaccauccugacaccccuaaucacccuuaccuccuguauuuuuccuauagcauuuaucacugacauaccacauauuuugcuuauuuuuauucuucccuuaauaggauguaagcuccaugaggacaaggauuuuuaucuuuuucauucauuuuuuuguccuagcaguuagaacaguuccuaguauauaauagacaaucaggaaauauuuuuugaaugaauagauggaacuuuccuucuuccauuaaaaucuuaagagcuuuuauuaucuuccuuuaauauagucaguguacuuguuuuaauacguaauuucauuauucuuuucucucugccuguuuuacuccuuuccaucaauuggaauacuuaaaaccuuacccauaacuggcugggugcgguggcucacgccuguaaucccagcacuuugggaggccgaggcgggcggaucaugaggucaggaguucaagaccagccugaccaacaugcugaaaccugcucucuacuaaaaauacaaaaaaaaaaaaaaaaaauuagccggguguggugucgcgcaccuguaaucccaccuacugaggaggcugaggcaggagaaucgcuugaaccugggaggcagagguugcagugagcagagaucaaaccacuacacuccagccuuggcgacagagggaggcuccgucacaaaaaaaaaaccuuacccauaacuuuuuucuucuccauuuuuaucuguguaaagaaaauaauaacaguuaaauaucauaguuacuuauuaacucauuuuacuaagaagcuuuccucauuuguaguaguauuauuuuuucuuguuuauuaguauucuuuguuacauuguuuguauggugggagaaucaaugacagcugccauuagucaucacccagcacucaugggccacuuagugcaguauucuaagugcacuaccccccagccacauaccgguaccaguggguggccuguuaggaacugagccacacagcaggaggugaccagugggcgagggagcauuacugccugagcucugccuccugucagauaaguggcagcaucagauucucauaggagcgccaaccauauugugaacugcgcaugcgagagaucuagguugcauacucuuuaugagaaucuaaugucugaugauaugagguggaacaguuucaucccaaaaucauccuccaccauguccccaccagucuguggaaaaauuaucuucugcgaaaccagucccugguacgaagaaggaccacugacguaauggauaucuuuuugguccuucauguaugccuuuacuuugucaucugcaauauaacuucauccuuccuaugguguugcuuggauuguuacaucauuaucacuaucauuauaugguagauagaguguuuagaucuauuuuaucaacuaggaaacagacaccauggagaucagauaacuuugccauggucaguuaguuaauuucaaaagacuuuuagguggggcuauagcuacaguuuaauagaugugugugacuucuuaaaaaagauacuuuaaaaaaauuaacaguaaauuugugaauucucucugaaaauauucuuuuaacaacuggcauuuuaaaaguucuggauguauuuuuaaaauauauucuuuuguggggaauggggguuuucuguuacagaaaucauuccagacugggacaaaugcacgucuagaugaacgcauuuuugcuaugugucaagugaaaaaccagcccuugguuuaccuuaugcucacaacucaucccaguuuguauagaguugacaaucucucagaugagguaagauggauugcuuuuuugugguuuuacuugaagauuaguaagccuaaucauaguccaguacagaaaugaggaaggguuuguuuauuauuuaaggcuuuagcuuuuauuuuauuuauuuauuuuuuuggcuaagucugaguaaauaaauuuuaguauagggaagcucuuaaaaauagugccuuuaaguuuccuaaaauaccaucuguagagcagaucuaagaaauggaaagauugucaaauugaccagagcaacuuacuaauuuauucaaacaaaucgaucuuuuaacaacugacauuuuaaaaguucugggugcauuuuugcucgcuucagcagcaaauauacuaaaauuggaaugauacagagaagauuagcaugccccuuguacaaggaugacacacaaauucgugaagcauuuuuaggaacagaaaaccgaacacugcauguucucacucauaagugggaguugaacaaugagaacacaugggcacagggagggaaauaucauacacuggguccugucaggggguggggacaaggagacagagaucauuagcacaaauaccuaaugcauguggggcuuaaaacccagaugacagguugaugggugcagcaaaacaccauggcacauguaugccuauauaucaaaccugcacguucugcacaugugucccagaacuuaaaguauuaaaaaaaaaaaaaaaaaaguucuggguguauuuuuaaaauauauuuuuucuggggaauggggguuuuuuguuacagaaaucauuccagaauggaacaagugcacgucuagaucugagagugaaauuacaucugaacacccaguucaauguaacaguguccuugaauuaaagaaaaaauacuucucuaaguuguaacauuguuuuccuuugguagaaauuuaccagaauuaaagucacaagaaugaaaaugucaaaucauaaucuuucuaaaauugugaucaaguuaagauauauauuuuggaagugauguuuugguuaaaaacuuuucaggccagguaugguggcucacaccuguaaucccagcacuuugggaggcugaggcggguggaucaggagguccagaguucaagacuagccuggccaagauggugauacccugccucuaauaaaaauacgaaaaacaaaaaaauuggccagcucugguggcgggugccuguaaucccagcuacucgggaggcugaggcagagaauugcuugaacccgggaggcggagguugcagugagccaagauuaugccacuacacuccagccugggugacaaagugagacuuugucuaaaaaaaaaaaaaaaaaaaccuuugaaaauuuaaagaauuuaauaugugggccaggcgcaguggcucaugccuguaauccagcacugugggaggccaaggcaaguggaucaccugaggucaggaguucgagaccagccuggccaacauggcgaaaccccaucucuacuaaaaauacaaaaauuaacuggucguggugaugcacgccuguaauccuggguacucgggaggcugaggcaggagaaucacuugaauccaggaggcaaaggucgcagugagcugagaucaugccauugcacuccagccugagugacaauagagcaagauuccaucucaaaaaaaaaaaaaaaaagaauuuaagauacuuuacauauguaaaagaaaauugccuaugaaauuugagguaacuuuuuuacuuuuuuuuuuuuuuugagacaggguuuugcacuuguugcccaggcuggagugcaauggacugaucucggcucaccgcagccuccgccucccagguucaaagaauucuccugccucagccucccgaguagcugggauuacaggcgugcaccaccacaucuugcuaauuuuguauuuuuaguaaagacgguguuucaccauguucuuaaggcugguuucaaauuccuaaccucaagugauccacccgccucagccucccaaagugcuggaauuacaggcgugagccacugugguggccuauugcauucuuuuuugaagcaaagguuaagaucagaaguuaauggccaggcacgguaaaucacaccuguaaucccagcacuuugggaggccgaggcagguggaucaccugaaguuugaggaguuugagaccagccuggccaacauggugaaaccccuucucuacuaaaaauacaaaaaauuagccgggcaugguggcgcaugccuguaaucccagcuacucgggaggcugaggcaggagaaucacuugaaucugggaggcggagguugcggugagccaagauggugccauugcacuccagccuuggcaacaagagugaaacucugucucaaaaagaaaaagaaaaagaaaaaggaaacaagaucagaaguuaauuuggcuuuauugggagucacaguagcuuaguuagauaagugauaacuauuucgucaucuucuuuauauguaaauaugaauaauuggccgggugcgguagcucacgccuguaacagcacuuugggaggccgaggcggguggaucaacugagguugggaguucgugaccagccugaccaacauggagaaacuccgucucuacuaaaaauacaaaauuagcuggguguuguggugcaugccuguaaucccagcuacucgggaggcugaggcaggagaaucgcuugaacccaggagguagagguuguggugagcugagauugugccauuacauuucagcuugggcaacaagagcgaaacuccgucucaaauaaauaaauaaauaaauaagaauaauugugauuuaccuaagcaaggcccagacuuguagagguaacauucauuuaauuuuuuguuguuguuuaacugugacuccauauuuccuauauuuaaaaccuuuacucuuuuacuuaauuccucagggagcacucaacaucagugauagaaccauaccucagccccccauucuucagcuuucaguggagaagcugagcagagauggagcuuuccucauggaugcaggcucuguaaguaauuugacuuauccugacccucacugcaaacuacuauacuguuuuaauuuagcauuugguuucauucccuuuaauaucucucuuccugaacagauuucauauuuuaaccuauauacagucguacacugauuaaugauguguaagucauggcuuauaugaugguggucccauaagauuuauaauggagcugaagaauucguaucauuuaguauuuacuaugcuauuuuuuuuuauuauugcuuuggaauguacuccuacuuaauuuuuuaaaaaguuaaccuuaggcggguccuugaggagguauucuaaaagaagaucuuauuaucauaggagaugacaucucuaugcauguuacugccccuggagaccuucuaaugagacaagauguggagguggaagacagugagauugaugaucuugacgcuguauaggccugggcuaauguguguuuguguuucaguauuuaacaaaacaauuuaaaaaguaaaagauaaaaaauuuuaaaaauagggccgggcacgguggcucaugccuauaaucccagcacuuugggaggccgaggcagguagaucauuugaggucaggaguucaagacccgccugaccaacauggugaaaaucucuacuaaaaauacaaagaaauuaaccgagcgugguggggcaugccuguaauccuaacuacuugggaagccgaggcaggagaaucgcuugaacccaggaggcagagguugcagugagccaagauugcaccacugcacucuagccugggcaacagagcaagacugucucaaaaaaaaaaaaaaaauuuaaaauagaaaaaugcuuauagaauaaugauauaaagaauauuuuuguacaacuguacaauguguguuuuaagcuaaguguuauuacaaaagagucaaaaaauuaaaauaauuuguccgggcaugguggcuuaugccuguaauugcagcgcuuuaggaugccaaggcaggcggauugcuugaggucaggaauucgagaccagccggggcaacauggugaaacccugucucuacucaaaaugcaaauguuagccagacauaguggcuccaggcuguagucccagcaacucagaaggcugaggugugagaaucaucugagcuggggaggcugaggcuucaguaagcugagaucacaccacugcacuccagccugggcaacaaacugauaccuagucucaaaaaaaaaaaaaaaaaaagaagaaguuggcugggcccaguagcucacaucuguaaucccaaccuuuugggaggccgaggauggcagauuccuuuagcccaggaauucgagaacagccugggcaauauagcaaaacccugucucuacucaaaauaccaaauccaggcguggucacgugcaccuguaauaccagcuacuugggaggcugaugugggaagaucaccugaacccaggagguugaggcugcagugagcugagaucauaccacugcacuccagccugggcagcagaacaaggcccugucucaaaaacaaaauuaagagacugggcgcaguagcccacaccuguaaucccagcacuuagagaugccaaggcgggcggaucaccuuaggucgggaguucaagaccagccugaccaacguggagaaaccacgucucuacuaaaaauacaaaauuagccaggcgugguggcacaugccuguaaucccagcuacuugggaggcugaggcaggagaaucacuugaaccugggagguggagguuguggugagccaagaucgugccauugcacuccagccugggcaacaagagcaaaacuacgucucaaaaaaaaaaauuaaaagaaguuuauaaaguuauaguaaacuacgauuaauuauugaagaaagaaauuuuuuuauauaucucuaguguagccuaaauguacaguguuuguaaaguuuauagcaguguccaguaauguccuaggccuuuacauucacucaucacucacugacucacccagagcaacuuucagucuugugcacuccauucgugguuaagugcccuauacagguguacuguuuaucccuucugccauauuuuuacuauaccuuuccuauguuuagauacacaaauacuuagcauuguuuuacaguugccuacaguauucaguacaguaacaugcuauagacguuuguagccuagguacaguaggcuauaccauuaaggcuuguguaaauccacucuaugauguucauacagagaaaucacuuaacaacacguuucucagcauguauccacauuguucaguggauucauggcaguacauuugucugccaccuuuccccuccauaucuuccuuguuucaugccaagcauaaaaugucucaucagguaaauacuaauuauuauuaauucaguuaaaggcuguacaaucucacuaaauauacuuaccuuuuugaccuuuuaaaauauacucaagcugggugugguggcucacaccuguaaucccagcacuuugggaggcugaggcaggcagaucucuugaggucaggaguucaagacuagccuggccaauauggugaaaccccaucucuacuaaaaauacaaaaauuagcugggcaugguggcacacgccuguagucccagcuacucuggaggcugaggugggaaaucgcuugaacccaggagucggagguugcagugagccgagauuacaccacugcacuccagccugggugacagagugagacccuaucucacaaauauauauauaaaauaaaaauaaaauguacucacucaacagacucaccuuuauguaugcugcaucucaaaauaauuuuauuccugucccuagguacugaugcuuuggguuggaaaaaauuguacacagaauuuucucagccaaguucuaggaguucaaaacuaugcaucaauuccacagccuaugguaagacucuuuuauuauagugauuauaaagggcauuucaaaguuggcaaaaacaugaauauccccuauuuugauaucagaaaauaauaacaaaaucauaccaaaaauuuuuauugauggguuuucauguugauggauucuaugacuccacucauagaaucauuagggaauuuauauauuuaaaaggcagauaugccagccacagcggcucacacuguaaucccagcacuuugggaggccagggcgggcugaucacgaggucaagagaucgagaccauccuggccaacauggugaacccccuucucuacuaaaaauacaaaaauuaguugggcgugguggcgcacaccuguagucccagcuacucaggagauugaggcaggagaaucgcuugaacccaggagguggacauugcagugagccaagauuguaccacugcacuccagccuggcaacagagugagacuccaucucaaaaaaaaaaaaaaaaaaaagauagauaugccaggcgugguggcucacacugguagucccagcaccuugggaggcugaggugggaggaucacuugagcccuggaguuugagaccacccuaagcaacauagugagaccccauaacuacagaacauuuuuaaaauagcugggcaugguggcacacaacuguggucuuagcuacuuacgaggcugaaaugggaggagugcuaggaccugggagguugaggcugaagugagcagugauuaugcugcugcacucccgccugggcaacagagcaagaaccugucucaaaaaauaaauaaauaaaagacugcugugucaggauuauagcuaggauaagcacuggcuuucaggccuuaaacagaacuacugggcuggaugacuaagcguuuuagguaaugaguaagaaauuguuauauuuuuaauaauaacugaacgaaucaauuaauucuugacgucaugcuaaaaugaagggaagaacuaagagguuuuuuuagaugagggcuuagaaacuaugcccaagggguaccugcuacuuguuuuuguaaauaagguuuuauuggaacauccaugccuguucacuuauguauuguuuauggcuacuuugguguaacaauggcaagguugcccgggcgugguggcucacaccuguaaucucagcgcuuugggaggccgaggcuggcgaaucaccugaggucgggaguucaagaccagccugcccaacauggagaaacccccgucucaaggcgaggugggcgaaugaccugaggucaggaguucgagaccagccuggccaacauggagaaacccccaucucuacuaaaaauacaaaauuagccgggugugguggcgcacaccuguaaucccaacuacucucccagcuacucuggaggcugaggcaggagaaucucuggcaggcgaaucgcuugaaucugggaggcagagguugcagugagccaauaucacgccauugcacuccagccugggcaacaagagcgaaacucugucucaaaaaauaaaaaacaauggcaaaguuaaguaguugcagcagagaccaaaugaucugcaagccuaaaguacuuacuauaugggccuuuaagaaguuugccuacuccuguucuagaauauucguagaaaauuguguucccaagucaaguugcacuggcaucacugcaggaauuuuuuaggaaagcaaaaucucaggaccacaacccugccccagaccuccuaaaucauuaucuguaguucaagaagaugaucaggugauucauauacauguuaaaauucaagaccaggcaugguggcucacaccuguuaucccagaacuuugggaggccgaggugggcagauugcuuaagcccaggaguucaagaccagccugagcaacguggugagauacucgucucuacuaaaaauacaaaaauuaccuggcagguggcacacgccucuuauuccagcuacuugguggggcugaggugagagaaucacuugagccucaggaggcaguggagguuacagugagccaugaucacaccagugcacuucagccugggcaacagagcaagaccuugucucaaaaaauaaguuaaauuugagaaguagaccgggcacuguggcucacuccuguaaucccagcacuucgggaggccgaggcagguguaucgccugagcccaggaguucgaaaucagccugggcaacauggcaaaacccaucucuacaagaaauauaaaaauuagccaggcaugguggcacgcaucuguagucccaacuauucagaaggcuauggugggaggaucaccggagccuggagguugagacugcagugagccaugauuaugccacugcacuccagccugucaacagaggccuugucucaaaaaagaaaaaaaauguaauuaaaaaaauaaaaauuugaaaaguaccauagaccauacauuagauauguaauuaaaguaauuggauauuguugguuuugguuaacagacagaccuuccagaacuugauacaccagaaucugccagaauaauagcuuucaucucuuggcuuagagagcagagaccauuuuucccaauacuuuauguaauaagguaaguugaauuuuccauuugcuaguaguaaaacaauuuguuuggccuugccaggaccugacaagaguauagcaaaaaaaaagaagaaagaaaaagaguucuucucaauaaauagcaguaaaucauaccuuauauccaaugauuggaaauacagaacuuuuuucauuuuuaauugacuaauaauaaguguauauauuuaugggguacacuaauuuauugauacauguauacauuguggaaugaucaaauucggcuaauuaacauauucaucuucucagccaauuauuguuuccuuguggugagaacauuuaaaauccauuauuuugccuauuuuaaaauauacaauacaucauuauuaaccauagucaucauacuguguaauagaucaccagaauccauucauccuaacugaaauuuuguacccuuugacuaacauuucuucuuuccuucuccauagccacuuccugccuccuagccucuaauaaccauaauucuacuuucuacuuauaugaguucaacuuuuuuagguuccacacauaaguaagaucgugugguguuugucucucugugccugguuuauuucacucagcauaaugucacaaaugacagaauuuccuguuuuuuaaaggcugaagucgccgggcgcgguggcucaugccuguaaucccagcacuuugagaggucgaggcgggcagaucaccugagguugggaguucgagaccagccugaccaacauggagaaaccccgucucuacuaaaaauacaaaauuagccuggcaugguggcacaugccuguaaucccagcuacucgggaggcugaggcaggagaauagcuugaacccaggagguggagguuguggugagccaggaucgugccauugcacuccagccugggcaacaagaguaaaacuccaucucaaaaaaaaaaaaaaggcucgguagaauuccauuguauauauauaccacauuugaaaaauccauucaguuauuuccauaucguggcuauugugauuaaugcugcagugaucauggaagugcagacaucucuuugauauacugauuucaauuccuuuggauauauauucagaaauggaauuucuggaucaacuauuucucuuaauuccaccauaagcuuuucccuuaaacaacuugaaauuuacauaaucaaccaaguauucucagagaaagccucuagaaguaacuguuuauauaguaaauguuauuaggguuaugaggaaaucaaaagccuucugacaagucuauuuuacugcuacauuuuaucuaaauuuuuuugccuuuuauuccuaagggaugagaguccaaugaaagcaaacuuccuucaaaacaugauagaagacagaacagaaucugcauuaucauauuaugaauuccuguugcauauacagcaacaagugaauaaaugaaugaaugaagaaauuugacuuauuuuuaaggaaugucacgauagugcagaauaccuggaaauguguaauaccuucuuuuucuauuauguuuguggacuaaugugaugauugagauguucucacugugauuucaacaaccuauagcaaauaaaagaccacagcagagaaucaaacaugcaacucugaaauacuguauuuuucaaaucagaauauagcuacguaugauuggauacuuuuuucuugccaauuauguuugaguuguuauggauuaaaauaagaauauugcagaggcaaaguacauuuuguaaaauaaagauuucuguguucuacauguauauuucucauuuuuaauuuuucugaaucuuuggcugcuacauuuaaaaccucacaaaccuaaguguugcagggaaguuacaaauugauugguagugauguuuuuaaaauaaaaacaauggaaaguaaauauaauguaggaaaacuagaauucauuccccacacgugucuuuuuuuuuucuuuguuaagggaaaggaucauguugacuaaaacuaaacuaauucuaguauagcuugagaaaaauaugaagaaacacauucaagcuuuaaaaucugucaguauucuuuaugcuugaagaacaaagucacuuugauuugaagugagaacuaucauuaggugguuuucugauuuccugaugaagaguuggacauacugucuuaaucuauagugaaaagaauuugagcugucuucauaaacacugggacuagcaaugauaauagggagauaagaaacuuuaauuaucuugauccuuuaaguggauuuuauuuggugcauuucugcucuggguauauaauaaaaguggggguuuuuggugaaaugagugaagaaaugaaagguuucuaaagugcuauccaaauacaucaguaacauuuuucuaaggaguuuaauuguuaaauuggaagucauucauaagaaauauuuaugcuugaauaugaaaaucuaugaaagcauaaaugcugcuguuugauuugguggauauuaagauuauacacauccaacauauuaaaguuaugaaagaaacuugacuucugaaaauccuuaagagacugcuuucuugauucagcuagagaaauauuauagucaaaacuauugagugaauuuuguuuacaaauagguaaauuauacauuuguauauuuaaagugcugugacauaguaucuuuaagaguuuggcucaguuuucacagauucauuuugucuuaagaauuucuuaaauauguucauguauaauacuugaucaaaauauuuuuggguuuuuuguuuuguuuuaauggguuagaaaauguuuacaaucuuggucuuauaugaucaccaauggaauaguaacuuccagguuuauaucaauaugagcugacuuuaacugaguuguuugggauagggaagaagcagucccucuacaguauacaacuacugcuugccagcuggaucaaaauaaucauguuuuaugaaaauaucucccuuaagcaguguuaagguugguuugcaguguguaaguggcacauugaacuggaaguuuucuugaaagcugcuucaucuauuaagaagcaauuuucaaauuguagcgaauuauauuauccccucuuuuaaagaaacagucguuauaugcugauguuucuuaaaauaacuaaaauguuccucuuaaugugauuuuaaauggaguuauuuguagguccuuucuuaguaguaaagaaucuucuagagggaaacauuugugcuuuuagggauaaucuuccuugugccucacuacaucccuaaguggguaugacucuuguuauuaccacaugcuuuuuuaguauauuucacaaauuuacuuuuaaauauuauuuuagauacgguguaacaugugcaauucagaauaauuuuauaacaggucaugaaaaacauaacuuuaguuaggauucacaauauuuguucuccacauaaugagagaaugaaugagccuuuggagauacugauauaaggcaauuauuuuuugcaauguugaauguguuuuuuaguuugauucuuuuuuuuucccccaauagggcacuaccugccauaucaucuuguauuacuuuuugauguaaagcgacuaauauuuacacuaugccauauuuuuuuuaauuauaguuguaaauuaugaaagauccuugaauuuucuacagaucuacaacuacuaauguaacagacaagggcaaucuugguauuuaaaucugagcauggcaguucuaccauaaaaaguacucuauuuuucuaauuucuaggauuuuuaaaauaacauuucuguaagucugacauacuaauagucacucaagcaguaccauuuauuuuaguuugcauauauuuucacuguuuuuaauuuaauguauugagucuaauagacuguuuugcaauaauuagaauaaagauuuauuucuucuaaucaaagaugcauaacagcuauuaucuaggggaccaccaaaugugauuucaaaauuuuguuaacuauuacaaauguaauccuuauauagaaauuuuaauuuuguaaaguaguguauaauauuguaauauuaaauucuuguucuuaaauucaaauauguauugaucuucaaugugcuguguuaaaucuugcuucucugaaaaguuggagacaagauuugucuuccuuuuuacaguuuguaauuuucacuguuuuauuccuguuaaaaaaaaaaaaaagucauuuguaacccaugcagaccauuguuugaucuaugcuaacuuaucaacuuggcuauucaauaaaguuaauugaaaagagcuuaua

SEQ ID NO: 192228 - RNA, 31695 nt, Homo sapiens
gccggcccggaaggggcugaugcgaacuggggccacggcagccaucgcgcuuugcaguucggucuccugguguacggccaacgccaaguaggggauugcguucccuccagucgcaggugagugacagccccuccuucugggaggaccggugggcagcagcuauggauccccuagaaggcgcacuuuuagggccaagaccuacucugagucccugccuguggcacugcgugaaggggcgccuguuuuucaccccgggguuaggcggcgcgagggaggacaggucucauccaugcuccgcggggccgucugauagcccucgaggcagaacacugcugcugucagacgcuuggucuuuucaggaaagaacgagguggcugcaggcaagccccuuccuuccccugggccucaguuuccuuaccugguaaggugaagguggcgggucucacugacagcugaagaggcugugacacggccugguguuuucagcgcucccaauuaguguagaggcaaauugagcuuccuuacuaguacugguuaacguuuuccguagcccaaagucccaguuaaguggaaaaaagauacacuguugagaaaacuguacugauuuuuguuuuaauuuuuuaaauuuuuguuguuguuuugagacagaguuucccucuugucgcccaggcuggagugaaguggcacgaucucggcuuacugcaagcuccgccucccggguucacgccauucuccugccucagccucccgaguagcugggacuacaggugcccgccaccacgcaccgcuaauuuuuuuguauuuuuuaguagagaugggguuucaccguguuagccaggauggucucuuaucuccugaccucgugauccgccugccucggccucccaaagugcugggauuauaggcgugagccaccgcauccggucuaacuuuucuauuuuuaguagagaugggauuucucuauguuggccagucuggucuccaacuccugaccucaggugaucugcucgccucggccucccaaagugcugggauuaaaggcaugagccaccucagugggccacuguacugauuuuuaagguguugaagcuuuuccaagaagauuuguuuuaaaacagcuaaaacuuugacauuguuagcugaaagaaccaaauucgucagcaauuuaagguguuugguacaguggacaaaaugaggugaagaaguccuuuuaacuugaaaaauuaaacauaguauuauuuauuuguguguucuuacaucagccucuauauuacuaagugucuuugaagacguccuauauuccguguuaaaguaucagugaagaguaggucacauugaaacaaugaaagaaggaaagaaaaggaacauuuauugacuacuaugaguaaggcacuagcugucauuuuacagaugacaaauaaaugguggugccaguauagcaaagcaacaugauuaucuacuauuauaccuuucaguagacuugugucugucaccaaaauguuuugaacuuaaaaaauguuaagauaguucauuggcauuuucugaguuuguagaaaaggaaggugucuucauuuuagaaaugucagagaugcacugucaguaauuacaaagauuagcaguuuaaauaagguauauuuuaaccuuccuuugacuugcauuauuguacuggaauagaaauucaagcaagaauuaagaaaaaagaugagucuaacagaaaugaaaaucagccugggcaacauagcaagacccagucucuacauuaaaaaaaaaaaaauuugcugggugcagggcccuggcuagcaggccaguagucccagcuacucgcugcugagaugggggguuugcuugaagccaggucaagacuacagugaccugugaucaugccacugcacuccagccugggugaaagaaaaagacauuguugcuaaaaaaaaaaaaaaaaaaaaaaaaaaaagaaaaaaaaagaaauagaaaaggaaaugaaaaucauugccacaucauuugaagcuuacaaguuggaaugcuauauuaguauuucuuuucuuuuuucuuuuuuuuuuuuuuugagacggagucucgcucuaucgcccaggcuggagugcaguggcuccaggcugacugcaaccuccaccuccaggguucaagugauucuccugccucagccucucaaguagcuaggauuacaggcaugcaccaccacauccugcugauuuuuguauuuuuaguagagaugggguuucaccauguuggccaggcuggucuugaacucccgaacucaagugaucuguccggcuuggccuccuaaagugcuuggauuacaggcgugagccacuguguccugcuauagguguauuucuacacuuacuuuuuuuuuuuuuuuuuuuuuugagauagaguuucgcucuuguugcccaggcuggagugcaauggcgugaucuccagcucacugcaaccucugccuccuggguucaagcgauucuccugccucagccucccgaguagcugggauuacaggcauacaccaccacacucagcuaaucuuguauuuuuaguagaaacaagauuuuuccuuuuuggucaggcuggucucgaacucccaaccucaggugauccgccccccucagccucccaaagugcugggauuacaggcgugagccaccucccccagccuucuacacucauuucguuaaguacucacuuggcugagcauaguauuucuacgcucgcucacuuuaaauacucaucccaacucgggguuucacuauguuggccaggcuggucucgaacuccugaccucaagugaucugccugccuuggccuccuaaagugcugagauuacagauaugagccacugugcccagcccucaccuuggccacucuuaaaaauuuucuacuauuuauauuugucaugguuuuauccuucguuuucuuuuucuuuuuuuucuuuuuuuuuuuuuugagacagaauguugcccuguugccuaggcuggagugcagugccacgaucuuggcucacugcaaccuccgucucccggguucaagcaauucucauaccucagcuuccugaguagauggaacuacaggugccuaccaccacacccagcuaauuguuuuuuuuuguuuguuuguuuguuuguuuguuuuuuugagauggagucuugcucugucgcccaggcuggagugcaguggcgcgaucuuggcucacugcaaccucugccucccagguucaagcgauucuccugccucagccuccugaguagcugggauuacaggugcacgccaccaugcccagcuaauuuuuguauuuuuaguagagaagguguuuuaccauguuagucaggcuggucuugaacuccugaccucgugaucugcccgccucggccucccaaagugcugggauuacaggggugagccaccgugccuggccuauuuuuguauuuuuucuuuuguagagacggggucuucccauguugcccagucuggucucaaacuccuggguucaagugauccccccaccucggccucccaaagugcugggauuacaggcaugagccacugcaccuggccuauuuuuguauuuuuuuuguagagauggggacuucccauguuucccagguuggucugaaacuccuggguucaagugauccccccaccuuggccucccaaagugcugggauuacagguaugagccaucaugcccaguucauccuucuuuuuuuuuuuuuuuuaaagacagggucucacuauguugcccagguuggaaugcaguggugugaucauagcucacugcuugaauucuugggcucaagcaauccuccagccucagccuccugaguagcugggacuacaguuucuugcuaccauacccagguaauuuaaaaaauuuuuuguaccgggcaugguggcucacaucuguaaucccagcacuuugggacaccgaggcgaguggaucucgaggucaggaguucaagaccagccuggcuaagauggugaaacccugucccuacuagaaauacaaaaaaauuagcugggcuugguggugggugccuguaaucccugcuacuugggaggcugaggcagagaauugcuugaacccaggagguggagguugcagugagccaagauugugccacugcacuccagccugggcgacagagugagacuuagucucaaaaaaaaaaaauuuuuuuuuuagagaugggaucuuguuauguugcucaggcuggucuuuaacuccuggucucaggugauccuccugccuucgccucccaaacugcagggauuacagacaugagccacugugcucagccuggauauuuguauucuaggacaguuacuacacccauuucaccauagcauuaccaugcuuugcaucccaaaguuauuagugcauugauucuacaaucauacucugaugucauauuugccucuuuagacuauuaggucccuuauuuucucccaauaguacuuuuuggguauuuguauuuugucaucuuauguguauuuuuuuuuuuuacaggaccccugagaacuaauguguauuuuuuauuuuuauuuuauuuuuuugaggcagggucucacugucaccaagugcaugcuaucacaucuggcuaauuuuuguauuuuuuauagaaaugggguuuuuccacguugccaaggcuggucacaaacuaaauauguauuuuuuuucuuuuuuuuuugagacggagucuugcucugucaccccggcuggagugcagugcaguggcacgaucucggcucacugcaaccucugccucccagguuugagcgauucuccugccucagccuccugaguagcugggauuauaggcaugcaccaccaugcccggcuaauuuuguauuuuuaguagagaugggguuucuccauguuggucaggcuggucucgaacucccgaacucaggugaucugcccgccucggccucccaaagugcugggauuacaggcgugagccacugcucccggcccuuaaugugugguuuuauuuauuuauuuauuuauuuauuuauuuauuuauuuauuuuuugggauggagucucgcucugucgcccaggcuggagugcaguggcgcaaucucggcucacugcaagcucugccuccugguuucacgccauucuccugccucagccucccgagcagcugggacuacaggcguccacuaccacgcccggcuaauuuuucuguauuuuugguagagacgggguuucaccguguuagucaggauggucucgaucuccugaccucgugauccgcccgccucggccucccaaagugcugggauuacaggcgugagccaccacgcccggccgguuuuaaaaaguaaaugagccaggcauaguggccuaugccuguagcccccagguacucaggagguugaggugggaggauugcuugaguccccgagauugagguugcagugagcagagacggcgcucccugggugagagggagacucugucaaaaaaauaaaaaguggcggggcgcgguggcucacgccuguaaucccaacacuuugggaggccaaggagggcggauuacgaggucaggagaucgagaccauccuggcuaacauggugaaaccccgucgcuacuaaaaauauaaaaaauuagccaggcgugguggcaggcuccuguagucccagcuacucgggaggcugaggcaggagaauggcgugaaccugggagguggagcuuacagugagaggagaucgcgccagugcacuccauccugggcgacaggcgagacucugucucaaaaaaaaaaguaaaugguuuuguguaauuacucauguaaaucaguuuuaaauauuaaaugccauauaagcuuuuuaaaauuugcuuuuaaaauuuuucuauaauagcuuuuuugagauauaguugauauaccauaaaaucgaccuuuuaaaauuguacauuaaguguuuuuaguauagucacauuguuguguaaacaucaccacuaucuaauuccagaacaugugaucaucccaagaagaaacccaguacccauuagcaaucauuccccauuuuuccuuccuucagucugacaaccacuaauauacuuacucuauggauuuaucuauccaggauauuucauuuaaaugagccauccauguaguuuaauggaacaaggcuuuaagaaguuacuuguaaucugagauucuguuccauuacauccuuugcacugguuuucauguuacuugaguagaucacuuuucuaaucugcagagagacuuuuccuguuugguauuggugcaauaaauaaaucugcugacguguguauguuuccuuguucuugaccuuugcucuucacaugucuuaauaguguguucaugguguuguguaaccuguuuucugggcucagguaucuguuugcagcuaaguaacuuuuauucuuaguugggcauuuuuacuucuacuuaaaauaacaauaaaaaaacaguuaauucuguuucuaauuacuccuaguuuguuuuaagguuccuagaaaccacauuuuuuuuuuuuuuuuuuuuuuuuuuuuuuuugaggcagagucuugcucuguggcccaggcuguggugcaguggcucgaucucggcucagugcaaccucugccuccuggguucaagugauuccccugccucagccuccuggguagcugggauuacaggugugcaccaccacacccagcuaauuuuuguauuuuuaguagagaugggguuuugccacguuggccaggcugaucuugaacuccugaccucaggugauccacccgccucagccucccaaaguccugggauuacaggugugagccauugugccuggcugaaaccacaauuuuaaagaaauauauauauuauuaucuuccaaagcagaguuugugucuucuuagauuaucucucuugggacaaauuuuacaacagcaaauugguaccauccuuaugcaaaaaauccuuuuucugucaaggcuuuucaccauucuuuagcucucaccuaccaacaaucaucuucagugaggacuuugccacuugauucacagucuguaucagugcccuccagucuuccaggugauuacacugccugucaauguggacaguguacccucuagccuggcuuccaguaucugucaccuccauuuuucuuuaucguccaugccagagccaggccuuggaguuugccaccacccaacccugaacuucucuugaauucuugaacccccuauauucucuuccacuuugcuggcacaauucuggcacuccuuucaccucucucacccuuuucuguuuuuggcuuagagacuuuuucuacccuauuuucccaauucuguucuguugagaagccugccuuugaucaccgcuccaucucuguauacuaccuuucuuuaccuuuguccacucaacuugaacuucugaucagaucccuacagcccucucacuaguacucucaaaauccuguuccccuuguccuuuuucauuucuauucuggauguuccuaaucucuagucacuccauguugagcacugcugguggaggguggaagguuggaaaucagcacagauuggcacugcugugaauguuugaguuucaauuccaacugaguccuuggcuuuuuuuggcagucuuuuaacuugauucauuccccauaguagcuauuguaaugcuugcucugcuccucaaaaauucucuauacccuuucacuuuuggagucagauucccaccaccuccacaaauuuucuggccaucuuuccuccuaaucuuagacaagagacauaggcugucaguccaagcuccucuugggacuuugucccuuuugguuaauuccuuucuucccuauuacuucuuccaucccacuaucuccuucucuuuaguuuaucaucauacucaagccucacccuuuuugagaaggaaauuucacuuccaggccugggguggcucacgccuguaaucccagcacuuuuggaggcugaggcaggcgaaucacuugaggucaggaguuggagaccagccuggccaauacggugaagcccagucucuacuaaaaauauaaaaauuagucaggcauggcagugccugccuguaaucccagcuacucgagaggcugaggcagaaggaucgcuugaaccugggaggagaagcuuucagugagcugagaucgagccauugcacucuagccugggcgacagagcaagacucugucucaaaaaaaaaaaaaaaaaaaacucacuucccuuaucccauuuccaacauuuuuuuaaacgauuuuaguuuuuuaccauuugaaauuuuuugaaauaggaaucucuccucacugccucaccuauuaaccucuuaucccauuuacugucacccuggcuggagugcaguggugcgaucucgguucauuacaaucucuaccuccgaggcucaagcaaucgucccaccucagccuccugaguagcugguacugcaggugugcaccaccaugcaggaguacaguggcacaaucuccacucacugcaaccuccacuucuuggguucaaguaauucuccugccucagccuccugaguagcugggauuacaggggcccaugaccacacccgguuaauuucuguauuuuuaguagaguugggguuucaccauguuggccaggcuggucucaaacuucugaccucagaugauccacccaccucagcuucccaaaguguguaacucuuuguaguaaaguugcuguaggauuaucuacucagaguugguguuuaacaguauuggaguuuaauguauauugguguuuaauguugacuacuaaauucaaacucuuuuuuuucagacccuaucagauuuggauauguccuucauauuugauuggauuuacagugguuucagcagugugcuacaguuuuuagguaauguugguccuuuguucucuacaguuauccccuuuggucuuauuuauuuaauagugcuuaucugugucaagucucuuuauagauaagccaguaguaaagaauaguuaagaauaugggcuuugaaaucauacauagauguucaauuacucauuguaucccuuuuaaauuaaguaaucuuuggcaaauuacuuuuuucaccuuagccugaguuuucuuaucuguaaaauggcaguaauaauuccuaccucuuaagguguugggaauauuacuaacagaacuaucuaccauuuauuagcuaguuuaccuauaugcuuuaaugcuuuaugucauuuaauccuuacaggauuauuauuaaaaugcauguuccauaaaguagcuuguacaccauaaauagcaguuuuuaauaagccaaaugagacuucuuuacccagcaguucuuuuuuuuuuuuuuuuuaauuuuauagagacggagucuugcuauguugcccaggcugguguuuuguuuguuuguuuguuucugagauggagucucgcucugucgcccaggcuggagugcaguggcgugaucucagcucacugcaaacuccaccucccagguucaagcgauucuccugccucaaccucccgaguagcugguacuacaggugugugccaccacaccagcuaauuuuuguauuuuuuguaaagauggggcuuugccauguuggccaggcuggucuuaaacuccugagcucgagugaucugcccaccucagccucccaaagugcuaggauuacaggcaugaaccacugugcccagccuugcuacaguuuuuucuuuuucuuuuuuuuuuuuuuugagacagagucucacucuguugcccagguuggagcgcaguggugcgaucucagcucacugcaaccuucgccuccugguucaagcaauucuccugccucagccucccgaguaucugggauuacaggcauauacuaucaugccuggcuaauuuuuuguauuuuuaguagagaugggguuucaccguguuggccaaucuggucucgaacuccugaccucaaauguuccaccugccuuggacucccaaagugcuaggauuacaggcgugagccacugugcccggccuccuugcuacaguuucuagguaauauugguccuuuguucucuauaguuaucuccuuuaauuuuauuuauauaauagugcuuauuuguguugagccucuuuauauaugaagcaauaguuaagaauaguuaaggccgggcgcgguggcucacgccuguaaucccagcacuuuuggaggccgaggcaggcagaucaugaggucaggagaucaagaccauccuggcuaacacggugaaaccccgucucuacuaaaaauacaaaaaauuagacaggcaugguggcacgcgccuguagucccagcuacuugggaggcugaggcaggagaaucgcuugaacccaggaggcggagguuguagugagccgagaucaugccauugcacuccauccugggugacagagcgagacuccgucucaaaaaaaaaaaaaaaaaagaauaugggcuuuguaauuauacaaauauguucaauuacucgauugaacaaauauguucaauuacuuuuaaauuauguaaucuugggcaaauuacuuuuucgugacacucauaguagugacagucauagaaguagauuccuuaaugauaaaauauauauauaguucugcccccaaaacuaaaagauuaggacaucaaacaauuuacuucuuagacuuaagcauggacaaaggaguaaguguuauuuuaguaugaaucuauucaaaaacggauggccugaaacuauaauugccuaaugucuuuaaaaguuuguuuauuucagucaggugugguggcucacauguaauuuuguggagguuagaccauuaaacauguaaaaaauaaaguuuggcugggcguguggcucacgcugauaaucccagcaccuugggagggcaaggugggcagaucacuugaggccagccuggccaacauggugaaaccccaucucuaccaaaaaauacaaaaauuagucaggcgugguggugcacaccaguagucucagcuacucaggaggcugaggugggaggaucacuugagcccaggaaguugaggcugcagcaagcuguaaucaugccacagcacuccagccugggcaacagaguaagacacugucucuaaauaaaucaauuaauuaaguucaauaugaaauuuagcaguucaauuccagucuauuauaaauuggucaaugcugccuuuuuucuauuuaucaauuuaucuaucaaucaauaccugauugauacuucuaaaauuaaucagcauuuuggcauuguagauauguuaaggcaaaacacauauucuauugacuggguugaaguuugguuuuauaauuaucugaagucccaaaucaugaauagauuuauuuauuuauuuauuuauuuauuuauuuauuuauuuuuugagacagagucucacuuugucgcccaggcuggaguacaauggcaugaucucagcucaccaccgcaacuucugcuuccuggguuccagugauucuccugccucagcuucccaaguagcugggauuacaggcaugcgccaccacaccuggcuaauuuuuguauuuucaguagagacgggguuucaccguguuggccaggcuggugucaaacuccuuaccucaggugauccgcccaccucggccucccaaagugcugggacuacaggugugagccaccgugcccggccaugaauagauuuaaaauagcuuuuuuaaaacugaaaauagguuuagaacuucaagcuuaauugggccaaauuuaaauucauuuggauaauuaguaucagauaucacuuugaccaaucauagcucuugcuuugcaggauuauauaagaaaacugguaaacugguauuucuuggauuggauaaugcaggaaaaacaacauugcuacacaugcuaaaagaugacagacuuggacaacaugucccaacauuacaucccaguaaguauauuccuacauacaaugugauacuugaucaaaugaugcugagucauaugcacuaaccaaaaguguuuuguuucagacagggucuuucucuguugcccaggcugcaaugcagugguaugaucacaguucacugcaaccucugucuccugggcuuaagccauccucccgucucccaaguagcugggaccacaggcaugugccaccaugcccaguuaauuuuuauauuuuuucagagaccagguuucgauauguuucccaggguggucuugaacuccugagcucaagugaucagccucucucagccuccgaaaguauugggauuacaggcgugagccacugcaccuggccaaguuuuuuguuuggggggcauuuucugguagauaaauuaugaucaggugauuugaccuguuccuaaaauaauaaauuauaggugaccucgcucccagggagaauauuuagaucuugaauuaguacucauaccuuuuuaucagcuaguacucccuucucuagcuugaggaauuaaaaaguuuuugucugagggauugugacaugauugguaaauaguccaccaucgccuuguuuacauaaccugaauuuuuucuuucagauuuuuuuuuuuuugagguggagucucacucugucgcccaggcuggagugcaguggcacgaccuccgcucacuguaagcuccaccucccggguucacgccauucuccugccucagccucccgaguagcugggacuacaggcacccaccaccacgcccggcuaauuuuuuguauuuucgguagagacgggguuucuccguguuagccaggauggucuugaucuccugaccuugugauccgccuuccucggccucccaaagugcugggauuacaggugugagccaccgcgcccaggcuucuuucagauuuuaaagccauauuacuuuauuuuauuuguguagagacagggucuugcucugucauguagguuggagugccgugguaugaucauagcgcaccauuuaaacucccaggugcaagugauccuccugccucugccucccaaaguguugggauuaaagauaggagccauugcaccauguacuauuuuaagcacuaauucaguagauacauuacaauuuuauacauggcugguaacucaauuuguuaaccaguuauuuuucuagucuuaauaaccucaacaauaucuaauguacaccacagaauuaaucuaaagaaaacaaggcauauauugacacacaggaaguuuuaaaacaagggugggugugguggcucaugucuguaaucccagcacuuugggaggcugaggcaggagaaucacuugagcccaggaguuuaagaccagccugggcaacauacugagacuccaucucuacaaaaacaaaaacaaaaaauuagucuggcaugguggcauacaccuguaguccuagguacuugggaggcugaggcaggaggaucacuugacccuagguguucaaggcuucacugagcuaugauugcaccacugcacuccuaaccugggcaacagagugagacccugucucuaaagaaacaaaaaauaccaaaaaaauugaaaguuuuuuuuuuuuugagauggagucuugcucuguugcccacgcuggagagcaauggcacgaucucggcucacugcaaccucugccuucugaguucaagcaauucuccugccucagccucccaaguagcucagauuacaggcaugugcuaccacacccagcuaauguuuuguauuuuuaguagagacgggguuucaacauguuggccaggcuggucucaaacucccgaccucagaugauccgcccaccucagucucccaaagugcugggauuacaggcaugagccaccacacuuggccaaaaauaauguuuuuuaauaaugacucuaauuuuuuuuuuuuccuuuuuugagacagagucucacucuguugccuaggcugaagugcaguggcaccaucucggcucccugcaaccucugccuccugggcucaagcaauucuccugccucagccacuggaauagcugggauuacaggcaugugcuaccaagcccagcuaauuuuuguauuuuuaguagagaccagguuucgccauguuggccaggcuggucucgaacuccuggccacaagugauccaccugccuuggccucccaaaguguugggauuacaggcgugagccaccacacuuggcugacucuguaaauuauuuaauaaauuuuauuuugcauuuaagguuauguaacgaauuugagaauaaaguuaauguuaaaguggguaaauuauuagaaacagaaaccuaauuuaaccugugaccuuacuuuuacaggugaaaauuuuaugaaucagauagacacagaguuuaaagacaaguuaaucuauagauuaauuaugaaauaguaaguguagccuuaauaaugaauauaaaauugagaacuggaccaaaaaguagauaauacuguaauuauuuaguccaguaaauguucaaagaacaaagaaugaggauagaacaaaacaaaguauuuuaucuauaaaacaauuagugagguuggaaaaggaaauugacaaaucuuuuuuuucuuuuuauuuuuuuugagauggagucucgcucugucacccaggcuggagugcaguggcacgaucucgacucacugcaaccuccgccucccaaguucacaccauucuccugccucagcuucccgaguagcuggaacuacaggugcccgccaccacgccuggcuaauuuuuuguauuuuuaguagagacaggguuucacuguguuagccaggauggucucgaucuccugaccucgugaucugcccgcuucggccucccaaagugcugggauuacaggcgucagccacugcgcccggccaacaaaucuuuuuuuuauauuaggagaaaaaaguggggcuuggcaaguaagauucugauauaagaacaauucuguuaaagaaaaaaugaucauggugaaauugaguagauaaaauugucugcaaaaacagcguaauuuccaaccuggccaacaucgugaaacccguucuguacuaaaaauacaaaaauuagccggacacgguggcacgugccuguaauuccaccuacucgggaggcagagacaggagaauugcuugaacccgggaggcggagguugcagugagccaagauggcgccacugcauuccagccugggcgacagagggagacucugucucgaaaaaaacaaaaaacacagaaaaaaaacccaacaaaaaccagcauaacuggaagagacuacagaguggucuuaaauauuagguguaagucauuuuuuaauuuuuugacguugcucuauuucauuuauucaaauauuuauugagcaccuacuuuaugucagacauuguucuggauacuaggggaaaacagaugcuaucucaaccuuuccugcagcucacauucauuucaacucauauuuuuuaauuaaucaaaagcauaugugaucuauucugguguggaaaagaaaacauuuuugaaaaggaaaaaaaagcauaugugaaaaccuacauauauccuaugaucuggcaguucuacuccuaguuacuuacccgagagaaaugagaaaauacauuuaccaaaaaccuuguacaaaaauguuuauacuagcuuuauuuguugguggugaguuauuauuauuuuuuuuuuuugagucagugucucacucuguggcccaggcuggagugcaauggcacaaucgcggcucacugcagccucaaccucccagguucaaguguuccucccaccucagucucccaaguagcucgaacuacaggcacaugcuaccacaucuggcuaauuuuuuaauuuauuuguagagauaggguuucaccauguugcuuaggcuggucuugaacuccugggcucaagcgauccucccauccagccucccaaagugcugggauuacaagugugagccaccauacccagccuauacuaauuuuauuuguaauagccaaaaacuggaaacaccucaaauguccaucaaaaaggaaauugauaaauaauggaaugcuacuuagcaagaaagaugaauaaaccacugauacauucagucauauuaugcuacauggcagaagcuggucauaaaaaguuaucuacuguaugauaccauuuauaugaaauucuagaacagacaaaacuaaccuguggugauagaauucagaucagugguugcuuccggagaugaaaauggggauugacugggaaggggcuagaggagacuuucugggauguuaacaguguucuguaucuuaaauagccuaauucagacuucuuuuauaaagcagaaaguauauuggggauuauuaccauagaggugguuugcuaacuaagcauuaucuuuuccuuaugaacagugacuuugaauauagauuguauuaaauauuuuauucauuuggcaaucuacacauagaauuucuuucuuucuuuuuuuuuuuuuuuugagacaaagucucgcucuugucccccaggcuggagugcaaugguaugaucucagcucacugcaaccuccaccucccggguucaagcgauucucuugccucagccucucgaguagcugggauuacaggagccuaccaccacucccggcuaauuuuuguauuuuuaguagagacgggauuucaccauguuugccaggauggucucgaacuccucaccucaggugauccgccccccucggccuuccaaagugcugggauuacaggcaugagccaccgugugcccugcccuuuuuuuuuuuuuuuuuuuuccgagauggagucucgcucuguugcccaggcuggagugcaguggccagucucggcucacugcaaccuccgccugccacauucuccugucucagcuucccuaguagcuaggauuacaggcaucugccaccacgccuggcuaauuuuuguauuuuuaguagagacgggguuucaccacauuggccaggcuggucucagaacuccugaugucucaagugauccacccgccucggccucccgaagugcugggauuagaggcaugagccacugcaccuggccuacauacagaauuucuuuauuuauuauuguuauuuuuugagacggagucuugcucugucgcccaggcuagagugcaguggugcaaucucggcucacugcaagcuccgccucccgcguucaugccauucuccugccucagccuccugaguagcugggacuacaggcgccugccaccacgcccagcuaauuuuuuguauuuuuuuaguagagacgggguuucaccguguuagccaggauggucucgaucuccugaccucgugacccacccgccucagccucccaaagugcugggauuacaggcgugagccaccgcccccggcccagaauuucuucuuauuuucagacagaaucucucucuguugcccaggcuggagugcaauggcgcaaucucggcucacugcaaccuccgccuccuggguucaagugauucuccugccucagccuccugaguagcugggauuacaggcaccugccaccaugccuggguaauuuuuuuuuuuuuuuuuugagauggagucucgcucuguuccccaggcuggagugcaguggggcaaucucggcucauugcaaccucugccgccaggguucaagcgauucuccugccucagccucccugguagcugggauuucaggcaccugccgcugcacccagcuaauuuuuuguauuuuuaguagagacgggguuucaccucguuagccaggauggucucgaucuccugaccucgugaucugcccaucucggccucccaaagugcugggauuacaggcgugagccaccgcgcccggcccccagaauuucuuaagaagauaaaaacucugggcuaaaguagcuacacuaaaacuuauguugucauuauggggcacuugugcuuuuggccauaagugaguacugguucuggaauuacccucccacuguacacaacuagaaaaccggacaaaaaaagaugcuacaacuguuuucagacauugggcaacagcuaccacaggacugugauuccugagagaaaggaaacaacucuauuuugguuuuaugccaagagguaauuuucagaccauggugcaaagagaggacacccaaacauaguccaauagucuugcugaguugaggagauguagaccagaauuuggaaaggccaacaggacuagaauuuuuuugcuaggacagagaggagggaguaccggagaggagggaccucuggagagaaaggacucuagaaauuuacauagcugaauaccaaucugugcaugcaauggguaaagcuccaaaaggcuagucaaagaacaauuguaagaaugcuguuagccaaauaauuacuagagcucucauggggccaggaauuguuguuuaaucccauuuagccuucuaacaaauguuaaaaacugaucuguaagcaagugaacugucagaacaaaauucaaccuucuucaaaagacuacaacaaaauccagcacucaauaugaaauuacuagacaugcaaagaaacaggaaagugauucagucaguagaaacagacacaagugugacaaagaugauggaauuagcagauuaagacauaagacaaucguuaugaaugugcucagggauuuaaaggaaaacacaaacaugaggaaagaaauggaagauauaacacagaaucaaaugaaacuucuagaaaugaaaaauacaguauuugaaaugaaaauuucuuuuuuuucuuucuuucuuuuuuuuaauagagacagggucucccuggguugcccaggcuggucucgaacuccugggcucaagugauucucccaccuuggccucccaaagucugggcuuacaggugugagcuaccaugcccagccugaaauggaaauuucacuggauaggauuaauaguaaauuagauagugccaguacugcagaaagaaagaccacuaaacuuaacucaaugcaacagaaacuccagaaugaagcacagagagaaaagugacugaaagcaaaauaaacagagccucaaugacuggugagacaacaucaggcagucuaacaaaccugcaacugaagucccagaaguggaagggaggagaaagaaagauaguuauggaaauaauggccacaauuuuuuaugguaauuguuuuuguaauuaaagacugucuuaugucagccauaagagaaaauuauuucaccuguaucauuuaagaugaauuauaugaacaauuauuagauuggagcaguuauuugaauucauagcaaauaauugucugaagagauuaacauuuucagcaggaagaauagagaaggaaaaauaaauguuggauuuguggugaguagaauacuagaacugaauauuacaauuauuuguuauauugucaguaugaauugguguauaucuaauuacaaaaaaguauuauuguaccaguuuguaaauguuugauuugaccuuauuugcaauaaaaguaaaucaaacauuaaguaguaaauauaagcuauuguuagaaaugcuuguucccuggugcuguaaaggauagcacuugaacauaaauuuaauuuccucagcaaggccauuuuuacuuucugcagaaaggguacacuugccagcaguuuugccacaagaguacaccgaacaaaggagacagggucauuuauaaucugaugcguccacccuacugcuguguccgguuuccauuggcuggaaugggaccucacauucuguauuuguccugauuggcuagcaacuuagaacuuuuuaaaagaggcaaaggcagaggagaacaaaggaaggaggaaguaacuuguggaaugcugagaaagguaaaaacaccuucaaauaaggaagaggaacaggcuaugaccuaaugcuugcuuggaccaguguaaguaugccagggcaaauauuuaggcuaaauugugggagcuaagaacauaaaguacauugauuucuuuauuacggcuggcagauauuuaagaauguuagcacgggucuuugaaucaauuuugcuucuaagagaaguuacuauuuauucuuaauuagauggggaggaaagucuuugaaaaggaaccucuacuuuacuuuuuacacgauuaauggguuucuaauuuucauguaaaaauauuuuaaaaucuuauuuagcuuccgaagaacugaccauugcuggcaugacguuuacaacuuuugaucuggguggacauguucaagguaagauucuuuuuuuuuuuuuuuuuuuuuuuuuuuuuuuuuuuuuuuuagacaggcucacucugucucccaggcuggagugcaguggugcaaucucagcucacugcaaccucugccuccuggguucaagcaauccucaugccucagccuccccaauagcugggauuacaggcaugugccaccgcgcccagcugauuuuuguauucuuaguagagaugggauuucgccacguucaagguaagauucucuuacucuuacagucacuuuguuuuauuuuaacuuaacaaaaauguggccauuaguucuagugcaugaaaucucauucuagucacgcaaggccagaguagauuuaaaauuuagggauuauuacuccccgauaaauacuuuaaaagcaaagggugauuuucaugauacuucuggccaauucaaaugagaauugcuuuuggugguaaaguguaugaguaaaauuaacuuccauucucucuacuucaaucuaccucucacugucauaaucauguuuugaacauguuacugcucuguaaaacaaaaacaaaacaaaacaaaacaaaaaaaccuucaguggcuaacucauuacuuacaaaauaaaggccaaacucauuaaccuggcauucaggaucucuaugaucuggucccaguuuacuuuucugggcuuuuaaaaauuaucuuauagagacagggucucacucacuauguugcccaggcuugucuccaacuccugggcucaagcaauccucucaucucagucucccaaaaguugggauuauaggugugagccaccacaucuggccuacuuuucuuuuauuucccucuauuccccuucccguucuuuuugcuucaaccaaaucagaccuucuugguguuuuccucugugcuuuuguucaugccauccccauccgcacaugaguaaccccuuuaggccccagcguaugcccugcuaccucccuugggaagccauucucaguuggagugcucucagcuauacuucauagcacuuaguauauuuguguacaugucuacaacaaguuuggaaagacugccuuaucucuuauauuaaacuugcggggacuaaaauccuguuuuuuguuuuguuuuaauuaaaaaaaauuuuuuuuguagagauggggucucacaaucuugcccaggcugauuuugaaguccuggccucaagcaauccuccuaccucaauuucccaaagugcugggauuacaggugugagccaccacaccuggccuguucauuuuuuauauccccaaaaguacuuggcaacaucuaccucauaguaagucauaacuaaccaauauuaccgaauuggugggcauucuaaaaaccugaugcgacauauaguugaaaagauuguaaaugguucuggcuagugaaagcacauuugagacauguaauugucuggcauauacacaaaauaauuucuggaauacgaugauuagaauuggaaucuaauggaauuugucugagacuucauuucuauguuguuucaagauaugucauaauggcuggguguggggucucaggccuauaaucccagugcuuugagaggcugagguugggaggaucacuugaagccaggaguucaagaccagccuugcaacauagcaagacccugucucuacacagaauuuaacaauuaauggggcauagugauagacacugauaguccuaccuacucaggaggcugagaugggacuaugacuugagcucaagagucugagguugcagugaacuagccuggaugacagagcaagacccugucucuuuaaaaaaaaaaaaaaaagguaugucauaaaacucaagucagugaagaaaguuauguuauggaaaaaauuacucuuaugauuucauagacuucaguuaauuauuaacauuugagcuucuuuucugaguaaaacaauuuuguuuugguuuuuuuuuaauuauuuuuuuugaaacagagucugguucugucucccaggcuggagugcaguggcaugaucuuggcuuacugcagccucugccuccugggcuccauccucccaccucagccucccaaguagcugggcaggcacacaccaccacacuuucuaauuuuuuuuuuuuuuuuuuuuuuuuuuugagacggagucucucucugucacccaggcuggagugcaguggcaugaucucggcucacugccaccuccaccucccggguucaggugauucuccaagccuggcuaauuuuuguauuuuuaguagagacacaggguuucacuauguuggccagguuggucuccaacuccugaccucaggugauccaccugccucagccucccaaagugcugggauuacaggcaugagccacuguguccggcuuggcuaauuuuuuguguuuuuuuguagagaugagguuucacuauguuguccaggcuggucuugaacuccugagcucaagcaauccaccugccuuggccuuccaaagugcugggauuacaagugugagccaccacacccggccuuauuauuuuaacaagcuuguaccugauauuaauuuccuucugucacucauuccaaauuuaucacuggcaaaaaaaaucugauaacuagaaaugucaaaaaaugaacacugcauauauauguaauauaaauacacacauuuuauguauauauaaucacauauauguaguuuuuuuacugcuuauauuuuagaucuaguagcaguccuccaaugaacuuaacguguauuuuuuuuuauuuuuauuuuuauuuuaaauauucuacuccuuacauaugauaauuggaagagacuaaaguauuugacuugcccacagucaaggaaagccugaaauucccucuuaguuauucucagaagaauuuggcaccacuggguaaaagauuaacuugaauauauugugaaguaccagcagcuaagggauuaccgcacuugauaucugguuggacucuuugcuuaaaccaucugcuggguuugaccaacaaguaaacucuaaccccugauuguuuuuguuagcucgaagaguguggaaaaacuaccuuccugcuaucaauggcauuguauuucugguggauugugcagaccacgaaaggcuguuagagucaaaagaagaacuugauguaaguuaaauaacugaaacuaaauauagucaaaucacucugguaagccugcagaaguaggucagagauacagguaucagagugcagcuuuucugcagucucugaugaaacucuuggcaauuuguugagcucagugauugcuuuaaguagugauuacuuagaaugcagagggaguaacugaguaauuguagcuauugaggaaguacuaacacagacaucuuuuaugaagacuuaagaagcucacccuguacagaauguacccuuuuaguauauuucaugucuguuauauuccuggaguggguugaucuugagucccuggucaugcuaagaugcuauaucuuaagccacagccuggaaaugauaggacaugccaucuuugacacuacucccaggagugagcagaggcauauguagcuaccuccccuccaguaucccaggucagauauuuuguaaaggggcccaacagcagcaggcaaggucagcaccagaucuggggccacagaguaagcagguccaugauuugauugaagguugaucauaccauggcucugcccagagcaggcaaacaaauacuuguacguguggaaaaguccagguagguucuaugguuacaaaacaaggacagagaaugccugaguuccuacuuuguuccagagacugugcguauuacuugauuuaauucucaauuucauaggguggaugcuacuguuccuaauucucucuagagcuucagucaggcuaacuugcccaaagucacaucucaaaagcaguagagccagaagugaaaccacaucuguucacuucuaaggugcuggcucuauacguucuaugucacuccuuuaaaggaugagcagaguaaacauuuacaggaagagccuuaggaagacagaagaauuuagcuuaugguuucauugaggucacuuuaaaauguggggaaaguuugacaaagaacguugguaugacaugauaugguagaaaaugaguccuuuauuguuuuaucauaucaaaauaagcucuuuggaugguuucauaucaacucuuguuuuguauuguuuuguuuuuuucagucacuaaugacagaugaaaccauugcuaaugugccuauacugauucuugggaauaagaucgacagaccugaagccaucagugaagagagguugcgagagauguuugguuuauauggucagacaacaggaaagguaaaaaaaaaaaaaaaauuaugauggguguguuuaauucuacaguacaaaugucuucuuaaauuacuauuguccaacuauacaagcccauuaucauuuucuuaaagaaaacugucauuuauaccugugggucuuuuuaauguccucauuucuuucuaccauggaaugaaacauuuucuuggugacaacaaaaaugucaaggaugaguuaugccuaaggcuugugcuuauaggaaacuaaauuaaagcuuucaaaguuauuuaucauacauuuucagaauuagccaccaaacgauauauuugaguguuuaaguauaccaguaguguguuuaggcccugaguuuaccagagauaaauaagacauaaacuuggaauauuuuacgguuuucugaacauauacuuuauaauaagcuuuaagacggauuguuuugguauucacuuuuccuaggauuuauuuugggggaaacaucagcauugaaaaaauccagauaaacaguggaagaaccccagagauuuacaaaauuuuuuuaguuuacauauacuauuucaggguggagaaauacugcagcauauagcaggaggcucuuuuuuuuuuuuuuugagauggaguuuugcucuuguugcccaggcuggaguacaauggugcaaucucggcucauugcaaccucugccucccagguucaagcgauucuccugccucagccucccugguagcugggauuacaggcgugugccagcacgcccagcuaauuuuguauuuuugguagagacgggguuucuccauguuggucagucuggucucgaacuccugaccucaggugauccgcccgccuuggccucccagagugcugagauuacaggcaugagccaccacgcccgguccgcaggaggcucuuaagucagacaaaguagacuuuggucuguuuucugucuucuuuuuuauaaauuagcuugauauuaauuuuaggaaaugcuuuguuuggucauaaaccuucucagggaauguuugucuuuaauauuagugaagccaguuuggauuuuuuucuaagucagauuauuuuuauucuuggguaucuugcaagcuaaccucuuucccacugaguggccauccugcccuaagguagagugagagaaggaggcuucuuguguguucauggggcuuggaugccaagcagccacgacuuuaucacagucauggauuuaucacagccauucuuuguucuaaaauagaaccuauaauucugcugggauguggggcuuuauuaauuuuauaaaauuccaacgaaaugucucucuucuauucuaggggaguauaucucugaaagaacugaaugcccgacccuuagaaguuuucauguguagugugcucaaaagacaagguuacggagaaggcuuccgcuggauggcacaguacauugauuaacacaaacucacauugguuccaggucucaacguucaggcuuacucagagauuugauugcucaacaugcauaacuugaauucaauagacuuuugcugguuauaaaacagauguuuuuuagauuauuaauauuaaaucaacuuaauuugaaugagaauugaaaacugauucaaguaaguuugaguaucacaauguuagcuuucuaauuccauaaaaguacuugguuuuuacaguuuauaaucugacaucaccccagcgccauuuguaaagagcaacuuuccagcaguacauuugaagcacuuuuuaacaacaugaaacuauaaaccauauuuaaaagcucaucauguuaaauuuuuuauguacuuuucuggaacuaguuuuuaaauuuuagauuauauguccaccuaucuuaaguguacaguuaauaauuagcuuauucaaugauugcaugaugccuuacaguuuucaauaacuuuuuuucuuaugcaaacgucaugcaauaaaacaaacucuaauguuuggcauccuuguugggcaaauguuucauuuaaaugugucuuaucuagcuaguauacucugaaaauuugaguauuuaauauuaggcauaugaagugguuguugggaaaggagauuccuucagaauauuuagaauagcguuuaaggcucucaaggcuuagguauuuaccaugagaugguuguggucaguugcaccugauaccauguaucccugaaucauguguauuuuuauuaguaaugcagccacuaccauugcugauggggucuguguccuagucccugugggauuggccuucugaagaaaagcacauuuaugguacacaagguugauucucaguuugguaggcucuauaguuccaucccagcugucuaauucugaagugcuccagucuuauuggugcccaaugggguaaucugugccucuuccccaaaagcaaugacaggcaccagugucuccacauuuagauauauucccagucucuguacauuuaacaguacucucuggggcaagcaauaaguaggaccuugugugcaguuucauuguagagacauguauaucugaggaauaaaacagcuuguucugugucagucugagauauguggagauuuuguuccuauccuauagcucuuuuguauucuuuggcauauuuuauauccugguagaagaaaacaagugcuuguuuccaauuuucuuuuuucuuauuugcucucagguaguucuuacuccauacaacaaagacuuuuuguuuguugggcuuuuuuuuuuuuuuuuuuuuugcucuguuucauuuuguuuuagagacgggguuucaccauguuguccaggcuggucucaaacuccugaccucaagugaucugcccgccuuggccucccaaaguucugggauuauaggcgugagcuaccaugccugaccugacuuuuguuuuuagauauuaugcuugccaugugauagggccugcaagccucauugcuaggcuuacuaagaaaauuuuaguuuuucaaaagcauuauaauuuccuaagaaacugaauucuuuuuuuauauguuugagauucccaucauuaguaauauaagaugaaagguaagugccaaaaauguauuuuuaaagacccucaaguuuaagauuuauccugauuauaagccaaguuuuauaguauauuuaaccaauuccaucaagaauaauuuuaauaucaaaaauuaguguuuucuguagccauuguccaugucagaguuacaguccuuuuugucauugauaauauaaccuaugaagcagauaaggauugaggaauaugacuggaaggaauuacuauuuagcuaagcugacaaggucgcuucuuaagaugacauuugguuucaguaaucugacuauucuguuuucacuuucaucuucuuucuaaaugaaaacaaaagugcucccucccuuccuggaaaccucaguaacacuaugggaaaaguagaacaugacauugcagccuauugauuucuucuuccagauagguuuaaaguacuccuuaaguucugacuaaauagaacuaagccuuauuaaaaauaacugccucuuguucauguuaucuguaccuucagggaccugccuuucuucaaguauuuccuagaguaucuauuaugauacugaagaagcuaauuauuuguguuguaaauggguauaaaugaaaaaaaaacauacugguuucucuagccaggaaaaaugcuuucugguguaauauaucuugcuccagaacccucauucuaauuguaacacuaggaucaaagaaacaaagucacuuuguggaccacagcuaaacuguggauauuuucccaaagacauaagauuuuuauggcccgagccucuagaaaggaagccauguuuaggagcaaccagcuuuccucccagcuuuagggggcagaguuccugagccagaggacuuacuguccagcuuugagaaccucuccagaguauaugcacuggguacugcucuuuuucaagagaaccaaauuaagaggauggcaagaaacaguagaagcacagaggaaagacaacucugcaugugccugugugaaugugugcauccauggaguauuucccagguaaauacuaguacuggggacauaggcuaauugugugucccacacugcaagaugcuagggcguaguuaacacugugguauacauacaaaucaggcacuguccaaaagauuuuuuaaaaucuaaagucugaaauguaaaaauauaaggucucaacccacuuuuacacuuuuaaagagaucccauaccuguuucacugacugccguuaauuacacuuuuggaucacagcugguuaaauugauagauuucaguuuaucucagugaauuuuuagaauggagauuauagcauuuuuuaauuggagaacagacauuuccuaaaguauaugaaaaaaaauuauucacuguugguuuaaaccaguaucuuuguaugagugccaaagauauaugaacacagauacugccugugcagaccuaaauuuuaguuuuguguaccuggauccauauacaaauuuuuugugguuuauagcauaaaagcagaacguuguuucuuucuuaguuuucaaccggcucaucuuuuguuuuuguuuuuuguuuuuuuguuuuuuguuuuuuuugagauggagucuugcuuuguugcccaggcuagagugcaguggcacaaucucugcuuacugcaaccuccaccuccgggguucaagugauucuccugccucagccuccugaguagcugggacuacaggcgcgcaccaccaugcccggcuaauuuuuguauuuuuaguagagaugggguuucacuauguuggccaggcuggucucgaacuccugaccucgugaucugcccaccucagccucccaaagugcugggauuacaggcgugagccgccaugcccggccaauuuucaacuggcccauacuuuauagugauggaaagcgcauaaacuacuuguaaaucauuaaaauagggugauaacugugauaauaguguuucuugcauucuagaaaauuauuuuauuaacuacauucaaaacccagcauuucacagguuccaucauuagaaacaguauaguucuaguuaacaugauuggagaguuucaggggaaagguuuacauuuucugaaacuguauuugguaugugacucaaugugguauuucagucuuguuagucacuuacaugacugacguuugcaaggauuuauugccaaguaaaauuugaccagagugcacugagaauagcuacauaaggggaaaucucucaaaauuccuucuguucauuuaauuuggagcauauuguuuaaaucauuuuaaacauauguaaaaaguugaagcauuaaaaaaucuucaagaaacaaugaaaaaauagaaauuagcaaacauaaguuucuuaaugcaaaauuaauagugaauaaaauauagccuacauuaaaagccagaggcuuugcuauaaauauaagaguuuagaaaaacagugugcuucaauuaaggacuaaauuaucaaaacugcauguuuguuuuuucuuuucuuuucuuuuuuuuuugagaugaagucucacucuguugcccaggcuggagugcaguggugcgaucuuggcucacugcaaccucugcuucccagguucaagcgauucucgugccucaccaucccgaguagcugggauuacaggugcaccacaccaugcccaguuaauuuuuguauuuuuaguagagacaggguuucauuauuuggccaggcuggucucgagcuccugaucuuaagugauccacucgccucggccucccaaagugcugggauuauacacaugagccacugugcccagccuaaaacuacauguugaagcuuccggucauuuccauuauuauccuucuuuugaaauucaaguuagugcuuuuuaaccaaauaaaagaagaaccagcucuugggauaugugacucugccucuguauaaagugacuggaauuuuguuaaaaccguguuuccacuucugaacccuguuaccauucccccucacaaauccccacccaacaccuggauuuuaaagauccuccagugucaagggaagccacagagucuauuaaagaggcaguucugaaccaauuaauuuuuguccuuauaauuuagagcauuaaauagcuaauauauuuaauggcacuaauuguuguucacggcuuucaucauacuuuuaaacagaauccaaaguauucaaaggaaaguaagcgaaguuauccaaagccaacuuuguuucagguguguccccugccccaaauagauuuuagggcagaaauagaaaacugaguuuacacagaacuauuuuuggaaaagcugcacuggaguagauggauucuucuucagcauacuuuuuuguuuguuuguuugagauggagucuugcuuugucacccaggcuggagugcaguggugugaucuccacucacugcaaccuccaccucccagcuucaagugauucuccugccucaaccuuccaaguagcuuggauuacaggcgugcgccaccacagcuggcuaauauuuguauuguuaguagagacaggguuucaccauguuguccaggcuugucgaacuucugaccucacgugauccaccugccucagccucccaaagugcuagauuauaggcgugaaccacugcgcccggccagcaugcauuuuaaaaguggcuuagauuuaguuuuaaauauuuuggggugaaaggcaggaacaguucuguuuuugacauacagguuuucuuugggauuguuuucauuuucaaguauagauucaugucagaauggccaacuuaacguggguuucuguauucccugguguugcucuuaaccugaacucauaaucaguugccauacugaggcaagagcacucagggugaacauagucaaguuacuuuaaaagugauaaaaguguuuuuccauggugaaaccuucaguauuuggcugaauguaaaguauguugaagugguauauugaugguaaguuguuaaucacuaaccuuguuugcacuuuuguacaccacugcuugcacuaggaucuuggugugaauuuucaauuguuuuacaguguauacagauuauuaaggauaauuuauauaaagauguuucuguuuaacuuuguguguuuuacaacaaagagcuauaauagaugguuaaacguuuuugaauuguguuuauauguuaguuugauuauguucuauuaucuuuucaccugccaugaauuugaguguuaggaagggaaaaauaaaauacuaaucuggucuugaagaa

SEQ ID NO: 192229 - RNA, 88284 nt, Homo sapiens
cuuggucacaugguggcacggccgcugcgucagucacagcccuggcugcaggaguccagcugccgucgccgccgccagcggacggggcggggauccuggugccaggucuucguuaacccgcccccgccgccucagucagcugucccagcccgggcccgaccgucauggagcggugcggggccuacgccuguuccgugugaggcgcaucgcugccgccgccgccgacgccgccuucguuugucgaggccuccggaacccccgccgccucccggagccccucgcccuuggcagccugucaccgcccccugggcgggcucgaaugcgcguccggugaaggugcaggcccggcgccgccacugccgcagccaggagaugguucgggccuagcggagccgggacuggagguaagaagggccgacagacugacccagggccgggccgggccgcggggguuguggccggggccgggugggggugggggcccgcaaguucugcggggagccucggggagacccuccgggcuggggcugcucaaucaggcgucaccccuccucucaucugcgcgucccaccccaccaccuucccgcaaagauaagaaaauaaaaaaagcuaacccaauccuaacaaaaauucccagaaauccauccguuuaguguuucuccuuuccucuuucuuuccucagacguuccaucggcugauuuguuacuuuuucauauccuccucaauuucaaauuaugucuaauuaaagagaaaauaggcccagauucuggcuaacauuacccagcuaguucucgcuuuccuucucgcgauccugcgcaccucucccacacccccacccccgcaaaaaaaaaaaaaaaagaaggaaaaauuuccgccuucgacuugcgaaggggauugacuaaaaaugggaacguggggguauaauacucgaauacccuccccuacaacuucugaaucggucuguuaccuaguuaucccaguagcuugugcguggauauugauguuuaggccuuuccuccagcugccugugcuugggguuaaucucguaauugacgucagugcuuuguuccuucuacuuugcuguuccuuccacucuuugaggauggaucauggaguacaggaguuuugggaguaaccuuauugccuuuucguuuacaaacaguauuauuuucaggaaguggaaguacgaaucugaaauguuuguauauggaguucaaggcgaagaguucgauuuaggguucucguaguuuugucaguuguaauucagaauuaugcgguuucuucccugcuggccacauggaaauuuuauacuaaggccagucacuuuuccauugaccaguguuuuucuugauggaaucuaagcuauaggugucugugaauagacuguaaauguaacauaaaaugugugcuguuuuucgggcucagauaugaaaagcgcaaagcuucguuucuguauugauucugcacuucauaaagugcuuuuuaaaacuuaacuggucuuuaacuuaucaaaauugaaauauuuaugagaacuuucuuaauuugggauuugauaaagagccuuuguggucugugagucugccuagaaucaucuuuggucauacgugcauaaagaaguguuggcaaguggccacuugguuuucaacaaagcuggcuucuuuaaauuucucagauucguuuuccuuauuaucacugcaucuuucagcuccuaaauauaagaaaaauucccaguaaguuauuuuaaguuaucuuucagaguuaacuuacuaaaaaccuggaagcagucaaauuuuucuuuuuuuauuaccagcaguuucauucaauuugcggugguuugcaggcugguacuuugauuuuuguuaacucucuagaaacaguaggcaaauuuuacuuuaaauaaaauuuugcuucaaguggggacaagauggggugucugaaaaaagagcccagcuguguuaauuggaacaugaucuacaguuugggaguguaaggugaagcuguguaauuaagaauucuuaaagauugaauauuuuuguucugagucacuuucuacuugucagauucucacauucagguugauacauucucuucuguguacucuugaguuauuguacccuuuuuguagcaauauauucugcagccgggccuggugguucacgccuguaauccuagcacuuuagcacuuugagaggccgaggugggcggaucaccugaggucaggaguucuagaccauccuggccaacauaaugaaaccccgucucuacuaaaaauacaagaauuagccaggugugguggugcacaccuguaguucuagcuacuugagaggcugaggcaugagaaccaaauuagccagacauggugguacaugccuguagucccagcuacuccagaggcugaggcacgagaaucgcuugagaaucgcuugaacugggaggcgaagguugcaguaagccgagaucacaccacuggaaugcaguggcuccaucucugcucacugcaaccucugccuccuggguucaagcgauucuccugccucagccuccugaguaguugggauugcagguacacacuaccauucccaguuaauguuuuuuguauuuuuaguagagacgggguuucagcagguuggucagacuggucucgaacuccugaccucgugauccacacgccucggccuccccaaaguguugggauuacaggcaugagcacugcgcccggccaaccuaggcgaugucucaaacaagcagaagccuacuauauguuuugcacuguaauuuucuuuuuuucccugucucuugcagauauugagggaugcauaauaauuuucuuacagaucuguuacagggucuuugaggaaguacuauauuuauuccucuuuuuaucuuccucaguauuuuacacaauuacuagauugaauuugaaugugauaauauuuugaacuugaaauuguuguucuaucaacuuaucuaagauuucacaaaaagguaauguaaagaaagcuguaugagcaaaggaucaguauuugaaagggaaaaaccugucaguuucagaagaugagacagaagaugaagcuuucuaaaaguuauauauuuugccuuuuuugagaagguaagguaaaugccguaguuuuauguguaccugagaggaacaaauaaaacagguauuucuuccuuuguggccauccacugguuuagaauggaguucaaaaucuaugaggacuuuucuuugugguauuuuuaauaaaaucaaagagguauucuuaaguauugagagcacaccuggacaaugacccagaaguacagcauguacuauaaaaaauugaugacuuagauuuuuuuuuacuuuagcuuuauucuacagauaucucacuaugaagacuuuucuauaugauauaaagguucccagcucuccugcauccuuauuauguuuuacccauucccuuauucauuuccucugauaaguuggaacaauucuauuugauuucugggaggguguuagcuagucucaguuauugugaaagaagguguagugacuaaagacugccuaaagcuaaccugaccuguuaccuugcugcuuuuuccuuugguuuaagaaaagcgcuccuacuggccaggcgcaguggcuuaugccuguaaucccagcacuuugggaggcugaggcuggcggaucacgaggucaggagaucgagaccauccuggcuaacacgucucuacuaaaagaauacaaaaaauuagcugggugugguggcaggcgccuguagucccagcuacuugggaggcugaggcagcagaauggcgugaacccaggaggcggagcuugcagugagucgagaucgcaccacugcacuccagccugggcaacagagcgagacuccgucucaaaaaaaaaaaaaaaaaaaaaaaaagaaaagcacuccuacuuguuguuaacucccuauacauacccuucuugguuauuugaagugauacucuaguacacggaagagggcaguaauauauguuccaguuacugaguuuuggcacaucaucugcauuccuguuugucuugauguucauuuucgcugguaucauaucuugaaaguuuuaacgauacuggggcacagaaaauauuagaaccuccaaauucaauuccagaguauuccaaaacauuuuaauacuagaacuaccuauucuauuuuugaagaaaaaaaaucuuagcuaccugcuuuaucagcuauucuuuauuuaaaaaaaucuguaaccuugccgggcccgguggcucaugccuguaaucccagcacuuugggaggccaaggugggcggaucacgaggucgagagaucaagacaauccuggacaauauggugaaaccccgucuuuacuaaaaauacaaaaauuagcugggcaugguggcgccuguagucccagcuacuugggaggcugaggcaggagaaucgcuugaaccugggaggcggagguugcagugagcugagaucgcaccacugcacuccagccuggcaacacagcaagacucuaucucaaaaaaaaaaaaaaaaaucuguaaccugaggaauguucugacagaaggcauuuuauguaacuuuuucucucuuggaguucuuaaugaacuguguugguggcuuuuaggcaaggaaacguagcuuauuaguggauacuguuuuaaacuaauuacuucaauaaucauuuccuaggacagguaaaagaacuucauguauucuuuucccaagguuguuggguaggaggaaucagggacugacaugaauagacugcacuggaaagccaguaugguuugauuacccagagaucuguucggggacagggcugccuggaguugcuuugggccuaauagcucucccaggauuuugucaguuuggaguugccuaguggguuaugacuuuuccuuuucaugucaucauuagggaagggacaguuuuauggagagaugaguaccagccaauacucuguagagacacaccuucuuaccuuuuugcaguugcuuccauuucuuccaauuggaauauuauuucuucuaacuuguuucuuaccuguuaaaauuucaccguuuuuaaaggccugauuuacguuucauugccuucuugaaguuuugguuaauucuucaccccacuccaguugugaucuacuuccuuucaaucucugcaucacuuuguagcuccuuuuuuuuuuuuuuuuuuuuuuuugagacagggucucacucugucauccaggcuggagugcagugaugugaucuuggcucacugcaaccucugcuucccaggcucaagcaauuuucauaacucagccucccgaguagcugggacuacaggugugcaccaccaugcccugcuaauuuuuuuuguauuuuuuguagaaaugggguuucgcccuguuguccaggcugguguaccucuuuuaauuauuuguuaugcagcuacuaugggacuauagccugcugaguaacaucacgaaaaauguauuagggaagacacuaguaaaagaaggacuguaaguguuguaauauuucauuauguguuucuaaaauauaaagauuaaaacaaucccaauauuauacacuaaaaaaaguaacacgcauuccuuaauaucaucaauaucaaguguucacauuucccugauuauaguuuuuguauuguuuuuacaauuuuugugaauuaggauccaaauaaggucuguaaauauuacauuggguuuagguaaucgauacuuuuuucuuuuaaucuauaaguuuuccucuaucuuuuuauugugguuauucccauacaauugguuuguugaagaagccaggucuuugcccuaugauacuucucagaaucuagauuguguugaugagaucccagugguuucauguaauauguucuuuugucccuuguauuuucuguaaauuuuguuuauuuuauuuuuuuuauuucuauuauuugagauggagucuugcacugucacccaggcuagaguacaguggcaugaucucaacucacugcaaccuccgcuuccuggauuucaagcaguccugccccagccuccugaguagcuggggucuacaggcgccugccaccaugcccagccaauuuuuguauuuuuaguagagacaggguuuugccauguugaccaggcugaucucgaacuccugaccucaggugaucugccugccucggccucccaaagugcugggauuauacguaugagccacugcacccguccuuucuguaaauuuuaauaguuaacaucuagaagucugaucugauuuagcauuaaauaaaauaacauuuuaaauaauaacauuuuaaauaauaauaauaauuauuauuuuuuuggacaggacugcacucgguuacccaggcuggagugcauggggcagucacggcucacugcagccuugaucugcugcacacaugugauccuccugccucagccuuccaaguagcuaggacuacaggcacgagccaccauaccuggcuaaauuuuuugguuuuugcaaagauggggucuugcuguauugccugggcugguuacaaauuccuggccucagguaguccucccaccucagccacucagugugcugagauuccaggcaugaguuacugcaccuggccauuuuucuguuuuuuuuuuuuuuuuuuuuuuuuuuuuuugagacgaagucucacacugucacccaggcuggagugcaauggugcaaucuuggcucaccacaaccuucaccucccagguucaacugauucuucugccucagccuccugaguagcugggauuacaggcaccugccaccaugcccggccaauuuuuguauuuuuaguagagaugggguuucaccauguuggucaggcuggucuugaacuccugaccucaugaucugccugccucagccucccaaagugcugggguuacaggugugagccaccuugccuggcccauguuuacauuuuuaaauggugggagaaaaaucauuuuuuuuagcaagucaauauuuuaggaaacucagauuucuuucucucgcucucucuuuuuuuuuuuuuuucugagauggagucuugcucuguugcccaggcuggagugcaguggcaugaucucggcucacugcagccucugccucccagguucaagugauucucccugcuucagccucccgaguagcugggauuacagaugugcgccaccacaccuagcuaauuuuuguaguuuuaguagagaugggguuuugccagguuggccaggcuggucuugaacuucugaccucugguaauccaccugccuuagccuuccaaggugcugggauuacaagcaugagccacugggcccggccaggaaacucagauuucaauguccauaaauaaaguuuuacuggaacacaggcagcacacccguuuguuuuuuguuuauguauugucuguggcugcuuuugcugcugugauggcagaauuuaguaauugugacuauauggccugccaaaccugaaauauuuacuguggcccuaaaaacauuuguugaauccagccuuaguggauacuuggguuugaggauuucuuuaggguugagcaguuaguuacaagguccccauuuacuugguggcuguuaggguuuuuuguuuguagaauauguauauuuguguaauacauaugaguauaauacacauauauuuacauguauuacguguauuauauauuuauauauuacacaucuugugcauuauauuauauauacuauacuauauaguauaguauaauauaguaaguauaguauauauuauauguagcauauauaauauacucugauguauauuauauacuauauaaucuauguaauacauguauauguauauauuuuguguguguguguguauauauauauauauauauuuuuuuuuuuuuuuuuuugagauggaaucucacucuaucacccaggcuggagugcaguggcaugaucuuggcucacugcaaccucugccuuccggguucaagcgauucuccugccucagccucuugaguagcugggauuacaggcgcccgccaccacgcccggcuacuuuuuguauuuuuaguagagauggggguuucaccauguugaucaggcuggucuugaacuccugaccucgugaucugcccgccuuggccucccaaaguguucagauuacaggcauaagucgcuacaccugaccuguauaguuguauguacgcuauuauguaguacacuaugcaagugagcauuaccgucugagcuuugcuuccuaucagaucagauucucauagugauacagacaggaggcagggaaauacuggcuagaagugggugggguaccuggugagggccccucaagcuuggacccauaacccuaaauaagaacuucacaucccuguuuuccugccugaauguuuccuuuuccauaaccacucuggcccaccacgccccuccacccuguacccauaaaaacuccaagcuccacuagcagaggaacagagugguauggcagaggagagaagagaagaagcagagaggagaagcagcagcuggacaccggagacuauggguuggagaggauuucagcuagggacagcugagcuccaggggaagauuaucuucccacuccaucccuuuuccagcuccccauccugcugagagccacuuccaccacucaauacaaucucugcauucagcauccuucaaguucaugugaccugauucuuccuggauaccggagaagaaccuggguaccaggagggcaggaugugaaaggcuaucacccugaccuuccagugagcuuaacacuuagccauccguggacagcaaaugauaaaagagcauugucuaggccgggcgcgguggcucacgccuguaaucccagcacuuugggaggccgaggcgggcggaucacgaggucaggagaucgagaccauccuggcuaaaacggugaaaccccgucucuacuaaaaauacaaaaaauuagccaggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaagagcauuguuuguaacacacacccucuggggcuccagaggucgugggcaaccaccccuagaugcugccaugagccgguaugggguuaauuccugcuggcacccaaaagcuucugcacccacucacccugugugcucccccucccacaagggguuugagcauggcagguaagcaagugagccaccccugucacaagucacgugauggggucgagggaacucugccgugucaauaggagcucgaacccuguugugaacugcacaugcaagggaucuagguugcauacuccuucugagaaucuaacuaaugccugaugaucugaggugaaaugguuuucuuucaaaaucaucuccccgcaaccccuguccauccauggaaaaauugucgucugugaaacuggucccuggugccaaaaagauugggaacugcucauaugcaugacuuuccugaaucuggaaugcacacuguguucaagaacuggaagggacugguagaaaguaugagauuaaucugaugaggagacaagagucagaucaaguagaauauuguaagccauguugaggacuuuaaaguuuaucuuaaaguaaacggaaagcuuauuuaaaaauuuuaagcaggaguuaggcaaucugaccugacuugugucuuagaaagauuacuuuggcugccguauggcauauaaagagagaccgagggaaguagaaguccaauuagaaaggcuguagcguuuauucaagcggaagauaaaaugugguguguuuugaacgguggcaguggaaaaagaagugaggagggagauucaaaauauauuuuggcaguuauggugauggauuagauuugaagagagguugaaggaagaauucagcaaaagcaguuggcuggcuggaugcauuacuauuaggaugaggaucacuggaggaggagugguuggugauaagggaaagcagaucagaaaauuaauuuuagauguauuaagauugagauuuuugggauugggcauggugacucauuacaaaguucuuguaaucccagcacuuugggaggcugaggugguaggauuacuugaggccaggaguuuuaggccagccugggcaacauagugagaucuugucucuacaaaaaauugaaaagaaaaaaaaauuacccagguguggugucaugcauccuuuagucccagcuacucaggaggcugaggugggaggagcacuuaccuaaggaguuugagguuacagugaacuaugauugcaccacuguacuccagccugggugacagacugagacccugucucuaaaaaauaaaaaaucgaaauuaaaaaaaacagagauuucuuaguuuugaagccuuugggauuaaaaaaagauaauacaauuuuuuuuuuuuuuuaguagagacagauucucccuauguugccuaggcuggucuugaauuccugagcucaagcaguccucucaccuugcccucccaaagugcugagauuacaggcaugguagugccuagcccugauuuagauuucuuagauagccaaagggcauugucaaacagguuccuggaugugugguuuuguauuucagaagagaaagugucauggggagcauaugugggcauucugguuguaggcauagaguuguguuuuuuuuuguuuuuuguuugagacagagucucacuccgucacuuaaacuagagugcagugguacgaucuuggcucauugcaaccucugccucccagguucaagugauucucaugccacagccucucgaguagguggaauuacaggcaugcaccacuaugcccaguuaauuuuuuuuguuauuuuuagcagagacggaguuucgccauguuggcuaggcuggucuugaacuccugaccucaagugaucugccugccuuggccucccaaaaugcugggauuacaggugugagccaccgcgccuggccacauagagauauuuuaagcuuugggaauguaaggagaggauauaaaaugaacgagaauaagacccaugucugagcacgguggagcaccacuuuugaagacaucugguagguaggaugggaagagccagaggaacuggggaagcugggaaggcuaaguguuacagaagccaaagaguauaucaaggagagauaaguggcugaauguauugaaugguaagucaaguaaaaugauaaaauaucuguugaauuuagcaauauggaaguugcuaaugaucuugguaaagaaauaugaugugggaaaucggaaacagaauguugggaaauuggaaacagaauguugggaaauuggaaacaguagaauguugaauagugauuggauacggacggcauuuuggaaaguauuaguaauuuggcuguaucuacuaaaguugaaaauguucauccucugcaguaguuccacuucuagcugucuauucuagaagaacucucacucauugguacaaagagaugugcauaaaaaugaucauuuagcauuguuuguaauggcagagaaaggggaaacuaccuaaauaugugucaucuggagaguagauaaguaaacuguguggauacacagugaaaauaaaugaacuacagcaauggauuaaccucauaaugcugaggauucaaaaaacugaguuguuaagaguauaccuuuuuaauaauguugaagaaauaugcaaaacaauucaguuucuuauuuagagauauauacauauguaguaaaaguacaaagaaaauuccuagcugggugugguggcucaugccaauaaucccagcacuuugggaggccgaggugggccgaucacuugaggucaggaguuugagaccagccuaggcaauauggugaaaccccaucucuacugaaaauacaaaaauuagccugguguuguggcaggugccuguagucucagcuacuugggaggcugaggcagaagaauugcuugaaccugggauguggagguugcagugagccgagaucgugccacugcacuccagccuggggaaccaagugagacucugucugaaaaaaaagaaaaagaaaagaaauuccugagaaugguugacaccaaaaucagaauagugucuacugcuuacagggggagagaauacuuggagaugugaucaggagaaguacacagcagccuucaacuauguugguaaugcuuuuauuuccuaaggugguuguuugauggguagcacaacuguucacuguauugguccuuaucuuuuaggguaacauuuuauaaaaugagugguugcugaggagguggagaaucaccaaaaguccuuuugagaagcuuggcuggagagagauguggggccaaugaagacuuuuuuuuuuuuuugagacggagucuugcuuuguugcccaggcuagagugcaguguggcgaucucugcucgcugcaaccucugccuccugguucaagcgauucuccugcuucagcuuccugaguagcuaggacuacagguuugcaccaccacgccuggcuaauuuuuguaauuuuaguagagacaggguuuugccauguuggccaggcuggucuugaacuccuggcuucaagugaucugcccgucuuagccucccagagugcugggauuacagcagacaugagccaccaugccuggccuuuguuaaaauuuuuuuaaagaagaauauguuugaaugcugauggaaaggauucguaggauucacuagagauggagaaguugaaguuguuggagaaaaaaucgcaacugcuaaaggucuagaagauagcaaaaugaggauaauuguucuuuguuaggaagauucgaguuuuuuuccuuugucacugggagggaagagaauagauguagacgcugauaguuugaaaguugaugguugauugauaaaaauauuuuucuuccauuguuuuuuauuuuuauuuuauuuuauuuuugacauggagucucgcaccgucgccugggcuggagugcaguggcgcaaucuuggcucacugcaaccucugccuccuggguucaagcgauuguccuaccucagccucccgaguagcuaggauuacaggcgcccaccaccaugccuagcuugcuugcuuguuuauuuauuuauuuauugagauggaguuucgcucuuauugcccaggcuagagugcaauggcacgaucucagcucacuacaaccucugucucccguucaagcgauucuccugccucagccucccagguagcugggauuacaggcaugugccaccauuccuggcuaauuuuguauuuuuaguagagacgggguuucuccauguuggucaggcuggucucgaacucccaaccucaggugaucugucugccucggccucccaaggugcuggaauuacaggcgugagccaucgcgcccggccaggcacggcuuauuuuuuguauuuuuaguugagaugggguuucaccauguuggccaggcuggucuugaacuccugaccucgugaucggccugccucggccucccagagugcugggauuacaggcaugagccaccaugccuggccgcuuuuuauuuucauuuguuuauuuuugagaccaggucuugcucuguuggccaugcuggagugcaguggcacaaacauagcucacugcagccucaaacuccugggcuccagugauccuucugccucagucuccaaguagcgaggacuacaggcaugcaccaccuuuccuggcuaauuuuuacuuuuuuuuuuuuuuuuuuuugagacagagucucgcucuagugcaguggcgcgaucucugcucacugcuagcuccgccucccggguucgcgccauucucucgccucagccucccgaguagccgggacugcgggcacucacccucacgccuggcgcgcgcgcgcgcgcgugugugugugugugugguacacaugggguuucacuguguuagccaggauggucucaaucuccuggccucgugauccacccgcaggauggucucagucuccuggccuugugauccacccgccucagccucccaaagugcugggauuacaggcuugaggcaccgugccuggccuaauuuuuacauuuuuuaagagaugaggucucacuuuguugcccaggcuggucuggaacuccugggcucaagcgguccuuccaccuuggccucccaaagugcggggauugcagguaugagccacugggccuggcccauuguuucuuaaagcagaaaaauaauuuauuccaaaagauggcagagagccagguaugauggcuuaugcuuguagucucagcuacucugaaggcuguggcagggggauugcuugagccaaagaauuugaaacaagccugagcaauauggcaagaccccaucucaaaaaaaaaaaaaaaaaaaaaggcagaaauaagauuuucauccugaaaauguaauuugguguaguuuuguugggaucuucccucucaacaugccuuccuacugauugccccacuggagucuuuuuugucuaguagcaguuuuuagacccgucacugagucccauguuuugauaaggcaagagccaucuucaaaucuauaaauuccaagggauagauuaauauauuucucagaagagagcaucuucugucuuggaagaguccauaaacauuguguggaaucagcacaguuuagguuaaguacacacauaauucaucaaaguguaaauaaggucaaggaaaaaguacugcauugugaaaaaaaauucaaaugugguaugaacauuuaaggcagcugaugccccaaacaggcaaagucgaagaagguggccugcauuuggaggugauuuugcauccaaaaaggaauucgcuuucuugauuucaaugacugaacacuguaaaacaugucuucuuccucaaggccaaugaugcuucagauaccaggugguuucaucuuucagucauggucuauagagaggguugcauugggccaaaauugcaaucagccaaaagagaguggcaaacugaacaggucaccaucauggugaugauaacuccccaguuaggccgcuuagugacgaacuagggcacaaagaagccaacaaagccccagaacaugcucgucacugugaggccaugauaacgcuguguuugcugcuggagcugccucucucugauuuuuaguauuguuuuuuaaucuuuguccauuaagacaagguuauuugugaaugaaaauuaggauuguggggagucacagaacuucgugaaauacuugugaggaaugggaaagaacauucaucagagaaaaacaguacaauuucacuuugggaggcugaggugggcggaucaugaggucaggagaucgagaccaucuuggccaacauggugaaacccugucucuacuaaaauacaaaagauuagccagacauguuggcgggugccuguagucccagcuguuugggaggcugaggcacgagaauugcuugaacccaggaggcggagguugcagugagccgagaucgugccacugcauuccagccuggcgacagagcaagacuccaucucaaaaaaaaaagcacaauuucugggaaacuuugagggacgaguugagaaugauuuaugaaauacaguaagaaauucacauaauacauaaggaugugaugaagaaagcaaaaauguguggaauuguuaucuuuguuuucacguuuuucacuacauuauuuuaaaccugaaggcuauagaagucucaugacuaacuuuggggcaaagguccuucugugcuaaauauugucuugggaccugauguuuuguuauuggcuuugaucuguagguguacaaccuuuguuucccugacuuguaggaagugaccucuucagacugucucauggguagagaaauucuaccaaaugaggccaagagggauuuauguacuguugaggcuuugugcuuuagcauagugcauugugguaaaguuacaguuuaauagcaguuguaauauacuggguuugaaaauaauugaaauauuagcucaaaucucauuuugacuuucagaguuuaaaucacucaauaaucuuauaguugaaugacucuguuuuucaguaggauaguuauuuuaagacacuaagugaaaaaaacaaaaaacaaaaaacauuguaacaaauucugaccuccacuugaaugggggauguuagaauacacauuuuacacuaaauaguuuuaauuuuuuguuuucgaggcagagucuuacucuguugugcagccuagaguggaguggcacaaucucggcucacugcaauuuuugccuccgagauucaaaugauucucuugccucagccucccgaguagcugggacuacaggugcgcguuaccacacccggcuaauuuuuguaguuuuaguagagaugggguuuggccauguuggccaggcuggucuugaacuccugaccucacgugauccacugccucagucucccaaagugcugggauuacagaugccagccacaacgcucgguuguuuuaaauuuuuuaaaauuaaacuugcaaaaagucauaaaguguuuuauauacuuauuuaauuuauuugagacagagucucacucaguugccacaaagugcaguggcaugaucucggcucacugcaaccucugcuucccggguucaagcgauucucgugccuccaccucccaaguagcugggacuacaggagcacgccaccacgccugaccuaaaauguuuuauaacuaauguauguguuuauaaaaaaauuauagaaugcauuuaauuccuaggaauacacauuuaaauuuuuauuuuuaagguguacuaauuuuuuuauuguggcaaaauauaaaauuuacuauuuuaauaauuuuacauauacaauucaguggcauuaaguacauucacaguguuguacaaucaucaauacugucuguuuccagaacuuuuucaucaucccaaacagaaccuccccaccucuauucuauuuucggucucuaugaauuugccuauucuaggugccucauauuaaguagaaucauacaauauguguccuuuugugucugacuuauuucacauagcauaacguuucaagguucaucuauguuguagcauguaucagaauuucauuccuuauggcuaaauaguauuccauuauguauguguguauauauaccacauuuugcuuauccguguugauggaucgucaucuguugauggacauuuggguuguuuccaucuuuucgcuauugugaacaaugcugcuaugaacauugguguacauggaucuguuugagucucugcuuucgguucuuuuggauauauuccuaggaguaaaauugcuggauccuaugguaauuauuuguuaaaguuuuugaggaacugccaauccauagcagcugcaccauugcauauucccaccagcagugcacaaagguuacaauuugucugcauccucaccaacacguguuauuuuguguuuuuguuuuuaucauagccauccuaauggguguggagugauauuguggguuuuuuucuuucacuaaacuuuacuuguuuauuaauuuauuuuuuuugagacagaguuuugcucuuguugcccaggcuggagugcaauggugcaaucguggcucaccacaaccuccgcgucccggguucaagcaauucuccugccucauccucccgaguagcugggauuacaggcuugcgccaccacgccuggcuaauuuuguauuuuuaguagagacgggguuuuuccauguuggucaggcuagucucaaacuccugaccucagaugauccgccugccucagccugcgaaagugcuaggauuacaggcgcgagccaccgugcccggccuguuuauuuuuauuuuuauuuugagauggagucuuguucugucgcccaggcuggagugcagugcaguggugcaguguuggcucacugcaaccuccaccucccagguucaagcaauucuccugucucagccucccaaguagcugggauuacaggugcccaccaccaugcccagcuaauuuuuguauuuuuaguggagacgggguuucacuauguuggccaggcuggucucgaacuccugaucucaggugauccuccugccuuggccucccaaagugcuggguuuacaggcgugacccaccaugcccaguguuguuuguuuuuaaaaguaggcagucaagugugggagugagaaggggucaaagacuagagcaagggguucagucuauaacuugacugugaacaaucaguugagauaacugacuaccuucgaaccagccucucauuaaacuuuguuucaugggucucaaaauucugagacagauucuugguuaagucgcuuccauugaacaguacugauuuuaaaaacuaguaauuuaaaacugccacaugaaaaaaacugaaaauggaucacaaaacagucaucuuuuccuucugaagauuucaccaugcacuguuaucauuaaccagucuuuuacuguuaaacuuaaauggccaaucgaaacaaacaauucugagacuguucuucuaccauugauugagacugggguggcagguauuagggaugauauucauuuagucuuccgagcuuucugggcagacucgaugauauugccagguccaggagccuucuuguccacuguuuuuguuuuuuuaauuaaaaaaaauuuuuuuuucuuuuuuuuuuuuuugagauggaauuucacucuuguugcccaggcuggagugcaaugacauggucacggcucacugcaaccuccaccucccguguucaagugauucuccugccucagccucucaaguagcugggauuacaggcgccugccaccaugcuuggcuaauuuuuguauuuuuaguagagaugggguuucacucuguuggccagacuggucuugaacuccugaccucagguuguccgccugccucagccuccaaagugcugggauuacgggcgugagccaauuuuaaauuuuuugagagagagucucacucugucacucaggcuggagugcagugauacuaccuugacucauuugaacuuccaccucucaggcucaagcauuccccagaccucaguuuccugaguagcugggaccacagacgcaugccaccacacccagcuaauuuuuuguauuuuuuguagagauggaguuucaccauguugcccaggguggucucaaacuccugagcuugagugauucuccugccauggcuuccaaagugcugggauuacaggugugaaccaccgugccugaccuucuggccuuauccucuguuuuuuuuuggagacagagucucgcgcugucgcccaggcuggagugcagcggcacgaucucggcucacugcaagcuccgccuccuggguucacgccauucuccugccucagccucccgaguagcugggacuacaggcgcccgccauuacaccuggcuaauuuuuuguauuuuuaguagagaugggguuucaccguguuagccaggauggucuugaucuccugaccuugugaucugcccuccucagccucccaaagugcugggauuacaggcuuauccucuguuuugaugacacucacagcaacuguuugucuuacauuaugaacaacaaaacaacccaaagaaggauagucagaagcucucaacacacgugugggcuugccaggaauuuuaucaaagaugggagcauuaccagauuucaagaauuuagggccaucuuucaccuuaccagaauggcaauccgucuuucccuucagcucaggaaacuugcaggcagugugagccauguggcaauccauuacaggagcauagccagcacugauuuggacugggugguucaggauaaucaccugagcagugaagccagcugcuuccauuggugggucauuuuuccugucaccagcaacauugccaugaugaacauuuuugacagauacguucuugauguugaagcccccauuguucccaggaaaaacuucacucaaagcuucaugguauauugcaacagauuuggcuuuaguuguaacauugacuggagccaaggugaccucuaugcugacaccagucuccacuuggccuacagagauaguaccaauaccaccaauuuuguagauauuuuggagagacagacacaagggcuugucaguuggacaaauugguaguaggaugcaauccagagcuucaagcaggguguuuauacuggcauuugccaucuuuacaggugacuuuccaucccuugaaccaaggcauguuagcacuuggccacagcauguugccaucauuccaaccagaaauuggcacaaaugcuacuguguugggguuguggccaacuuucuuauuguaagggcugacuuccuuaaccauuuccuuguaucucuucuguuuguagggcggcuaaguggaauccauuuuguuaacuccagcaauuagcuguuucacacccaguguguaagucagaaggagauaccagcuucaaauucaccagcugcaacaaucaggguagcacagucagccugagaugugccuguaaucaugcuuuuuaaaaaaucuuugucuuggggcgucaacuaguuacauaauacuuucuggccucaaguuuccgcagggaacugucaucagugccaccacccucacacucagcuuucaguuuauccaagacccagguguacuugaaggaccccuuucccaucacaguagccuuguagagacugggucucaucauguggcccaagguggucuugaacuccugagcucaagcgauccucaugccucggccucccaaacugcugggauuacaggcaugagccacugcacccaggugauaaaugguauuuugucaaguggcaggauuaauaauaucugacaugggccgggugcaauggcuuacgccucuaauuccagcacuugggaggccgagguggguggaucaccugaggucgggaguuugagacuagccugaccaacauggagaaaccccaucucuacuuaaaauacaaaaucauccuggcaugguggcgcaugccuguaaucccagcuacucgggagguugagguaggagaaucacuugaauccggcaggcgaagguuguggugagccgagauggugccauugcacuccagccugggcaacaagagcgaaacucugucuuuaaaaaaaaaaaaaaaaaaaaggucaaaaggacugaguucagggggcuuccagaaagguaaccuagaacauguucauguagugagaggguggcacaccuuucuccaagggaauugaagcuccuucaccauuguacaucuugccucuguaacucuucauuugacgguuuauuuauauccuuuaaaauaacauuuguaagagccuaguaaccagguuuccauuaauucugugagcuucuccagcaaauuauuaaaacugaaggaagggguugcagaacccugauuuuuagccaguuggucagaagcacagguaaaaacaaccugggacuugggauugacaucaaaaguggggagcagccuuggggacugaacccucacucaaccuguggggucugacaguaucuccagguaggagacagagaacacccagcugguauuuucugaagaauugauugcuuacuuuuuuuuuuuuuuuuugagauggagucuugcucuguuccccgggcuggagugcacuggugcgaucucgucucacugcaaccucugccuccuggguucaagcgauucuccugccucagccuccuaaguagcugggauuaaggcaugugccaccaugcccugucaauuuuuguauuuuuaguagaggaggggauuccccguguuggccaggcucaucucaaaugccugaccucagguaaucugcccucguuggccuccuaaagugcugggauugcaggcgugagccaccgcgccuggccaauugcuugcuugugcgugcgaaaaaaaaccccacacaucugguguuagaaggauguugugagaguauugugugagaaacugaguuuguuggcugggcacuguggcucacaccuguaaucccagcacauuuggaggccaaggugagcagaucucuugagaucgggaguuggagaccagccugggcaacauugcgaaacccugucccuacaaaaauacaaaaaaaguuagccaggugugguggugugugccuguaauuccaguuauuugggaggcugaggcaugagaaucauuugaaccucggagucugagguugcagugagcugagauugugccacugcuuuccagccugggagauagagugagacacugucucaaaaaaaauaaaaaagaaaagaaaagaaacugagcuuguuuauuccuguauucucauagcuauaaaauaguuuugcccguuugacaaagauauacuucagauugacucauuuaaauuucauguuaacguuggaggaguugaaauuacuggaauuauugcuuuuggagaaaacuuauuucaucuuagccagagauagugaugguaagagacacaggaggcaaaaaaaaucgaaccaauauauuugauacaaaaagaucagaaaaaaauagagaauaagcacuauaacugguauauuaauuuuuucuuuucuuucuuuuuuuuuuuugagauguaguuucguuuugucacccaggcuggaguucagugaugcaaucucagcucacugcaaccuccgccuccugaguucaagcuuuucuccugcaucagccuccugaguagcugggauuacaggcaccugccaccaugccuggcuaauuuuuguauuuuugguggagaugggguuucaccguguuggccaggcuggucuugaauucuugaccucaggucauccgccugccucggccucccaaagugcugggauuacaggagugagccacagcacccgaccuaauuauuacagugaguuaauuuaguucuuagcuuccugguagccuuauaaguguucacuugugugacuuugauuguuuaaaaaaccaguuucuuugacauugaauuacagaaagaauuuuauuauaggaaucaccuauuuuuacaagagauauagaaauacuucuugaaugauuauuucagugcugcucaaucuauaaaauaaaaucauacuuuauuuuuuguuuuuauuuuuauuuuuuuuugagacggagucucccucugucgcccaggcuggagugcaguggugcgaucucgacucacugcaagcuccgccucccggguucacgccauucuccugccucagccucccgaguagcugggacuucaggcgcccaccgccacgcccggauaauuucuuuuuauauuuuuaguagagaugggguuucacuguguuagccaggauaucucaaucuccugaccuugugaucugcccgccuccgccacccaaauugcuaggauuacaggcgugagccaccgcacccggccuuuauuuuuauuuuuuugagauggagucuugcucuugucacccaggcuggaguccaguggugcgaucuugacucacugcaaccuccgccucccagguucaugcaguucuccugccucagccuccugaguagcugggauuauaggcaccugcuaccacggcaggcuacuuuuuuguauuuuguaguagagaugggguuucacugcauuggccaggcuggucuugaacuccuuaccuccagugauccgcccgccuuggccucucaaagugcugggauuacaguuguaagccaccgcuccuggccuuaagccaaaguucaggcucaugccuguaaucccagcacuuugagaggccaaggcaggcagaucaccugaugucuggaguuugagaccaggaguuuggccaacucggugaaaccccaucgcuacuaaaaauacaaaaauuagccgggcgugguggcaggugccuguaaucccagcuacucaggaggcugaggcaggagaaucaauugaaccugggugguggagguugcagugagccgagaucgugccaucgcacuucaaccugggggacaagagcgagacuucgucucaaaaaaaagaaaaaagaaguugcagaucuuucaggauuuaaauuuaaggaaacugguaguuaacauauuccuuagucucucagguauaaauaacuuuguauguuggcagaaccauagcccaagaggccuauuugaagccugguuguuagugauauaaaacuauuacuugguucaaaugugauggaguauaauauguucuuugguuuuguuuuaugaauacuuaaguuuugugguauucuuuaaagauugaaauagaguucuauagagugcuaaguauuagcgaaaccaaagaaauccuguuuaagcuuauuagaaaauuguauacauuaagcuuauuagaaaauuguauacauacaaaacaauuugaaaacauaucugaaacacuuagaacauucuuuuuuuuuuuuuuuugagaaagggucucguucugucucccaggcuggagaucaguggcacaaucauggcucacugcaaccucugccuccuggauucaagugauucucuugcuugagccucccgagaagcuauuacagguguccaccaccacaccuggcuaaauuuuauuuuuaguagagaugcaguuuugucauguuggcuaggcaggucaagcgauccucccaccucgggucccuuuuuuuuuuuuuuuucuaaacauuaaauugccuuuuuuuuuuuuuuuuuuuuuugagaugagucucucucugucgcccaggcuggagugcaguggugccaucucagcucacugcaaucucugccucccggguucacgccauucuccugccucagccuccugaguagccgggacuacaggcgccugccacugcaccuggcuaauuuuuuguauuuuuaguagagacgggguuucaccguguuagccaggauggucucgaucuccugaccuugugaucugcccaccucggccucccaaagugcuggguuuacaggcgugagccgcucaggccguuaaauugcuuuuauugcaugacacuuaguaugcaaaucaggagguuuuaauuuuaaauguuugcuuucacuaguucuaaccacugauuaaaguccucaaaaguacuugguugcucucaugccuguaaucccagcacuuugggaggccaaggugggaggaucacuugaggucaggaguccagccuggccuggccaacauggugaaauccugucucuacuaaaaauaaaaaaauuagccagccauuggcaugcaccuguaaucccagcuacucaggaggcugagguaggagaaucgcuugaacccgggaggcauagguuguggugagcugggagaucgcaccaccgcacuccagccuggaugauagagcaagacucuguuucaaaaaaaaaaaaaagaguauaauacugcuuuguuacuaauucuaauuuuauaauuauaguuucugaugaacuuuaauuuucugauuugauuuaugaauuauaggccagaaaugcuccacacauauaaccugauuguuucuuucugggcuccagugagccuuuuuuuuuaaaaaaaaaaacaaaaccaggucugauuauuuaaucugucuccagggaagaguguugcagauucccugguaaucccuagugccagaguuugccagccuuuacuaccauugucuguuuaaucaaaauccuugcugcuauaaauuggcuguauuucucuugguuuguucuagugaaaauaagacaaacuguccugauuauagagaugggacuuccauuuuccccucacuccaaagacuuccuuuuucaauacaaguuuaguugcuguuacuaauccaaguuaauuuuugauucuaucacugaaaaccuggguuuugccauuuauugagguguuaauugaaauauuaauauauuuagagcagaaaugucguuuuuuagggaaucuagagcaacagcaaagcugaggucaaacuaccguaaggauggacaccaaggaagcuguguuugggacaaaaagaaaucaagauaagguagaugcaaaguagagaaaagaacuggacccuggggggaagggugguaguugggaguggguuauaugcuucuaagggcaaagaauaggcagauuucugaagaggagggcccaaaaggaaauacugaggauuuguguucaaauacuacguucccucugaauguacaaguuuuugcuuuuagcuaacagaguacuucaaacauugauaagguuaaguguuuuguugggguggguucuaauauucugggcuaguguuuccuuggaauaguuguggaagacacuauugguauuuguugauaaaaccauuaccaaaacccagcuucagcacuaaugccuguuauuacuuggaggucaaaagggaaucugugauugaaguguuaagcugacaaaaucuguacagaauauuuaauuuuuccuuuuauuucugugauacaaagauuguguuucuuuucauagcaacaugaaccgugaagaccggaaugugcugcguaugaaagaacgggaaaggcggaaucaggaaauucagcagggcgaagacgccuucccaccuagcucuccucucuuugcagagccauacaaaguuguaaguugcccuucugugaauguuuuuuucccauuagcaugacauuuuugcuuuuaaaauguuucacacuugaauguuuauauuagaaaagaauuacuaugaauaccacuuaacauuuuuuuccuguccuuuacauagaagauauuuuuuggggauaaacuuuucuuuggaguauauuaugcuuacagaaaaauacacaacauagguauuauggcuugaagaauuuucacagcaucaacagcuucauacaacucagaucaagaaauagagcauuaccagcacccuaaaagucguuuuccaacccaccuccuauugcuguccuguguucuuaaaaauguggucugaguuggcucauacauuuaccucuauuuuccuaguugugcuacuaaccaucggcggguacuucaccauucugaauuuugaauuaaauuagaauuuuguaacucaauuugcauuguuugauuuuuccuagguguucuuuaagugugauaucaauaaaaaaugaauauuucauagaugcuuuuguuucuucucacugccauuugcuacuuaguuuacaaaguuucagagauuauuaguauguuugaauaaaugugucuucaguaucagucugauuucuuuuucuguuguuauagacagucauuuggguaucacuuuuuucauuaaauuuuuguuucugcuucuaacuauaacauugaguuaugaggaauauaauauuuucauaaacugccaaaauacgaauguuagcuaaucugcuggacuguggaaguuaauuuuuuuuuuuuuuuuuuuuuuuuuuugagacggagucuugcucugucgcccagguuggagugcaguggcgcgaucugggcucacugcaagcuccgccucccggguucacgccauucuccugccuaagccuccagaguagcugggacuacaggcgccugccaccaugcccggcuaauuuuuuguauuuuuaguagagacaggguuucaccauguuagccaggauggucucgaucucuugaccucaugauccgcccgccucagccucccaaagugcugggauuacaggccugagccacugugcccagcuggaacuuaauuuuauaaaggcagauuacuuuucuguucuucaaaaguuuuuuuuuuuuuuuaugagaaggaaucuuguucuuucgucuaggcuggagugccaugucaugaucucggcucauugccaccacugacuucuggguucaagugauucuccugccucagccucucgaguagcugggauuacaggcgugcaccaccuugccgggcuaguuuuuuuuuuuuuuucggagauggagucuuacuggagugcaaugacgcaaucucugcucacugcaaccucugcuucccggguucaagcgauucuccugccucagccuccugaguagcugggauuacagacacccgccaccacgccuagcuuauuuuuguauuuuuaauagaaacgggguuucaccauguuggccaggcuggucuccaacuccugaugucaggugauccgcccaccuuggccucccaaagugcuggaauuauaggugugagccaccaugucuggccacacccggcuaacguuuguauuuuugcuagaaauggguuuucaccauguuggccaggcuggucuggaacuccugacaucaggugaucuguccgucuuggccucccaaagugcugggauuacaggugugagccacugcaccuggccuuucaaaauacuuuguguauuuaaaagacagucuugcuauguuacccaugcuggagugcaguugcucuucacaggugaaaucauagugcacuggagccucaaaaucuuggaauugagcaaaccugccucagcugcccagaguagcugggaguacaggcacgugccacugugcucggauuauauuuuacuaugguuauuuuuaggcacuuuucaaugauuuuuuuuuucacuacagaaaugauauauuuggaguuugcuucaagguauuaacguuaagauaugagguaaagccucccuuugaaaagccccuuuccauucgaaguuuggaaaauuaguucagaauuauauuuuauuucugauuaugcucauuuuauaauuuuauuuuauuuuauuuuuuuguagacuagcaaagaagauaaguuaucaagucguauucagaguaugcuuggaaacuacgaugaaaugaaggauuucauaggagacagaucuauaccaaagcuuguugcaauucccaagccuacaguaccaccaucagcagaugaaaaaucuaacccaaauuucuuugaacagagacauggaggcucucaucagaguagcaaauggacuccaguaggacccgcacccagcacuucucagucucagaaacgguccucaggcuuacagaguggacauaguagccagcggaccagcgcagguagcaguaguggcacuaacaguaguggucagaggcacgaccgugagucauauaacaauagugggagcaguagccggaaaaaaggccagcauggaucagaacacuccaaaucacguucuuccagcccuggaaaaccccaggcuguuucuucauuaaacucuagucauuccaggucucaugggaaugaucaccauagcaaggaacaucaacgcuccaaaucaccucgggacccugaugcaaacugggauucuccuucccguguaccuuuuucaagugggcagcacucaacucaaucuuucccacccucauugaugucaaaguccaauucaauguuacagaaacccacugccuaugugcggcccauggacggacaggaguccauggaaccaaagcuguccucugagcacuacagcagccaaucccauggcaacagcaugacugagcugaagcccagcagcaaagcacaucucaccaagcugaaaauaccuucccaaccacuggauguaagucacacauuuagagcuuuuaacauugugacuacgugaagcaauugacugaucaugaaauuacgauugaacuugaacacugcuuccuugccuuaauaguaaggaauguaaaaguugaaagaugaaaaaaauguaaagacagacuugugaguuacucccaaguggaugcguagaucuguuaacucguccucuugggaaauggagaaaaugucauucacaguuuucaaauacuuagaugacaagucaguuauagaauaaaagaaugacuaauugauaucuuagauuucugcauuuugauuuuauagaacaauauaccuuuguuguuguuuaaaaacaaaauuaacuuuucuaugcuuagauugauacuaaugaaugagaugcaggugaugguuuaugguuaugauaaaugggacuuuugggucuguggaaauaguaauauuguauacuuugaaugcuaugauccuuuucucugguuauacuuaaaggauuaagacagcugcuccagguucauagugaugguuugaaauuuaaauugaauugcuuaccaaagcauuuuggaacauuucauugugaaauagcugaaauuauaucuuuuuuuuucaagaugggugucucauaauguugcccaggcuggucuggaacuccuggccucaagcgauccucucaucuuggccuucaaagugcuaagguuacagacaugaccaucaugccuggcccaaauuuuaucucucucuuuuuuuuuuuuugaguuggaguuucgcucuuguugcccaugcuagagugcaacggcacgauuucggcucacugcaaccucuaccucccagguucaagcgauucuccugccucagccucccgaguagcugggauuacaggcaugugccaccaugcccggcuaauuuuguauuuuuaguagagaugggguuucaccauguuggucaggcuggucuugaacuccugaccucacgugauccgcccgccucggccucgcaaagugcugggauuacaggcgugagccaccgcgccuggccccaaauuuuaucuuuuaauguaguuugugcaauaaaaaaaaauuuggaaagugacgucaguagccaaaaaauuacaacucuuagcucaaaaugguggaaggaagaaucugcguaauguaaaaugcuguuuugcaaacauuuaaaacaucuuuccaguggccuugggaaacucauuuugaguggcauuuguuaucugauuacuccucucaagagaacaguaaaaugguaauuuguucuuuccuuaaacaacaugaucuuuagaguuugacuugaguucggcucucuaauuccuguuugugccuuagaauaagcaauuugguuuuugugacuuagaaagacuauguaaaauguccauguuccagacuaguaaucuuucaguaauacuuguuuaacccauuuaugcuugguguuccauuauuggaaugcuaagcucguaggaguuacuuacguccuacugcucaaggucaucgcuaagguacgauuuuucacacaaaaaauuugcagccucuggcauaaauggguuaacuuuguuuaugugaaaugauguaucucaguaucaugauauguuuuauauauagguaagauuaaauuuuuagacaagcugcacaccugaaaaauuacauucuaaaaauuauuucuaaucuaaaauauaggauaaaaaacuuaaaaccuuugaaaacuauaaaguucccccagcuuuguauaguuuggugauuaaaauuuucuggugcuugaaaaauuuauauuuaaggaaauuaauccaaagauucuaaccaguguacugauuuagaguaguggggucauaaauacuuuuaauaauguuuuuaaaucugugaagcaaauacuaaaaaucuacugauaaaaaucuaaugugugcugcuuuuucuuucaaggcaucagcuucuggugaugugagcuguguggaugaaauccuaaaaguaaguuuuuuaaaaaaaaucauuucaauuucuuuaauuuuuuaugcucugccaccuucuuacccucuuucuaccuguauuucacaaaggaucugaagcaacagauugcuuauauuuguaacuugauuauguccaucauaaauaauuuacucucuucuuuguuuaccauuugccuucagagagcuaguuuuguucuuuguguuuuuuuuuguuguuguuguuuguuuguuuuuugagaugaagucucacucugucgcccagccuggagugcaguggcgcgaucuuggcucacugcaaccuccaccucccagguucaagcaauucuuuaaccuuagccuccugaguaggugggauuacaggcucccgccaucaugcccggcugauuuuuguauuuuugcggaguugggguggccaggcuggccuggaacuccugaccucaggugauccaccugcuucggccucccagagugcugggauuacaggugugagucaccgcgccuggccgcguucuuugcuuuuaaguaaaauaaauuuuaaucuuaacacuuacuuugccuggaaaacauuaacaagccaauuauaacuguacuuucucaugcuuaacuguuaauaauuugaagugcaaaaaacucaguaguuaucagucaaaccauuaugaucaaaauaccuugcuuugguucaucuuguacauacuggucaaaucuuacaguaauagauuuccuuccaguuuugcacauuuauuuuuucuugauauggagucucacucuguuacccagucuggaguacaguggcauuaucuaggcucacugcuaccucugucuccuggguucaagcaauucuugugccucagccuccugaguagcugggauuacaggugcccaccaccauguccagcuaauuuuuguauuuuuaguagagaugggguuucaccacuuuguccgggcuggucuugaacuucugaccuccaguuacuccccacucccccauccuccugcccggccucccaaagugcugggauuauagccugagccacugcacccggcugcuuuacacauuuuuuuuuuuuuuuuugagccagaguuuuacucugucacccagguuggagugcaguggcgugaucucagcucacugcaaccuccgccucgcagguucaagugauucuucugccucagccuccugaguagcugggauuauaggcaucugccaccaugccuggcuaauuuuuuuuuuuuuuuuuuuuuuuuaguagagauaggguuucaccauguuggccaggcuggucuggaacuccugucugccugccuuggccucccaaagugcugggauuauagguaugagccaccacgcccagccaacauuuuggguauuuaaugacacauguuuaaaauugacacaugaccaaaaaguacauuacucuauuggaaaaagagaaaguccagugaauuagugaaugacaaugacuacuuuuugcuuaguagagaaaacugucagucacauauuacuuguauuuucuuuuuuauuuuuuuuugugagcuccugaauuugugucuauacuuaaauucacugugaacaccuuugaaagacuaccugcauugguugcuuccacucuuuucuuucccauuccuuccuuuagcccacuauaaucucccuuuuaccucugccauuuugcugaaccuguuucucuauggucauuaucuuucucccuccauccagaggcaucauuugaguucuuuuuuauucuuucugcuauguauuuuuuccuucugcaaacauucuucuuuccuugacuguuuuuaugcuucauuguuuuuauuugccuuccaccuuucuugccucucuuucuuugcccuuuuuggaacccuugugccuucucuuguuucuuaagugcaggugcauucuucuagccucugcucuuugacuugccuuuuccaccauucuuggcuuuaucucuuagacagcuauuuagucuuucuguccuacacuggccuuuggguuuugguuugucucuuaauugcuucuuagcugaguuuccauuuggauuuauuucucuuugccucuucagacucaacaugucuaaagccauacuuaucagacuuccuuggauuaguaguacaccguuuucccaugcuuguaacuguagaauccuaaauaucucuaauuucuuccucauguucuauguaguugcaaaacuagauguagacuuuaaaauuuuugcuuuuuaaauauccauuccuuucuucccguuucugccgccuugagcuucaguaauuauaacagaggccucauucagccuuucugccuccagaaucucccuacucauaugucuuuugcauugcuaccugauucuuuacuucaggcccuguggucuucauaaauuaauuuuucccuaaaaauuuucaguggcucucuaagauuauagaaagaauaguauccaaauuuaauauccgcaggccaauccuaaccucucucauuacugacugaccgcuuuugcuaaacugguuucccuaagccacauacauucuuucucuuuuaccuccuuaaauaaaguaagcuuggaauguauuucuccucccucuucaguuauauauagauuuuuuuucccuguaaucccaaugaaauacuucuucccccguaucagauugugagaccacagugauagcucuuucauuugaaucucauucauuucuuaguugccauguauauaaaaaguguaagggagcauaaauauuuuccucugaauccucaacaguucauagaauuauuaguauguggaagauuuucuuacauuuaaugaucucuuuaauguuauugacauccauauuuuauaugugcaggggcuuggcacuuggccuuuaguuaauaggugcucagucauucgaugauaauuggagaauuaaaucaaauuuucaguugagaguuuugauauuugagauauaaaaugccaauguuaaaaaccugaguuuaugaauuuuuguuuccuuuucccuuuccugucuguaguaugcaaggaacuucagguguguguucccuucauguuuucuuuguauuuguagucauaucauuuuuaggaaccccaucaugaacuuaaaaaaaaauucacucuaaauguauauuuauugaaaaaaugauuuauucaaggcaugcucauuaagcaccuacuuugugucaaccacugggaauacaguggucauaauguuaugccuuugagcugauauucuagagcuggauguaggaagcaaucuauuacauaauauuauuucaggaagugaaauucuauuaaaaaucaaagcauuuuaagggaauaaagagcaauuaugugcagguggcuguuuuaagagguucaaguaguaauauaucaagugcccuugucucuuccuucugucauucuguugcccaaagcuaaacauuaacuaggacguagacugauuugucuuugucacuuaauaaaauacuguggacaucauuacauaucaacaguuaaauuucucauuuuaaugucugguguucuauuuuauagaugucugguaauuuauuuaaucaguacuguguuggugucaaccuaaauaacagaggcucucugaaagaaaagaugaugggaauagagcauugcaguggaaauacaugugccauaguagucuauggucauauucaaagagguaaagagagacaaagguuuuugaaggaaaaaaugaggaagauuacauaauuguuuuugaaauaauuauccuuggcuacaaagaucacuaguaaggaugacaccagucugaggucggacaagcuggacagauguccuuguggaaauauuuuuuugguuuaagguuuugaugaccuuugugcaagguugugguuuuuguagauuuuuuuguuuaucaggcauacaagcaugagaagccuuucuucauggucuuucccagcucaggguguuuuggguuuuuuuuuguuuguuuuuuuguuuuuuuuuaaauauauaaacauuagugacuccauuuugauucucacaacuuucacauugacuaccuagguuguuucaguuuuugaagugugagccccuuauacguauaucuuuacaaaacuguguggauauugcuaugggauaaauuccuagguguuacaccacuguuaauuuguugcauuuccuuaauuuaccugauggcuuacuuugaacuaaaugccagaaauaauauacucucuccuuauucugauacuucugucuccuuggcuuaucuaacauacacauuguaaucuuaccagaccucacccagacauauuuggcauuaagauuaggcagaaggcauugaaugaaaucaaacuuagggucuugcuuuucuguuuuccuccucaugugcuuuugaaauuucucuucugauuucuuccccugacaaaauuuuucuacgaguauauauaggcucuauagccagacuuuugaggaugaaauauaauguucauuauuuacuaaguguauggccuugaauaaauaacuuuugugcuucaguuucauccuaaauagagguaggauaauaaugguaucuaccucauaaugucauugugaguacuaaaugaguaauaaacauguaaaacacuuagcacagugucuggcccauucaagguacacaguaaauguuagcuguuuuccuuaucauugucccuuccucccacucuccuagcaagcucuuccugauuagcguuuuauuaugugccuuguauuugauuacaggcugauuucuguaacuauucacagguuucauaauuugaauuguaaacuccucaaagccagggagcauuuauuaaucuucuuauuaccuacaccauagugccuagcacacaauugugcuuaauauuuauugacuaaguauguagaauuuuggaggagcugucaugaaaccaguauuuauaaauacaaaucugguuuuuagcuguauaauuuuuauccuugaccugguugaaaacaaacuguaauaauuacauuucaggagaugacgcauucauggccucccccucuaacggcuauucauacaccaugcaaaacagaaccuuccaaauuuccuuuuccaacuaagguaaguaaauaaaauguaucuuucauaauguaagaaaacucuaaauggcuugacuaaaaucauauggauuaaaaauugucuugccauuccuauucuagugggagacagacaguaaauaagugaauaaauagauaaauucagauagugacaacuguuaugaagauaauuagcaggguaauggaacugagagcaucuuggaucaagagguauuaagaaagcuuugaaggcaauaugcgagagagauuuaaaagacauuaauacagccggacacgguggcucacuccuguaaucccagcacuuuggaaggcugagccaagagacucucuugaggccaggaguuugcgaccagccuggucaacauagcaagacccugucucuaccaaaaauuggaaggaaaaaaaaaaaaaaaaaaaaaaaaaagcuuggcauaguggcacaggcccguggucccaguuacucgggaggcugagaugggaggaucacuugagccugggaggucaaggcugcagugagcugugauugcaccacagcacgccagccugggaaacagagcaaaauucuaucuuaaaaaaaaaaaaaaaagacagugguauuuauugcagacuauuaugguauuguaggccagaggugguaagggcuucucaaacuguuguuuuaagaaccuguuuccauaagacauagcaaccauacuugucccguggaaagagguuccucagauaacaguuccaagguuguuuaaaaucagcagauugacuuuuuuuuaaacuuauacuuaacaguauuaauuuacacuuaaaacaaauaauacagaaauacauucuccuugugaaaguuuuaccagucccccuaauaauagccuuuccccaauuccguccccuucaucccaacagagcuccuuuccuaaguaccuuugcaagucuuuuuuauauucauguaauacauauauaaucauuacauguaagcauuuucuuauuuauuucuacgcaaauauauuguucuguaucuuucaucagucagcaguaggucuuggggaccuguccauguuacugcauguagagguauuucguuucuuuuuauugcaucuuuaguguuaauauauccuaguuuauuuagccauuucucuuugguauuuaagcugauagcaaguuuucauuucuauaaauguuucuucaguugguaucuuuguuggugccuucugugugcaugugauuuucuuuaggguagaaagcaaaaaguagaauugcugaguguugagaguauauauuuaauacauacacucacaaauuccuuccauaguucuauuacaggauuuguaccagccaguauucccacuuguauuaccuguuguuucacacaugcacaccaccauuugauauuauuaaacagcaguguuuugaguaaaaauggcauuccauuugcuugauugcuagugagguucaucaucuuuacauauuuguuauccauuugguuucuuuguggguaaauuugcuuauucucacuguccuuuggguugcauuuuuuaccuauugaguuuuagguggucuuccuuuuuuguuuuguguuguuuuguuugaauuguggauucuaauaauuucuuauacaugcugaaaauuuaucuaccaguuagauucuugucuuuuuauugucuaaaguuuuuaauuuuugaugaauaaaauauaucuuucucuuccuuuauaguuuuugcuuuuaaugucuuguuaaagaagacuuuucuuucucuaggaucauaaacauacccucuuauuuuuauuuuaaugugguuuuuaguuuuauuuuuuauguuuaccuuugugaaugaugucagguagauuuaaaaauuuucugucuauaugugugccauaucacucuuaccuuuuauaucuuuguuuacauauacaaaaugcaccgguauuuauuuauuuauuuauuuauuuauuuauuuuucugagauggagucucccuuugucacccaggcuggagugcaauggugugaucuuggcucacugcaaccucugccucuuggguucaagcgauucuccugucucagccucccgaguagcugggacuacaggugcccgccaccacgcccagcugauuuuuguauuuuuaguagagacaggguuucaccauguuggccaggcuggucugaacuccugacgucaggugauccacccgccuuggccucccaaagugcuaggauuacaggugugagccaacgcaccuggccaaugcacuguuauuuaaugugcaguuugaguuuuguuuuuuguuaguuuguuuugagauggagucuugcugugucaccuggugcgaucucgacucacugcaaccuccgccuccuggguucaagcgauuuuccugccucaucuucuugaguagcugagauuacaggcacacgccaccacgccuggcuaauuuuuuguauuuuuaguggagacaggguuucaccauguugaccaggcuggucucgaacuccugaccucagguuauccacuugccuuugccucccaaagugcugggauuaacaggcgugagccaccgcgcccagccugcaguuugaguuuugauagauaugugcaccuguauaaccaccaccauaauuaggaauuagaacauuuccaucacccccaaauuucuucauguuccuuuguagucucccucgccuccaccacugucccuaugcaauuucugaucuauuuuaugucacucuagauaaguuuugcuuuuucuagaauuucauguaaauggaaucaguacaucaugugcuucuuuuauauauuuacuuucuuuugcucaguauuuaguuuuguaauucuuccauguucuugauuauauccaugguuucucuuuuucuuuuucuuuuuuuugagacagagucucagucuguugcccaggccagagugcgguggcaugaucucggcucacugcaaccuccgccuccuggguucaagcgauucuccugccucagccuccuaaguagcugggauuacaggcaugcaccaccacgccuggcugauuuuuguauuuuuaguagagacgggguuucaucaugcuggucaggcuggucucaaacucccgaccucgugauccaccugcguuagccucccaaagugcugggaucacaggcgugagccaccacgccuggcccaguuuuucuuuuuuuauucccaaucaguauuuuauuauauggaaacaccaaaauuugcuuccuguugaugagcauuuggguuauuuccagauuuagacuguuaagaauaaagcaucuauaaacauucauguuuucuuuuauccuggguaaauacugggucacauaguaaaaaguagaauugcugguucauaggguaagugcauguuaaauuuuacuuauuuauuuuauuuuaauuuuuuagagacugaggucuugccuaggcuggucuuaccuaggcuggaguacaguggugugaucauauagcucacuauacccuugaacuccugagcacuagcaauccucucauuucagccucuugacuaccacgcacuacaggugcuuaccaccaugccagacuuacauagagacgggggucucacucuacugcucaggcuggucucaaacuccugacuucaagccauccuucuguuucagugucccaagcacaagcuacugugcccaccacuaaauuuauaguaaacugaaaacuaacucacucacucacugacucccucccuccuuccuuccuugcuuucucucucucucucucucucucucucuccuuucuuuccuuucuuucuuugcgacagggucucacuuugucauccaggccgcagugcaguggcgggaucauggcucauugcagccucgaccucccaggcucaagugauccuccugccucagccuccugaguagcgggaacuacaggcaugcaccaccaugccuggcugacuuuaaaaaauuauuauuauuuuuuugagacaaaguuuugcucuguugcccaggcuggagugcaguggugcaaucuuggcccacugcagccucugccuaccagguucaagugauucuccugccucagccuccugaguagcugggacuacagguacgcaccaccacgcccggcuacuuuuuuguguuuuuaguagaggcgagguuucaccauguuggccaggauggucucaaucuccuuaccuccuaaucugcccaccucggccucccaaagugcugggauuacagaugugagccacugugcccggcccccauucuuuuuaauuacuaagguaauauucaguuauguggcaucauaauuuaccuaauuaucuacuaauggacauuuggguugcuucuaguuuuugguuuuuuuuuuuuuuuuuugagauggagucucgcucuaccgccagacuggagugcaguggcgugaucuuggcucauugcaaccuccaccuccugguuucaagcaauucuccugcuucagccucccaaguagcugggacuacaggcacgugccaccacgccuagcuaauuuuuguauuuuuaguagagacaggguuucaccauguuggccaggauggucuugaucucuugaccucgugagccgccugccucggccucccaaagugcugggauuacaggcaugaaccacugagcccaaccucauuuuugguuauuaaaaauaaagcugaugugaauauuuguguauaaaucuuuguauaaauguauacuuuuauuucuuucuuuuuaagacaaggucucuguuguccaggcuagagugcaguggcaugaucauggcucauugcacucacgaacucccggacucaagcagucucucaccucagccucccaaguagcugggacuacaggugcaugccacuaugucuggcugauuuuuguauuuuuuuguagagacgagguuuugccacauugcucaggcugcucuugaacuccugggcucaagcgguccuccugccuuggccucuuaaagugcugagauuacaggcgugagccacuacaucuggccuguuuuuaugucuguauuauaaaugccuauuaguggggugguuagguauaugguaggugucuaugccucacaccuguaguccuaguacuuugagagguugaugugggaggaucacuugaguccaggaguuugagaccaguguaggcaacauaaugagacucugucuccacaaaaaauuaaaaaaaaaauuacccaggcaugguggcacaggccuguagucucagccacucaggaugcuaagcugggaggauugcuugacugcagcugguugaggcugcagugagcagagaucaugccacugcucucuagccugggucacagagacugacucucucugggggggaaagaaaaaauuagaaaacaacugucaugcugggcgcaguggcucacgccuguaaucccagcacuuugggaggccaagguggguggaucaccugagguugggauuugagaccagccugaccaacauggagaaaccccaucucuacaaaaaauacaaaauuagccaggcaugguggcgcaugccuauaaucccagguacuuggaggcuaaggcaggagaaucacuugaagcugggagguggagguugcagugagccgagaucgugucauugcacugcagccugggcaacaagagcgaaacugucucaaaaaaaaaaaaaagaaaaaaaaaagaaaacaacugucauacuauuuuccaaagugguugaaccauuuuuuauuccugccaaugguauaugagaguuccacuuguuccauguccuuacuaacacuugauauugucagucuuuuaaaacuuuagccuucuagcaguauuauagugguaccucauugugauuucaauuuacauuucucuagagacagaguaucuugagcaucuuuucauguacugauuugccauuugcuuaucuucuuuggugcagugucugaauauuuugcccaucuuuggugcagugucugaauauuuugcccauuuuuaaaugggcuaagauucuuuuuuuuuuuuuuuugugacagagucucgcucugucgcucaggcuagagugcaguggcgcgaucucggcucacugcaagcuccgccucccgaguucacaccauucuccugccucggccucucgaguagcugggacugcaggcgccugccaccaugccugacuaauuuuuuguauuuuuaguagagacgggauuucaccguguuagucaggauggucucgaucuccugaccuuaugaucugcccaccccggccucccaaagugcugggauuauaggcgugagccacugcgcccggccugaaaugggcuaagauucuuacugccauuaucauauaugugauuugaaaauuuuguuuucuugcucuguggacuaccuuuucauucucuuaauagugucccucuaagaacacauguuaacuuuuauaaaguccacuucuucaguguuuucuuuuacgggucaugauuuuggugucuaugaaaucuuugccuggcugggugagguggcucuugccuguaauccuagcacuuugggaggccaagguggguagaucacuugaggucaggagugugagacuagccuggucaacaaggcaagaccccaccucuacaaaaaauguaaauauuagccaggcgugguggcaugaccuauagucccagcuacuugggaggaugaggugggggaucauuugagcuugggagguugaggcugcagugagucaugauuaugccacugcacuccagccuaggugacagagugagaccuugucucaaaaaaaaaaaaaaaaaauguuugcccgcugggcugguggcucacaccuguaaucccagcacuuugggaggcugaggugggcagaucacuugaggucaggaguucgagaccagccuggccaacauggugaaacuccgacuccacuaaaaauauaaaaauuagccagacaugguggcgggcaucuguaaucccagcuacucgggagacugaggcaggggaaucacaugaacucaggaggcggagguugcagugagccaagauugcgccagugcacuccagccugggcaacagagcaagacuccaucugaaaaaaaagaaaaaaagaaaaagaaaaaucuuugccuaacccaaauccuccuauguuguuuccuagacuuuuuuuuuuucuuuuaaauaagagaccaggucucucuguguugcccuggcuagucuugaacuugugggcucaggugaccaucccaccuccucugcuuccugcauagcugggacucugcucucaguuauccuaggcuuucuuuucuguuuuugaaagagucucacucugucacccaggcuggagugcaguggugugaucuuggcucacugcaacaucugacuccugggcucaagcgauucucaugccuuggucucccgaauagcuggaauuacaagugcaugccaccacacccggcuaauuuuuguauuucuaguagagaugggguuuugccauguugcccagccuggucucgaacuccuaagcuuaaaugauccaccugccuuggccucccaaagugcuacaguuauaagcaugagccacugugcccagccuuuccuaguuuuuuuauaguuuuagguuuuacauuuagaucuaugauuuaucuuaagcuaauuuuucuauauuguuacaauauauggaaugaaguuuuauccucuuguauguacauauccaauuagcaucuuuauuuaaaagccuucucuuuccauugaauugccuuugcaguuguaguugacucuguaugugugaugcauuucugacauuuuauguuucauuaaccuguuugucugucauggugccaauaugagccugucuugaugauuugacuuugagacuuacuguaaagucacuacaauguaaauccucaaauuauauuaguguuuuucaaaguagauuugacuuuucuaggcucuuugcauuuucauaagaauuuuaggcugggcacaguggcucacaccuguaaucccagcaauuugggaggccgagguggguggaucaccuaaggaggaguuugagucuagccuggccaacauggugaaaccccgucucuacuaaaaacacaaaaauuaguugggcacggggcaugguggugcacaccuguaaucccagcuacucaggaggcugaggcaggagucucugggaggcagagguugcagucagcuaagaugaugccauugcgugugcuccagccugcgugacagagcaagacucugucucaaaaaaaaaaaaaaacaaacaaacaacaccuugucaauuucaacauaaaagucuugugggauuuugacagggauuguguuggaucuauagaucaauuuggggagaauugacgucuuagcaauauugaaucuucugacccaugaguccuuauuucucucuauuuuggucuaauuuaauuucuuucaguauuguuuuguaguuuucaauauguagauuuuggacaucuuuuguuagaguuaucuuuuuguuuuuugaaagagugucacucugucacccaggcuggaguacaguggugcucagugcaaccuccgccuccuggguucgagcgauucuccugccucagccucccagguagcugggauuacaggcgcccaccaugaugcccaguuaauuuuuauauuuuuaguagagacgagguuuuaccauguugacgaggguggucucuaacuccugaccucaacugauccaccugccucggccucccaaagugcugggauuacaggcaugagccacugugccuggcugauuuuuuugugugugugugagacagagucuugcucugucacccaggcuggagugcaguggcacgaucuuggcucacuguagccucagccuucuaaguaggugggauuacagaccagugccaccacacccagcuaaucuuuauacucuuaguaaagauggcuuuucaccauguuggccaggauagucucgaacuccuggccucaaguggucugcccaccuuggccucccaaagugcugggauuacaggcaugagccacaguacccggcccuguuugauuuuuuuagugcuauuauaaauggaauuuuauaaaaauuucaguauuugauuuuuccuugcuaauuuauagaaauacauuucaugggcuggaugcgguggcucaugccuguaaucccagcacuuugggaggcugaaggaggaucaccugaggucgggaguucaagaccagccuggccaagaugguuuaguagaaaccccaucucugcuaaaaaaauacaaaaauuagcugugugcgguggcacacaccuguaauccaagcuacuugggaggcugaggcaagaggauuccuugaaccugggagguggagguugcagugagccgagauugcgccauugcacuccagccugggcgacaaggugagucucugucucaaaaaaaaaaaaaaaaaaaaaaaaagaaaagaaaagaaaaagaaauaccuuucauguauaauuuuauguuucaucuuguaauuuugcuaaauuuacuuaauagcauuuuuguagauaccauauauuuccuagacaaucauuucaccugugaauaaagauuuuauaauguuuguuucaaauggaugccuuauuuuauauucuugcuuuauugcacuagguagaaucucuaguaugauguugaaugccaguagugagauuagacauucuugccuuauuuuuuaucauagaggagaaaguauccagucuuucauuauuaagugugauguuagcugcaggcuuuuuguggaugucauuuauuacauugaggaaauucuucuauuccucuuugccuaagaguucucauuaggaaugaauuuugaauuuuguugaauauuuuuuaaaucuauuggaaugaucauaagauuuuccuguuuugauuuguauuaauauggugaauaacauugguuaaauuuggcugggcgugguggcucacaccuguaaucccagcacuuugggaggcugaggcaggcggaucaccugaggucaggaguucgagaucagccugaccaacauggagaaacccugucucuacuaaaaauacaaaauuagcugggcgcguggcacauggcuguaaucccagcuacucgggaggcugaggcaggagaaucgcuugaacccaggagguggagguugcggugagccaagaucaccccauugcacuccagccugggcaacaagagcgaaacucuaucucaaaaaaacaaaaaaaaacaaaaaacguugguuaaauuuuaaauguuaaaucaauauuacauuccugauguaaacucuacuuggucaugauguauuuuuuuauagugcugaauuugauuuuaaaaguuuuuucuaauuuuugcgucuguauuccugggcuaucuuggucuguauuguucccuucuuaaaucuguaaccauaacaggucuguugucugaugcacacagcaagucaauaacagagacacuggguugcugcagagaaggaguuuaauuauagggccuccaaacgaagagaugagaggaaaccucaaaucugucuucccaaggaguugagaccauggcuuuuaaggauuuuggagugggcugaaguauuaagaucauugauuugucaaagaaugcuaggugaaauuaugggauaggaagauguacaagcaguauucucaugcugauucuguuccccuguggagaucuuuaaacugguuggcuucagcuguuccacugugcuuaagcaacucuugauuuuaaaaaaaaaaauuuauggaaacagggucucaugauguugcccacgcuggucucaaacuccugggcuaaagcaauccuccugucuaagccucucaaagcacuggguugauaagcaugagcuauugagacuguccugcuuaagugauucuuuuuuuuuuuuuuuuuuuuuuuuuuuugagacagcaucuuacucugucacccaggcuagagugcaguggcaugauaucagcucauugcaaccuccgcuucccaagcucaagugauucucccuguuucagccuccugaguagcugggauuacaggugcccgccaccacacccagauaauuuuuuaguagagacaggguuucccaguguugcccaggcugguccugaacucgugauccaccugccucacccucccaaaguacugggguuacagaugugagccaccacaccuggccuuaagcaauucuuaaacaaaagccuuaaguuucuaaugucagaaauucuaucuauaggaacaauggggaugcugauggucaguaucuaguguuagugacuuccuguuacaaagaagugagucagccgggcguaguggcucacuucuguaaucccagcacucugggauuacagggucaggaguucaagaccagccuggccaauauggugaaacccccaucucuacuaaaaauacaaaaauuagccgagcgugguggugggugcuuguagucccagcuacccaggaggcugaggcaggagaaucgcuugaaccugggagguggagguugcagugauccgagaucguaccacugcacuccagccugagugacagaacgagacuccaucucaaaaaaaaaaaaaaaaacccaaaaaaaagaagugggucaaagugcaguauaauuaaugcuuaauuauaauuauauuucuguccagaauucuguuuaacccugugagggugguuucauauccuugccuuguuuugguaucugaguaaugauggccuuauagaauggauugggaaauaauugcuuccccuuccauuuucuggaauaguguguauagaaaugguauuuuuucuuuuuucuuuuuucuuuugagacagucuugcucugucacccaggcuggagugcaguggugugaucucggcucacugcaagcuccgccucccggguucaugccauucuccugccucagccuccugaguagcugggacuacaggcaugcgccaccacgcccagcuaauuuuuuguauuuuuaguagagacaggguuucacuguguuagccaggauggucuagaccaucuccugaccucgugauccgccugccucggccucccaaagugcugggauuacaggcaugagccaccgugccuggccagaaaugguauuuuuuuuuaaguguuuguuagaauuuaucucugguuaugagcuuucuuuguaagaugguuuuuaagcaaaaauuagacuucuuuaguagcuauagggcuacucauguuaucuauuucuccuugaaugaucuuucguuguuuauaucuuucaaggaauuuguccauuuuaucuaugaauuaccaaaguuaacaaauugcuguaaguuuuuuauaauauucucuuauacauauaacauauucuauuaugauagcacuucucuuauucccuauuccgguaauuuguuuucuugucuuuuucuugaguguccuggcuagagauugucaguuuucuugauagcuguuuuuucuuucucuguuguuuuuguuuuuuauugcacugauuuccacccugaucuuucacuuuucugcuuucuuaugguuuaauuuguucuucuuuuuuuuuuuugaaauggagucuugcucugucucccaggcuggagugcaguggcgugaucucggcucacugcaaccuccaccuuccggguucaagcgauucuccugccucagccuccugaguagcugggauuacaggcacaugccaccaugccuggcuaauuuuuguauuuuuauuagagacgggguuucaccauguuggucaggcuggucucgaacuccugaccucaugaucugcccgccucagccucccaaaaugcugggauuacaggcgugagccgcugcgcccggcuugcucaucuuuuuaacagauuucuugagguggaagcuaaggucauuuaauugagauuuuucuuauuuucuuauuuuauuuauuuauuuauuuuuagauggagucuugcuccguugcccaggcuggagugcaguggugagaucucgaaucauuguaaccuccaccucaccgguucaaaggauucuccugccucaggcucccaaguagcugggauuacaagcauacacuaccaugccugacuaauuuuuguauuuuuaguagagacuggguuucaccauguuggucaggcuggucucaaacuccuggacucaagcgauccacccaccucggugucccaaagugcugggauuacaggggugagccuccgugucuggccuaauuucuuguuuuuuggauuauaucuaacuguguugguucccaaauauuuggagauuuucugcauauuuucuguuuugauuugugauuuaauuccauuguggucaugaagcauacauuguaugagauugagacuuauuucauguuccagauuauugucuuuuuuugcuaauguuuuguguacacuugaaaagaauguguauuccagccagugugguggcacacgcuuguaaucccaacacuuuagaaggcugaggugggaggaucccuggaggccagaaguuugagaccagccugagcaacagccagaccucaugucugccaaaaauuuaaaaaucagccgggcacgguggugggcaccugcaguugcaacuacucaggaggcugaaacaagaggauugccugagcacaagaggucaaggcuacagugagccaugaucaugccacuguacuccagccugggugacagagaaagacccuuucucaaaaagaagcguauucugcuguuguugaguggaguguccuguuaggucaaguuggcuuauaguguuauacuaaucuucuauauccuuacucauuuuaauucuaucaauuaucuauuauugagaguuaacuccaacuauaauuuuggauuuguauauauguucuugcuuuguuucuucaugcuuucucaaacucuguuuuuaggugcauaaacauuuaggauuguuaccucuuaaugaguugagucuuuauuacuaugaaacaaccccuuuuaaaucuuauaauauucuuugcuguaaaauuuacuuuuauauuaauaugaucagcuccagcuuucuuuuauuuaauguuagcaugguauaguuuuuuccaaccuuuugcuuuuaaccuguuuauguucuuauacuuaaaaugcauuucuuguagguaguauaugauuuuguugugcuuuuuaaauauaaucugacacucugcucuuuaauuaggguguucagaccacuuacauuuaaugugauuauuuauacaguugggcuuaaaucuacuaucuugcuuuuugauuucucugucucaucagcccuuuuguguguguguguguguguguguguguguugugugugugucagccucuaucuucaagugauuuuauaccauccuuuucugcuguauaagacccuauugucauuauacuugcauuucucccgucguagaaucuguaugauuguuguuuauguuuuacuuccacauaaaguauaaauggcacaauauuguuacuauuuuuuauuuaaacaauauauuaucuuuuaggcugggcgcaauggcucacaccuauaauccuagcacuuugggaguccgaggaaggaggaucacuugaguccaggaguuugagaccagccuuggcaacauagugagacccugucucuacaaaaaauaaaaaaauuaccugaguguggugauacguaccuguggucccagcugcucaggaggccgaggugggaaaauagcuugagccccggaggucuuggcugcagugagccaucaucacuccacugcacuccagucugggugguagugagacccugucucaaaauaaguaaacacaguuuguuaucuuuacuuuuuuuugagacagaguauugcucugucacccaggcuggagugcaguggugcaaucuuggcucacugcaaccuccaccucccugguucaagcaauucugccucagucucuggaguagcugggauuacaagugccugccaccacgcccugcuaaauguuuuuuuuuuuuuuuuuuuguauuuuuaguagagacaaucucgaacuccugacgucaggugauccgccaaccuccaccucccaaagugcugggauuacaggugugagccaccgcaccuggcccauuuuacuauuaucuggaggacuuucuuuaauauuucuuuuaguacuuugaaaaaaucuuuauuuugccuuuccauuuuuauuuuuaaaguguuuuugccagcuauagaauucuagauugaggaccuugcccccuugcaacuaucugccagcuugcauuguuuuugauauguacauuguugucauucuuuuuuuuguauguaaaauguccuuuuuuuuuuuuggcggucuuuaaguuuuuuuuuaaucauugcuuuuaaucuguucaguuaugauacguucuccuguaguucucuuuaucuuucucgugcuugagguuuguucagcuucuugaaauuuuggucuuauaguuuccaucaaauuugggaaacuugcuauuacucaauuuuuuuuuuuacccucuucuccccuuuugucgucgucuucaaggacuccaauuacauguauauuaggccccuuaaaguugucccagaguucacugauguucuguucuuucuuuuuuuuucuuuuuuuuugugggaggucuuauacuguauugcuccauuuugcaugguuuguauugcugugucuuuagguucacuaaucuguuguucugcgaugucuaaucugcuguuagacauuuaauacauauuuuuauguuagacauguuaucaauaaaaauuugauagugcuuauauauuuauuaauuaaacagauauuuauuaacuucuuacuauguuccuggcaugagauuugacaacuuguucuuuauuaaugacaaagauuuuuaguagaaagaugaggguaaaagacuaguuguacuagucucaaaagauaucagagugucuuuugaagcaaacagagaaugugauaccaagaacuguauggugaugucggggaguguuuuuauaagaugaagauauuuuguuauuuuuauaaugcugauggcuuaguagaaagggaaaaacaaaugauccaugggaaagagaagagguaaccuuaggaaaucuucacaagagugauugagauucagugcccaaguagaggacaguagcuuuagaauagaacaccacuacuucauuggcaccagagggaagcagagaauauggguauaguuggggauagcuugggagauuuuccagugauaguuuggagaauauuaaagauuuugauugccuuugcacuuacucaccauguuuggaacaaccuccagcaguguucuugacacuggagauagaacgcuguacaauuuaaauguucuugcucuaagauggguauuuaaagaacauaggaaaacgcugugccaaugcuuagaauaguucuggcacaaaguagcuguucaaugaauguuuguuaacugaauuuggauguauauacucaaguaacaguguuuagauuuugguguuugugagacaccucagcuacugacugacuguugcuaagguggguugcuucuuaccgauagcuuaucucauucuccaaauuuaaguggguacaacuucauguguaauauaccuaaaagcucugugugauacuuuaauagguacuuacucuccaugugcacuaacuauauguaccaaguccaaugagaggacagagaagggagaaaguuguuauaccuagggaauuugggguuagcauccuacaggaggugacaccaauuagaguuugaaggagaaguauaggagugcuagcaagauguggguugauaaggaacacaucagaaagcacuucacaccauugacgagucugaaagagcaguucacaggcggcaaauggugcuaaguuuaggaucauauuggggagcugguuuaguauauucaucucucuccuugaauuggucccauuuaaaaacaaaaacaauucaaucccucuguuccaugugauucaucagucacuccuuuuguuuagaauaaaacuuacuaaagauugauucauauuugcuauuuuucccugguauuuugcuggguguuauaaggaagugugaaacaagaaauguguuuugccuguaccaaacauuugguuguagaaaucaauaauacaaaagaaagcaauaggaauuauuuauuaguguuuaauuggauguguaguugugugcaucacacuuagacguaaguugucuucucuuuguauucuguucuuuaccuagaaccucuuuaccuaggugcuucacaaaucuuaucuucuccuccccaucuccuucccucuuuaccuuccccuuccaccuguugauacaguagcugcuuuaacaggaauuacaaaaaggaacccaggacaaggcaagaguaauggcaaaagugcaguuuaugcacaguugcaguguuggaacaaugauguugaagccagaaaugucuggaacugugaauaucuucaacucaguuauagaaucaugcucuguacaauauauucuguaaugaaaugaggagugaaucugaauauuuuuuacacuaacauagaaauuguuucaugauaucaguuaucccacuuaaaaaugaguuagacaccucucucuuuuuaaucucucuaucucacacacagauacacacacacacacgcacaccaccacgaaauaugcuauauguaucuuuucauaauguauuuuuaaaaaauaauuaaacccccuucucucuucagaguaaagaugauguuggccuauugugguggcucaugccuguaaucccagcaccuggggaggcugaggcggguggaucaccugagaucaggaguucaagaccagccuggccaccauggcggccccaucucuacuaaaaauacagaaauuagcugggcgugguggcaugcgccuauaaucccagcuacuugggaggcugagcuggagagucauuugagcccaagagauggagguugcagugagcagagaucaugccauugcacuccagccugagcaacaaguaugaaacauccuacaggagugugaaacuccaucucaaaaaaaaaaaaaaaaaaagaugauguuuuaacaaugaaugaaguaaccgcuucccuaaaagauaugcuugagcggcugggugcggugccucaugcuuauaaucccagcacuuugagaggccaagguggguggaucacgaggucaggaguucgagaccagcguggccaacacagugaaacccugucucuacuaaaaauauaaaaauuaacugggcgugguggcaggugccuguaaucccagcuacuuggaaggcugaggcaggagaaucgcuugaaccugggagcuggagguggcagagagccgaaaucacaccacugcacuccagucugggugacagagcuagauuccgucucaaaaaaaaaaaauauauauauauauauauauguauauauauaguguauagauuauauaugaguguguguguauauacauauacauacauucaagcuaggaaaauaacaauaauauugucauuguuuauguauuuuuaguuuuuuguuaccaaaaaaccacaguucuaauaugaauacuguaaagagcugaaaaaaaauuucuaaucagugguuugaaccuauuugcuaaaaauaauaaaaugcauccuucuaauuuauuuuucuaaaugauuuacaacaaggaacauggaaaucuaauucaacuucaauagaauucuuuacauaauuaauguauaggacugaaauuuuguuacugugauuuaauaagcaugguauuucuuccaugaguauaacuauaucuuuguggcauccagugaaaccagauaucaaaaauaaguccaucuuagcgucauaccuuugaagcauuauauuuuuguguguaagaaagguuuuguugucauucauaaauauauuuaaaaauuacucuaaaaaugguauuuaauuuuuguuaugcuuuugaaauugcaguauuuuaaucuuauacauaaguaguaaugcauauucuauacauauuuuggagauacaaauggaaaaauuucuuaguaauggaguauaugauuaaaaaaaaaaaagcuggaagacaaacuuguuuaagcuguaguuaucuccuacugguacuacuccaguaaccucauuuuguauccuuaacuccauucuagcuuucuuaaaacuguucuccacuuaguaggcgagaugauccucacaaugugcagauguaguuguguaacucuccuacuuaauaagcugcacacacacaggucuuuaauauggucuauaagucuguaaacugugugaucuagcauuuuaggucuucagucucauaucucaccacucuuccaccuuuacuuuuuccucucugugggcugccuuuaaguuccuuguacaagccaugcucuucccuuuaagcuggacuuuacacauguuuucucucucccuauggcacuuagccuaucucuuccuuucccaguuuauuuccuauauauccuucaaauuucaaucugaauggcaguuccucagggaagccuuugcucaucuuccuggcuagaucauacacacacacacacauaugcacacaugcauacaagcacacagguacacaugcaugcacaauuacaaacucaauauaauuauguguauuugcccuucauuguguuuauuacaguugccauuuuacuuugauuugcgugaguacuugcaaagguaguaauuauugacauucaaauagguguuaagcuccaugggggcagggcccuugucaguuuuugcuuaucauuguuuucucaguacuuugauacaugaguaaguguguugccagagaguuuggguuucauccuuaggaaaaaacaaagagucauugggaaguucuaugaaaaauaggagagcagugaugacgcauacuaagacuugggcuguagaaggguaaacuucuacaggcuguagaagggaggcuauagcugaguaaaggagauaaacuagagcuaggaagauccauuagaaggccauuguagguaaacaagaugaagaccugaagucuuuccgguucagauggucucgccuuugguggauguuuaagagacagaauccaguaguauuuguggaccugcugacuauugucagauauaagacaaauaaaucagauuauuuggaauauggggcuauuaacuuuuaggccauuuaccaaguaaaugaauauaagacaauaaacaauuugaggggguaaaggaaucuucauuuuauuuuauuuuuauuauuuguacagauaggaucuugguauguugcccagucuggucuugaacuccuggccucaagcuauccucauugcuuagccucccaaaguauugggauuaccugcauaagccaccacacccauccuggaaucuucauuuuaaacaaaagucacaaaagugaccucuugcccacugcucuauauacaguuuuuuaacagcaguacugagaugugauucacuuaccauguaauucaccuacuucaaguguagaguucaguaguuuugaguuuauuuauaaaucaucaacucaaaaagaaacuguacccuuuagcuguuaucccucuuucccucuaccuuccuagccuuaagcaaccacuaaucuacucuaucucuauagaucucucuguucuaaacauuuuauauaaauaguauaauguaguauguggucuuuugugacuauauucuuucacuuaacauuauguuuuuaagauucaucuaaguuguagcauguaacaguacuucauuccuuuuuauggccaaauaauauuccaguguauaaguauauaucacauuuuguuuauacauucaucagcugauggacauuugaguuguuuccacuuuuuggcuguuaugaauaauauugcuauaaacacuuauguagaaguguuuguguggacauauguuuacauuuuguuugguuguguaccuaagaguggaauggcugggucaugugguaacucuguguuuacuuauuugaggaacugccagaauguuuccaaagcagcuguaccauuucgcauucuuaccaggguucugauuucuucacauacuugucaacacuuguuacaucugucuuuuugauucuagucauccuagugguugagaagugguaucucauuguagauuuguauuuccgugaugacaggugugagaaaucuuuucaucugcuuauuggccauuuauaugucuuccuuggguaaauguuuauucaggcccuuuuccuguuuuuuaauuggcuugucuuguuauugaauuguaagagcucuuuguaguauauuguggauaccagccccuuaucagauacaucauuugcaaauauuuucuccuauucugugaguugucuuuucacuuuuuugauaacaaucuuugaagcacagaaguucuuaauuuugauuaagucaaguuuaucuugccaaaucccaggucauuuagauuuggcauuguguuuuuuucuaaagauuuuauagcucuagcuuuuacauuuauaggucuuugauccuucuugaguuuuuuguuuuguuuuguuuuguuuuuaauaugaugugauauaaaggcccagcuuuauuuugcccauggauauucaguuuguccagcaccguuguuaaaaagacuauucuuucccauauaauggucuuggcauccucuuggaaaaucaguugaguguagaaauagguuuuuaauguuuuuuaaccgcaaaacuauauuuuagcuuucuaacuauuuggauuguucuuucacagacaauucuguaacuaaaggaagauuaugcuuauuuuuaaguaagcuuuuaggaauauuuguauaauuuuagugcuacaucuuguauccagauuuaauuuugagaaaugcauaguuugcacauauggaacagcuguucuggucaugaaaauugaguuuggaaagccauguuucacuaagggugacauucuggcuucuuucuauuggugcuuccugagugcuggacacuaugcuguuauagggcuuacauggaaguaaaugaccaucucuuccucacguugcuaauguauauaaaauauugggagcagggagaaggagggaguaaaaugacauggaaauauccauaugggauuuuuuuaguccauaaaagugguauacuuuuuuuuuuuuuuuuuugagauggagucucgcccuguugccaggcuggagugcaguggcgcgaucucggcucacugcaaccuccgccucccaggguucaagugauucuccugccucagccucccgaguagcugggacuacaggugcacgccaccacgcccaacuaauuuuuguauuuuucguagagacgggguuucaccauguuggccaggauggucuugaucuccugaccucaugauccgccagccucggccucccaaaaaagugguauacuucuaauggauaaagguuauacagcuaucuucaccugguacacugucuucgguauuaccuuuaguuuuaaaugaaguguuuucuuaagaccaagaauuuuaaauugaaauuaguuauuuuauaaagggcucuaaauaaggauaugacuacaauggaugcugcugaaagaauugaaugauaaagauuauuagguggcuuaaugcuuuuuguauuaaucucugggaaaguccauuauugaucccaaaauugccaaggcugaucagacaggaucauuacauucuuucugugcuuuuucaaguacuugaaguguuuuuauguaauuuaagcauuuuucacuaaucuuucuuuuuuaguguaacuuuguauaauuuuauguuccuuuuucuuaggagucucagcaguccaauuuuggcacuggagaacaaagugaguauuucuuucccucuuuguuuucaaauuaagcuauuuauugaacauucaguuuucauggucacaccauauauaacuuuaguaauaccuuuacaugucauauccuuuuucauuuuuguuuucuuuuuuuuuuuuucuggaguguagugguguggucguagcucacugcagccucgaucuccagggcucaagugauccuccugccucagccuacugaguagcugggacugugggcacaugccacuaugccuggcugauuuuuuaaauuuuuaguagagauagggucucacuauguugcacaggcuggucucgaacuccugagcucaagugauccaccugccucgccucccaaaguguugggauuacuggugugagccaccaugcccucguauccuaauuuuuaugaucuaauggguaguaguggguugagcugaaaaauuguuaugcuuuaaaaaauucaagaacuguaagucauuggagaucaaaauacacuacuuuuauuaagcauuugaacuaauaguucaugaauacaauuugaugggcaccucguaaacucaagaguuauucuucuuucuuuuaacuuacuucaugaagauacuuggcucuaugaugauaaaacuccgcacaagaagggucauuuuauuuagcugaccauggcccuuuucuucuuauauuuguacagucccuguuuuuucuuccuugguuuucugaucuggguagaaaaucugcugccugcuauacccucaccuuuacccuuacucucuuggccugucagaagaauucuagggaagauagucuuauggucccaagagauugugguuguguagauugagagugguaagaucaggaaccaaugcaaaugucugggcuuuaccguauaccucuguaacaaaacagguauucuuuuugccaagagcaguaacuucuuaauuaagguagauuuguacuagucauaagguauuuuggaaaugaaaauguggaacuuuuugauccuuaguuuaucuucagugaucuuaaugcagggauaaaacuagaagaauaccucuuuugauguuaugcuuucuuuaucugucuaucaauuucuuaguuccaccuuaaaggccguagcuuacaggaaaaagggauuugacauuguuaauuaugcagaaaauguuaaaaugcagaaaauagcuaacuauaggccagagaauuuacauuuucucucuucuuuuuguuuccuuuuuuuucucagcuuguuuucccuagucgucaucuuuuaagaaugcuucauccuucuacucuucucucauucucuuuucugaaagcuguucacaaaugggaucauaagcugccucuacucauuauuuguguuuuucacuuuguuuuagagcuauuucuauaucagcauaaagcucuagcucauuguuuaaccuuaaaauuauguuauaauaugaaaauaucuuaauuuauuucacuaguccccuaucgauggacauuuuuuuccaguuuuugccauuacaaaccaggcuauaauaaacauucccaagugugugcuuguguguucguguauuccucaagauuauaccuguaauguaaauuccuuucauuggaauuauuaagucacuuagcaauauaauuacaguacugagaagguauuaccagauugcccuucaagaagaucguaugaguuuauaguccuaccagcaacauaugcacaugcuuauuuccccuguagucaccaguaucucauauuauugggcuugaagguguuaccaguuuggugguugaagaauuauauuucauuguuugauuuacauuuauuugaggguauuuuacauagacauuuuacagucuaaauagccauccuuuaguugcucacuucauucuuuuuguuccagaaagauauaauccuucuaaaacuucaaaugggcaccagucuaaaucguaaguuuauugcuuaaugaguuuaauauuuaucauuuuugcuaaaaguuaccuguaauaucuagguauuuugaacaguauuuagaaauauugaggcugggcaggguggcugacaccuguaauccuagcacuuugggaggccaaggcaggcagaucacgugaggucaggaguucgagaccagccuggccaacguggugaaaccccuucucuacuaaaaauaaaaaaauuagccaggcgugguggcgagcgccuguaaucccagcuacuuggaaggcugaggcaggagaauuacuugaaccugggagguggagguuguagggagccgagaucgugccacuucacuccagccugggccacagagcgagacuugaucucagaaaaauuaaaaaauaaaagaaauauuuaaggcaugagcaugcaaauuuuuauguaaagggucagauagugaaauauuuaggcuuucagagccacauagucuguguuuugacugcucagcucugccaucuguaguaugaaagcagcuguagacccuaaguguggcaguauuccagccacacucuuuaaaacaaugugguagguuggauuuggcuugugggccacaguuugcccaccuuugcucugagaucaugguuuuuucucaucugagaguuguauguguauguuuuuguguguauauuccuaauuuauauuuaauaagucauaaaauaaagacaggauucuucuuuaggccaagcccuucauuuaaccacuagauuaaguaacauacauaguuuguacugucuuuaaguuuucuuauuuuuauuuuguugguagaagcaggaauauauauaaaaauguaacaggguaauguauuggaugaaaauaaauuccaacuuaaagaaugaacuccugaacuccugagaccacaaguuaacucagugauuaaagcaaaguucuaaagaagcagugacuacagugccagcuuucuaugccauagucacagacuauacugugaugacccuagccugguagcacuucagcugaauauaagaacuaagaaugaaaauacaugaacacaagaaguacccccuucacugcugaaaaauucaaauuauacuccuauucaucauacuuauuuauauguaaagaacggauguggucuuaccauauauauaccuaucacuuugauugugagggaacaaaagcgugcagggcccugagcagucugguaaaagcuuugacauauucacauguguaaacaaguucauugagcugccauuguuaaaucauaaaggccgagagaauucagacuaaguacauuuccuuagaggaaaaucagucguagagauagaugcacuaagccccugucugaaagaaaacucuuuuuucccuguucuguuuaauugggccagucuuaaaaaucaucugguuacuuuauuucaaggugguguuuaauauguaauauuuugaacuuagggucagauauagaaauguugguuaaacuuugaggaggaaaaguacaaguaguuaauagagugaaagaagauuuccuucucacugauuggagauuguaaugaaauuuuaagaaagguaauggaauuacugauaaugagaaauuagacauuuuccuaguuguaguucucccuaagcuuuguauuaauuuuuccucccauguaaaaagacaaggaauguuuuguggacuguuacauagaaaauuuuaaguuuaaugguuuugauuuuauggccuuaaaagaaaauuuacaucuuuaauuuugcuuucaaaaacaaauuccagaaacugucagcuuauaguauuuguguguauguguuuuaauugauuugaaguuugaucaacggagauuuuggaacuugggaguuuuuuuuguuuuguuuuguuuuuuugagacagagucucgcucugucgccuaggcuggagugcagugaugggaugucggcucacugcaaccuccagcucccggguucaagcaauucuccuccuaccucauccuccuggguagcuaggauuacaggugcccaccaccacgccaggcuaauuuuuguauuuuuaguagagacaggguuucacccuguuggccuggcuggucucgaacucaugacuucaggugauccgccaaccucagccucccaaaguagugggauuacaggcaugagccaccgcacccagccagaacuucaaaguuuuaaaaauauauacauagccauuucugcuauauagccaggacuuuuacccaaaauauuuauuucuacagagggcacuuuguuucauagcaaggcauuuaugaacuagaacuuuggcuuaggaaaccguucugguuuucacaguuacccaguugucaacaguuauacuaaccucucuuuauggaacaugggggacaaaggaagaauugcuugaugcuuucauuuuaucuuccuucuuuuuaggaauuauaucucucuaguggauuguuggguaugacuuuguuaauuuuuaauaaugaaugugugugugcaacuaggggaaaaguuagagauuacagaacugaauuaugagaguuuauagaaaguagcuuuuguuuaauuagaaaaggugaauauuuuauucaugggaaggauagagcuuaggaaugguuaaauuccuccauucucaauuuugagauuuugaaccaaaccagauagaauaagacuuacugguguuuuguuuuuugguuaaauuuuuggcuaccacagugauuauuucuagaauuuuuaguagauauuuaguacucuggcauaccauguaaacuguuccaaaaauaauaauucuuugucuuuucccucuaguauguuaaaagaugacuuaaaacuaagcagcagugaagacagugauggggaacaggugugucuacuauuguauuauuuugccagucucauauaguauuuucauuguauuuuauaaaaaugauaauugaauaaugcauuuauuacuuaaaauaaguuucuuauaagcuuucugacacugaaauguuguaguuuucuucucuguuuuuaaaucuccauuuuuuucuuauuuuuuuaaaaaauuggguuuuccucaacauuuauuauggaucaaaacauacucaugaagcaguagauuauugacaauaauaacuauuaacaaagcuuuugaucuuauucuggcaauucaguuacucuucagguaaaaacaguauaagugcuaaauauuguugcauacauuagagaauccaguuuuuucuguuaagaguucagauauuauucacacuaagcaaauagaauacuguuuauucauucacagauucuuucuuauguuuuaauuuuaggauugugauaagacaaugccgaggaguacaccaggaaggugggcauccuuuucuuuucuguuuuauugguaagaguugggucagccugauaacauugcagggauauaauaaguggccuuauaaguaaauauuaauuuugauaaugguuguacaauucuguaaauuaagucauugaauuauacacuuaaaguggguguuuuguguauuauaccucaaacuguuuuuaaaaggugaguauuaauagcuaaguagcacaucagaaacuuuaaaaagaauuacucauuucauuuacagugaagcucuggauucauagaauuauagcagucuaacacauaguaaacauuuuaaagaaaguugcagccgggcgcgguggcucacgccuguaaucccagcacuuugggaggccgaggcggguggaucaccugaggccaggaguuugagacccaccugaccaauauggugaaaccccgucucuacuaaaaguacagaaauuagccgggcguggugguggacgccuguagucccagcuacuugggaggcugagacaggagaauugcuugaaccuggaaggcggagguugcagugagcugagaucgugccacugcauuccagccugggccacagagcaagacuccgucuaaaaaaaaaaaagacaagaagaaaaaaagaaaguugguugucgauuuggauguuuuccuguugucaauguaaaauaaacuuuggacauuuguauauuucaucucuuuuaguaacucugaaccuucacaccauaauagugaaggagcagauaacuccagggaugauucuaguagccacaguggaucugaaagcagcucuggaucugacucagagagugaaaguaguuccagugacagugaggcaaaugagccaucccagagugcaucucccgaggugagacagaggcggugggguaccuuccacaggcccucucaggguccuuggugauguccauuuaaaaccugauccaaauauaaaaggagaaggaaagaagguuccauagucugacaaaaagaaauuguacuguguacguuggaggaaaucuagaugguuccuuguuguuugaacaaauucggucuagauuaggaacugcuuggcauauuacaggucacuaaaauacuguguaccuuuaguuuggucuuuuauuuuuaugacucaacaugguaauugauguucugugguuacaaagaacaucauguuguugauaaaaagagucuuauguaauacaauuuugguauagcuuguuaaauugcaguuaaaaaucucuuuguaccuacaucauuuguuuacuuucuagaauuaaauauucuguacgguaauuuguaauuaugccuuugaaauuggauucuugaauaggaauauuugcuauuuaaaggucauauauaacauuaagcuuaucuuuuuuuuuuuuuuuaagauggagucuuacucugucacccaggcuggagugcaguggcucaguuuuggcucacugcaaccuccgccucccggguucaagugauucuccugccucagccuccugaguagcugggauuacaggcgugcgccaccgcaucugacuaauuuuuguauuuuuaauagagacaggauuucaccauguuggucagacuggucucaaacuccugaucucaugauccgcccaccucagccucccaaagugcugggauuacaggugugagccaccgugccuggccacuuaucuucuuauucagaugauaagagcuaauagucaauacucagcccuuugcuuugguucauagagaaccauuugcuuuuguugcauuaggcauugugguuuuuccucuucuuugagguuguaaaggagggagaacgaaaaaagcauucaguaucgaaaaaagcauacauauuucucuguuuuucagccugaacccccgccaacaaacaaauggcaacuugauaauuggcugaauaaagugaacccacauaaagugucacccgccucuucaguggacaguaacaucccaucaucucaaggcuacaaaaaggaaggccgagagcagggcacugggaauagcuacacugauacaaguggaccuaaagaaacgaguuccgcuacuccgggacgagacuccaaaaccauccaaaagggaucagaaagugggcgugggaggcagaaaucuccugcacagagugacagcacaacacagagaagaacuguaggcaaaaaacaacccaaaaaggcugagaaggcagcugcugaagagccucguggaggccugaagauagaaagugaaaccccuguagacuuggcuagcagcaugcccuccagcagacacaaagcagccaccaaaggcucaaggaaacccaauauaaagaaggagucuaagucuuccccucgaccuacagcagagaaaaagaaauauaagucaacaaguaaaucuucccagaaaucaagggaaaucauagaaacagauaccucauccucagauucagaugaaagugagagccuuccuccuuccucacaaacuccuaaguaccccgagagcaauaggacuccuguuaaacccuccucaguggaggaagaagauagcuuuuuucggcaacgaauguucucuccuauggaagagaaggaacuucuuucaccccucagugagccugaugacagguacccacuuauugugaagauugaccugaaucuuuugacuagaauaccaggaaagccuuacaaagaaacagagccgcccaagggggaaaagaaaaaugugccagaaaagcacacgagagaggcucagaaacaagccucagaaaaaguuuccaacaaaggcaagaggaagcauaagguuugugaaggguuuuuguuguuuguuuugaaacaucagaaucugaaaugcgguggaaaucucaguaagccacaaaguaacaaggugggucauaagcugugaaggaaaauaguggguaaacccaaggcccaggcgaggcuacauguggaacagucucuugaggauuucugugcuucugccuguguccuucaguaaagcagaauaguugcuaaugaaauaagaaaugagucagugcuuuucagcaugugcuggccaguguagagguuagagagcagcagcuugcaaauuggcauuugcaacauucucaacauuuugguuuuagguguuuuuaguuuggauauguacuccccguauuguuauaaucccuaccauucucuucugauguacacccagaccaagucacacuuaaauaacuaaucugcuaugcaccucuaugccccagcuuauuuuccuuaacaaaggucagaacuaaaaauauugcuggcuuauagccagcugucaucccuaaauacuuccaagauaauuuuggauauagaggcaaaauuuguauauuuaaggucugcuuuucuuagacuaaggaaaugugaaaacucacgcaugucugugauuggaggauaauaaucguacaaugaagagaucugaaucacuacauauauagagacugugggaaaaacagccugaucuuuucagcucuagugaggaauuuacaggagaauguaaaguuuuaaguagucuauaucaaagaauacuauaauuucuuccgauacaugucuaugauugugaaagaccagaaguuaagcuugaguaggugaacagauagguaccagaauggccuuaccaaguaaguaaacuuagaacacaaacaccacuccaguugaccugagaaucacauauacuacagggagaauagagcacuuucuuaaaauggagugagauauuuuccucucuccuuuucauaaaaccacagugccacgugcagaugauauauauucagacaaauuagaauaauacaugacuucuuuuuugaaucuuuaaaaauugaaauuguccacauuauuuaaauuuuuagaaaaccaaagcuuacuacucucuauacuauaccuaaugaguuuccauuaucauaguauagagauguuuugcucaacuaguaagcuguuuagggcugcuggccccuguagcccacagccucagaucgcuggacuuggcugugggauuuaauucauagaauaauguggaauaagagcuuguguaugauagacucugcucuuuuggaagcuaggacuuuuuuuauggaauuuuaaaaaaugguccuuuugugcuuaaaaaguauuacuuuuuuuguaagauuuuauuuuauuuuucuuacuuuuagagacaggguauuacucugucaccuaggcuggagugccauggcauucauagcucacugcaaccucaaacugccggguucaagugauccucccuccucagccucccaaguagcuaggacuacaggcaugcgaccccacaccuggcuaauuuuuuauagagaugguaucuugcuauauugcucaaacuggucucaaacuccuggaaucaagcaguccucccaccucagccucccaaagcacuggcauuacaggugucagccaccacaccuggcccuucuauaagguauucagacauuuaaaauauaaagugucaagggcaguaccuggagguaaagcagguaguacuaagagaagacccaguuaaggguaauaaaggauguagauuucuuuuucucauguuuucauuugucugucuuuauucauuuguauaggggaacagauucuuuuguuaugguagaauauuugcauucucgugcccugauauuugaagcaaaaggaaaacuuagauucacuuagaaaaguaacauuggcaauggaugggcccaccacuuguguuuuccaucagaaaguuuuuugagucacuaggcugugcuaugaucaaaaguauggaccauaaaaaauguuggcaaaguugugaaaaaguuggaacuuugauauggugcugaugagaauagaaaugauaccacugcuuuggaacauaguuugguaguuacugaaaaaguuaaacauagaguuaccuuuugaucugcaguuguacugcuaguuauauauccaagagaaaugaaaacauguccacacaaaaacuuguacuugaauguucauaguagcauuauucauauuagccaaaaaguggagacaacccaaauggccaucaccugaugaaugacuaaacgaaaugaauaaauucuaugcagugaauacuauucagccauaaaugagaaugcaguacuaauccaugcugcaacauggaugaaccuuaaaaauguuacacuaaaugaaaggagccacaaaggccacauauauugaaugauccauuuuccugaaaugucuagaauaggcaaaucuauaaagaugaaaugugauugccagugucugggggaggaggagauggggagugacuacuaauggguauagaguguguuuucaggauaaugaaaauauuuuaaaauucauuaagccgggugcaguggcucacaccuguaaucccagcacuuugggaggccaaggcgggcggaucaugaggucaggagauugagaccauccuggccauggugaaaccccgucucuacuaaaaauacaaaaaauuagcugggaggcugaggcaggagaaucgcuugaaccugggagguagagguugcagugagcugagaucgugccacugcacuccagccugggcgacagaacaagacuccgucugaaaaauaaauaaauaacuaaauaaauaaaauuaaaauuucauugugguaaugguuguacaacucugaauauaccaaauguuauggaauugugcacuucuaaagagugaauuuuauguuauguaaauuauaucuuaauuauaauuucacagauacuaccucccaaaucauuacauugaaaagaugccaucuuagagacuguaggaaaugcguuucagucucuggguuuuguguaucuaaaauaggcgaccucagccuuaaaaccucaucuucuugaauauuauuuaaaugaauuauaguacuucucuuuuaucuucuuucugaugccuaaucauggauaaacucuuuguggguagcuagugcuggaagcugaaguuaguugaauaaaaaucagaccacgguuucuauuuuucaucuagaaugaagaugauaaccgagccagugagagcaagaaacccaaaacggaggacaagaauucagcaggccauaagccauccagcaacagagaguacguucccaaaacauguugcaugccaguguuguuaauauauguauaucauuugauaguggguacuuucugacaugcucugaguguuccuuuuaguaagcaaguguuauauaaaugcauacacauaacauaugccaaauagugggagcuuucacuuuuagcuaauagggauggaaaacauuuaacauuuaauuaguucuuccuuuauucauuuuuuauugggguaggggugaguauggggggagaauuaaaguaaagcuaugccacuuucugguuagauggcaaacuuaucuguaauuuccaagagacugguugccaacuuaaaagugguaaucucuucauucaccauucaucaauuuguucaaucauucagccaauauuuauugaguacuacugagugguaggucaguuuuuggcccuggauuuacaaccacgggaauaaaaacagagaagaugccuaccuucauggaauuuacagucuuauuuuguuuuauagaaaucauguguccuaguaaucaaauggggaaaaacagauuugucuugaaagcagacaaagagaaauggaaaaaucaauuaccccuguauuacuguguggagaaaugaaggcauucguuugguuuggcaggucaucuaagcagagugcugcaaaagaaaaggauuuguugccuucucccgcugggccuguuccuucaaaagauccaaaaacagagcauggcucucggaagaggacuauuagucagucuucuuccuuaaagucaagcaguaacagcaacaaggagacgaguggcagcagcaaaaacaguuccuccacaucaaagcagaagaagaccgaagggaagacuuccaguagcuccaaggagguuaagguaaaguguugggggccuggggcuuuugaaaaucauucaacuugccaugugacuuuuccagggugacacugugcuuugaaauuauuguaacaucucaguaaauauauaggccuaugucuuuuacccucuauauguaauaauccugauaaaugaauacagugauauaagacugugaaggugguaagucagcuggucacauacauauugaaagaaaaacccuuggguacaguggcucauaccuguagucccagcuauuugggaggcuaagauggaaggaucauuugaggaauuugaguccagccugggcaauguggugagacccugucuguaaaagaacuuuaaaauuuaaaaaaaaaaaaaaaagauagaaaccagucauuggaaaaguugguuauggaagcuuuuaaaauaagaacuaagugguucuaguugcuaagauugaguuguuguauauuguuugaaauaggcuuugaguuucucagaauuauacuuuacaaacaaguuauauuacguaaagugacaaagcaaucauuugacuuugauucaugaaauagaaaaagaaaucuuuagcuaaguuagcacugaaauuauuucuaauuauuauuccuaggauacucacaaugcaggggaguauucuucauguuuauaguuggagauuuggaucaaaggagcuuuuucaaggcuguacuuuaauagucacucaaccucaauuuguuuaccagguuguuugcuuucuaaacuguucugaucaggagcaaauuuacuuaaaucagaaaauaccuauuauuuaguaagcaaagguuugagaguugaaaaauaagacuccuuaaagcuauuauauuuauuaacugguaaaauuaaaauuuuuuaaauugagauuauuuuaauuaagaacuucucaaauuaaaauacacagaaagcuuuuucucuagcugaacaaccucuuucuuuaguaguuuaguguuagcacaaggugcuuaggaccuugacuuuuauauuggccugcuuuauugcuccaguucuccaucugccugcugaugguuuuucuccauuucccauccuuuaacuguaggauuugaggccucugugcuugcuucuugaaaccugcuauugcuuuuuuaaauuauuauuuaauuuaauuaauuaauuuauuaauuaauuuauuuauuugcuuuuaaauaagugagcucuccugcucauuuggauucugcuaucucguagguaaaaaucacuguguaugcuucuaucacacguaagaaaggaguuucuucaagaaguucgucagcuucuugaaagcaggcauuugugucuuauuuuguguuuuauccggugcuuaacuugcuggguaaugaggaaauauuuguuggaucaaauguagucauuugguacucuguuguuuucaacaaaauauggaauagggccuuaccacuuugauuucaauagcucuuggcacuuaacaguuacugaaguuaguauuuguuagucuugacaauuuccaaguuaggcagugacauuugaguuuauuagagaauaaucuguaauuuaguuaggaaauaugcuauuuuuuauucuaucaacuaaagaaaaaauuagaucuggaaaaucaacauugcacauaguuuuuauauaagaaaacuguguuuaaauauuuggaaacuuauuuucagaaauccucugaaaagcaaaucugaauguagguccuuaugggucuauuuauaaaacauagagggggccaggcaugguggcucacggccuguaauuccaacacuuugggaggcuggcuggaggaucgcuugagcccaggagguugaagccacagugagccaugauugcaccacugcacuccaaccuaggcgacagagugagacccuuucucaaacaaauaaauaaauaaaacagaggaaaagcuauccuaguaauguuacaguacaacauaauauucagaaagccauuucaaaguauaauuauauauuuaaaaauuuuauauuuuuauauaaauauaaaaaauuuuauaugggguaaauagguaaaguaaaauuauauauuauugaguuuucuaauguugaaacauccaugcauuccuggaauaaauuccacuuguuuaugguguuuuauuauggaaaaauguauauucguuuuauuaaagauagggcuggauggaaggcaguugagagagagucauagcucuuucauaaagggcuauauugauaggaggcagaauagacauauagccaggugcaguaguacaugcccauggucccggcuacucaggaggcuggggugggaggaucacuugagccuaggaguuuaagaucaaccugggcaacauagcaagacucccaucucuuaaaauaaaaaaaagacauguggaugagaggcagaguaaaguuuaagaaaguaacuaggcuuuugaagucuggcaauucugaauuugaaacucaaauuccaagaaugccauuuaaaaccuguuugaacuuaggcaaguuacucaaccuccuugagacugcuuuuucauuuuaucuuaauagcaguacuuauuucauagguuuguuaaaggauuaacaauaaugcuaaguacuuaguuaacuuagugccugguaaguaguaagcacauaauaaauauuagaugcuauuaauauuauugcuguuuucauugaccaguaacuaccaauaaauguugccguaaguagugcugccauuuucauacuaggcuuuugucuuccuuauguuuuaacaacugccuaggccagugccuggcauauaguagacccuuauauaaauauuagaaugaauauuucaguuauauaaaauggacccuuuuuuuuuuuaaaguuuacauuaugaaguuuauaaaaguuuuguaacaaggaaauucauuaugaaaggcaaugaaauuuuguuuccuuuuuaccaguggcugaagaaaugcuauuaguuucauuuuuaaucuccuuacgguuuucauuguaguuauauauuuuuuuggucaggaaaaggcuccaaguagcuccucuaacuguccuccaucugcaccaacucuugauucuucuaagccucggagaacaaagcuugucuuugaugacaggugagauaauaugauuuuuuguaucuguauuuaagaaaugauuccagucagcauauaagaaacucauuuucauuucuaucauuggccgggcgcgguggcucacgcuuguaaucccagcucuuuuggaggcccaggcaggcagaucacgaggucaggaguuugagaccagccugaccaacauggagaaacccugucuguacuaaaaauacaaaaauuagcugggcguggugguacacaccuguaaucgcagcuauucaggaggcugaggcaggagaacugcuugaaccugggaggcagagguugcagugagccgagauugugccacuguacucccgccugggcaacagagcgagacuccgucucaaaaaaaaaaaaaaucuaucauugaucagaaggauauauacuuacguaugaucugcagaauauucagguuucaauuugaaaaguacccacuaguccaaguacggcuccuuuagcuuaacuccaugacucccaugagggaugugaaugaucugccuuccaguagaagaaucuuacuacugcugauaucacuguuaaaauggaggguuucuuaaaugaggaagagcaauauuguuuuuuccucuauuuuaauaaaagguaauuucuccuacucacauuuuauuuaugcuuaaucuuacaaucaacuugaguaacuuaguauuugauacuagggagcuugauuucuguuuuccuaauuagguuugccaugaguuggucaaaacaacuuaugcuuuuaaccugauauaaacauuugucagaaaauacugaaacaaauucuuaguaacagcucauuuucuuugcuugaggacauaaaaacugagggauacuagauacugaaaugaacuaguauuaugaaaauauuuacuauucuauuuauaaugaaaauuugucuugcagaaauuauucagcagaccauuauuuacaagaagcaaaaaagcuaaagcacaaugcagaugcauugguauguagauauucuccuuacacuuacguauuuaaucaaauuaacuuaaguaaucuucugauguuuguagccauaguagaucauuacucauuacuugcauucuccuuucuucagucugauagguuugagaaagcuguauacuaucuugaugcugugguaucuuucauugaaugugggaaugcauuagagaagaaugcucaggaauccaaauccccauucccuauguauucagagacgguggaucucaucaaguaaguggaaaaacuuggcagaucauuggcaauaacauuauuucucugguccaucaaggaagaggcugauauauaguaaacugaagaggguguauaauccuuuaauguccuuggauaaaggagaaguagauacuucaaugaguauuuuugcuuuuauuuagguuugaaauucuaauguuuugaggacaagugaaaucauaagaucaaggugaaguauucuguuugucauuuguuuguuauuguaacucaacagauacacuaugaagcuaaagaauuacuuggcaccagaugcuacagcugcagauaaacgacucacaguacuuuggugaguuuucuguguucuagccucugcuagauacaggaaguucuauaauaaauagugcugugugugcucuucugaauguuuuccuugaaucagacuucuguaauccugucuuaaaucuguuccugaugggucaagcaggaaguaacucaaaauuccuacugaaagguuugaguuguugucagucucugauccauuucccucuugaugaaagccuuggcuuugugagacugauaguagaaaccuccauggucuugaauaaucacuuuuccacacucuucauuugguacccgcucucuccauucacauauacuuuuccuuagggagcaagcaucuaguuuguucagaauaaaggaugugacuuguuugcuucaucccagugagauauuaucaguucgauuguuacaggucuuuacuuuaccuggcacuguguuuaacacugggaaugcagcuaagaagaagacuaacacagcccuauucaucauggaguauagucuagugugagaagacagaaaucaaaucaucauacaaguccauaugaauuaaguauuuugaaagaaaaguauauguaacuguaacaguagaggguagggagaccuacucuauuuagagggaacaacauguacaagggcuggaugguggaaaggaaugggaaacuuucaaggaacuaaaagaagaccagcgagaagugggugugacuggagagauaggcagggaugauccugcacggucuuuauaagcuauguugugguuuguaauauuugcaguucaguuuccuaguuuuuguuuuuuaauuuuagauuguuuacacuuugguuuggaaauucuaccccuucguaauuuuuaaaacuucaugacauguugguguccuauggauaagguuuggauuuuggaaugucagcaaauaaugagagccuaguccuaggcuucuuagccaucuuccccucccuaggauguguaccacaauaagaacacaucuguugguuuugccuaacgguuaauguuguggccuaugccauggucacaugagccagucuccugcacaaugcaaaggcugucugugcaaaucuggccagaguuugcuguccugguaaauaagccgcccuuuuccauuggcuagccugcgaugcgagucuuugcuguaccugaggcuguucaaacugaagaaggaaaaugcucugaaguacucaaagacacugacagagcaccugaagguaaguaugcaaaagcacaagguccguuuccuaggagacagaauuuguagucucccauccccaucugagaacugcccucauguuuaugcaaaacacaccaggggaggagcuacuguuugggacuuuucaaauaaguuugagguuucuuugaguuuuuuaaucuacguguaucugauuguagaacucuuauagccaugugcagcggcuguauuuacuuuuuaaaugaucuuuuguuuucggccggguucgguggcucacgccuguaaucucagcacuuugggaggcugaggcaggcagaucacgaggucaagagauugagaccaucuuggccaacauggugaaaccccaucucuacuaaauauacaaaaauuagccaggcauggugccacacgccuguagucccagcuacuugggaggcugaggcaggagaaucgcuugaacccuggaggcggaggcugcagugagccgaggucaugccacugcacuccagccuggugacagagagagagacucugucucaaaaacaaacaaaaagucuuuuguuuucaugccauccuuuucugacuacuaucuuaguuuccuaaaagauuuuccuauguuucuucaggccaguaccacauaaauccuccuaaaaucugccucugauuaugacuuggaacccuucaguaguugccugcugggucaaguuuaaacuccuuacccuggccccaaggggucucuuguuccuugucuaaaccucugcuuuaggcaaacugcauggggcacauacacugucuuuucugcagccuuugugcauaguaugauucaucucuccccucuccccacccacccacccacccaccccuuuuuuaagagggaguuuuuuaaaaaaaacgaucauggcucacugcagcuacucccagguagcugggaguagcugggauguaucccccuucccuuuauccauguguuacucauuauuuccuugccucuucugugaagucuuccagaacacccagcucucaccuaauaauuuauuucuuuuguacuuuuacacacacacacacacacacacacacacguauuuuggugucuuaaauauuuacagcugcucacgaugagcucuugcccaaagcuuuuaaauauauuuagaacuucuuaaaguaguggugguuuuuguuguuguuaaguacauuuuacuuuuuccacagaauucuuauaauaauucucaagcaccaucgccuggcuugggaagguagguaaaauuuuauuauguaaaauauuauuguggcaauaaaagugaaaugaguaugguccaauuuccaaaaauggaaagaugacuacuuuuuaaauaaguaaaaccaucucugauaaaauauuuuuagaaguuauaauuuuuucucuguauuuuuuaggaauugaaaauauaaaugaacauaaucauaaagauuagauaugagacguuucaccuguuaagaaaucugaguuuuuacuagcacucaacccuuuucacaguuugauuuccauaguuacuuggacuuaucacagcaggcuuaucuuuagucagaucuuggcacugccagaauuuaguaacaaugacaugauugugauuucuccuucaucuccacgucacuuucaucccaccuaucucccaaaggauaaaaaacaccauggaaccuuuuaaauuguaucuguucaguuauuauguuuauaagaauugacauucuuuguccuguguguauuuucuuacauaaguuuauaaugcuaaaagugcagauaaaaauacaaacaagccgggcaugguagcucacgccuguaaucccagcacuuugagaggccgaggugggcagaucacaaggucaggaguucaagaccagccuggccaacauggugaaaccccaucugugcuaaaaauacaaaaauuagccggguguggugucgugcgcgccuguaauccuagcuacucuggaggcugaggcaggagaaucauuggaaccagggaggcguggagguugcaguaagucgaggucaugccacugcacuccagcuugggugacagagcaugagugucuccaaaauauguauauauguguauacacaaguuuauuuuuaccccaacuuuugauuuuuccuuucuuuuagugugugaucauagucuugaacauuucacaaauuuuaauacuccugaaaugaaccugccagauuucaacauguauguuuucuaagaaauauuuaauuggcaggaagcuuggggugauuacaguugcuugagagagcuguaccucuuuguuaccucugaguaauuugguuaaacuaggaaagugucagaaauuguggaguucaauaaaagauguucccaucuucuaccacaguuuuuuagguuaaaugugaauuccaccaaacuuucuacaaaacaguauaaaaaauauguaauuauaugcccgaacagauggaaaguguugagcagagagugaggggaucuggcuuuuaagucuuugaacuguaacaagguacaugacuucuucaguuauuguccaucucuuguuuuguuguuauucauuaaaacaaaggcuacagauucuaagauaacaagauuaugaauuacaagauuauaguacuuauuuagaagaaauuguagcucucugaaaacccaucuaguuuaagagaaucuuuacauuuuaaaugcuuucauguagaaagagcuaguaguacuugauuuuauaaugcuuaccauguccauaugaacaagcuuccuauuucuguuguguagcaaagcuguggggaugccuuccccuguuucuccaaagcugucaccaggcaauucaggaaauuauucaucuggggccaguagugcuucugcaagugguucuucagugaccauuccacagaagauccaccagauggcagccagcuauguucaggucacauccaacuuccucuaugccaccgaaauuugggaccaagcugaacagcuuuccaaagagcaaaaagguagguagguuucuggauaaacuucaagggauggaauuguuagaaggaacuuuuauaauuuaguuaaguaagcguuuagucuguauuuaguuuuauuauuuagaguuaaugauaaucuguuuguuaauagucuucauugcuuagcaguuaaacaauaaaugaaacugaauuuggucaaaagauaccucucaugauucuggugacaaaacuaaacugaaaauaguucuuggacuaagacaaaugugcuuauauucuggcacauuaaaugcagcucauaccauaaaaguaauaaaauauauguccuacccuaggaugguuaacaguaaauuuggcaauaggcauaagauuacauccaaacaucuguacaucugagaagguuaauguauaagaaagcaugcucauacuggauuuuuagguauauuggaagaaaccugugaaauaaaggagacuagggaaugaauagaaauuuuuuuuuuuuuuuuuuugagauggaguuucgcuuuuguugcccaggcuggagcacaguggcacgaucucgacucacugcagcuuccaccuuccgguuucaagugauucuccugcucagccuccugaguagcugggauuacaggugcccgccaccaugcccggcuaauuuuuguauuuuuaguagagaugggguuucaccaugugaaccaggcuggucuugaacugcugaccucgugaucugcccaucucagccucccaaagugcugggauuacaggugugagccaccacguccggccagaauucuuaacauucuuuaaaauuagguuguuugaggcuuugcccuuuaaaaguuuauuauuucccaaaccaaggacauggagaauuauaaagucuuugaagaccuuaguggaaaguacuguauaaccaccauuuuauuuaguagauguuauuagcaaauaugugcaugcagcuucucuuuaggcagauccuuuacagagaaacacuacauuagccaaucaagugucauuuugucacagaguacauuuaaauacuuacagcgugaacagguaaucagaugaaaaugaaagauuccuaucccuaaagagaggcaauggugaaagguaaaaguggaaucccaacuuuuuuuuuuuuuuuuuugagacaggguuuuacucugucacccaggcugcccaggcuguggcacagucacaguucacugcagcaucuaccucuugggcucaagugauccucgugccucagccuccugaguagcugggacuacagaugugugccaccacaccuggcuaauuuuucuacuuuuuguagagauaaggucucauuauguugcccaggcuaggaaucccaacauucaacauaaagcuguauuuauaaaaacauaauuuguggccgggugugguggcucacaccuuguaaucucagcacuucgggaagccaaggcgaguggaucacccaaggucaggaguucgagaccagccuggccaacauggugaaaccccaucucuacuaaaaaaaaaaaaaaaaaacuuuuuuguauuuuauauuuggcugaggcagcagaaucgcuugaacccaggagaccaggguugcagugaaccgagaucgcgccacugcacuccagccugggcgacagggagacugucuaaaaauaaaugaaaauaaauaaaaacaugggauuuaguuaucaguugguucauggcauaugaugguagccgaaaguuugauauaaucuuaagugucuaaccucacagaggcuguuacaggaaacaggcaaagaauguccuccuuuuugugucacuugcuucuuauacaaaagcaaugcacaaaauguuuugaguaaucaguagcacauuauggcauuaaaucuucauuuuaauaauaucuacugcauaauagcaauuuaucauuuccauucauggaauccugcuuauauauaacacuuaauuucugaccauacauucuguuuaaaauguugcaugacuuagggaacaaauguaacuugagagacuauggaaugauuugcucuaaaacauggacaguaagcauuuuaguguaggaggagguauuuuuugaguuuaugaaugcuguuuuauaaucucuacucauaguuuuaaagcagugauucaaaagaguauauaucauuuaaugaauguuuuugguuuucuagaauucuuugcugaacuggauaaaguaaugggcccucucaucuuuaaugcaagcaucaugacagaucuaguucguuauacccggcagggacugcacuggcuucgccaggaugccaaguugauaucuugaacugaacacauucucguugccucugauuuucuccacaacacugugucacaucacgaaggaaaacugccauaacauaccaccuagucgacacuaagaaugaggaauaguuuucuccucguugguucauguguuguuguuuuugauaauccaaagcgaucaugucaguuggcccuuuaauauuuccaaugugaaagauuauuuaaaugcuuuuaaaucugcagcacauugauaagaugguuuccgugagcuaugauaagauugaaauuccaguugcaauucauaacuaaugaauugaaauuuuauuuauuuuaauuuuuuuaaguucccagauuggggcuaguuuaagacuuaguuauuucugccuauaaauuuacucuguugaauauuuagcauaaauuuaauguagacauuuuuauuuauauaccuugggagcuuuauuaccuaauaucuuuuugugguagcuguucuaagaguaagaauugguucgucuaaaauaaggacauauucuuucuacaccugcuaccugaccugauauuugaaaucuuaacuccaauuuuauuauuguggaauuuacaguuaguauuaaggauauucuucuacacaugaaaaaaucacuuaaauaugagaaaauggcauucuacauguauguacuaugaaaugugucugauuugguaugcauuauuucaaaaacugugaauguguguuaauaacacuacagcaaucacacagugacuauagcuugcauuuaaugcauuacaaaagagggaggacaaacuuucuagaagaagcauuucauguugaaggguuucauaaaaggacaauccugaacguuacggauuuuauuaaaaccauauguuauuuuuuguugcuaaucauuugacacuuaaucgaaacagaauaaguuacuguggaaaaaaggaugauccaacuccugaggauugccgccugugugucuuuaauugauuaucuuugauaguuagaguuauuuuucagauuuuucccccucauacuggauugugaugcucugauaugagcaugcaaugacugauacagaaauaggcuggagcuucggugugugcuuuugcuauacagcuuacaguucuaaugccugauguagagaugaugaauuucuccuuuuuaaaccuaucuucuguuuacuccuuuugcauuaugaaggcccucuucaaugauguauguuucugauggaaucagaaaauuucacacuagaaaaguguaccuaacuugauucagugugagcucuugggacagggaguggagccagggguagagcuuaaagaagcuggcucuguaagaguuguauaucaaaguaccuuuugcuacaaggugcauauagaagucuaagauaagaaauguacccucuauacuuuauuuuucaugccccuaucauguuuggugugccuuaaaucuuaccuuuaaaugaagacucuauggauuguuuacaaaugaaguuuuacacuaggaccagaucguccauacaugauuggucuucuacaauaauaauguucaauucuuucauuuuaaaucuuucuuuagggucauauaaagauuaguucuuucagaaaagcuauugcuuugguacaugacuuagucuaaccaguuggguaaugcugcuuugaaaaauaguuugucccucuccccauuccaaaaaugaauccauucagucagaaaaaaagauuauccuacuauuuguagaugauugcuaaggcuugaaauaggaaaggggaaagaagggauagaaaaguuucaaguccaguagugcagugaauccuuuguguuugagacuuuuuuacacuuauuucugaaguuagugaacuuucauugucccuguggccucauauuuauagagcuucuuaacuguuuuguaccucagauuguuuuuagaugucauugaagauugagauguacaaauuauguugaauuuaaccuguuucucuuggagaaauugccucugauaucuuucuaacuuaaucuuaguguguucuaggaacaguuuuccauaagaggacaacuucucaaugaucaugauaguuauuuaguaagaaauaaugguuguuaaucaaauacauguuaugucuuguccuucucugauuuuucugacuuggauuccuuaauuugcagugaugucuuagaaauggaaaaaguauccucugggcuuucagacuuucagcaacaacagccagugggauaccucugaguucuuguguucuagucucuuguauguccugaaaggcagcaggagcauuuuuggggucacacugauauuuuguuaaagcagaguuuccugcaugguuuauggugcugcucuaauauuuucucuuuaaaacugugucaauuuuuggagaaugaauuuuucaaccuuuucauuguggaggauuuuucccacaagguaguaaugggcaauggaucaaaauccuaucauaaaugauugaauuuucaaugucauaguguguggaaauacuacucccuuuccuccaugucuaucuucuuagauguucugucuuugucaucaucugcuccagcacauacuuuggacuccuuuacaggugaccuuccccccucccuccucaauagguguccucaguguuuucuaagcauuuaaaacugaauuugacaaguggcuaaaaacuuagucugagacuuguacuuaguauaugguuaauuauagaaacaacaacuauuuuaaacaguuacucuguugacugcucuuuaugacuacacuuguaugccaggaggcagcagccuauacaccauuagacucuuuacaagcaaccaacgaaccaauugcagugguugcaguugucacaguagucuugccugggccagacugggcugggcugugggaagcauuccccuucaggggaguuuccacagcucagcccaggcuccagucuggcuagagagcauccagcccauuccuugccucagugccaccuuuuucugggcaaguagccaagaagugacuuuauaugcagugaguacuucagauaaacuuacagcuacagcugccgaagaguggagaagguugaccaccauuuauuuaauucucuaguguaaaaacaauugagagcagugugcgugagcccacagacaccuguguuucugggagcucuggcaguggcggauucauaggcacuugggcugcacuuugaaugacacacuuggcuuuauuagauucacuaguuuuuaaaaaauuguuguucguuucuuuucauuaaagguuuaaucagacagaucagacagcauaauuuuguauuuaaugacagaaacguugguacauuucuucaugaaugagcuugcauucugaagcaagagccuacaaaaggcacuuguuauaaaugaaaguucuggcucuagaggccaguacucuggaguuucagagcagccagugauuguuccagucagugaugccuaguuauauagaggaggaguacacugugcacucuucuagguguaaggguaugcaacuuuggaucuuaaaauucuguacacauacacacuuuauauauauguauguauguaugaaaacaugaaauuaguuugucaaauauguguguguuuaguauuuuagcuuagugcaacuauuuccacauuauuuauuaaauugaucuaagacacuuucuuguugacaccuugaauauuaauguucaagggugcaauguguauuccuuuagauuguuaaagcuuaauuacuaugauuuguaguaaauuaacuuuuaaaauguauuugagcccuucuguagugucguagggcucuuacagggugggaaagauuuuaauuuuccaguugcuaauugaacaguauggccucauuauauauuuugauuuauaggaguuugugucugggucccaggaacaucuacuggggaugacuguuaggcagcuugugaugauguuuuuuaaaaaaccuaaguaacuuggggagacagagcauuucaaacccauauagacaccuaucauaccuguauauccccuaauacauggaacauaaauuucauuucagcuuuaugcauuaauguauugaagaggcaggcuuuuuuuccaguaauaauacuguacaucuaagguugcuauucaguaaaacuaauagaagagauaauuauugaauaccuuggaauauguagugagaagaggccaaauuuuucauguuugugagcaugucuuucagauacucgcuaauggagaaauucacuuuagaccucuagaccccaaaaccaaguuagcaagugacaaaaaguaaauuauuaauagucuguaaaguggaugcuggucuuacaaagcuccuauucacaugaacccuaugguuaauuagaaagaacuugcugucuccagaaaagggaauggaaauaauaacuauguaucuucuuuucauguaauuuggucacagaauaagguauucaaguuaagucuaauccaagucuuagagaucuuuaaguauccuaaaauagcagccuaaguagucaucauguaaagaaguugacuuucaggaaugucagcauugaccucuccuugccacuguuacucagcuaaacauaacuugccauucuuaaaaauaaaaaagcucccacccagaaacucuagugauacucaguuuugaccucuuacugcuuccaugugggacuucuuuucagcuuuuaaccauuggaauuuucuaccugcuauguuccucucuggaaaauaucaauuuggaaaugcugccuuucaaaucaaugccaugaucauccauauuguugaguuuguuguugguguuccagaaguguccccauuuuacaacuuuaugcacacaccuggcaaaucauuaacaugagcauucaacaguacugggaugggugggguggggguagggggcucaccaacagaacuggccaguugacauugccugaaaaggcaccaccuuuaagggccaguugugggguugguaagcacaguuaugaaaauuucuaucuagccuccguuuugaaugguuuuaagaaauuuuguauauggaggauggaaaugcuuauauauuuauugaaaauccuuuuauuugaaauuaaaauuauuugguauauaauuguuugauauuuggggaggguuuuggaggggagauaaugucacugauaaauuaaaagccuguugauuuugcagaaagguacuguuagugacugauaaggaugccuuuguuuuguacaugaaccaaaucuuuguuuuacauuucuuuuauccaaaauauuuaggcaucugacauuuucaaccagaauuucaauuauauacugugauuuuuauuuguugcaauacauuacaauuucagagguacuuuggggcucaaaagcuaggauuucuaagucaguaugugcauuucacacgauaaagcuguuaauggugagcaaaguauuauauacuaacuagauuuuuccacaucuguauaguauauuauauguauuuugugguauugagaguauagaaaguuuagagugucaaacaugcguuuaauguguauuuuuaaacaaauuuauggcaauuaaaauauuuggagacaaggguaucacauuucaauuuguaaagaucuuuuuaacucuacugugucauuaagaugcuuuguacaaugccaaaccauaguuggagaaacuaaguuuaauaaauaucaaauagauuuucuguauuaaaguuacugaacacugua

SEQ ID NO: 192230 - RNA, 155350 nt, Homo sapiens
gccccgccccgcgcgccguggccguuugaagugacuaauuucugucauaugacugaggcgcccauggggguggcggggcggcuguaggagcaggggccuagcaagcgcccagcggagcgaccccugccuggccguggcuagcauggccccuacgcuguuccagaagcucuucagcaagaggaccgggcugggcgcgcccggccgcgacgcccgggacccagauugcggguucagguagggcgcuguggggcgggggucgcggagccgauggccuugugggcuccgggcuccagggguguuggggccuucgguguuccgacccgagcggaagcgccgcgccgagagcagcaucugguccucggugggguggagccggcugcgggcuagcgccgaaggguuggagcgagguccuaccuuuuauuuuaccccacccgccucgccguugccccuucccccuccucccgucgguuuguuuacgaccugcccccagccacgcgcgacucugcuccuccggaccuagcaccgcggccugagacuuuggguccacacgccuuccuggcaccgaguagaguugggcgcgggcuggauuggaccucagccgccguacuccgggccgcgaaguucuccccuccuccccgugaccaguuguccuccgggcgcugcguuccagcuccguuggcguuguggagagagcggcacguuuggccaagcuucugaguugagagaaggcuggaggagcgaguaggcaacgugccguucuuucagguuucuuggacgcuaaaauuggaggugugcaguaaccggaccgagcgaccuuaauguuaucgaaggagaaaugugaaacuugaguuuaggguuacugccgaaggaagaccaaauugaaugaaaucuggccuuggaauuggcuguagauucuuccuccucgaauuguuacugaaaaggagucuuaaaaauugaaaauguuaguagagcauuuuguaguguuacaggcuuuguuaauuuuucauuguaguaccuguugcuggcagaguaacuuuucagaauuguaagauuugauauaaaccugaauucaagguaaaauuuagucguuaaacugcaccugaggagauuauguccaaacagccuuuauacguauugcaguguggaaacuugcaaauauaacuaggcuaaaugucaaaugccacacguuuuaaacuugguaggauagcaaagagcccaguuguacaacaauaguagaaacaaaaaaauaaaauaaaaauaaaaaaagagaaucugucaaauuuuggaacaggcgaaguugccacacugguuuaagaaauuuugcuauucuuaaaauuauucacucucucuugcuaaugcaggucucaucaggaaaaauucaguaaaugcauauggaauugaagagguuuuucuacguaucugucuuuuccccugaaaaauaaaugugucaugcucaucugucucucuuuaaacauuucuuuaguguuuuuccuuugaaaaaugaaagugcagguuagauaauacuacauugagccaucuaguaacucaagcgacaauaggaaacagguuccgauaggauauuuaaaagguggcauuugaauagacaacugcuuucuauuucuggacaaagauugacuuuggguacguagguuuacaaggcucucaagucacucauaugaaaaaacauuuucacgucugguuuucaaaaauguaaagucuacuacauaguugcguaauacuauuuuacaguuaccaaagaacuuucucaucaguuaucuuauuugauguuucacagcaaucuuacgagauagagcaaguagcagugcagauaacuauauacuuuugccaguggaaguaagaauuaucuguaagcccaauaacugcaguacauuauggaaucucucacuuuaaaaauaaaacuugugcaugugagaaaugaaaacugaugaaacagaauaggcauaucugaaggaaaaaaaaccauucugguuaaugucacauagcuaauaacuuacagaucuaaucaacccaggguuuuuuaaaaacuauuucauugagcuauaauuuauacacaauaaaguauaaauacauuuuaagcauacaucguauacaguuguguacccaccacccccaugaaguuuuagaacacuuccaucacccaaaaaguucccucaugcucuguuguagccuaacuccuccucacccguggcagucacugauacuuucugucauagucuugugucugucuuguuuguugcauuuauuaguuccuuuuuuucucacucugucaacaggcuguaguacaguggcgugaccacgcuuaauacacugucaaccuccugggcucaagggauccucucaccuuggccucccaaaguucugggcuuacagggaugagccaccacacccagccaguuccuucaauuuuaucacugaaugguauuccauuguauggcuauaccaugauuuguuuauucagccacuaguuggaggacauauuuuuuccccagauuugggcuauuaugaauaaugcugcuguuaauguuuguguauaaaucuuuauguggacauauauuuucuuuucucuuggauagaaaucuaggagugggguugcagagucaugugcuaaauguuguguuuaacuuuaaaaaaaaauugucagacuuuuccaaaauaguuguaccauuuuguauucucaguagcaaugcaugaagguuacagguucuucacaaucucuucaauauugauauuguuauuuuuguucuuuuuuaauuaaaaauuuuuauuguaaaaaaaauaugaaauuuacuuuuuuuuuuuuuuuuuuuuuuuuuagauggagucucacuuguugcucaggcuagagugccaugauacaaucaaggcucauugcagccuugaccuccugggcucuaguaauccucucaccucagccuccugaguaggcuccuaaguauccucccaccuuggccucccaaagugcuguaauuacaggcaugagccaccaugccuggccaaaauuuacugucuuaaucguuuuuuuauucuuuugauuauagccauucuagugguaucuugugguuuuaauuugcauuucccgaagaucauauucagcaucuuuuuauauaacccagguuuuugaguagacuaacauuuuguuuucauucuaguauaccaugcuuucauugcuggaauccuuuuuuggguguuuuguuuuguucuagucagccuaaauuguuaaaucaggcuuggguguaguuagccauuggcaacuaacuguagcucagucccuaagaggcaguuccuagaguaaccaauauacaaagcucaguaauuguaagccacagcaggacuuuagaauaggagagacuuccgauaaagaagcuuuaggaaccuuucuguauugucuuuuaugguuaccccauuggaagagauggccaggaaauacccccuucccuugucuucacucuaaggucucuuaccauaucgauuucuaugugcuuaucuaagauucuugagcuggagaugaguuugaaaaauauuauggggaguguauuuuuucagucauuuauagaauugagacaguaauuuguuuucuccauuucaagaauuugggagaaaaggcuguuucuaguagaaaauauugcuuuauguucucuccauuuucuuccaguggaaguaaaaaguauaagcccaauaacuauaguacauauaaaagugauuauuuugggcuggguuugguggcuuauacuuguaaucccagcacuuugggaggcccauggcgggaggagugcuugagcccaggaguucaagaccagccagggcaacauggcaaaaccccugucucuacaaaaaauauaaaaaauuagccauguguggcagcaugcaccuguaguccuagcuacucaggaugcugaggugggagguugcuuagccugggagguuaaggcugcagugaugagccaugauugcgccacugcacuagucuagccugggcaacagagugaaauccugucucaaaaaaaaagauuguuuuaaauaaaauuccugaaaacuaauuuggcaaagaagguuguuuugaagugaaauguuuguagggcauaauuaauguuuuguuaaauaaugucuggauuuuuguuauacagguugaguauccuuuaccugaaaugccugguucuagaaguguuuuggauuguggaauuuuuuggauuuuugaauacuugcauaugcauaauguguuuuuucagaggugggaccuaagucuaaacauaaaauucauuuuuauuucauacauaccuuguacacauaauagcacauaauuuauacaguacuuuuuaaugauuuugugcacaaagugucgacugcauuuugacuccucacaugaagucagaugugaaguuuuccacuguggcgucuugucagugaucaaaaaaauuuuggacuagagaugcucauccuguaucccaaauauaugaacauuuauucugauucuuuauaucagggauucuuaagguacucagccuuuuaacuggucuuucugugaucacucuugccuuuuuccaaacuacccucaauaugucacuuuuuaaaaagugccaauuguggcugggcacgguggcucaugccuguaaucccagcacuuugggaggccgaggcagguggaucaccugaggucaggaguuccagaccagccuggccaauguggugaaaccccaucucuacuaaaaaugcaagaaucagcugggugugguggcgggcgccuguaaucccagcuacucaggaggcugaggcaggagaaucgcuugaacccgggaggcggagguugcagugagcugagaucgcgccauugcacuccacccugggcaacaagagugaaacuccgucucaaaaaaaaaaaaaaaaagugccaguuaucaucaugaacagcagacaaaaugagacaaaaugauguauagaauuuaauaucuucauaacagguuuauuuuaaggauucagagauaagucauguaaagaacuuaauguggugcuuagcacauggcuuucaggaaccagaaguaguuguuacuguuauaucaguuuuguguaaaaaccacuuaguuugggcccagacucauuaaaggauggcuuuugcccauucuacauaguauggcuuuugcuaauuugcuagccuugacuuuuuuuuuuucuuuccauaaugacauuuuuuaaaaaagccacuauaguauuauuguuaauagaauuaacagaaauuccuuaauaaaagccauucuuaguccauauuccaauuuggugucaucucaauaugucuuuuuaugguaguuuuguuugaaucagucuuaagagucuguauauugcauuugcaguuaggcagcuuaaguaaauuuuauucuauaacagcccucccccacuuaaaugugaaauuccccacauucuguguuuggcuuuuccagucuuaugguuucccagcaauaugugguuuaaaaagccccuccaggcaauucugaugcucagguuugcuguaaguuugcuauaaccuauuucucuguuucuugucuuuccugaaaacuugaaguucgauuuagauauuuuaucauauuuacauucccuuuuuuucaauaaaauuauuuuguagauguuguguacuuccuauucaucaaaguuaccuaccugguugccccacuuguagugauuucaggugguaucagccuuauucuucuauuacauaauuugcccuuuaacuaaugauuuuagcauucuuuguugaucauugccugaauucauuauuuuguuagaguuugcaaaauggugauauccugauucucuaauuuuuuaugcauuuauuugcuggaauaacuuuuaucaacuauuugguuacuccuugcuacagaaaagggagcauaaaaggugauuucccuuugucauuuuccaaaguaauugguaaugagcuguucacugcagguuuuuuguuuuaauuaucaucuuaaaagauuaucaugagcuauuggauuuuaguguguuuuaauccacuccugucaaauugucucauauuuggccaauggaagccuuuuuagguugacuucuguuucuuuuugacaugaccucauuaaucuuugauaacuucuugcuuucuucuggccuaugucuuaaucuacacuccuccuucuaagaguuuaucaccuuugauuuauuuuagauucugggaugugccaagcuguacugcucccuguucuugauauagucccuuauaccuuuuuguuuggcuuuuuguagugaucaucugggcuuauucuaauuacuacuuccuccaggaagccuuuucugauuucuuccagacuagaguaggucugacuguaacuuuguuucauagcuuauugcauguccuucugugacaucugucauaguugucauuguccacgucucucuucuuugcuuacuugagccuuuucuucaguguuaagcaucaagauuuauuuuauagucagaacucuguaaauucacguaagggguuguguauggggaauagaugccuagguuuuuggcuggagcaacuaaguaggugccuuuuuuuuuuuuuuuuuuuuuuuugagacagguucuugcucuaucgcccaggcgggagagcgguggugcgaucuugggucacugcaaccuccgccuccugggcuuaagccaucuccccaccucagccucccgaauagcugggacugcaaggugugggccaucauggcuggcuaauuuuuuauuuuuuguagacacgggguuucgccacguugcccaggccaguauagaggcugaucuuaaacacgcuaucaaaaauagccaccuucuccccauuuucugucagaacacacacuuuauauccauuauagcucuuuuaauaauuuauuauaauuugucucccccaaguucacauuguugugccaguggacagcacagugccugagcauaugcugaggaaauauuuguagaaugaauaaaugaaauaacaauuuuaagggcagagggagagggucaaaaguucuguuuuggauauuuggucugguuuuaauugccauugagaugcccacguagagaugacaguuuaauaaagucagucuggaguucacaguagagauugggauugcagauaugaguuuguguguaugguuaguauuaaaacuacagaauggaagagaucaucuaggaaaaggguguagauagagaaguggaaaggacggagggcuucgcccugaggauguguuaaaauacacagaucugagagaggaagauauaccaagaagauagauagggaaaagccagggaugugugguguuagggaagccaagaaaagaaaguguuuaaaaaaugauagagugagugauaaauuguuuguauacugguugcugacaggucucgugaaaugagaaacagaaaaguguccauuauauuagucaagauggaggaaauuggugaccuugaugguuuuuugguagggaggauaaauguuuggggggaaaagugagauagauguggaguaaaugugaggaaauggccccacuacuuaacuuucuauuauuucuauaggauaaauauucuguagugccgaguuauuuuuucacuugcaguguucugauuuuaugucacauuuugagcuucugaaguucuuaaaagcuagcuucauaauauuaccaacaauuauaagaaucauguuucagaaguuuuguuuuuuaaaugggauuuuuaaaaauuugucauacccacaagaauuuuuauuuuacuuaauuuauuuuaaauauauguauuuuuaauugauuggauuauacacgucccagccucuuguaaccacuauucuacucuacuucuaugagaucaacuuuuuuaguuucuaaaugugagugaggacaugugguauuugucuuucugugccuaauuucacuuagcaucauguccuccaggcucauccauauugccgcagauaauagaauuucauucuuuuuaauggcugaauaauauuccauuguguauauauacgacauuuucuuuauccauucaucuguugauggacacuuagguugauugcauaucuuggcuaguguaaauacuguugccguaaauaugagugugcagauauuucuuugacauacuaauuuucuuucuuuuggauauauauucaguagacagauugcuggaucauaugguaguuuaauuucacaguaagaagugcaaauauuauaauuuugguuguuaauuuuaucugcuuuuucaucccuaaguaguggaauuagauuuguuuuuuacacuggguuuauugaaaaaaagagaaaaauacagcuuuaaaguguaguuuaugaaacuuggauaucacuucuuuuuuuuuuuuuuuuuuuuuugagacagagucugucaccuaggcuggagugcaguggcacaaucccggcucacugcaaccucugccucccggguucaagcaauucuuaugccucagccucccgaguagcugggauuacaggcacgugccaccacgcccaaaaauuuuuguauuuguguuuauuuauuuauuuuaauuuuuguauuuuuaguagagaugggaguuucaccauguuggccaggcugaucucaaacgccugaccucaggugaucugcccuucuuggccucccacagugcugggauuacaggcgugagcuacugcaccuggccuuggaucucacuucuuacuaauauaauaauuaucuuaaauccuauugauuuuaaacuugcuuaaaauaacuucccauguaaaacauaagauaaccucuuucauuuuaaaggaguccuaaucuacucucucuugauuuuguuucuguuucugggaccaccauucucuuagucuaccaaguugaaaaucagagaucauuguuuauuccuccuagucuuugauugccauauuugcucauuuguuaaguccuguugauucagauucuuaguagcuucaguucuuuuucauuuuccacugucaucaccuuauacaaaccguugaugccuuucuugaaacuuuuccauuacuuucccacuucuuguguguucuguguuccccuccacaccauacuacuacuuuuuucagcaggaagacagggucucacugugucacccaggcuugaguuggaguucaguggcgcaauccuagcucacugcagccucaaacuucacuucgagcaguggucccacguuggccucucaaaguguugggauuacaggugugagcugcugcaccuggccccacacuguucuucuaaauugauuuuccuagaucauaauucuaaucaaaacacucagaagucuugacuccucauuaagcaaugaggauugaucugugcugcacacuguuuuaugugcuuuacaccuauuaacucauuuaauucucacaauagcuuuauaaagaggucugauuaucccuguuucauugaugaggaaacaggcacagagaaauuaaguaucuuaccccaugucacguggcuauuaagugaugaaauuaagauuugaacuuagauguuuaaguucuagagccuuuguucuuaaccaaguucaaaguccucaguuuggcuuaucagccuuuuaucaaguuguagcuggugugauggacuugaugaguucagauccaugccccaguacugcggggugucuguguguaugcuugcaucucuuaauucugaaaucagaccacuugguuuucaaacucgaguucucacacuuaauugcugaguccucaggcuucauucucuuuugucauuagguaaugcuagaagcagugccucuugaucuguuaucucauaccacucugccuaggagacaagacucuguacuccaagauuuucagcaaaaguccuaaacucggugcuguuuauaucacccuugaacuuauucauggucaucaugaccugauuggcuuaggcauagacuaccuauuuugguuacuguggcaaggggaauggaguugcucugauugugguaguacaucuggagcuaguagugaggucagucucccacaaaaugcuggcugaagagggggaaguagauacugaagagauagucccaguauuuauuauaccuaccuucugauaguuguuuugaggauuaaauggcauaguagguacucagauguuagaauuucuucccacauccccugcuuuaguucaguaugugcuguuauaacagaauaccagagacugaguaauguauaaagaaaagaaauuuauaaggcucauaguucuggaggcuaaaaagucugagagcauggugcuggcagcuggugaucccguggaaaaaggcaucacgugggcaagagaaaaugcgggugagagcaagggggugcugaacucacuuuuauaacaaacccacucucgagauaaugaccuuaauucauucaugagggcagagcccucauaaccuaaucaccucuuaauagucucaccucucaaaauuguugcauugaggauucagucucugacaugugaacuucggggacacauucaaacuauagcacucuaaucccccaauuucucuuuuccagccuucauuuuaguuuguccucuagugguagccucuaauuaggaccauuugauguuucuugagaauaaucuguuucauguguuugcaaacugcuuggaauacuuuggaugugacguauuuuacagcuccaauagaacccauguuuuuccuguauuucuucauuguggcagauacuugcuuguguuuuaauugcauuuuuauauaucuauauuaauacuucacuagauuguaaguucuauaagggcacagccuuugucuaacuuagugcuguacuucugguauccagcucaaagaaggcauucaauaaauauuugaugaaugaacaaaugaauaaaaauagucacugaacugaaaaaguucuaauucauuuaacaaagaugcuucuguuuuguguugcuugccuaaaguuauucauucaaugagcaauuuaagcagauuuuucuuugacaucauuguuuaucaauuuaaaggaaaauuuuauuuauuuugauuuuuuuaaacauugcaaggguggccucauuuuccagaauaaguuuccagaauaaguuuuggaaucgguuaugacucccauaaauaaggauuuuguauguauuuugauuaauuucuaguuacuuuagaauauaaaacacaaacugcacauuuguaaaaaauagacauuauuugugaauaauuuaaauauuaaaaaauaaauauuuucaaagaaacaaggucucacuuugcugcccaggcugggcuuaaacuccugggcucaagcuaucuuccugcuucagccucccaaguagcugagacuacaaguguauaccacugcacccggcuaauauuuuaaauuuuuuuuaacgaaaugccugaacauuuuuuaaagauuacauaguaaagccccauguuaauguaccgucugugacacgaucaguuccaaucauggaacuccugacuggcuaaguggugaagcucguuacuuguuaauuuuuuuguuuuuuguuuuuuuuuugagacggagucucuguugcccaagcuggagugcagugaugcaaucuuggcucacugcaaccuccgccucccggguucaagugauucuccugccucagccuccugaguagcugggauuacaggcgccugccaucacgcccggccaauuuuuguauuuuuaguagcggcgggguuucaccauguugggcaggcuggucuugaacuccugaccucaagcaguccaccugccucaaccucccagagugcugggauuacaggcgugagccacugugcccggccuacuuguuaaaaucugacucaaaauauuauguguugaauuuugcccugcccaauagcguuaugauauauauauagucauauauaucauauauaugauauauauauagucauauauaucauauauaugacuauauauauagucauauauaucauauauaugauauauauauagucauauauaucauauauauaugucauauauaucauauauaugauauauauagucauauauaucauauauaugucauauauaucauauauauagucauauauaucauauauauaugauauauauauaguuauaagaaauuuacuuaugauaguaguucccugucccaccgugccucaaacccaguccugaucuuagaggcaaacugcuuuuucaauuacuuuugcuguuuuuuuuuuugaauauuuacuuuaauauuuuuguuuuuauuauuauuuuuuugagagacagucucacucugucgcccaggcuggagugcaguggcguggucauggcucagugcagccucgaucaucugggcucaagugaucuucccaccccagccucccaaguagcugagaccacaggcaagagcuaccaugcccagcuaauuuuuauuuuuuguagagaugggggggucuuacuuuguugcccaggcuggucucgaacuccugggcucaaacaguccucccauuuuggccucccaaagugcugaaauuacaggugugagccacuacauccagccuucuuuuauaguuucaaacaaauuaaauauacuguuuauuauugauuuauuuauuauuuccugauaauuaaagauuuaggucuuuaacacacacacacauacauacccuucuccuucauucuuucaauauuagaauuuuugguugaaugaucaaaauuaacuauauuguuguaucguaaaugucuguucacugaugagcuaaguguauuuuauguuuucuuuccuuuugaagguaauugcugaauuuuuguguuucguuuucuuugaaaucauuaguauuucuauauccuucaacggcuccauaaaaccucuaaaagcaauuuaucucuuagucaauuaucugacagauaauugaucaguucauauuguuuccuccuggauauguccuuuuuuggaaccuuccagcccucucuggcuccagucuggacugcuggcccuguagguaugcucccuaguguugucaggaggcuuccuuugucuugucuugggaauuacuuugcccuuuuguuuuuccuucuuuuuuuuuuuuuguugggggcagauuacccauugacuggcuuccauggcuucuuccucuuuggauuauuccuguguuucaguggaccauaucuauccaggaguuuccugagaaugaaagggugggagauaaauuuuugagacugcaagucugaaaaugucuuuguucuaucuuuaugcuugguuggcagucugcuaaguacacaauucuagauugagauucauuuuaagucaguaauuugaaggcauugcccuauugucuugagcuuccaguauugcagcugagaagucaaaagccauaacugacccccaagaagcuuuuuggggguuuucuugauuuuucucuuuaccuucauucugaaauuucagugauguaccucaugauuuuguuuauuuuuguuuuuuaauucauuugcugauauuugauggggcuuuuaaucuggagacauuuuaguucuaaggaauuuucuuacaugauuucuuagauugcaucacuucuuuuuagaacuuuagauccuccagggacagucucccguauugaucuuucaaauuucuuguuuuuuuuuuuuggucuguuuuguuuuuuccucuccuaauuucugacuuaguuuucuauucuacuucuaggagauuucauuuuuuggggggugaagugucuauuuuuaugucaguuaucauguuuuuaguuuccaagagcucauucuuauuccuuuucauaauucucuuuuuucagaucuguuuuucaaccucuuucucugaaguccuaaugaccaugagucugguauuucuuugacaguuucugaagagaauacaccuguucuguguaaaggaugggguuaggaaagggaacuucauaguauauaagcauacacaggugauauugcauguucaauucuaggccaguaaauauugccaaaaaguaagcuacacaaauuuuuugguuuccuagugcauauaaaaguuacauuuacacuacgcuguagucuguuaaguguguaguagcauuaugucuuaaaaaacaauguguaccuaacuuuaaucuagaaauacuuaagaaacggaccaggcgcgguggcucacgccuguaaucccagcacgucgggaggccgaggcggacggaucacuugaggucagggguuugagacuagccuggccaacauggugaaaccaccacgccuggccuagccuccacuucuaauucuaauucucuugcuauuuccaccacaucuacaguuacuuccuucauugaaguguugaaccccucaaaguuauucauaaugguugacuucagcuucuuccaaacuccuguuaauauugguauuuucaccucuucccaugaaucauggauauucuggaaugaugaauccuuuccauaaggcuuucuuucccucccucuuugccucccucccucccucccuuccuuccuuucucuuuuucuuucuuuuuuauuucuucauugagacagagucuagcccuguuguucaaguugaagugcaguggcguaaucuuggcucacuguaaccucugccucgcgggcucaagccucccacgucagccuccugaguagcugagacuacagguacugccacacccggccaauuuuugugcguguuugguuuuuguuuuuuuguuuuuugguagagucgagguuucacugcguugccaagguuggucucgaacuccugggcucaagagauccccccgucucagccucccaaggugcugggauuacaggugugagccacagugccuggccuccagaagguuuucaauuuuauuuucccagauuuaucagaagaaucacuuauuuauggcagcuauagccuuacagaauguauuucuuuuccuucuuuuuauuuuucuuuuuuuaagagacagagucuccaugucgccuaggcuggaaugcaguggugugauccuagcuuauugcagccuugaacuccugggcuuaagugauccucccaccucagcuuuccaagugucuagugcuauagguguuugccacgaugccuggcuaauuuuuuugguuuuacauaaggucuugcuauguuguggaggcugggcuugaacuccuggccucaagcagucuucccaccuuggccuuccaaaguguugggauuuacagucaugagccaccacaccuggcccuaaaauguauuucuuuuuuuuuucuuuuuccuaaaauguauuucuuaauuaguaagacuugaaagucagaauuacuccuugauccguaggcugcagaauggauguuguguuagcaggcaugauaacauuaaucuccuuguacaucaccauuggagcucuuuggugacaagaugcauuguuaaugaguaguaauauuuugaaaggaauguuuuuuucugagcgguaggucucaacagugggcuuaaaauacucaguuaaaccaugcugucagcagaugugcugucauccagacuuuguuguucaucuauagagaauaggcaaaguaaauuuagcaucauucuuaagggcuguaggauuuucggaauggcaaaugagcuuuggcuucaacuuaaagucacuagcugcauuagccccuaacaggagagucagccuguccuuuaaagcuuggaagccaggcauugauuucuccugucuggcuauggaaguccuagauggcaucuucuucugauaauaaauaggcuguuuugucuacacugauaaucuguuauuuaguguagccagugucaucaguuaucuucgcuagaucuucuggguaauuugccuuuuuaccuuguaauuuuauguuaauggagauggcuucuuuccuuaaaccucaugaacuaaccuauacuacuuucaaacuucucaccucucucagacuucauagaguugagagaguuagggccuugcccuggauuaggcuuuggcuuaagggacuauugugacugguuugaucuuccauccagaccauucauauuuugucccuaucagcaauaaggcuguuucacuuucuuaccauuuuuuuauucacugggguagcacuucugauuuccucuaagaaauuuuccuuugcauucacaacauggcuaacuggugcaagaggccugucuuuuggccugucucagccuuccucacuacgcuugaucauuucuagcuuuugauuuacagugagagaugugcaacucuuucuuucacuggaacacuuagaggccauugugggguuauuaauuggccuaauuuccauaugguaugucucagggaauagggaggcuccaggaaagggggagagaugaggaaugguugauggagcagucagaacacacacaacacuuaccaauuaaguuugcugucuuauaugggcacaguuccuggugcccccaaaacaauuacaauaguaacaucaaagaucacugaucacagaucaccauaauaggucaaauaauaaugaaaaaguuugaaauauuuuuagaauuaccaaaaugugacacagagacaaaaaguggcauguucuguuggaaaauggaaccaacacagaguugccaaaaaccuucaauuuguaaaaaaaauaaaaauaaaaauaaaauaaaaauaaaaaaagugguaucugcaaagugcaauaaagcggaguucaauaaaauaagaugccuacauagacuucuguucugugccuuuuuccuccauucuugaagguacuuuaugcuuccagggacuuugcuucucuggguucugagaugaauccugugguugcucauugacacucccauauguagacauuuaggauguaguuacuuguguuuuugaaaauucauuugcuagauuugcuaguuuucaucuuucaaauauuuauugaagucucuacauuugauauuuuccugucauauucucuuugucuuaaagauacauacauauauuucauuuacugucauuuuagugggcuuugaaugugucagugucccuugcuuacauggauuuccugaaaaauuuuaaagcuuuuauuauuauuauuauuauuuuuuugcuagagacaggguuucaccauguugcccaggcuggucucaaaacugcugggcucaagggauccacucaccuuggccucccaaaguacugggauuauagacaugagcccugcacccaucccuaaagcuuuuuauuaaaaaaaauuucuaacaaaaauguaaagagcaugcucuaacaucugccauuacccagauuucacauuuaucaacauuucugguuuuuuguuucauuuuucccccaccuuauuuuaaauauuaauacuauuacuguuuuuuuuugguugguacuguauuuuaaaacaaauuguagacauccuaucauuucuuuuucuuuucuuuuuuuuuuuuuuuugaaacagaaucucacucuguugcccaggcuggagugcaguggugcgauaucggcucacugcaagcucugccucccagguucaagcgauucuccugccucagccuccugaguagcugggacuacaggcgcacgccgccaugccuggcuaauuuuuguauuuuuuuuuuuuuuaacuagaagugggguuucaccauguuggccaggauggucucgaucuccugaccuugugauccacccaccuuggucucccaaagugcugggauuacaggcguaagccaccaugcccggccacaucuuaucauuucauguauacauccuugaauaugaaucuugaaacaauuacuaauagaucuaaaaaugagcagugauucuuugauauuuaauacucaguccauguucaguuuuccuugauugucucagaaaugacuuuuuagaguuggauguuugaaauaggaucccagaguucacauacuuauuugucuauagaauguuccauauuuuggauuugggucugauuucuuuuucuuuuuuuuuuuuuuuaauuauacuuuaaguuuuaggguacaugugcacauugugcagguuaguuacauauguauacaugugccaugcuggugcgcugcacccacuaacucgucaucuagcauuagguauaucucccaaugcuaucccuccccccuccccccuccccaccacaguccccagagugugauauuccccuuccuguguccaugugaucucauuguucaauucccaccuaugagugagaauaugcgguguuugguuuuuuguucuugcgauaguuuacugagaaugaugguuuccaauuucauccaugucccuacaaacgacaugaacucauccuuuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauagucauuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugaucgccauucuaacuggugugagaugauaucucauagugguuuugauuugccuuucucugauggccagugaugaugagcauuuuuucauguguuuuuuggcugcauaaaugucuucuuucuuccucacaguauacuuuaccuuguuccucugucuacauuacuuucuuuaaauugagaguuagaucuagaggcuugauuagauucagagucagguuuuguuuguuuguuucccaagacaaugucauagguggugguauguuguuuuuuuuguuuuuguuuuugagaggggggucuugcuuuguugcccaggcuaaucuugaacucccaggcucaagcaguccugcagccugggccccccaaaguguugggauuacaagcgugagccaaaaaaacagaaaguaccagaaagcacagaaccucagguugucacauuucuaguggugcuaagauggaucaguagguuuauggggugucaaccugauccugccauuauaggguugccuaucaaccauucaccucaugguuuuagcauccauuggugaugauuacaguaauuauuauuucagugaugcucaaacuuuagcauucaucagaaucaccuggaggacuagcaaaaacuuagaauguuggaccccacccccaggaauuuguauuucuaacaaguuuuuaauuagugcuaauguuguuaguguagggaccacacuuugagaaccacaauaugauaucauuagugguugcaaaauaaugauuugauaguuugcauuucuucugaaauaaguuuuuucaguaaagauaguauauauguuuuauuuaccaguuuucaaaauaaugauucaguguucuagcagcuuucaaaggugaccagugaacuuuuuuugguugauauuuccuuuuguuuuuuuaguauuugauucagucuguugcagucaugauauguuuuugugaaucaucuuuggcugguugggacccuuuuagaugggcaccuauuuucuucucacauuaccuuaguaguuuuuuucgggcaccguguguuauuccaagcauguuuuuacgacaggaccauuuuucccagcgauuccaguuccuuuugguaggaacagcauuuaguaucacacuguauucuagagaucuucauugucacuggucaucauuauuucuagguguuuucagaguacaaaacagagauacaaaauuucucuuguucaaaaaaaaaaguuaacugaaaguuccaauucaaauuaaauuuuguuuuaauuuuuaaaauauuucuuuuauguugaaaauucuguuuucuaacagucuuacuauaguuuauuuuauaacauauauauauauauguauaguagcuucagaauaauaauagugcaccaccgugcccugcuaauauaucuuagacaauuuuuuuaguagauacagagucucgcuauguugcuucgacuggucuugaacuccucagcucaagcgauccucccaccucauccucccagagugcugggauuauagacaugagccaugcacccagccuaaaguacaauuuauugaaguauaacauguauucagaaaaguguacggaucguaaacauacaccucaguacaguuucugaaagugaacacacuuuauauaauauauaauaagcacccagaugcacaagcaaaccguuaccaguguccuggaaccuacuucauuugccuuucuaguuacucucccucaucuuugccugggguaaccacuauccucacuucuaacaguauaaauuaguuuugucuguuuaacucuguguaaauggaauuauguuccaauuuuaguauaugugauguggaagcaagcccaguggaaucauauuguaaucacacacuacuguguuuggcuuguuuucaagguauuucagauuuauucauauugccacauguagcaguugcugcuguuuaguauuuuguuaugugaagauacaauuuacccagucuauugauggaguauuguuuuucagucaaaggguuauuuccaauuuuugacuauuaagaauagugcugcuaugaauauuuuuauauaugucuuucgguggacagaugcugaauacuuuagcugauaguuucucuucagcauuucuguguuuggaauguauguuauaugacaguuccaaaguuacacacauugcauuccuaaauauguuguguaauacacauugcacaugugucagaauuauauguuuaaccccaauguaauuguggauguagaagauauagauaaaacuacaccuuaccauauaaaauaugcagaaguacaccagugacgucaguuuugcuaugguugcaguaagcagugcaguucuacaaauuuaccauuuuaaaagcauuuugucaaacuuucuggauacaaagaugcugccaaggaacucacagccuaauacaugaguuaagauaugaacauagcauacauuauuuugcauugugcugaagucauuuaaguaccagaaggaaugugugaagugcuauaguagauuaaaaauguggcauaucuauaaacacagauuuaaaagguaagagaaaguaacuuauagcaaaauauuuauuuguagcuuaugugucaggcagaauuuuaaggacuuuagauauauuaauucauuuaauccucaaaacaacucuacagggcugggcaagguggcuccugccucuaaucccagcacuuugggaggcugaggcgggcggaucaccugaggugaggaguuugagaccagccuggcuaacauggugaaaccccgucucuacuaaaaauacaaaaauuagccggacgugguggcggacgccuacaauccaagguacucaggaggcugaagcaggagaauugcuugaacccggggggcagagguugcauugagccgagagugcgccacuucacuccagccuggacgaaagagcgaaacuccuucucaaaaaaaaaaaaaaaaaguauauauaauauguauauauauauuuauauuuauauugauaaauucaauauggaauuauuagaugauacauauuuuauuuuuaaaugaacuguuuuauuauccuuacuguuacacuuguguauaaaagaugcuuugggauuuuacuuuuuuucaguaaauauauacugauaaauguuuacauguuaauuuaaaaagcucagaggaaagauuauucaacuuucugaaaacauagcauacacaauaaauaacuguuugccagggggcaaaaaaagcucuguugucuucuaguaccaguugguauuacguagguuuguuugcugucucauaucuuauuuauagaaguuuggaacuggaaacuagauacuaaacaaacaguaauguuccacuguaguuuaugcauuagaauccuucuuugaucauaaguauuuuugcauaugcuuccgugaaacuagcaacuucggagaaacuggcaacuugcuuggaucaaauccauuuuuauauaccuuaauaccgaagcaauauguagcacaccuaaauguacugauuuguuuagauaauauuuguaaaagcuuuguaacauuacuaauaaguuauaaauuaauagaagauaccauagcaguuagagagcaugaggaaacauuuauggguaucauaugucugacuuuagaagcuuugcagacuccuuccucucaagaaaagagcuucuguugggagaaauuucaaauuccaugacuguguuuguuaaaauauuucagauauauacuaaauauucuggugcucucagaauuugcaaguauuuaaaaaucauacuaguggauaauuuuaguuguguguuuauucuuuuauuggucuucagcagcugucuaaccuugcuuuccuccuugaacauggagaccaaacauugggaugacuucauuuuaacuagagguuaccuuuauuaguuagccugauuacucuuuuauaauaacagagaaccuuugugaaugaauuuuucaaaaucuuacagaacguaugggagggugugaaaugaaagauaggugugugacuuucaaaaguugaucugaaagagcucuuaaaaaucuaagacuuguucaguguuacuuuuuuagagguaacauaagauguuauaucggauauacugccuuuacacuauuuggaaaauaaagacuauuuuggcuuuguuuuaaaaaugcaaaggaggccagacgcaguggcucaugcauguaaucuuagcaauuugggaggccaagaugggaggauggauugaggccaagaguucaagaccagccuaggcaacaaagugagaacuuugucucuacaaaauauaaaacaauuaguuggacaugguggcacucauauguagucccagcuacuucagaggcuaaggccggagaaucacuugagcccaggaguucaaaguugcugugagcuaugaucacgucacugcacuccagcuuguuaacagaaugagacucugucucaaaaugcaaaggaauuaaacaauugacuucaaacauaauuguuucauuuguuugguaagcacauguugggcacauccucccccugcucccucuuuuuaaugccagccacuguacugggccuucauagaagaaugagauccuguagagaaugagauuaagaaugacuaaugauucuuaaucauuuuuccugccacauaccccucuagcaaccugguaaaaccuauacacaaaccucuucuuauaaaaauguuuagaaacacuuaaaaugaaauucauagaggauuauaaaguaaacuuauguugagauaguugucagaauauuaaauuucuaauauaguagcacauacuauauuauuaacucaugaaauaacaagaccuagcaguggaucuaauaaguauuguaauuuugaauaaugaugugcauaaacacauuuuucuagguaucuacaucagcuguacaaugaugaaacuaucuaugauuccuauuggugaucaaaguuauaggaaccuuauaccucugaaguuuguugccugcauuuuaauagaaggaaacgcuaaaugguaguuagagauugguggaaaucucuaacuacaauucauuccccauccaaguugacaggcacaccaaaccacagaucugugugggucagcagauugcauguuaagaaucccugaucuaggagcuuuaguuuaggcugugagacugacacuucaguggguaguuauauaauaauugaaaccugagcagggguuuugucucauuuaucuuuacauuuuuauaaucucacaguguccaguaaacauuaaacaguuaguuauuaauagagcuagauaaauaauuuggggguauauaugggagauuacuucuguuagaagagguagcauugagcuguauucuaaauuuaguauacauuggaauuuucagguuggaugaaguaaggaagagguacucagaauugaggcaugcucauaggaauagcaucaggaaggguaugacagguuugaugauuauugagagucaagauacacauuuaagggaauggcaagagaugagagguugagauaaugcuggggcucagauuauaaggagaguuuuguguauacuaggcaacugguaacuuacaaugauaugguacaaucagcuuuguguuuuaggaaguuaucucaguugaugucaugacagaaaaaugggacagagugggaagaaauuagaagcagaggccagugaagcacuguugcaguuauuacagguuagagagggcagggucaugaugguagcagagagaugggaaacagcgauccauaucugggagaagaggauucuaugcuugacugaauaugggaugugaaggagaagaaguuguggccucaaucuacccaauugggagacuggugcaugggccaugguagugccaaaacauagagcuauuaagguaaggaaugcaggagggaagaguaggcaugguggagaagauagagaaauuuaguuguacuuaguaaguuugagguaggcugagauucagguaacaguuuucuuaguaggcaauuggggugagagauuuugaaauuuuacccuuuagaucaaucacuuuuagaucauuacaguaauuuuuuuuuuuuuuuuugguuugaauuuguuuuauucagauacaguuuacaugcaguaaaauuuauucuuuuuuagguuugcaguuugaugagucugacaauguauagucauauaaccaacacuacaguugagauauagaauauuaccccagaaaguucccuguaccuuuuagugauucucuucucccccacaucgagccccuggcaagaacugaugugauuuuuaucccuacaguuuggccuuuuccagaaugucuuauaaaugauaucauacauuguguagccuuuuguaucagguucuuucacuuaguauaaaugccuuugacauuccucuaugcauguuauuccuccauguaucaguaguguauuuuuguugcaaaguaguauuccuuuguaugugugaagguuuuaagaaacacaccuaccugggcuacaaacccuaauauaucugaauucagaaggauagccaggaaaugguaauuucuuggacucccgucucaugguaugagauaaugguacuagggaguagagugcaaggaggucauagugucaaaugugcguagguggaauggaacauaagaggcugugcuuaggacuguuuuucauguuugguuuagaagggaagguaaaugugacaguaacguaaaacuuuuuaaagauaaauaggugaaagaaacaaaucagagguauaaggaauagggaagauuuaacaggagacuagaagggauggaucaacucuguagacguggagagggagaggaacgcuuuuuucuuuaagguaaaaggagaacuaguaugauugggugcuguuauaagugaauugagaggacuuacagauuuuugaucugagugucuggaugaguagacuuaguagguugacuuuagagaaguaaacuucuaauuaauucaaauacugguuuuccuguuuuggaacauguuccuuuuucauccauuguuucuuaguuuuguggcacuuugcugguuuucaagcuagugggcaucaagcuuuucucuggccaguucuuuccuauccugaaacccuucaguggaaaaacaaaucauguucugccuuaagaguaugaugguuauuaagcuauuuuguauuccuuggaggaaaggauauacaauccuggggauucaaagaagugcuucuugaaaugaaugugaaguuuuaguaucagacuagagguacagacaaucauaauguagaaagcauagauguuucccuuucuccaauuuucuuuuccuugggguuacaucuuuuaauaguuaauucugaguuuacuaguuagaauuuaugucuuugucacaggaaggggaacaucacacucuggggacuguuguggggaguggggagggauagcguugggagauauaccuaaugcuagaugacgaguuagugggugcagcgcacuagcauggcacauguauacguauguaacuaaccugcacaaugugcacauguacccuaaaacuuaaaguauaauaauaaaaaaaagaauuuauaucuuuguauuguuucuaauucaucuuuccugaaaauguuuggugcacauacaaacaaacugauauguuuguuugccucuacacugaugguauacauacaguuuugaauuuugcuuuucuucacgugauaaucacuuuggagaucuugaugugugugaugcacauucuaaggguugaagagagaaacauuaucccuauaccaaucuuagagguagucuuacuuuauagacaaguaauugaggacuagagaaguuaaggcacuucucuacaaucacagagaaucaguauguggcacaguuggaauuuaaaucuaaguuuggcugauucagagcccauucuucuguuuuuggcauguugggugugaggaaugauucuugguuucagcauauugucuguuaccuuauagauuaauagcccauuguauuaacgcauuucuguuagugaauuaguccuaucgggauacauacacagaugcaccccuugguuuuucuaaaagaacaugcugauacauauuaaaauacaaacccacugaaagacagugcuuguaaagcauucuaaaaugucucuauuucaugaaccagcuacuuaauguauuacaauaugguagucuuauugagguuuauaaauuaaaaggcaguauuuucugcuagacuugucuacuugaacucaacacaagaguucagauuagugagccaguuuacauacugaccagucugggcccugugaucauuagggccugcuuuucaacuugcuugucagcuggguagaauacaagcuugcuauggcuuccaggaauguguauguggacuugucugaaauagcagaguugggacauacagaaguugagaaaggaacuauuguguuuucuuguuuacugcaugaaccucaauuuguuauagauacggauuguugaagaccuggguucuaagccauugguugccugagcacucuuacucuggaccagaccuuguuuaguuaaagcauccuuaaaaaauacauacauuggcauuucuggucugcacuagcugccaggacagcacuuaguugaacagaauacuuagauugauuuucucguagucauguacuuauaguagaagagauaaaggaauugaaaagcagucguaauugcuucuguaaaaaucccagacucuucagugaaacaaaaaagcaggauguuacuugugaaaugguaggacuggauagauggagccuuuugcaaaaacagauuuugucaugggcaacagauuucuuaaaggcucccggucccucaugguuccauugcugggauuaagccuuuuugcauugcagcauggagagccuuuuauuugaguuaaauucagacuucuugguaugucaucugacagucuugugguuucagauaaauaugguucauugcuguuauuaaccuggguugacaguugugcaugacuggaguuuuuagggauuuugaaaaguggaacugcuuaagagaaauaggaugccacuaauguagagcuuaacuuaaugugauauucaaguguguuaacaucaaaauaauccaaaucuaguuauuaauuuggugauauauuugcuuuaaaauaucugaaaauuuuaaaugccaagauuuuagauacuuauuuuauugaaaguuaaauuaugauaauaaccuuaauuauuagaaugacuucuugaaaauguuuuaagcaaguauuaauuauuguuuuaaaauauguaauucauaaauacuguacaguauguuaguccuugguuuauguuuauuuuaugauucucuuucugccauuuguugcucuucuuucuugguauguuuacaugggaaccuucacugcagauuuuuggaaagcagugugcuuuucuguuuguaucccauauauauauuuauaaguaaaauguaaauuaaaagcuugacauuguauuaguguauugaucauaauccaguuauuuuuauaguuaacgguauucucuaauuuuacugacauggaccugaauuuauuuagaauuauuuuugaugcuuugugaacaccuuaaauguguguccccacuuagucauuugaguuaaauaauuugaauuaguaauggccuuauacuaauuuagguacauuguuuuuauuuuauuuuauuuuauuauuaguuuuugagacgaagucuugcucucucgcccacgcuggagugcaguggcacaauuuuggcucacugcaaccucagccucccggguucaagcaauucuccugccucaggcucccgaguagcugggauuacauuaccccuggcuaauuuuuguaucuguaguagagauggggcuucaccaugguggccaggcuggucuugaacuccugaccucaggugguccaaccgcaucagccucccaaagugcugggauuacaggcaugagccaccaugcuggccuguuuuuuuauuuuaaauaagucacauuauacaaguuccccccuuuuuaaaaaaaaaaaaaaacuguguaugacccaguuaaacaacuuggauacugggucucuauuguuuuagcucauuuaacauucuuccaguguuuugcuguaguuuuuaaguucacagguauauagaguuaaugucagaaaguuaaaccacauaggccagguacauuucaauuagguauacguauugcugaaaaauacuaaguaaauaugauagcauauuaugauacaugauagcucuuaugguguagaaaucuacuauuugccaaugugccauuuuuaccaagaauucauguuaaugaauuuuuugugcauauaauuuuaugcauguuaaauuguacaauaaauauaaaugaauuuuggaacuuuaaugcugguaauaguuuauauuuuuguuaugguauuuuuuucacaucuaauuugauuaaaugaugauaguaauacuauggccaagcagcugacuaucccugucauugaaauguaaauuacagucacuagaauuacauuaauacccugaguauaguugaauuuauugugacaaaauaagucuaaagauuaguguucuuacaacauuuaguauauuaagauguaguuagagaaaaauaauuggauauaaacagccuauauaaauauuaaucaagauuuugugauacaaauaaguccuaaauugauaacuaaagucuuuggaacugagauuagcaaaucagucauggaauuauuuuccugucagauuagagaauuauaauuccuuagauagaaaaaugauuacuauauauacaggcuuccagcauuaaaaugguacuccuugaaauaggcauuuacucacuuguuuagcaaagugguugaaguuuuauuacauucauuaucucuuacagcuucuuccuaugguauuuagguuaauuugugauuaaccaguugucaaucuggaaggaauuuccacagcuuacaagaucaaauugaauuauauagaaacugguacaaaaugaugucuugucacugaugguccuaccugcuuaagaacauuucuuuucuuuuuuuuuuuuuuuuuuuuuuuuuuuuugagacagaaucucacucugucaccaggcuagagugcaguggugcaaucuuggcuuacugcagccuccgccucccagguucaagcgauucucccgccucagccucccgaguagcugggacuacaggugcacaccaugcccagcuaauuuuuguauuuuuaguagagacaggguuucaccauguuggccaggauggucuugaucucuugaccucgugaucugcccaccucggccucccaaagugcugggauuacaggcgugagccaccacgccuggccaagaaaauuucuuuuaagccugauaguaggagauacuuucaaguggagugcaguagaguugcagugauauaagccguagugguuaauguuaggucucagccugacuggauuauggaauaccuggaaauuggaagagcauuguuucugagugugucugugaagaguguuucccgaggagauuuggugugggagucuguggacggagugcagaucagcccucaacauagauaggcaccauccaguuggcugggggccuagacagaacaaaaaaaaggcagaggaaaugggauuuccucugucuuucuucuggagcuggaacauuguccugccuuuggacauuagaacuccaggcugucuggccuuugaacucaaagaccuauaccaguggcucaccagguucuuaggccuuuggccucagacugagaauuacaccauugguuuccuugguucugagguauuuggauuuggacugagccaugcugcuugcaucucgggucuccaccuugcagauggccugucaugggacuucucagccucuguaaucucaugagccaauuuuccuaauaaauccccucucauauaucuguauauauauucuguuguuuccaccucucuagagaacccugaccaguacagaaaccuucuagacuaugacauuugggcuugacugcuuccuggcuaaauaacuuagaaggagauuuaaccagcauucaacugaauuguagauugggaccggggaaauuuaaacauuuggauuggagaagucucugcuuguuaaagauaaguaggggcagggcuuuaaaaacuacaggccagcugcaguggcugaugccuguaaucucagcacuuugggaagccaaggcaggaggauugauugagaccaggaguuugagaccagccugggccacauagcaagacccuuucuguaguccucacuacuuggaggcugaggcagaaggaucacuugugcccaggaguucaagguuacacuauuccagccugagugacagagugagaccgugucucaaaagaaaaaaaaaaaagaaaaagcaguaacacuauagaauagaggaaagggaauauuaaucugcagacuuagaaaaagauuagguuucugaaauuuacuaguuggaaucaaaauuuguaaucagauaauuuggcauccucaauaguaugcaagaaagaauguuuucugaaacagcagagcaugagaagaagauacuuggcaaagaagauguaagauuacaaugaaaagggagauggagaacauaaagauugcacagaaaugaaaauuuaugugacaaaauuagguuuuauagggcuguuaauaaaaaguagaguugauaagugggguauuuaguaagugucaugaaggucaaggaugaaauucugcugaaauacagaggaaaaagaaaaggugaagaaaguaucaccuguuaugugcuuuagaguuauguacuguaaagauaaaccauuggaacagaagccaauaucagauacuuaaagugaagacaucagaauagaagaaaggauauuuacacgcagauuaaaaggguuuaauauucuuuaaaaugugaauuaaaauaguuuugauuucuuuuuaaggaaagcaugcuuacauuugccuuuuauugcuggauuucucaacucauccuaguagguacuaauggagaaagaaacauguucuaacauauccucaggguuugccuaaagaggugauuuuccaucaaacacuuacauucacugaaagaaaacaguuuaugaugcaucugaaagaaagcaugcuuacauuugccuuuuauagcugaaucuauaaacccauguaauaugaaucaauagaaaaggaaacaugucuuagaaagguguuucucccucaaacacuuccauuaacugaaagaaaaguuuucaugaugcuuuuuuuuuucccccgcagacaaggucucccucugucauccaggcuggagugcaguaacauugucacagcucacugcaaucuggaccuccugggcucaagugaucaucuuaccucagccucccaaguagcugggacuacaggcgugcaccagcauacuuggcuaauuuuucauuuuuuguagaggcaggggcucacuauguugcccaggcuggucuugaacuccuggccuuaagcaguccuccugucucaaccucccaaauugcuggaauuacaggugugagccaccacacccagccguaugaugcaucuuaaagaaagcaugcuucuacuuaccuuuaaggaaguuuuaauuucaccaaguauagugucauagagcaguauaacagccauuuucaugccugaaaauggcaaaauuuugauaucugagugaggaguuauuguaucuaguccucgauucuacaaaaauauugaguacuaucuauaaacaguaaauaauugaugcauguguaguucugguucucaaaugcguauagauguucuuuucaguagugcuauacuaaauucauaguaucuuucagucguauuuuguuaguuacuguguacuuaauuuuuaaaaaacauuaaauagguaugaccagguauggaggccugacaccccuaauccagcucuuugggaggcugagauggacagacuguuugagcccaugaguuugagaugagccugggcaacauggcgaaaccucaucuguacuaaagaaacaaaaauuagccagguguggugguggacaccuguggucccaucuacugggaggcugaggugagagucacuugagcccaggaggucgagguugcagugagccaugaacaugucacuguacuccagccugggugacaaagugggacccugucucaaaaaaaaaaaaaaaaaagguguuuuaggccauucuuguauugcuauaaagaaauaccugagauuugaugauuuauaaagaaaagagguuuaauuggcucaugguucuguaggcugugcaagaagcauaaugcuggcaucugcuuggcuuguggagaggccucaggaaacuugcagucauggcagaagaugaaugaggagcaggcacuucacauggcuagagcaggagcaaaaaaaaggcaagggggcguaccacacgcuuuuaaacaaccagaucucaagagagcucucucacgcaaggacagcaucaaagggauggugcuaaaccauucaugagaaacucauccccaucauccagucaccucccuccaggcuccaucuccaauacuggagauuacuuucaacaugagauuuuggcagggacacagauccaaacuauaucaaaagguaucuuacuagaaaugguuaggaauuacugauaacaggaccauaugcucgcaguuguuucaauugaggcuugcauauuaauggaaaagucaacugaagugaggaauuuaaaaauuauauauuguaacauuuuguuuuuagcuuaaaacauguaaauauugauaugguuugggucugugucccugcccaaaucucauguugaauuguaauccucaguguuggagguagggcuuggugggaggugauuagaucauggggguggaguucucaugagaccuaaaacuguguagcaccucccccauuucuuucuuccuccuauucccgccaugaggugccuccuucuucgccuuucuccacaaauauaaguuuuccugaggcuuccccagaagcugagcagaugccaguaucaugcuuccuguacagccuacagaacuguaaggcauuuaaaacucuuuucuuuaauuacacagucucagguauuccuuuaacagcaaugugagaagggaccaauaauaugcauucauuugccaaucuuuugcuggccauuguagucguguguguguguguguguguguguguguguguguguguauuugcauuugcaaaguaugugagauauuuuaauacaggcauacaguguguaauaaucacaucaagguaaaugggguaucuaucuccucaagcauuuacccuuuguguuacauacaauccaauuauacuuuuaguuauuuuaaaauguacaauaaauucuuguugacuguagucacccuguugugcuaucaaacacuagaucuuauuaauucuacugaacuauauuuuggugcccauuaaccauccucacucccccugccacuacccuucucagccugugguaaccaucauucuacucuaucuccacuaguucaguuguuuuaauuuuuagcucccacaauuaagugagaagauggaaaguuugucuuucugugccuggcuuauuucaccauaaugaccuccauguuguugcaaaugacaggauaucauucuuuuuuaugacugaauaauacuccauuguguauaaguaccacauuuucuuuauccaucuguugauggacguuuagguugguucccacugauuuccuuucuuuuggguauaugcuuagcagugggauugcuguaucauacaguaauucuguuuuuaguuuuuuugaggaaccuccaaacuguucuccguaguggucauacuaacauuccuaccaacacuauaugaugguugccuuuucucuacauccucaccagcauuuauuauugcuuguauuuuggauaaaagccauuuuaacuggggugagaugauauugcaugguaguuuugauuugcguuucucugaugaucagugguauugagcaccuuuucauauaccuguuugccaucuguaugucuucuuuugagaaaugucuauucaggucuuuugccuauguuuaauuggauuauuugauuuuuuuccuauauaguuguucgagcuccuuauacauucugguuguuaaucccucaucagaugggugguuugcaaauauuuucucccauucuauggguugucucuucacuuuguugauuguuucccuuacugugcagaaacuuuuuauaacuuguugugauuccauuugucuguuuucacuuuaauuaccuguguuucucagaauaucuuugccuaguucaauauccuggagaguucucccaauguuuucuuuuagcaguuucauaguuugagguccuagauuuaagucuuuaauccauuuugauuuaauuuucguguauggugagagauaggggucugguuuuauucuucugcauauggauauccaauuuucucagggccuuauauuaagagacuguccuuucucaaauguauguucuuggcagcuuuguuggaaaaugaauucacuguaggauuuguuucuggguucuguauucucuuccauuggucuguguguuuguuuuuauaccaguaucaugcugauuugguuacuauagcacuguaguauaauuuaaagucagguaaugugauuccucuaguuguguucuuuuugcuuagguuagcuuuggcuauucuggaucuuuugugguuccguaugaauuuaaggauuuuuuuuuuucuauuccugucaagaaugucauugguauuuugaaagggauugcauugaaucugcagauuacuuuggguaguguggacauuuuaacaauauugauucuuccaaucugugaacauggaguauguuuccauuuuuuaauguccucauuaauuucuuucaucacuguuucauaauuuuuauuguagagaccuuucacuucuuuggugaaguuccuagauguuuuauuuguaguuacuguaauugggauuacuuuaaaaaaccuuuuuucagauuggucacugguggcauauagaaaugcuacugauuuuuguauguugacuuuuuauccugcaacuguacugaauuuaccaguucugauaguuuuuucauagagucuuuagguuuuuccaaacguaagaugaugucucugcagacaagcuuaauuugacuucuuccuuuccaauuuguaugcccucuuuuucuuucuccuguugaauugcuccagcuaggacuuccuggucaguauguuuuacagagggaaugaugaaugcuauuucuuuguaggaccaaaaaauuaaauguuguguaaaguaauagagcauuauaugaccauauacuuugcugucagaagacauauuuaaaaguuggucaguuagcagauuucuuuaaaguaaaaucuauucagagguuuuuaaaaacucagaaaacuuuaccaauguucagaaaauauuucuucaauuggcuguggugcuuuugguuucugaugguggccaguuauuggcauguugcuguauugggaauguuuuuggcuuggcucuugccgcguaauuuagcauacuucucucccucccuccuucccucccucccucccucccucuuuccuuccuucccuccuucccuucuucccucuuucccuccugucaucaaacucagaauguuuuucacugcuugguggugguggugaaucccuaauucuacaugcauagcuuuugaaacuuggcuccucuuuuucuauuccauguaggagcauaggauguuaaugguuucucagaaugaucuguaucaccuuccguguuuucagugagaaauaacaaugauggauaaggcucaggaaagaacaacuaacauaguucaagacacauaauaggcacuguacagauaauuacccaauucaugaacuaaaaaaaucuucauguuugauaaguauacucuauaguaagacccucugaugcuaacuagaggugaaaauauauggauggucaaauggaaauaaggguagagaaagagaagagauuaacugguauuuauuuacagguucaugaaauucaauuuuaaaaugauugauaaggaaaagaguugaucacuuagaaacacaagugaauuauuucgguauuuuccuuauaggugacaauuuuuaauguauugagauacaaacuaguguuuagcccaguauuucucaauacuuuuuuuucacuuauauucccccaaggagccuuuuuaaaaauuaacacccugauuucuuuuuuuuuaauuucaacuuuuauuuuagauacaggguguacauauguagguuuguuacaugggcauauuauaugaugcuuaggucugggguauggauuccaucacccagguagugagcauaguacucaauagguaguuuuccacccaugcuuuuucccucuucccucuaguaguccacagugucuauuuuucccauguuuaugucaguguaugcucaauguuuagcucccacuuauaaaugaaaacaugugguauuugguuuucuguugcuguguuaauucacuuaggauuauggcuuccagccgccuccauguugcugcaaaggacaugauuucauucuuuuuuauggcugcauauuacuccaugguguaucuguaccacauuuucuuuauucaguccaccauugaugggccccuagguuuauuccaugucuuuguuaucauaaauaguauggugaugaacauaugaauacauguauccuuuuguacaacaauuuauuuuccuuuggauauauacccaguaaugaauugcuggaucaaaugguagcuguuuuaaauucuuugagaaaucuccaaacugcuuuccacaguggcuaaacuaccuucccacuaacaauguauaaguguuccuuuuucuccacggccucaccagcaucuguuguuuuuugacuuuuuaauaaaagccagccugauuggugugagaugguaucucauugugguuuugauuugucucuaucugaugauuagugaugaugagcauuuuuucauguuuguuggcugcuuggaugucaucuuuugagaagugucagugcaugucuuuggccauuuuuuuaaugggguuguuuuuugcuuguagauuuguguaaguuucuuacagauucuggauauuagaccuuugucagaugcacaguuugugaauauguucucccauucuguugguugucuguuuucucuguuuauaauuuccuuugcugugcagaagcuguuuaguuuaauuaggucccacuugucaauuuuuguuuuuguugcaguugcuuuucaggacuuagccaaaaauucuuugccaaggccaaugucgagaaggguauuuucuagguuuucuucuaggauuuuuaaaguuugagaucuuacauuuaaaucuuuacuccaucuugaguuaauuuuuuuauacgguuaaaaaguaaggauccagauaaggcuagccaguuaucccagcaccuuuuauuuaauagggauuaacacccuuuuuuguuaagcaccauucccccuccaugaaauuuuaacaccacagauaugcuguguauuugccuauguacuguggcccuuuugagggcuacaucccacuuaauaucuaaguauuuuucucuuccccuccccaccaagaaccaguuugcccucuuggaagugaucuugcccgcauugagaaugcauggcuuaguccuauuuuaguugucaguaauguguguuacaggaguucacauggucuucugaggugcagcgucaguguguaaaggaaagugucuauuccagcauguuuauuuucuauuagcauucuuugaaggugucagauaaaaaaacaugcagagcagauaagcugacacacuauaaauaacaucuggguaaagucuuaaaauagcuugugguucaucacugaauaguuuucuuaccaacguuuaaauaugcuaaauacaauugcuuaauaguaauuacuaagaaaaguuuuucuguagcauauaaauuugugugaaugguggugguauacuuaacacuguuagugauuuggcuuacauuugucuucaguuaaauuuugauaaaaaagaaggaacaugaugaaguggaaggcaguaucagaagacuuagguucugguaaaaugagagaucauucuaaacacuugaguacugagcauaagcaaauaccagugaagacagaguagggcuacaggugaaaagaagaggcaccagccagcuguauccagaacagcaacuuuagguaggucaguuuugcuucuccuucacuucuuucauuugaugaaaugaauaaauuuagaaugacuauuaccauuuaaacuuauuugccuauuaaaagagccacucuguugugauuguuuguuguuuaauaucauauucuaagcaauuaauuugucaggcaacuuuuagguaauaaguuuauuucguuaauuucaugugucuauagauuuccaugucacaacuucuuucuauuauaagguaaagggaaucagaacuuuauuaguaacacuucaccauuucagggacauacucugcagaaguacacaugucuucccagauaauuuugaccagcauuuuguuuucauuuuuuguuuaugacucuagggaugucugaucuagaccaaaacagcuucaccaagauuuguguuuaaacauaaagcuauguuauuuucaucucugcuuuagacauuccuaucuuauucagauaugacccaaaauauaagccccucuaugaagugagcuuucauguuuuacuccauccuucccucccccgucuaauaaugccuaugcugccuuuucuuugcaucauuuagaacuccuuccuuguguccccacuuucuucccaauuuguccaccuuuuuuuuuuuuuuuggccuucagaggccguaauucuuccuuuugcccuuccaguagggaauguuuauuuugccacacacuacccaacuuugggccuaguaacuuggcccugucacuauugccuggaaacuauucuuguccucucaugaaaaccuguucuuuaugaggccuaugauauuguaccacacuuuccucuauuuuguuauuggcauccauggcugacauguaccagaugguugcccacuguucaucaagaacucugacacuuggcugauaguccuucuuuccagaucacuuugugcagucaucuuaagcagcccauacaucuaacauuuuggccuuccaguuccuucucuuauucucuaccuuuauguguucuucuuggcuguaccuugagccuuguuagcuaacugacucuccucucuuucugagaucuucccauucugaccacaacuucauauccuuugaucucucauauccuuauucagacuugugcuuuaacuucguugagaccacuauauguguuuguuuuauacuuccuuuucuccuaucagcuccauucuggccacauuuccucagcuagucaguccugacuuuucuuucucacugucacucuuaacagccuugcuccuuuucauuguggcugcucagaaaaucuacuguuuaauccauugccuacuuuuggcccuuucacaccuggaaucuucugugguaguacagaaaauuaguccuaucacagauuuaaggcuuuccacucagcugggcccccaaauaugguuugauaguccuuuugcuuuucuugggcuagcuccuuuccccauuuucuuugaugauuaugcuggacuuuuauaucucaaauccuguacuccaauucaagccacccaccucacauaugcuuguaaauaugcuugaccgcugcuuuuuauaaaacaugaaugaucagcuauaaaugcucgauuucaucucuccagcuugcauacuuaccugcaguaauuuucaccugugggucauuuucccuaccucauuaaguguauucugcuguucauuaggggcacccuugcccgggauacugugucuuaacuucucugugaucuuaauccaaaaauucucucugauuaccuuuaaauucuuuuucugauuccuuccccucaacuuggaaauauuagaaaggaaauagaugccuuuuuuccuuuauauuauacaccuguguauuucauacacauacacguuuuuccuuuuuuuaaaaaaagggcucuuguagccucacuucuucuaccugagugaccaugcaucuuggugauucaagauaauuucaguuuauuucugucuguuuaggaucccuuuuuaguuuuaaaacuucaguuuagaugguugguuauauggucacacuauuccucacuguuccuuuuuuacauggaauauuauauacugucuuucucagcucuuucucuucaaucaauugcuauaugguuauuccuuccccacugccuccacugaaacuguuccagcaagaguaccaaagacaccaaauugcuaaauuccaugaacacuuuuacucuucauaaauuuuggucuuucugcaacauuugcauugugcgugauuccuuucuuuucaucuucauuaaccuuuuuuuuuuuuugacacagucucucugucgcccaggcuggaauacagugguacaaucucaaucucggcucacugcaaccuuugccucccagguucaagcgauucuccuucuucagccucccaaguagcuaggacuacagacaugugccacuaugcccaacuaauuuuuauauuuuuaguagagacgaggguucacuauguuggccaggguggucucgaacuccugaccucaggugauccaccagccucggccucccaaagugcugggauuacagacaugagccaccgugccuggcccaucuuccuuaacuuuuguaacagugcuuuaccaugaguuuucuuuuccucucuaguagucugucuuuacugaucuucccuggcuucucugcuuuucuucucucuguucuuaaaauauugauguauccuaaaauucuaguuuauuaguucuucacauucuuuucuauuuucaauuaauauguucugccugaagauuucacuaccaauugugugucaguaacuccugugucuggaacucuguucccagccauucuccucagaccauuuuucuuuuucuuuuucuucuucuucguuuuuuuuuuuuuuaagauugagucuugcucugucaccuggucuggagugcaguggcgugaucuuggcucacugugaccucugccucccagguucaagugguucuccugucccagccucccaagcagccagaauuacaggcgcccaccaucaugcccggcuaauuuuuguauuuuuaguagagaugggguuuugccauguuggccaggcugaucucaaacuccucaucucaggagauccacccaccuuggccucccaaagugcugggauuacaggcgugagccacugugcccggccaccagaccauuuuucaucaaucgguugcacaucuuuucuucagcugucucgcagcccccuugaacucaaucuggcaacacccuuaucccaaacuuacucccccuccugagauauucuuuaucuugguuaaugguaucuccuuucaugaaaucugaaagcugagagucagccauucucauccuuuauuccccauauagucuucagguccuaucucugccuucuaaauaagaucuagcucuaucccuuucuauuuucagugcuauuccuuaguucaggguauauaacauucuuuucuccaggcuucucucuaucuugucaguucuucaaguuucugauuuucuaaaaugcacaagugaucuugucagcuauuguuuaaaaccuuuguuuacucauugccuggaugaagaagucuguauguguguguugaacugguuaugucuguugaucugaugcuccagccugccuucauagcugugccuguugcuucauugcacacuucugagcuagggucacuaagaauuacagcagaugcuguuuucuucuuccagagaagagaaugcccuucuccccugcccaucacuugaagcugaaacuugaaguaucacuuccuacucaauaggccaaggccauacacaaugauuuagauaauggacugaaagacugccuggaaucuaaacccagcuuugacacauuuacuagcuagcuguguuauuuugggcagguuauuuauuauuuauuguaugucguuuaugauuuuucuucaguaaacucuuaccugaccugcuuaugcacaccucuuaucuagauuguaaguuugccucagucauagcauguaucacguugauaaaaucauuugucugucuuuucuguuagacugagcauuucaugguauggcuaucuuuuucuuuucaugcugaaugaacgcuuuuaagucagugaaugaauacauaaagaaugugacagagaaauauucccaguaccuggcauuaugcugugagugugguaaauguuuaauaugucuguuuuaggccggacaugguggcucaugccuguaaucccaccacuuugggagaccaaggcaggcacaucacgaggucaagagaucaagaacauccuggccaacauggugaaacccugugucuacuaaaaauacaaaaauuaguuggacaugguggcaugugccuguagucccagcuacucaggaggcugaggcaggagaauugcuugaacccgggagguggagguuucagugagcugagauugugcuaccgcacuccagccuggugacagagcgagacucugucucaaaaaaaaaaaaaaaucuguuuuaaugagauguccauaauguaauguaacuugaugaauauaguauuacuuuuuuuaguagucuuucucuuuuaaaaauugagcuauaauuugcauauaauaaaauguauaauuuauuuugaaaaauauaugcaucuacuuaaccacaauggcaauaaagauaaaggacauuuugaucacucuggaaaguuccuuaguauacauuucuccuccauuucccucacucccuaucccugaucacugcuuugauuucuaucauuguccauuaguuuuaccucuucuacacauaaauagaauuaucaguaggugccccauugugucuggauucuuucaugcaacaguauuuuuugaguucaucuuuguuaccgugggaucaguaauucauuccuugguauuucugaguaguauuucaauguaggaauauaucguaguuuguuuauccauucucuguggcauuuggguuuaaauaaaacugcagugaacauuucugugagaguauuugugaacauuuauuuucauuuuuauuggauaaauuuccugugagaggaauugcugaaucauagcugucaagcaauauuccaaaaaugguuguacacuuuuacacuccuacuaacaauguaugggaguuccaagggcuucauauuauuaccaaccacugguguuauuagucgugucaguuuuagccauuuuaaugcuuguggccauuuuuuuuguuuguuuguauguuuuuguuuuguuuugaaacgauguuucacucuuguugcccaggcuggagugcagugaugcaaucguggcucacugcaaccuccaccucccgaguucaagcaauucuccugccucagccucccaaguagcugggauuacaggcaugcaccaccacaccuggcuaauuuuauauuuuuuuuuaguagaguugggauuucucccauguaggucagacuggucuugaacucuugaccucaggugacccaccugccuuggccucccaaagugcugggauuacaggcgugagccaccgcgcccggccguggccauguuuuaauuugcauuucucugaugauuaacacuguuaauuaucauuuccacauacugauuauccauucauauaucuccuuuugugaaaugcccaaguuguaccuguacccuuuuaaaauuggauuguuuauugcuuacugcuuuguggggguuguuuuggcuguuuauaaguuuuuaucagauaugugcauugcaaauauugucuuccaaucucuggacuggucuuuuuuuuuuuuuuuagauguucagguuuaaaauuuuuauaaaguccaacuuaccaauuuuuuauuuuaugcauaguaauuuuuguaucuuguuuaagaacucuuugccuaaccuaagguggcauaaucaccuguguuucuuuauagaagcuuuauaauuuuaccuuuuucauaaaguccuauuuuaaauuaacaaagaauacaaauucauggcugggcgcgguggcucacaccuguaaucccagcacuuugggaggccgaggcaggcagaucaugaggucaggagaugaagaccauccuggcuaacaaggugaaacccugucucuacuaaaaauacaaaaaauuagccggacgugguggcuggcaccuguagucccagcuacucgggaggcugaggcaggagaauggcgcgaaccggagaggcggagcuugcagugagccaagaucgcgccacugcacuccagccugugcaacagagcgaaacucuugucuccaaaaaaaaagaauacaaacucacaaauaaguuugguaauaaagccuuuuuuauuauugcugagauauacuucacauuccauaaaaucuacucuucuaaagugcgugauucaguguuuuagguugguuugguuguugcuguuuuuguuugugguauauuuacaaaguuuuuuggugaccaucaccacugucuaauuccagaacauuucaucuccccagaaagaaaccucguacacauugcagucauuauggauuugccuauucuggacaagucauguaaauggaaucaucauacguagccuuuuuguguuuggcuuuuuuuccuuaaccuaauguuuucaagguucacccauguaguaugcauucuuuuuauggccaaauacuccauuguauugacauaccacauuuuguuuauucaugaguucauggacaugccuuuuaacuuuuuaaagaaagcacauuuguuuuuucuucuucuuuuuuuuuuuuucagauuguggaauccauucacuccugaaauauuuagugccuaugauauuacauuuacuuagggauauguaguuuuacucauuuaccaagcuugggacuggggauucaaagaugaauaagaucuucccucagggagcuuuuuuuuucuaguggaagaaacaggcaugugaacagauaaauuacaagacaaucugaugaagauacuauuagauuuauaaucuaagguaaaguguaaucccaaaacucaguagcuaacucugcuuggaggaaugaauaagaacuuuuuagaguaggugacauuuggagcuagaucuuuaagaauaaauaagaguuugccaggagagugagaauauuucagguagaagacauggcuuguacaaaggcauggaauugauauaucuuggcaccuuugagaagcucaguaugauaauuauggguaacaugaaaagagucuggaaaggcagaucugggccagcccaugaagagcuuuacaucuaagcaaaggaacuuggauuuuauucuuugggugucugggagaccaaaggaguuuggcuaaaugaaauggcaucacugcuuauauaaggucuguuagaagaccacauauccagugaagcccaacuuuucauuuucuccagaaaauuuuguccauauuaggcaccuuuuaaaaaaugaauguauuggccaggugugguagcucgugcuaccuguaaucccagcagauuacuugaggccaggaguuugagaccagccuggccaacauggcaaaacccuauuucuacuaaaaguacaaaaacuagcugggcgugguggcacauaccuguaaucucagcuaauugggaggcuggggcacaagagucucucaagcucaggaggcagaaguugcagugagccgagaucaugcuacugcaccccagccugagagacagagagagacucugucuaaaaaaaaaaaaaaagaaagaagggaagaauauaccuccccucaacccaaaccauucucucacuaccaccuucuaucauagucuauugacuuaccugaaguuaucaaguuaauuuauuucuuugcuuagcuacuguuguaucuuucuuccagagagguucuuuuuuaucuugcccuaaccacugcuuggcacauaguagguacauaucuguauuuaaugauuaaaugagcuauucuaccucuaauaucuuaaacucuaggauccugcccugugauuauagccuccuauuccuuguccucucugccucccacucuccuucuuugcguuuuuucagcacuuugaccguacugccuccauuuucuuuuguuauuguugucccaucacuacguucccuaacuagcuuagaucaauucagcuguauucuugucagucuuauacuccauuuccauagccuuccuuuucuuuuguuccguauaccuaucaaaacccuuaccuuggcacagucugauccaaauucaagcacaugagguccuacuggagaaaaucaccuaacuguaguuugcagccaguacaucguccuaguucauagucuucaacguuauguagauguacagcauugccuggaaaucuuauguuuucuauucaacauacacucaugcaccagugaaugauggggcucuguucugaggaaugcauuguuaggcaauuuuguuguuaugcaaacaucacacaguguacuuacacacacuagaugguauagucuacuacacaccuaggcuguaugauaauagccuauugcucuugggguacaaaccuguacagcguauugcugugcugaacacuguagggaguuguaacacaaugguaaguauuuguguaucuaaacauauccaaacauagaaaagguacagcaaaaauaugguauaaaagauaaaaaguaggccgggcacaguggcucacaccuguaaucccagcacuuugggaggccgaggcaggcggaucaccugaggucaggaguuugagacaaaccuggccaacaugguggaaccacaugucuacuaaaaauauaaaaauuagccaggcaugauggcacacgccuguaaacccagcaacuggggaggcugaggcaggagaaucacuugaacccggaagcggagguugcagugagccaaaaucgcaccacugcacuucagccuggacgauagacugagacugcaucucaaaaaaaaaaaaaaaaaagauaaaaagugguacacuuauauagggcgauccauucacuuacugugaauggauuuugcgagacuggaaguuacugggugagucagugagugaguagucagugacugugaaaaccuaggacaguguuguacacuacuguagguuuuauaaauaagcacuguauacuuaggcuacauuaaauuuauuaaaaauguuuuucuucaauaauaaaauuaaccuuagcuuauuguaaguuuuuuccuuauuaacuuuuuaauuuuaaaaucuuuugaacuguuguguaguaacacuuuguuuaggacacaaacauuguacagcuguacaaacauauuuucuuucuuuaugugcuuauucuaagcuuuuuucaguuaaauuuuuuuaaccuuuuuguuaaaaacugagacacaaacacaccauuaacguaggccuacauagagucaggauuaucaguaccacuaucuuccaucuccacaucuugucccacuguaaggucuuuaggaguaauaacacacauggaacugucaucucuuaugcuaauaaugccuuuuucuggaauaccuccugaaggaucugcuuaaggcuguuuuacaguuaauuuuuuuauaaguagggguacacuuuaaaauaaugauaaaaguauaguaaauucauaaaccaguaacauagucuuuuuuuuuuuuuuucuuuuuuuuuuuugagacagagucucacucugucgcccaggcuggagugcaguggcgcaaucuuggcucacugcaaccucugcuuccuggguucaagagauucuccugccucagccuccugaguagcugggacuacaggugcaugccaccacgccuggcuaauuuuuguuuuguacuuuuaguagagacaggguuucaccauguuagucaggauggucucaaucuccugaccuugugaucugcccaccucagccucccaaagugcugggauuacaggugugagccacugcacccggccaacauagucuuuuauuaucaaguauugcguauuuuacauaauuguauccguaauaccuucauaugacugacagugcaguagguuuguuuacaugagcaucaccacagacaugugcguaauacuuugugcuaccaugugaugacagcuacaguguuacuaggcaauaggaguuuuugaacugcauuauaaucuuaugagaccaccaucauauauacaguuuguuguugaccaaaacguuauaugguguaugacuauuuuauuucccaacaacugcuauucucuuuuuuacucucuacuauccccacaucuuaccaccuuucccuuacuugccuucaccugcuugacaaagaaaauggaucucuuagauauggauucccuccgcaccuuaccuucauaucuacaaaucuuucugcacccauguacaucuuuaucuccuuucuuuccauccuagugugagaguuauuuucuuugagcuaaugcuuucacuugugcucuauauccuguucucuacuuccucagaggccuuguauuucuccuccaccucagauucugucaucagcauauauguaaacauguucagaugugucauuuuuuaaauagcagaauaucugucacucucacucuacuugagguuucauuuucuuucucuuuuuuucuuaccaguugucuguuuucucugcuccuauucacucuucaguccccuagaaucugaccucuguacucuuuauuccuuagaacuguccuugcuauggucaccaaugacuuuugcuucucuaguggauacuuuuuagugacucccgugguaguucuuuuucuuuucuaaaauguucuuuuucacugguuuccgugagaccccuuucccuauuuucauccuuugucggucuguuccuuuacaguuuccuuugcaugguaugaaagcacaauuuaguagaaacaguucagugugaugcaagucauugugguuuaaggaggagucucugguuuagccuggaugucuagguaggucuuuaucauuuacuagcacacagacauuuacuaaagauuagacagaagaaaaccaaaauuauauuuucugucaagaauuugggaugaagauguuuuauguugccgguuacacauaguuucacauacguugacagaguuaggguuaaggcucucuuaaggaagugaagaauugugccugguggacaacccacauaauggcagaaaauauucacaaacuguacauuugacaaaagucuaauauacagaaucuauaaggaauuuaaacaauuuaacaagcaaaaaacaaccccaauaaacagugggcaaaauauaugaacagacaguucucaaaagaagacauccaaccagccaacaaacaugaaaaaaugcucaucaucacuagucaucagagaaagacaaaucaaaacuacaaugagauaccaucucacaucaaucagauuggcuauuauuaaaaagucaaaaaauaacagaugcaggugaggcuguggagaaaagggaauacuuacacaccauugaugggaauguaaaguaguuuagccacuguggaaagcaguuugaagauuugucagagaacuuugaaagagagcuaccauuugacucagcgaucacauuacugaguauauauccaaaagaaaacaaagcuaccaaaaagacacaugcacuuguauguucauugcagcauuguucacaauagcaaagacauggaaucaaccuagggagggucccaucagugguggauuggauaaagaaaaugugguauguauguacuauggaauacuacucagccauaaaaaagaaugaaauccaguccuuugcagcaacacgaaggcagcuggaggccguuauccugagugaauuaaugcaggaacagaaaaucagauaccgcauguucucaguuauaagugggagcuaaacauuggauacucauggacauaaggauggcaacaauagacacugaggacuaguagagcaaggcaggagggagaggggcaagaguugaaaaacuuaauaguuggguuguaugcucucucucugggugacagcaucaguuguacccuaaaccucagcaucaugagauauaugcauguaacuugcaccacauguacccccugaauuuaaaaguugaaauuauaaaaaauaaauagccuguuguaacuaaugagaaacagcuccuggcaugucuguucucccauuucuuagcagcuguccugucauuuguauuguguucaguuuaccagauauuugucauuugguuuguuuucucuuucccuucuucucugccucacccaccccauuaaucuuuuaaauuguggaauguaauggauauguaaaaguacauaaaacaaaugugauguacuguuuaaauacauacuguaaaguaaagauccaugucagcacuaucuggucaaaacagagaacauagucauugcgccaguucaccuguuacgucccuuuucugguuacacuuuucccuccaccuuacuccuagaaaauuacucuccaaacucuggaggucauuacuuacauuguuuucuuuauaguuuaaaaacuaaguaugaaccccuagacaaacguugcacguuuuuaaccucuauauaaguggaaaaauacaguagcuaucugugugugugugagucauugucugacuucuuuugcuuguggucuguccauuuuugccuauagcugaaauucauucauugugauaaauuuuuccgaaguggaauugcugggaucaacuucauuuuuacugggauuuguuuuaguguauguguguguguauguauacacacacauauauauacacauacuaaauuuauauauaaauuuuuaaaaaacuguguucuaaagagauugugccaauuuauuuauuuuuuauuuuuauuuuuugagacagggucucauucugucacccaggguggaguacaguggcaugaucacagcuugcuauagccccgaccuuccaggcucaagcgauccucccacugcagccucuuaaguagcuaggacuacagaugugugcugccaugccuggcgaauuuuguuaacuuuuuguagagacagggucucacuauguuguccaggcuggucuugaacuccugggcucaagugauccuccuaccuugaacucccaaaguccugggauuacaggugugagccaccacacccaggaguugugccaguuuguauucauaccagcagcauaugagaauuuucacuauacuugauugcucuccacuuuuuuuuuuuuggcuuguuuuuugucuuguaaguccuuugcuauuauuuaaacugaaaaccauuucauuuuucacauuuccauauuggagaaauaguaacaaaacuacuuaaaaauauggguuaaccuuauuaugucaucuugguccaugacaugaaaucaguacauauuuucauuauguuaaauauacuuauguauauuuauuaaguuaaugcuuucaaaaaucacgagauaacuauauuuuauauauacugauaguuaccaguauuauuuuuaaauaaagauaauuuuguuuugccuuuauuuuuacuuuaaaguuuucagccaugaacuggugauauuuaauauaaagauauauauauuauuuaacaauaagauaauuuugggcuuuauuauauagauuuauuucuaauaauguauauggaauauuuauuaauguaacucuaauggaucuuuacuuuuccuuacuuuucuuucaaguuggccuuuaccagaguuugauccaagccagauucgacugauuguauaucaagacugugaaagacgagggagaaauguuuuguuugacuccaguguuaagagaagaaaugaggacauaucaguaucggugagcaucauuauugauuugguugacuuuuaauguugaacauuuugauaauuccaguauuaucaaacuggauaauuggggcugagggagaaggaaaugacuggauauuggggcugagggagaaggaaauguuuggugaaucuaacauuuugauuugaauagcugaggagugguuugaugcuuaggagucauagaauuggagacagucaagcagacaguugaaauccaaggcuaacuuaacaaaugugauaagcaugacuucuuuguauuuagacugcugacaacagcucagcagaacuuggcugaggcugauuuuuuuuuaauuaucucgauuauuuuuuauuacuuuuucagcaaacauuuauugaaguuuuuuuuuuuguauuugauaguauccuauugaauuucaacauaugccucucccuuacucuuaauuuugauuaaugcuguucauuuuguguuuguucagcuuuucucuuuuauguuaaacagcccuguaagaauccacucaugcuguuuuuugaacucucccugcauaccuuuucugggacgaugcuucauuagucucauuaauuucucuccugcgauguauuccuucaucccucucagcuuuucucuuugcuuggaaacauucacaaagcugcuaaaauaauuuuucuuuacuuuuuccuucagguuuguguuugucuaguucaggcuacuauaacaaaauacuguagacugggugccuuaaacaagaaacuuugguuucucccagcauauuugaguuuuuugugagggcugucuucuggguugcagacugcugacuucucacucuacccuuuacaugguggaaagaaggcaagagaacucuucaaguccuuuuuauaaggacaccaaccccauucaugaggacuucguucuuaugaccuaaucaccuccuaaaguccccaccuccuaauaucgcaugguggguuaggacgacauauaaauuuugaggagagacacacauucaguccauagcaguguccuucucugucuuuucccaucccuggccucuucgucccucucagucaucuuucuuggugucuguuggugucucucauuuucccuuugucucucuaucacucaggcucucuagagugucucuucucagucucucuguuggucucuccuuggucuucucugucucucggugucucaguaguaauacauugacucucuucucaaacuauccaguuauuacucaacuuucugaaauuugccuauaaaccuacucuucuuuuuauuauaaaacuuuucuagaaacucaucagugucuagaaaucaaacauuguugacuacuuccagucucauuuauuuuauuaugccuuuauccuauauacuaucucccuuaauugaaaauuuauccuccuucagaguuuaucacaacuuuaugaauccuuucugauuuucucuagguagauuuauuuucuccuccaucagaauucucauaauucuuuacucauauucauagccuucuauaucauagcuguauucguauguguauuuguuacuagacugggaaaaaaaccuuaaaguaaaaaauuguccuguuacucaccuuuauuuccuacacugcacauugccuuacaugugguaaguacucaggacacauuuugaucgauuguaauuacuguuaggaaguuuauuuucaaaauccuguaaauacucuccugaagauuuuaugucuuccuuuugaacacuacuguacauauugaaauacucauuguuuguccuggguucuauauauggaaagaaggacauugugcuguaaauuuuuuuaaacuuucuacauuauaauuuggguucauacauaauaaagacauuauguuuaagcauuagcaguuugcuguaugaaaguaaauuauucagcuuugcuguauuuguacaauauucuauuuugcugugguaaauguugaaguaacuucucauguucuucuuucuuaguuuuaaaacacuuuucuuaguuuaaaacaauuuacaagagagaauaaggacuauaaauauuauuuugaccauuuaauauaccaaagccuuuucuuuuuugagacaggguuuuuuguugucuguuuguuuucuugagacagggucucgcucucucgcccaggcuggagugcaguggcacaaucucagcucacugaaaccucugccuccaggcucaagcaguucucgugccucagccuugcgaguagcugggauuacaggugugcaccaccacaccuggguaauuuuuacauuuuuaguagaaaugggguuucgccuuguuggccagacuggucucgaacuucugggcucaagcgaaccgccugcuuuggccucauaaagugcugggauuaccagcgggagccacuuugccuggccuauuuaccaaaacuuuuauugaaaacauucuuuuuaaaaaaauuagaacauaaugucgccaugaguuauaaacagaaagucaagcuuuagaaugugagccuugcaaaauuguuuuacucuguucgcuuuaucaaaaaagaaauuaaaacauuuucucauuuggaagcagcguccaucuguccugcuauguugcccaggcuggacuugaauuccugggaucacgcaguccucccucuucaggcuacuugggacaguuuguuaucagccugaaucugaauuuuugaaaaauaucauuugaaaauugccaaguaggaguagaagauaguaauauuugggcucacucaauauguuugaguguauuuaauuaaaucaaaauccuauugauuguuuacugugaagcuauuucagcguuaaaaaauagucauuguaaaaauacuuacuggaguccuuuuaaauguguaagacacauggcaguuuuccuuguaaagauuauagaugaucauaauucacuuugaguaccuuuuaucuggagugugagagaaggcaauauuucacaguggaauauugauccauuucugcguuugguugaaccaaagaauugucaaugaagaauauaacagcaguuuauuaauauaagcagaucauuuuuguauuuccaugcaaagcaaacauuguguauguagaguauauuuaauggguuuugggagaaaauuaggaagcuauguauuuuauuacauuuuaaauucuauacaaagugaacuacauaaaugcuuugauuaugcuucagaaaccaaaguacuuugcaugcucaaauagugucuuauguaaguugaaauaaaauuguuaaucaguguauagcuuccucagaacucauuuuuucagaucuguuauauauuuuaugaaaaaugacuguugaauuauaaaacccaauuaaagugaauauguguagugaucuuaaagaaguguuaccggaaaggggucuggauccagaccccaagagaggguucuuggaucuugagcaagaaagaauucagggcaaauccguaaagugaaagcaaguuuauuaagaaaguaaaggaauaaagaauggcaacuccauaggcagaccagccccgaggccugcugauuguggguuuuuaugguuauuucuugauuguaugcuaaacaagggguggauuauucaugccucccauuuuuuacaccauauacuguaauuuacugauguugccaguggcauuuguaaacugucauggagcuggugggaguguaguagugaggaugaccagaggucacucuugucgccaucuugguuuuggugcauuuuagccagcuucuuuacugcaggcuuuuucaucaucaagguuuuuaugacuuaugucuugugccaaccuccuaucuccuccugugacuuagaaugcuuuaaccaucugggaaugcagcccagucggucugagccuuauuuuacccagccccuauucaagauggaguugcucugguucaacaucucugacagaagaaccuucccgugguagaaaaauauauugagauaugguuucgauaugaacacuaacauagccaaauggauccauucugauuuuaucacacuauuauccuuauccuagacauuguuuuuaugucaacaacagugcaaugcuauuucaugaguucccaguuaaguuauaugaccauucacauguaucagcuuucacugauucuaaacaaggauaaaguuguacaucaguaaauucacauaacuuuggaaagaugauuacagauuuuaagacaugagaaacacuccgaagcaucguacagugcuaauugaauaguugagucuuauuuaugauaucacauuugcacauaggauuugguuagauaauuggauuuagguuaauauacagaaaucaguaagcucaauauaugcaaauagcuuccaguuugaacacauaaaagugagacauucauuuaaaauagaaauuaaaaugacaaaguugccuaugcauacacuuaacaaaaucuguaaguuuagaacuuuaaaagucuucuuaagggacguaaaaacguaccuuaacaaauggaaaggcuaaacauauuccauggcaguagucaauguuauaaaguuguccaaagugcuuuguaaaauaaugcuaucacagaaacaauguuauccuuauuuuuguguguuugggguggggguagugucuggaacuaaauaguggauucuaaaguucaaauggaaaaaaauuagcaaugauugguuggaaaacugaaaaagaagggcagugaggaugagccaguccuaucacauuugaaaauauacugcacagucucaguaucuaaaacaguguuuuuuuuuuuuuuuuuuuuuuuuugagcuggagucucacucugucacccaggcuggagagcagcggcgcaaucucagcucacuacaagcuccgccuccuggguucacgccauucuccugccucagccucccgaguagcugggacuacaggcaccggccaccacgcccggcuaacguuuuguauuuuuaguagagacaggguuucacuguguuagccaggguguucuccaucuccugaccucgugauccacccaccucggccucccaaagugcugggauuacgggcgugagccaccacgccuggccaaacaguguguuauugacacauaaauaggcaauagacuaauggaacaaaauagaggaucagaaauacauccaaauacguucaggaauuuugguauaugauuaaggcaucaucuuaaaugguguugagacaauuagccauguggaagaaagauuaauuuagacucauacuguuacuacuuacuauuauuauuauuuuaaagauggcgucuuacuguuuuauccaggcuggucucaaacucuugggcucaagcaugagucacugugcccagccuuaauuuggauucauaucuuacaguguacaucaggaugaaaccaaguauaucaaacauuuaaauauaaaaauauaaaacuauaacauuacaaaagaaaaaaugagggaguuccuauauaucuguggaguggaaaagguaucucuaggcugggugcaguggcucacgccuguaaacccagcacuuugggaggucaacaugggugaauuacuugaggccagguguuugagaccagucuggccaacauaggaagaccccgucucuacagaaaacauaaaaauuagcuggguguggugcugagugucuguagucccagcuacugggagacugaggcagaagaaucacuugagcccaggaaguggagguugcaaugagccaggaucacgccacugcacucuacccuaagugacaaagcaagacccucuccccgcuggccaaaaaaaaaaaaaaggccggaugcaguggcucaugccuguaaucccacacuuugggaggcugaaaggcugaggaggguggaucacaugaggucgggaguucaagaccagccuggccaacguggugaaaccccgucucuacuaaaaaaaaaaguacaaaaauuagccgggugugguggcacgugccuguaguuucaucuacuagggaggcugagacacgagaauugcuugaucccaggaggcgguggcuacagugagccaagauugcagucaugccacugcacuccagccugggcaacagagugagacucugucucaagcaaagauauuucuagcuaugaguuaaaauucagaagccauaaaguaaaagauugacaaauuugacagccaauuuuuuuucaacuugcaugauaaaacagaaaacaacaccauaaggaaaguuaaaagacagauggcaaccugagaaaacacuuugacaauuuaaaaugccaaguguuaauauaaagaguuccuagaaaucaagaaccacucaguagauaauugagugaaggacaagagcugagcguugauauacaaauugauaugacacguuuaauaaaaucauacguuuauaagauccucucccuuauccauaauuaagaaaaugaaaaucaaaacuauacugaagcugggcauggugaggugagaggauugcuugagcucaggaauuugaggccagccugggcaauauggugagaacucaacucuuaaaaaaaagaaaagcaaaaaaaccuauacugagauuucaggucuuuccuuuucuaaugacaaaaacuaaugucugcugaucugagguggaacaguuucauccugaaaccauauccccacuacccugccccagucugcagaaaaauugucuugcacgaaacuggugccuggugccaaaaagguuggcaaccgcuguuaagcacuagggaauacaggugaauaaaagaagacauaguccuuuuccucauggaacuaagaaucuaacaggagaaagagacaguuaacagauaauuacacaaauauguguaaugaaauguguauuccaaguaugucuaauaaaaguaauaaugauagcagcagcuaacucacguuagcacuuacuaucuuuacauguaaagaguaaauauauguaaaacagaagaguacuaccauuauuauuccgauuuauagauaaagagguuaaaggaugacaauguuuaagugaauugccaugaaaggacuucauuuagucuagggagaucaagaaagugauauuuuaagcuuagacuaugggggaaaaaugcguuaagaguuaaggugaaagaggaagcacuugagagagcuggaaagacauuccaggcugagguaacccuguauguccaaucucugaaacaaaaguuugcuagaggaagaaaagggacauacuucaguuccaggacuaaagcauaaaaacacaccuaaaaguguguacaaaaggaugcacauacacacacauacuauucucccaucagcuccucagcuguuguuucucuacucccucccaucuugaagucgugacuuuucugaaagcaaacagcagcaacuacaguggcagaugguccuguaaugaggggacaaggugcagucaacaacaaucccucauguaagcacaggacuucuauaagcaggaauuguaggaaaaaggguucaauuucuuauuauuuuacuuuguuaucucagagaagugaugcuguacuuuaugucuagcccacaaaaacaaauaccuucgaauuaugcaaaaaaaguuauaaauauuacugaaaaauacaacuggcuuucuauaacuagguuauaauuuuuauuaacuuuuugaaacaaucacaaauaaguugcaaguucaauacaaagaacuuuugcuuuucugaaccgaauaagaguaaacugccuacuugauaucccaucagcuuugaauacgucaauguguauuuccuaaaaauaugaacauucuucuacguaaccacaauacagcaaaaauucaggaaaucauugauauauuauagccaaauaauccucagaucccauuaaaacuuggcaaguugucaaaauaacauccuacagaacaaaaggauccaguugagaaucuugcauugcauuuauuuguuguaucucuuuagagauagaucucucccaugcacaguucacaauaggauucgaacuccuaugaggaucuaaugcugaggcugaugugacaggagguggagugcaggcgguaaugcucacuugcccacugcucaccucuugccauguggccugguuccuaacaggccauggacugguacuggucugcagccacccucuggcuuagaacgcguaguacuuaaauacuuuuguugacugaugaaauggugguucgugauaguggauaagucaagccaacuggguuuugucuauaaguagauaacagauuuacuagcucuuguaaccuuggugaaguuauuuaaccuguuugagcuucacguuucucaucuguaaaauagcaucgauaauaccuaccaugcuuaguauuagagaaaauguacauuaaggccuggcauuuuguuggugaucaauaaguaauaagguuauuaagauguggcgaaggaugccaauaguaaaaauacccguauuuuuaucaagaguugaaacauacauggaaauaccuagugaagugccugacuucaauuauguuagccccucauguuaacuguuuucuaauaacaauuauaacgagguugaaugcaguggcucacaccuguaaucccagccagggauuacuuugggaggccaaggugggaggauuacuuuagcccaggaguuugacaccagccuaggcaacauaaugagaccucaucucuacaaaaaguaaaauuagcuggaugugguggcauacgccuguagucccagcucuguggagauagcuaggauauuauaacuauuauauauaauauguauuauacauguguguauauaaaauacacacacacacacacacacacauucccuuaaguguuguuagguaggguuuuucuuccccuuaaacaaauaacaaauuaagguuuagagaggucaguuaacuugcucaaggauacagguuuugaacucacaucuaguucuucuaauauacauauuuuauacguauauauacauauauaugugcauauauacguauauacguauacauauauaaauauguguauauguauacauauauaaauacguguauauguauacauauauaaauauguguauauguauauacauguauauaaauacguauauauguauauacguauauauacauauuuuauacguauauauacauauauacguauguguguauauauauaaaauacuuuaaguucuaggguacaugugcacaaugugcagguuuguuacauaucuauacaugucccauguuggugugcugcacccauuaacucgucauuuacaugagguauaucuccuaaugcuguuccuccccgcucccccgaccccacagcaggcccuggugugugauguuccccuucguguguccaaguguucucauuguucaauuccuaccuaugagugagaacaugcaguguuugguuuuuuguccuugcgauaguuugcugagaaugaugguuuccagcuucauccgugucccuacaaaggacaugaacucauccuuuuuuauggcugcauaguauuccaugguguauaugugccacauuuucuuaauccagucuaucauuguuggacauuuggguugguuccaagucuuugcuauugugaguagugcugcaauaaacauacgugugcaugugucuuuauagcagcaugauuuauauuccuuuggguauauacccaguaaugggauugcuaggucaaaugguauuucuaguuguagaucccugagaaaucgccacacugucuuccacaaugguugaacuaguuuacagucccaccaacaguguaaaagcauuccuauuucuccacauccucuccagcccuuguuguuuccugacuuuuuaaugaucgccauucuaacuggugugagauaucucauugugguuuugauuugcaucucucugauggccagugaugaugagcauuuuuucaugugucuguuggcugcauaaaugucuucuuuugagaggugucuguucauauccuucgccuacuuuuugaugggguuguuuguuuuuuuucuuguaaauuuguuugaguucuuuguagauucuggauauuagcccuuugucagaugaguagguugcaaaaauuuucucccauucuguagguugccuguucacucugaugguaguuucuuuugcugugccaaaucucuuuaguuuaauuagaucccauuugucaauuuuggcuuuuguugccauugcuuuuggugauguagacaugauuaaaagaacuagagaagcaagagcaaacaaauugaaaaagcuagcagaaggcaagaaauaacuaagaucagagcagaacugaaggagauagagacacaaaaaacccuucaaaaaauccaugaauccaggagcugguuuuuugaaaagaucaacaaaauugauaaaccgcuagcacgacuaauaagaaaagagagaagaaucaaauagacgcaauaaaaaaugauaaaggggauaucaccaccgaucccgcagaaauacaaacuaccaucagagcauacuauaaacaccucuacgcaaauaaacuagaaaaucuagaagaaauggauaaauuccucaacacauacauccucccaagacuaaaccaggaagaaguugagucucugaauagaccaguaacaggcucugaaauugagguaauaauuaauagcuuaccaaucaaaaaaaguccaggaccagacagauucacagccgaauucuaccagagguagaaggaggagcugguaccauuccuucugaaacuauuccaaucaauagaaaaagagggaauccucccuaacucauuuuaugaggccagcaucauccugauaccaaagccuggcagagacacaacaaaaaaagagaauuguagaccaauaucccugaugaauauugaugcagaaauccucaauaaaauacuggcaaaccaaauccagcagcacaucaaaaagcuuauccaccaugaucaagugggcuucaucccugggaugcaaggcugguuuaacauacgcaaaucaauaaauguaauccagcauauaaacagaaccaaagacaaaaaccacgugauuaucucaauagaugcagaaaaggccuuugacaaaauucaacagcccuucaugcuaaaaacucucaauaaauuagguaucgaugggacauaucucaaaauaauaagagcuauauaugacagacccacagccaaaaucauacugaauggacaaaaacuggaagcauucccuuugaaaacuggcacaaaacaaggaugcccucucucaccacuccuauucaacauaguguuggaaguuguggccagggcaaucaggcaggagaaagaaauaaaggguauucauuuaggaaaagaggaaguuaaauugucccuguuugcagaugacaugauuguguaucuagaacaccccucgucucagcccaaaaucuccuuaagcugauaaggaacuucagcaaagucucaggauacaaaaucaaugugcaaaaaucacaagcauucuuauacaccaauaacagacaaacagagagccaaaucaugagugaacucccauucacaauugcuucaaagagaauaaaauaccuaggaauccaacuuacaagggaugugaaggaccucuucaaggagaacuacaaaccacugcucaacgaaauaaaagaggacacaaacaaauggaagaacauuccaugcucauggauagaaagaaucaauaucgugaaaauagccauacugcccaagguaauuuauagauucagugccauccccaucaagcuaucaaugacuuucuucacagaauuggaaaaaacuacuuucaaguucauauggaaccaaaaaagagcccacauugccaagucaauccuaagccaaaagaacaaagcuggaggcaucaugcuaccugacuucaaacuauacuauaaggcuacaguaaccaaaacagcauggugcugguaccaaacagagauacagaccaauggaacaguaaagagcccucagaaauaauaccacacaucaacaacuaucugaucuuugacaaaccugacaaaaacaagcaauggggaaaggauucccuguuuaacaaauggugcugggaaaacuggcuagccauauguagaaagcugaaacuggaucccuuccuuacaccuuauacaaaaauuaauucaagauggauuaaagacuuaaauguuagaccuaaaaccauaaaaacccuagaagaaaaccuaggcaauaccauucaggacauaggcaugggcaaggaccucauguugaacucauaucuaguucuaaagcuuuuauucuuuuuacuuuaaauuuuugguuagagauaacuggagacuaguacauguaauuuuuaacaaugccuuuggugauguugguaacuagaaaacauucagucuucaguaaaugugacuuuagucagauuauuuguucuaaaaaccuaccugagguuuguuaaaugaaagaauggacauacugguaacugugauaaagcacuggaauacuuuuaggaauaucacagauguugguggauuguaacuuugguaguugugagcagugaaagauguagagaagcuguuggggaggaaaaagagaaagaggaauuaaaaagaaauacauuuuucuucuacacuagacugcacaaccaucugguccuaaguucauucucucauuaaaauuuuauuuauuacauuaguauauucucauuucgaaagaauaaacauauguauaguuaaaucugaaagucucauuugcauuucuccuuucaucccugcauuucuccccagaaaaauagguuauuuuuuauaacaguguuacuuacauuaacuuggguuuauuguuguauuuaaaugaaugaauaaguauuuuuuacauggucucaguuuugauuucuaauaugggaaaauauugauaaauauaacccauguacacaaaagacucuugggauccucgauaacuuguaagaacauuaaggguuguuuuguuuguuuggguuuuuuuuuguuuuuuuuuuugaaacagagucucacucugucacccaggcuggagugcaguggugcagucucagcucacuucccagguucaaaagauucuugugccucauccucccaagaagcugggauuacaggcaugugccaccaugcccagcuaauuuuugucuuuuuaguagagacaggguuucucccuguuggucgggcuggucuugaacuccuggugucaagugauccaccuccucagcuucccaaagugcuggaauuacagguaugagccaccaagcccugcccauaaagggguuuugagaccaaauaauuugaaaacuacugcaauauauuauuacaucgguauuaaugaacaucguauaggccgugguaaucuagaaaauucucaggauauaauaauguuggccagaaauacaaaccccacaaauuuuauuauaguuaugagacaaagaauagaaaauaguacuggagaaaauacagcaaaaugccaauagccauauuaauguuguauuuugaguuauuucauucuugguuuuuccaaagguuuuuauacuuugaugaaauuuguauaugguuaaaaaucuguuaaaacaugaguggaaauaucuguuauuucagaaacucggcagugaugcucaaguuaaagucuuugggaaaugcugccaacugaaaccuggaggagacaguucuuccucuuuagauaguucugugacuucaucuucugauauaaaagaccagugucuuaaguaccagguaagaucauugaugucauuuauuuauucauucauuuauaauuaguuuugaacaucauccaguggacuguggagauauaauagcaauuaguccuuaucuuccuagagcuugcauugaagcuggagagacagauaaacaauuauguuuaugaacuuugauaaaucuuagaauaggagaaguagaaagcuauaggcauagauugcaugaguauuuucuccuuauauuucccaauucagauuuauuggguuaucagaauaauuucuuauuuuacauacuuuuuuauuauugaaaaaugaagauaaauauacuaauacaguuucaguuguaugaaauuaaaguaugauuggaaguauacauaauacacaguuuuauuucucaaaaguaaugugacuucuuguaaaauauggaauuaaacguauuaguaaguauaauacauaggaacuucucucuaaauguauuacauuuuauauaagaucaguauuuggucucaugcuuagcaagugucaucugauguaaauuuaucugugucauccaaguuugcauuaaucacaaguauuuuauauuuacucaguaucaaaauagaaucuugacuuuuuaauuacugguaaugagaugauuguguuuugauggaaauugaucuuuauaccuaaucaaugggacaagcuaugugaaaagagucugaaauuacuaaacuccacuuggauuuacugcacaguucccccugccuucuucuauuccaucuccccuuuaggcaugauaccuuaacaaauccauaauaguccugugcuauacaacaccaucaugacuuacaccauuuugcacaacuuugaaaguuuugugauuuuuaaaaaauuagccaugugggccgggcaugguggcucaugccuguaaucccagcauuuugggaggcugaggugggcggaucaccugaggucaggaguucgagaccagccugaccaacauggagaaacccuaucucuacuaaaaauguaaaauuaggcaugguggcacaugccuguaaucccagcuacucaggaggcuggggcaggagaauugcuugaaccugggaggcggauguuguggugacccaagauugcgccauugcacuacagccuggguaacaagagcgaaccucugucucaaaaaaagaaaaaaaaaauuagcugugugugguggugugagccuguagucccagcuacucaggaggcugaggugggaggauugcuugagcccagaaguucuaggauguggugaguuaugaucaugccauagcaacccacccugggugacagagugagaccuugucucaaaaaaaauauguauauaggguggcuggcaagauggccaaauaggaacagcuucggucuguagcucccagugagaucagcgcagaaggcgggugauuucugcauuuccaacugaguguaaacaaagcugcugggaaguuagaacugggcggagcucacugcagcucagcuaagccacuguagccagacugucucucuagauuccuccucucugggcagggcaucucugaaagaaaggcagcagccccagucaggggcuuauagauaaaacucccaucucccugggacagagcaccuggaggaagggguggcuguuggcacagccucagcagacuuaaauguuccugccuuuugacucugaagagaacaguggaucucucagcacagcuuucaagcucugguaagggacagacuaccuccucaagugggucccugaccccuaugacuccucacugggagauaccucccagcgguggucaacagacaucacauacaggagagcuccggcuggcaucuggcaggggcuccucuggaaugaagcuuccagaggaagggacagacaggaaucuuugcuguucugcagccuccaguggugauacccaggcaaacagggacuggaguggaccaccagcaaacaccagcagaccugcagcggaggggccugacugguagaaggaaaacuaacaaacagaaaggaauagcaucaacaucaacaaaaaggacauccacaugaaaaccccauccaaaggucaccagcaucaaagaccaaagauagauaaauacacgaagugaggaaaaacgagcauaaaaggcugaaaauuccaaacaccagaaugccucuccuccuccaaaggaucacaacaccuugccagcaagggaacaaaacuggauggaggaugaguuugacaaguugacagaaguaggcuucagaagauaauaaagguaauaaacuccugugagcuaaaggagcauguucuaacccaaugcaaggaagcuaagaaccuggaaaaaagguuagaugaauugcuaacuggaauaaacaguuuagagaagaacaugaaugaccugauggagcugaaaaacacaguacgagaacuucaugaagcauacgcaagccaucaauagcugaaucaaucaagcggaagaaaggauaucagagauugaagaucaacuuaaugacauaaagcaugaagacagaauuagagaaaaaagaaugaaaaggaagaaacaaagccuccaagaaauaugggacuaugugaaaauaccaaaccuguguuugauugguguaccuaaaagugacagggagaauggaaccaaguuggaaaacacucuuaaggauauuauccacgagaacuuucccaacauagcaagacaggcuaacauuaaaauucaggaaauacagagaacacaacaaagauacugcucgagaagagcaaccccaagacacauaaucgucagauucaccaagguugaaaugaaggaaaaaauguuaagggcagccggagagaaacauuggguuauacacaaaggaaaguccaucagacuaacaguggaucucucugcagaaacucuaaagccagaagagagugggggaccaauauucaacguucuuaaagaaaagaauuuucaacucagaauuucauauccagccaaacuaagcuucauaagcgaaggagaaaugaaauccuuuccagagaagcaaaugcugagagacuuugucaccaucaggcuugccuuacaagagcuccugaaggaagcacuaaauauggcaagggaaaacgguaacagccacugcaaaaacauaugaaauuguaaacacuguugacacuaagaagaaacagcaugaacaaacaggcaaaauaaccagcuagcaucauaaugacaggaucaaauccacacauaacaauauuaaccuuaaauauaaaugggcuaaaugccccuguuaagagacacagacuggcaaauuggauaacgagucaagacccaugagugugcuguauucaggagacccaucucaucugcaaagauacacauaggcucaaaauaaaaggauagaggaauauuuaccaagcaaauggaaagcaaaaaaaagcagggguagcaauccuagucuuugauaaaacagacuuuaaaccagcaaagauauuaaagaaaaacaaaaagacaaagaagggcauuacauaaugguaaaggaaucaaugcaacaauagggaucaguguaacaagaagagcuaacuauuguaaguauauaugcacccaguacaagagcacccagauucauaaagcaaguucuuaaagaccuacaaagaaacugagacucccacacaauaauagugggagacuuuaacaccccacugucaauauuagacugaucaacgagacagaaaauuaacaaggauguucaggacuugaacucagcucuggaccaagcagaccuaauagacaucugcagaacucuccaccccaaauaaacagaauauacauucuucucagcaacacaucacacuuauucuaaaauugaccacauaauuggaaguaaaacacuccucagcaaaugcaaaagaauggaaaucauaacaaacagucucucagaccaaagugcaaucaaauuagaauucaggauuaagaaacucacucaaacuacacaacuacuuagaaacugaacaaccugcuccggaaugacuacuggguaaauaacaaacugaaggcagaaauaaauaaguuugaacaaagacacaccauaccagaaucucugagacacagcuaaagcaguguuuagagggaaauuuauagcacuaaaugcccacaggagaaagugggaaagaucuaaaauugacacccuaacaucauaauuaaaagaaccagagaagcaaaagcaaacaaauucaaaagcuagcagaagacaagaaguaacuaagaugagagcagaacugaaggagauagagacacaaaaaacccuucaaaaaaucaaugaauccaggagcugguuuuuugaaaagauuaacaaaauagaccacuagccagauuaaugaagaagaaaagagaaaagaaucaaauaaacacaauaagaaacguguugaucccacagaaauacaaacuacuaucauaguuuguacacaaauaaacuagaaaaucuagaagaaauggauaaauuccuggacacauacaccaucccaagacuaaaccaggaagaagucaaaucccuaaauagaccaauagcaaguucugaaauugaggcaguaauuaauggccugccaaccaaaaaaaaguccaggaccagacugauucacagccaaauucuaccagagguacaacgaggagcuggugccauuccuucugaaacuauuccaaucaauagaaaaaaaggaaauccucccuaacucauuuuaugaggccaacaucauccugauaccaaaaccuagcagagacacaacaaaaaaagaaaauuucaggccaguaucccugaugaacaucaaugggaaaauccucaauaaaauacuggcaaacugaauccagcagcacaccaaaaagccuauccaccacgaucaagucgccuuugucccugggaugcaaggcugguucaacauaugcaaaucaauaaauguaauccaucacaugaacagaaccaaugacaaaaaucacaugauuaucucagaugcagaaaaggucuucgauaaaauucaacacccuaucaugcuaaaaacucucaauaaacuagguauugauggaauauaucucaaaauaauaagagcuauuuaugacaaacccauagccaguaucaucccgaaugggcaaacgcuggaagcauucccuuugaaaaccagcacaagauaaggauauccucucucaccacuccuauucaacauaguauuggaaguucuggccagggcaaucaggcaagagaaauaaauaaaggguauucaaauaggaagagaggaagucaaauuguugcuguuugcagaugacaugauuguauauuuagaaaaccccauugucucaggccaaaaucuccuaaagcuguuaagcaacuucagcaaagucucaagauacaaaaucaaugugcaaaaaucacaagcauuccuauacaccaguaauagacaaacagccaaaucgugagugaacucccauucacaauugcuacaaagaaaauaaaguaccuaggaauccaacuuacaagguaugugaaggaccucuucaaggagaacuacaaaccacugcucaaggaaaaagagaggauacaaacaaauggaagaacauuucaugcuuauggauaggaagaaucaguaucgugaaaauggcuaucaugccuauaguaauuuauagauucaaugcuauccccaucaaucuaccauugauuuucuucacagaauuagaaaaaacuacuuuaaauuucauauggaaccaaaaaagagccuguauagccaagaaaauccuaagccaaaagaacaaagcuggaggcaucacgcuaccugacuucaaacuauaccacaaggcuacaguaagcaaaacagcaugguacugguaccaaaacagauacauagaccaguggaacagaacagaggccucagaaauaaugccacacaucaacaaccaucugaucuuugacaaaccugacaaaaacaagcaauggggaaaggauucccuauuuaauaaaugauguugggaaaacuggcuagccauaugcagaaaacugaaacuggauuccuuccuuacaccuuauacaaaaaucaauucaagauggauuaaagacuuaaacguaagaccuaaaaccauaaaaacccuagaagaaaaccuaugcaauaccauucaggacauaggcauaggcaaagacuuuaugacuaaaacagcaaaagcaauggcaacaaaagccaaaauugacaaaugggaucuaauuaaagagcuucugcacagcaaaagaaacuaucaucagagucaacaggcaaccugcagaaugggagaaaacuuuugcaauuagcccaucugacaaagggcuaauauccagaaucuauaaggaacuaaacaaauuuacaagaaacaaacaaccccaucaaaaaguaggugaaggauacaaacagacacuucucaaaagaagacauuuacacggccaacaaacaugaaaaaaaagcucuuuaucacuggucaccagagaaaugcaaaucaaaaccaugaugagauaagcaucucaagccaguuagaauggcagucauuaaaaagucaggaaacaaaagaugcuggauaggauguggagaaauaggaacacuuuuacacuguuggugggaguguaaauuaguucaaccauuauggaagacagugugccaauuccuccaggaucuagauccagaaauaccaguugacccagcaaucccauuacuggguauguacccaaaggauuauaaaucauucuaguauaaagacacauggauacauauguuuauugcagcacuauucacaauagcaaagacuuggaaccaacccaaauguccaucaaugauagacuggauaaagaaaauguggcacauauacacuauggaauacugugcagccauaaaaaaggaugaguucguguccuuugcagggacauggaugaagcuggaaaccaucauucucagcaaaauaacacaagaacagaaaaccagcacugcauguucucacucauaagugggaguuguacagugaaaacacauggucacagggagggaaacaucacacaccaggaccuauugggggguggggggcuagggggagggauagcauuaggaaaaauaccuaauguagaugacagguugauggaugcagcaaaccaccauggcacuuuuauaccuauguaacaagccugcacauucugcacauguaucccagaacuaaaaagcauaauaauaauuuuuuuuaaauguauauaauuucagguaaguggaacauugucuuugaguuacacaggguuuaacagauuauuagcuuccaggaaugaguacuuagaauagaccuuuuaaauaaggcauuuuaaaauagacaauaaugauaauagcauccuuuuaauuauaagcuucauuguagauuaugucacauuaaaauacauaccuugccagucacauucaugguaacuauuuaguauauguuagaacagacaaagagaaccuuaguaguaaacuauauggugucauaaaauucacauagcaauuuauuaauauuuuuacuguauuuugcuuucuggggauuauuuuauuuguauaauaguaaaaucuauaaauaaaugccuugguauuuaaauuuguauagcuugcuuaauacaagaaauaagaaauucagucaaaauaacaauggaguuagacacauuaugguaaaaaugagcuuauaagggaaggcugccaugucuaucauuagccagaaguaauuuagguugccaaguaauacuggcauugauuuuuuaaauagcuauuuuaucauuaaaaaaauuuucugcuccuuuucugaaauguuguucucaguacccaagccucuaugucuuaaaauaaaaauuugaucuuaaccaaaucucaagaauaaauuaguugcuuuguauauuaguaaccuagguaugacagaaaugacuuuuuucuuaaaaauuaacuuugugggcugggcgaguuggcucacaccuguaaucccagcacuuugggaggccaagguagguggaucacgaggucaagagauuguuaucauccuggccaaaauggugaaucccugucucuacuaaaaauacaaaaauuagcuggguauggugguacgcaccuguauugccagcuacucgggaugcugaggcaggagaauugcuugaacccaggaggcggagguugcagugagccgagauugugccauugcacuccagccugggcgacaagagcaagacuucaucucaaaaaaaugugaaacugauauaaaaauagccauguauuaaaaaauguguugcuacuugaaggugucuuuuuaaagaaaaguacaaauauuuaaacguggauuaucuuaacccuaauaauaggacaauuuaagauagguaguaaagagauaaaggaguaaaagagucacaugauaaaacgaaaaacagugugcagcuguauauccuggucuccaguuguaaaauggggauucucuucacuuuaugguuauuagaauuuuccuaaauauuuuagaaaccauuuauuuuuugauuuuauauaauugcaucaguuaagaaugguauugggacacucucuaaacaguggcuuaaacaaauuagggguugcguugcugacauacaugauaacccuaaaaguguacuaucuagguaugauacugggcuuccagauacccucagagaccaugguucccuuaucuuucuacuuagaguuaguguguacuuguugcauuguuguuauaauaugacaucuccaucuguagugacuuccauuuacaucuuacugaccaggccugugucaaaugcauguaaaugaauaguucugaaaauugcuacuucaaccauaacacugaucuuuuaaguauaaaaauuauucuaaaucuccuaucuucaagugaggcugugaaaugaaauuuuuuucauuugugcacauuacugcccuaaaacaaacuggacuucaaaaaaugaggaagaauuagagaauagauacuugguagguaaaaagugauauuugccaugauaucuaaauaguaaccaaauggauaagcucaaucuuuaacuauugucugacuccugugaagacaaagaauaaugaaagagaauaacuuuuuaaucaggagguucuuuggaaacaagacauuauaauguuucaaggaagucuugcucugucgcccaggcuggagugcaauggcgugaucuccacucacuacaaccucugccuccugggcucaagcgauucuccugccucagccucccgcguagcugggauuacaggcaugcaccaccaugcccagcuaauuuuuuguauuuuuagcagagaugggguuucaccauguuggccaggcuggucuugaacuccugaccuugugauccucucgccuaagccucccaaaaugcugguauuacaagcgugauccaccgcgcuagccucaaggaagucuuuaaaaaaaaaauugugggaagaacaugagaucuacccucuuaaauuuuuaaguguacaaugaauuguuuucuacauguacaguguuacacuauagauuucuagagcuuauucaaauugcuugacugaaauuuaaugccauugauuaguaacuccccauuucccccucaccccagccccugguaacuaccauucuacucuuugauucuguaaauuuggcuauuuuaaauaccucauauaaguggaguauuuaucuuaucaugcaguauuuaucucuuugugacuggcuuauuucauuuagccuaacguccuuaagauucauccguguugcguguugcagaauuuucuucuuuuugaaaacugaauaguguuucauucuauguauuuauuauauuucauuuauccaugcaucugucaguggacauuuaggguuauuuucacaucuuggcuauugugaauagugcuguaaugaauauaggagugcuaacaucucuuugagauccugauuuuaauuauuuuggaaaaaugcccagaaguggaauugccagaucacaugguaguucuauuuuuaauuuuuggaggacuugccauguuguuuuccauaaguacaauaccauuuugcauuccuacaacaaugugcaagggcuccaguuuucccacauccucaccacuuguugucuuugcuuuuuugauuauagccaaccugacagguuuugugguuuugauuuacauuucucugauuagaaauguugagcguuucuccuguaucaguuggucauuuguaugaauucuuuggagaaauguuuauucaagaccuuaauugcguuauuaguuuuuacuauagaguuguagggguuucugguacauuuugaagccaaaucccuuaucagauacaugguuugcaaguauuuuuucccauuccauauuuuaucuuuucccauuccauauuuuaucuuuuugcccucuugauuauuuucuuugcugugcagaaacauuuuaguuugauguagucccacuugucuguuuuugcuguuguuaccugugcuuugggugucauaucugugaaauuauugcuaagaccaaugucaucaagcuuuucuccuguuuucuucugggaguuuuacaguuucaggucauacauguaagccuuuaaucuauauucaguugauuuuugugcaugauauaggacaccaguuuuauucuuucgcauguggauauccaguuuuccaagaagcauuuguuaaggagacuauccuguccccauuguguauucuuagcacccuucuugaagauaaguugacuguauacauguagguuuauuucugggcuguuuguucuguuccauuggucuauaugucugucuuaaugucaguaccuuacuguuuucacuacuguagcuuuguaguauaauuugaaaucaggaaguguaaugcccaccagcuuuguucuuuuucaagguugauuuggcugcugcuucuugaagaagaagguuguggucuucugugguuucaugugaauuuuaauauguuuuucuguuuuuguaaaaaaugccauuaggauuuucauaggcauaguauugaaacuguagaucacagauaugucuuuacagaaauacaaaauagauauaaauugccccauuuauggaugcuucuuauauacaacaggaguaguaaaaauuauucugcauauucuuugaauuucacuuauuaucuauccuggagaaacauugcauaugcauaagaugugguuaagaaugccugcuuuugcauuauugguaauagcaaaaaucuggaagugacuuaaaugcccgugaguaaagggaacuggucugacaaacuguaguauuuucauacaauaaaauauuguacagcucuuaaaaggaauuagucaaauuuauguguaacaacaugguuacaucaagaaaacauuuuaaaaggaagaaaaucgaguugcagaacagcguauacaguguagaaguacaacucuuaauguagaauaacuauaucaagaauuuuuaauaaaaaucaacauaugaaauagucauaagcuuuuaauuaacacaguuuguuaauaugugguuauuguuuaggguucucggugcucuucugaugccaauaugcuuggagagaugauguuuggcucaguagcaaugagcuacaaaggauccaccuuaaaaauucaucagauucggugagagguuuucugauuuuuuuuuaacgagucccauuuuuagauauuuucguuuuuuuagagagaauuuuauaugaucuucacucagauugagcuugucauacuccauuuaacauguucuaugguuuuaaugcuacuucauggcucuugcagcuaugcugugaaaccucugugacuuacacauuuuuauuuauaauaaauccaaaaggucauuauauuuuaguuuuggucucucucuuucucuuuuucuucauaguuccccuccacagcucaugcucagcaaaguguuuacugcucggacuggcagcaguauuugugggagucucaauacguaagugcuuauggauacagggggaaauguaucacuuuagaugugcaaaguaugaaaacuaaccaacugcuuuuaggacugcagcacaaguucagauuuucugucuuuccuuaaguuuaaaaguucauggaagccagauuucacucuuaauugaguuuaguugagaaacaugagaugugguuucuguuucugugaauugcuagaagcaguaucuggaaguagaauguugaauggauuuccgucuuagggcaacaugcugauuuuucaguuuugcgguaccacgcugaguuaccugaguuaccacaaucuguaggguuggugcucuucaauuuucagauccccuacgaaauuaacccuaaagacaggacugaccuaggucagccauacugauauugcacauauacacuauauaaugauagccaccaggguauuacaagcuauuaaugcaaagauuagaauagugaagcugaaacaaaggcaggccuggugucaggaucaugggccaugugccagaaccuaguaaauuacuggggcuaaaguuaggcaguggaagaccccagagagagauuuugcaggugccauaucagagcaagacucauuggcuagucagagccccuggggguaacccaaggucaaaggcagcaaggaagcuacuccagacuacagaaauucuguagagcccccauuaauuguuaaugccuuaaaaagaccuguuuggaagaguuuuauuagcuaaguuucuaauaccuguaacucuuuggaaggaaagugggagguagucuuuuuuuuuuuuuuucgagauggagccucacugugucaccacgguggagugcaguggcgugaucucagcucacugcaaccucuguccuggguucaagcgauucuccugacucagccuccagaguaggugggacuacaggcgcaggccaccacgcccggcugacuuuuuuuuuuuuuuguauuuuuaguagagacaggguuucacuauguuggccaggcuggugucaaacuccugaccucaagugaucugccugccucggccucccaaagugcugggauuacaggcaugagccaccaugcccggccaugggggguauccuuuaaaauauuauggaugccuuaaaaaauauugaagccaaaaauacugauuuuuaaaaguagaaauuagagaucuacuaaaguagaaauuaaagauuccauguuggaaucacugauguuagccauaaucaccagaguuuuuucaccuuuucuaaguucugauaauuccuaaaaucucuagaaaggauauuuugcacuaaaagcauaaaguacuuuuauuuuucuuauccugaaagagacacuaaaagaagugauauagguuauuuguaauauauuacaguaaagauaguuuuuggauauuugccuaaugauuuauucuccucuucuuccuccuagcuuccaccucucccuaacagauaauuagaaaauauuuuuaggucuaaaauaugaggggaaaccuuguuuguaaucuaaaucagguucagcaacuucuacuuuaaagauccagauaguaaauauuuuuuggcgcaaagacuuggaaccaacccaaauguccaacagugauagacuggauuaagaaaauguggcgcauauacaccauggacuacuaugcagccauaaaaaaggaugaguucauguccuuuguagggacauggaugaagcuggaaaccgucauucucagcaaacuaucacaaggacaaaaaaccaaacaccacauguucucacucauagaugggaguugaacaaugagaacacauggacacaggaagggggacaucacacacuggggccugucgugggguggggugaggggggagggauagcauuaggagauauaccuaauguaaaugacaaguuaaugggugcagcacaccaacaugggacauguauacauauguaacaaaccugcacauugugcacauguacccuaaaacuuaaaauauaauaauaaaaaaaaauauauauauauuuuuuuggcuuugugagccagacaauggguuguaguuucucagcucugcuguugcagcaucaaagcauucauacacaguauauaaaugaaugggcauggcuguguuccaauaaaacuuuauuuacaaaaagaggcagcagacuagaucuggcacuccaggcuauaguuuaccaaccucugauuuaaaugauuauguuaguuaauuuguaaugcuaauaggaagaaacuguuuuugcacuuaaaauuucaucaggauguacaaagaauuguccuuaaaccauaaaaugaauuuggaauuaauuuucuucucacccuccauaggcuacaagauagucuugaauucaucaaucaggacaacaauacauuaaaggcugauaauaacacaguuauuaauggacugcuuggaaauauagguaaaugguuccuuugauuuuauaaguuuaaaaaauacuagcaggguaacaaguguuuuuugaaguuauuccuuaauaaugcagaucugucaugauaacaaagaauuucaaauacuguaaguggaagaggcauuuaaauugccaguauguauaacauuuauuuggaaaacauauuuuucauauauuugaacacaauauuuauuuuguaucugauaaagaguacugcuguagauauaucuaauuugucuucauuguuuuucguuguuaaauuugaugcaucuuugaaaggugucagugauaagaaaagcccuuaguaguucuuuuggcuauuucagcugaggaagacuauuacaccuucuuccuucugucuuccauaaccauaaaaguuauuuuaaaaugaugcuuguuuuugugaccuguaacucagaugagcagauguucaaauuugauguuucuuaaaagauuuauuagaauaacaauuuauuuaguacuuugguuagcugauuguuguuauuuaaguaccacauuuuaaagugacagacuuucuaaaauuucuggucauuuuuucuagacagcucaacugaacugcugcuguauugcgauacuucuggugcauaaaaagcuauguaguagccaagggaaugggauagcaauuagaauaguauuaauauuucuuccauuuucuguuuaguaagaacuuuuauuuauaauuaauuuuaauaaauauuuguuauauauuaguagaaaaguuuuuucuuccaacuugaacuguaugacauccuauuauuuauuuuuuauaauuuguguuuauucaaaugagcaaucacuuauaaaacaccuauuacugugggcuagucauaguguuaggcauauacuuuauaauguguguguguuauagaaaaauagaaguucugcauuuucuuaacucguuugauuacuucauugauuuuaauaaaggaaaaaugugacaaagaaauaacgaaaucucuuuucuuuauaauuugauacuuuucaaagcucaaggggcuuguugaaaguugaaaguaauuauggguuuuuuuuguuuguuuuuguuuuuugauauggaaucucacucugucacccaggcuggagugcaguggcgugaucuuagcucacugcaaccucugccucccggguucaagcgauccuccugccucacccuuccaaguagcugggacugcaggcacgcgccaucacacccggcugauuuuuguauuuuuaauagagacaggguuuugauguguuggccaggcuguucucgaacuccugaccgcaggugauccacccaccucagccucccaagguccugggauuacaggugugagccaccgugccccagccaaaaggaauucauuuuaacaacacaaauccauuauuacuuauaaagguaaauuauacuauagagguuagauauacuugucuucacuuuuaauauagaguagaaaauccauuuuacauacuacugacuuuaaauaaugagcaacauuuacuugcacucuuuuaauugugaaucaaggauuuuuugugugugugucuaccauuucuuauuuucuuucaauuuccaaucaaucagucaaucaaucaauaaguauguggugagcaccuguaauauaccaagcacucugcuuggcccugaagaugcaguggugaaccagacacaguuccugccucaauggauuuauagugaguggaagucagaaaaguaauacaacaauuacaguauacuauaguaaauucuuagaguuaaaagcagugugugauuaaaauaaggagaagcacucaauucaguccuggagagucaaugaaggcuuccuugaggacaugaggcuuaagcuugaaggauuagucagaugguuaggggaagaaauguucuaugaagaagcagugguacguacacagaccuagggguaagagaucauagaguauggaaagaaugugaauaaaucaguauguguggagcacagaguagggguaaaguuaaugaaaaagaaagaauggagcaaaagcuagaucacaaaacacacuguaggccacacugaggaauuuagaguuaaugcuugguguaguguaguugggcaccagugcagguguguugguucggguccuuuaccuguuuuuuuuaacgguuugccaaagacaggauuaaacaugcaacaauuguauuaggggaaaugacuauguaaaggaaaaugaggaaaaugcugggaaaggcugagagacccaucgaauugugauguaagucugaccaugaaugaaggagagagggguagaauguugacuggaagugucucagcccgcuauacaguucaagggaggguuagcaaggcccugggaaguauuugagucaaaguugguugucagaagugucccaugucuccccaaaaugggccugccuuuguauaccuacuguguucagccauuggcugggagcagccuaucagcuauguguccuugcacaaauguggcaauagauuucagcagguguucuuaaucaacauacucuuuauaguuggagaucuuugacauauauucucgaggucaccacagaggaauuuuuggaauauagcaacacagauuacauuuguaucuguagaagaauauucuaacugcaguaggaauggauucagauaagugggauugagaaaaggcccauauuagaaggcugaucauguuacuccaaaugacagauaauguuaccuacaguaaauuagugucaguggggauaguuguugagaaauucgcuaagggacauagaguggaccagauuagcuaauuaaauagaagaggugaggcaaaaggaagaaucaaguuuggcacuuugcuggcuguuuaauugcauguauauuggugcuauucacuaagggaaauagaagaaaucagaauugaugauuuuagguuuaggcauguucaguuggaaguacuggaauauccaagugaagaaauccauuguuguuagcuaguuagauagguauauuguaggguauucucuuuaacauaaaaauggaugaguguuuaauaauuuaaaaauaauagaaguugaccaguuaguuguaucuucuguggauuugagaaucaucaggacauaaauuauaauugaaagcacgggaauggaggaugaccuaggaaauguaaagaaugagaaggaaagauuguugaagauggaacccuggggaaugcuggcuuuaagaagggguacgaggccgggcgcgguggcucacgccuguaaucccagcacuuugggaggccaaggcgggcagaucacgaggccgggagauugacaccauccuggcuaacauggugaaaccccauucuuuuguaaaacacaaaagaaaauuagccgggcgugguggcgggcgccuguagucccagcuacaggcugaggcaggagaauagcgugaacccgggaggcggagcuugcagugagccaagaucgugccacugcacuccagccugagcgagacuccgucucaaaaaaaaaagggguaggagaagagaggcacacagacuaagacugagggggaaaaauacagagaguguguuacaugggaaaaaaguuuacaguguaauauaaucagcaucaauuacugcuauaagguaauauaaaauaauauggacuaaauuaagcaacaggaaggcuuuugguggccuagaugagcaguuucaguggggagaauagacaucagaaugggacgacucaggguuuggacuuuuguccaagaugcaagcagucguucucaaacuuuuugguuuuaggaacccuuuacacacuuagaaauuauugaggacugcagagaacuuuuguuuauguggauuacaacuacugauaaauacuuuauuagaaauuacaaccaaaaaauugaagaauauuuaguaaauccuugaaaaauuacacuaauacccccuuucauguuauuacaggccuccaaaaaauuaguaagaagaguggcauuguuuuauauuuuuacaaaucuccuuaauuuguggaugaggauacagcuaaauucucauaucugcgucuguauucagucuuuugugauauuuucguugaaguguaucaagaaaauccugucucacacagauauguaguuggaaaauggaggacuucgcagacccccugaaagucucggggacccaacggguccuuggaugacauuuugagaacugcugaacugcuguaggauuagauauauggagggugguagaagagaauugauuguguuuaaguguugacagaauaaggaaguuauaaggagcaugaaauuaaagacuagaaguaguaauugauagaaggagguuuuugaagaagaaugggggauugggguccuagcugacuuagaguuaacuuuggaagggaggaaggaacuuaggauuuuuuaauaagucacuagcacauuguaaggcuugaauaacaugacagcuuaggcaggaaggaggcaaggauggaugagagaguaaguuuugaagcagggugauaggaaaaaaaaggguuccaaucugguuaauucuacuguguguaugugcauauaugcaugugcauacucuaggaaacaaaaguuuuaugcugagaagaagagguagggaaggaguuugaagaaguagauaauuuuuaaaguaacgagggaaagaaagcuaggacgaauuaaaaagcugaccauugagacauggaaggauugcuguacaugugcuguaauuauagaaguucuugcuacagaaaaauaauaucuguuagcaauuugaaaacuacaguuggcuggauacaguggcucaugccuguaauuucaacacuuuaggaggccaaagcaggaggaucacuugaccccaggaauuugagaucaacuuggcaauguaucaagacuuugucucuacuaaaaaguucucaaaauuagcugggccugguggcaugcaccuguaguccuggcucauggggaggguugaggagggaagaucacuggagcucaggaguucgagcuugcagugagcuaugauuaugccauugcauuccagccuacaugacagagcaaaacucuguuucaaaaaaggaaagaagaaacaugcaauugucacuuuuuaaaacagaaagccccguauuccauccuaguuaaauguccuucauggcuauuuagacuauuuucaugaagcauaacuaacagguaacccagcugcuugcuuucaggcuauaauguccuucuugggucuucagacugcaguuaccuuuucuugaugaagcauguggcagccacuucucuugaacagcugggagucuggucccugaugagcuucauuuguguuccuccuuccacaguggcugacuccugguuuaguaaccuugguuucuuccauuacuuuguaacuuacaacuggguuagaaaaaccaauuuuuaauuugucaguaagaucucuucugguuuugcacccuguuguaugcugugugccaagugcuuaggugguuuucuccucgcugcaguuguaggcacauacuauaaucuucaaacaacuuuaaaaaaaugaauuuauuuggcaaauaucagauuagauagauaacauuaucguacuuuuucaaaucuuuaaaaauacugcuuuacauuagaaaggauugaacauuuaaaauaauuuuuacuuuauauagcagaagcuuguuuuuauuacauauagauuuauuaguaaaaauacaugaaguuguuguuucauauaaaucauggcuaaagaaacaccauccuguuucaaaaaugggaaagacagcuugaauucuuauuuaguuuaaaaguuuccauccauauuuguuggucugcucuugugcugccuuagcucaccuuuuuucccugacgcauuguggcuucucuaacaguccucuuucauguguauuuuacguuuuugccauguaggucuuucacaguucugcagccccaggcgggcauucucugagcaggguccgcuccgccugaucaggagcgccucuuucuuugcagguuugcgaugugcuguguggguagacuaguuggugugccccaacggcuagaaucuguaguuaagcuguggaaacaagagaguagaugaaugcaguuggugagguugugguuaagaaaacauugcauuaggaaguauaaaaacuuaauuccuuuucuacugaacauguucuuaaaguuuccagacaccggauuaucaguagaauugacauuuuuaugaaauuucaguuugucauuucucuuguggcauaaugauuuuaacuucagaaucugaaaccaaaacuuaauaugaacuuuauuucuuaugauaccacuuggaauuuuuaaugugacacugucuuguuuccauggcugaguagcuuuuguaccauaguucaccaauugcagaaaauuauccuaucuuguuauuauuguaaaauuucugaucuacacuauuccauaagagcaguuuuucuuggagcuaagauuuagaugaacaagcacuacuauaaugcucuguaaaaggcauauaugacuauauuugcuuacauaaucaaguugaugauuguagaguauguucauguguauauauccaggauucuaaucauauuccuuguuuucacacauuuuagcggauuaccuaacauuguaaccuuuuaguggaaauuacuggaaugugaacacauuuacucuucauuguucucagauugguaucaauuuagcccuucuuguuuugauuaauauuuucuuucccuguaaauauuagauauaaaaaauauauauuuguagaaaacuuggaaaacacuuuuaaaaggcaaaaauauauauuagccauuuuaucagccagaaauaccugcuuuuuuguuuuuuaaagaaaauggggaucauacuauucaaauaaauaucucaauuuauuauagagaauuuugaaacauacauuguuauaggcagaaacaguacagugaacuaugauauacccaccacuuggucccagcaagcacucauacuguucaguagcuugcuuuuuuucauuuaauaguauauuauaaauaugucacugaauaugcuuccaaaauaugacuuuuagucacuccuugcuucuuuagauauuauguuuuagauucuuauacuguguaucaaaucuucacagagcucucaaagcuuguucaacugaguaauagcucuugguguuggguuggugccaugcuauugaaaaaaauaagggaaugcaaugagaugagcaugauuucguuugcuauuuaaaaggagcuguucauccaccugaauagcaauauauuuuauaacugacaguuucaucuuuauuuauaguucacagcaacccaauggacaugccuggaagagagcucaaugaggacagagacaguggcauagcacggucugguaaugucacguucuuguauucaguuuuuuaugagauuacuguuggcauugauuuucuuuuuuaucccucccuuuauuaucaaauuuguucauauugauauuagccuuacaagagaacugugaaaagaccagagcaaagucuuauaaauuuaauauuuuucauguuuacuuuuaagugugcuaaguaggauaaagccaggaugaaguaaagccagaguaaaguacacugguugaagcuuagugaauauaagaagaaaagcauuggucagaaaaacugcuuagaaacuguaguaaaaaaaaaacacguuugcuuauauuugcuugcugcuaacuaaaguuuaaauugucauauugucucuugcccagaaaagcauaggcauuuugaaucaauguuauacuuuuuuuuuuuuuccaaauauggaccuguccaaaauuuguaggucuagcaaacauuuauugaaacaugguggacauuaaaaaaauuaaagcccagagucugcccuuacggaacacagauguauggagucuacugggagaaaaauuaggaaaaucaucugucauaggucauugugugaugcauuuagugauaggccugcgcaaaaagcuucagcgaaagagcaccacacuuagccugggcaaggggcagggaugccaacaaugcuuuacagaaggaugaugauugaguuguauuuugagaaauaaauagcaguuauccaggcaaaagcucagaaaagcauuuuagcuaaaaggaaaaguguuuguuggggcccagagagcagcauaaguaaaaggaggaguaauuuuaggcuugaauuacuguuagauaugagaaacuuaauucagugugauagcauguguuguuacauuauauggcucugcuaucgaaauuguuuuguaauucaguuuugaguauaaaugaaaaaucuaaacuugcuguauauugcaaucccuagguauguauuagaauaacaaagagaaguuuuauaaaaaauucaagugccugaacucuacuuucaaagacucucguguaaccuagagaagguaucucuaggcaucuguauuugugaaacaaaacaaaaugcaaaaccuaacacuugauucuaauggauagcuaggguugccgaccacuacucuaauaagaguagcuuguguuuuucaaguaaucucaucuuucuuuucuaauugaguuucuuauuuuuguuuuaaagaaucuagaguuuauuucuuuuaauaaacuuugcuucgauguaaucuagauauuuagucuucccuggcaggaauuuaauucucauuauuuuauuuaagauuuaaguauaauuuauuuauacuuacauucuuuguaaguugaagcaucuggcuagacugaucuguuaggcugcuucaaguuauuggauucauauaugccauuuaaguuaauguguguuuucuuuuuuuucuaauaggguuauuuuuaauauuagaaugcagugaaauguauuuuuuccaaacuuaggacagcauuuuauuuuucacugaagucauacccagauuuaguuguacauacccaaucuuggacuacaagaguuuauaauacuaauugauaaaauguggucugcauuuagaaucugcauucuaaaguaauuuagaaugaguucauugauggucuacauguuugcauggcacauacagcuuuauccucuaucauugaauuugucagaauucaaaugaauagaucuucauaaugaaagugucucaguuuuuagugcugguguccaaaauaauuuaucaucuggccuguaccuuuuuaauagugaugauaaugguucccuguuuugaauauacauuuucaguaugugcuuaugaucaugaaagauagaagucuggaauauugccaaacaaaagcaagcccuuaauggcaaguguuauccucucuaaauccaguggggaaaagccugaugaaaaucuccuagccuaaugaaaaaucagcaguuguagcucuuaacaccucaagcaauaaacauaucuuacagauuucacagaaguguuucgggaagggaauaauccauccccaagaucaggggauugcagccgugaaagaguggagucugcuggaauguguuugucaccuuagaugcuccagggagcauucuuuuuuuggagcuuaguagguauagucaugauucuuaauuaaaagugguagguuugacuacaugugcacaugugauccaugaauacuuguaaaugaccucuuuaaaugccauucagacacuuauuuucaauagcuuguucuuaaaauccagcugcugcauuaaguuugaauagcaucagauuuccuuuaauuuaagaacuaaaaggauucaacugaguuaggggacagucaauccaguggccaaagggauaaugccuuguugcaaaguauaauuuucuucuggagucccuagaggggaaugccaaaaggggauugucucagaguuuuuugcugauacauuguuaauauaugauuuuucuccucugagaccuugcuacaagaaggauguguucuuuuaaugaacauuuuugaggcucaugaagcaaaauaaaguuuaacuuaaccuauuuguaauuuuguuaaaaagaaauuugucauuaugcuuagucauuauugacuuauacuuguuguucuucugacuuaacagcaucucucagcagcuugcugaucacuccauuuccuuccccaaacuccucacuuacccgaaguugugccagcagcuaccagcgacguuggcgacgcagccaaacaacaaguuuggaaaaugggguauuuccuagaugguaaguuggaacuuuaaacacagaacaagauugaguaguuccuuaaacacaauuuuauauggguuuuuuagaaccuggacuuguauucuguguauuuuaaguuugaaacugaaaacuuuuaaaauuuacuacauuuuuaaaauugugguaaguuauacauaacaaguuacaauuuuaaccauuuuuagguguacaguucagugacauuuguuuaaauaccuucauauuguugugcaaccaucaucaccauccaacuccagaacuuuuuccucuucccagcugaaacucuguauccauucaacguaauuccucauuucucccuuuucuuccucuuguaaccaccauucuauuuucugucuuuaugaauuuucauucauaccuuguaugaaugaaaucauacacugcuuguccuuuugugucugccuuauuucauuuagcauaauguuuucaagguuuaucgauguuguagcaugugucagaaauucauuccuuuuuaugacugaauaacauuccguuguauauacauaccacauuuuguuuauccauuugucuauugauggacacuuggguugcuuccacuucuuaacuauugugaauaaugccgcucugaacaugagugugcaaguaucuguucgaguccccauuuucaauacuuuugguuauauauccagaaguggaauugcuggaucauaugguaauuuuguuuuuaaauuugugaggaacugucacgcugcacacuguuuuccaugguuacuguaccauuuuacauucccaccagcaaugcacaaugguuccaauuucuccauaucuucaccagcacuuauuuucuguuuuuuugauaauagccaucuuaaugagucugaagugguuccucauuguggauuuuauuugcauuuaucuaauaauuagugaaguugaacaucuuuucuauucuuuucuuuucuuucccuuuugagucgcccaggcuggagugcaguggcauaaucccggcucacugcagccucaaccucccugggcucaggugauccuuccaccucagccucucaaauaacuggaacuacaggcuugccaccacaccuggcuaauuuuuuuuuuuucuuuuuuuuuagagaugggguuucgccauguugcccagguuaguagaacuucugggcucgagugauccacuugccucagccucccaaagugcuaggauuacaggcaugaggcaccacaucugacuugaucaucuuuucuugugcuuauuggcuauuuguauaucuuuuuuggagaaaugucuauuuaaguccuuugcccauauuauaacugcauuuuuuugcuuuguuggugaugucuggaaauucuguauauauuuuagauauugaucccuuaucagauauaugauuuguaaauuuuuuuuacauucugugggaugccuuuuuacuccauugauaguguccuuugaugcacaaaagguuaaauuuguauguaguccaguuuauuuuuuuuuccuuuguugacugugccuuuuguguuauauccaagaaaccauugccaaaucagugucaugaugcaugaugccuuuacccuuuguuuucuucuaagaguuuuauguuuaggucuuugauuuauauacuacauguuuugauauuucaguuuuucauguuuuuauuuuggcaagguaauucauucuugaaagauuaguuuuuaaucuacauuaaguacaacuguagauacuaaaaguucuuguuuucuccucuuuuuuauuuccuuuauuccuucaucuuugacuuuacuccugaaaucaaaaacagacaccagaagggccuagaacagggaaaagauuguaccagacucaucuauaaaucuuaaaauuuagccacuuuuugguugauuaugaauugggauuaucuacuucuuuaguuacuucuaauuggacaaaaaaauguucccaaucugacucuguaguaaaauuucuuacaagaacaugaaccugaaagaauagccaguagauuucuuaaagagauauacaauugguaugaaauuauagguuuguuugauaaaacagcaaaagacuuagcuuaccuacauuuaauuagcaagaagauuaaauugugaauuuauuuuuacuuuuguaaauuaauaaaaaaucauuuauuuuuaaggucuauagaagaaagcuuuaaucucucagaugaaagcuguggcccuaacccaggaauugugcggaaaaagaagauugcaauugggguaaucuuuucauuguccaaagaugaagaugaaaauaacaaauuuaaugaauucuuuuuuucacauuuuccucucuuugaaagccacaugaacaaauuaaagagugcaauagaacagguaagcauaguuauuuauuuauguauuuuccuuuuaaaaucuuauucucccaauuaagcauuauauuuauuaauuuggcagaaaaauuaacagacguugugcauguguccuauaaagugcucugguggaugcaaauagauugaacccuuuuuaaggugcuuacugucuaguaaaagauauaagaucauucauccauuuguucuguaaauaaauauuugagggacuaaaaugugguagacaccguucuaccaacuaaagagaagugauaaaagcaacacuucugaccucaugggacaaauaaacauaugaauauagauguauguaauaaguccugugaagaaaaauaaaacggagaacgguauauaagggauccugcaaggaaggauuacuaauuuuuauaggcuagucaggaaugccccuuauuaaaggacaugugaaugugguccagaaauacggagcaggugagcuacaaccaucuggaacgagauauuccaggcaggggcaaaggccuuauugcaggaguaagccugauacuuaagcagcauuacgaggccaaggugccuagguugaagugagacuagaucauguaggaccuuauaagauaccauuguaagaacauuagcauuuauucuuacaaaaguaugaaagaugggaaaccauuggaggguuuucaguggaggaagaaggacauuauuuaugaggaucacucuuacugcugguggauaauagauuucuaggagcaaaaguagauguugugagaccaauuagcauacuguuacaguaauccagaugaugaauacgcaaaccacuuuagugauugaauugguaagaaagaguuggauucuagauauauuuugaaaacagccaguuugauuagcugguagacuaaucauuaagguugacucuaagauuuuuuuagccaagcaguuaaaaggaugaaguugccagcauugaagugagaaagacugcaagcgaaacagauuugauaaaggaagauggguauuuuauauuugcauauggacauccuuguguuuuuaugagucuggaguuuaccagagaagucaucaguguauagaugguauuuaaagccaugaaacugauggagauuggcaagagaggacaggcaaugguaagccugaguuguggugcauuuuaacauuaagaguuugacaagaugagaaggaaccagcagaggcgaaggaaaaggauuggcuauucaauuaggagaaaaaacaagaguguauucuuuuggggaaagccaaguacagaaaguauuucaaggaaggagugaucacuuuugucaguugcuacugagauaguauauacgauacaaauauguauaguaaauugugaaauauuagaaucuaagcuaaaaaggaaggacaaagguuuuuuagaaauuugggggaaagugaaaugacuuccuauugggaagaaguuucauuuggacugcauuuugaaggauguaugggauguuuuggaacauaaagcucugaaaauuggauauagcagaauagcaagaaaaucgacauucuugccacccaaagggaacacaguaacucauugcugaaaaaucuuauuuaggccuuuuuuaugcauauugugcuuuuacuugguagggauugugcugugucuacauuuuucaaauuauaugcccauuuaaaaaaacucagauugagcaacauggcaagacccggucucuacaaaaaaaaauuuaaaaauuagccaggcaugggggagcacacuaguagucucagcuacuagggaggccgaggugggaggggugcuugagcucagaaggucgaggcuguagugaguugugauugugccucugcacuguagcaacagagugagucccuaucucaaauaguaaaauaaaaaacaucauugucacauacacauuucucaaguuauuguaaaugguucuuacauauauuuuaguaggucuccucaauuuaaguaacaguuucccuguuaggccauuucuacuuuugcacaauuguugcuacccuaucguuaacaucuuggcgaauuuuccagauuauuuuuuagaggagauucccagaaguugagcugauaaaaucaguggcugucaccagaguuuuuugcaacagucuguggaagggaaaggauacaaagaggaauagugagagguacaacuggcgaaguuaaugaguaccugaugacaaaaaauguagcgugcuugccagggaguucugacuuugucuuuaaggcuguuugcaaguuguacuuuggggagauuaacuuggcaguguguuuuguauauggcugcugaaacgagcacuugguagugcguuuugaagagacuggaguaagagacgagagguggguagacccguuagaaugguuuagaaaggaaaggauguaucucaauaacucauuagugacuaaggaugaucugccuuuagagaagacauagauguuaguuauucauauugaguaugucaaaaaauaaauaguucauuagcaauacauuuuuauugaacaaaugaguaaaggccauuuucauuuaccuuuucuuaaguuagacacugauuacauuucuucaauuggcugcacucacauuuuguagucuagccaaagucaucacacacaguaauaaguugugggugaacugacauuuuuaguuauuuggagaaguauuucaaacuuuguauaaaacuugaaauaggcauuauagaacucauuaaagauuacuuuucaaguguuuucauguuuuaacgcuuugauaauucuguaaccuaaagcagcaguccccagccuuuuuggcaaccagggacccuuuguagaagauaauuuuuucacggauggggcuggggagguggggaguugccaugguuucagaggcauuagauucucauaagagugugcaacguagaucccuugcaugcacgguucacaauaggguaugcgcuccuaugagaaucuaaugcugccacugaugugacaggagguagcgcucaggcaguaaugcucgcucacuugcuugcucgacccaauuccugacaggccacugacggguacugguccacggcccagaggcuggggaccccgaccuaaaauguacauuguuaaugcuuauaguuguuuggauauuuguucaauuguaguaucgcauuuuuuauuaaagcugaaagaugaaauuaaaugaaugcuuuuacauaagugaaugggacuuaauuuuuaaaguucuauaguaguuacuuaaugauagaauauuauuaagaauagaauauaauagugaauauuguaccauccaaagaaguuaucuucuagggccaguuuucagacuauuuuuuuuuuuaaauaaaagcuauggauuuuguuucugaacaccuuggcaauuauuuugaagucuucuaucuuuugagauuugugauuuaauuuaaaaauagcauugcugauaagauuaaggaagaacacuaccaaauucuagcaaaauaauauucacuucuuuauaaauugccagucucuuaacaguuugaaaaaacauaaagcguguuucacuuucacccucugaagcuuuuggguguacaggaacaugauuucuggccuaaaguaggcugacaucuuaauuauuuuuuuaaacaauauuuaaucacuuuguaauuauauaaagaauacagaauucaauucucuuugaaaaaguguuaaagauuaaaguucuuuuugaccuccauauccuaauccugauccccuuuuugccuaccuagauuaaggcuuuuuaaccuuggcuaaauauauuuuaagaaagcaaauauuggccaggcaugguggcucaugccuauaaccccagcauuuugggaggccgaggcaggcggaucacaaggucaagagaucgagaccaucuuggucaacauggugaaaccccaucucuacuaaaaauacaaaaauuagcggggcaugguggugugugccuguagucccagcuacucgggaggcugaggcaggagaaucgcuugaaccugggaggcagagguugcagugagccaagauugugccacugcacuccagcuggcaacagagcaggacucugucuuaaaaaaaaaaaaaagcaaauauuacuaacaccuuuagcuaucuuauuguagaaucuuuauauucccuuuuuuuuuuuuuuuuuuuuugaaacagucuuacuccaucacccaggcuggagugcagcaguggcaugaucucagcucacugcaacuucagacuucuggguucaagcgauucucaugccucagccucuuucauagcugggauuacaggcgugugucaacacaccuggcuaauuuucauguuuuuaguauagacaggauuuugccauguuggccaggcugggcaaauuuuuaaaaaagaguuaacagggcugggggcaguggcucaugccuauaaccccagcacuuugggaggcugagguggguggaucacgaggucaggaguucaaggcuagccuggccaacauggugaaaccccaucucuacuaaaaauauaaaaauuagccaggcgugguggcaggcaccuguaaucccagcuacucgggagacugaggcaggaaaaucgcuugaacccggguggcagagguugcagugagccgagaucgcgccauugcacuccagccuaggugacagagugagacucuugucaaaaaaaaaaaaaaaaaggaguuaacagaaguguuaucugugaaauauaagcauaaaaccaugaguuguuguuacugaguuaucauuaugucuuguucuguuugggaaaaauaaguuuuuuguaacccagaaacugucaacaucaguuuuuuuauguguugacagucugcaguuuuaaaaauaagagauugaaaacagucaaaaauuuugaacuuuguucaaccauucauuaauuaccaaauguguagaagaaaaagccacaauaaaugcauuuacuuucuuuauuucuuucucgauaagaauuuugauagagcguuguguaaauaugugacucugucuaaaaaagacuuuuuuccauguuuugcucaugauuaacauaagaauuaacuaucucaaugauuguuuucaaggcuaugaaaaugagccggagaucagcugaugccagucagagaaguuuggcauauaaucgaauaguugaugcccuaaaugaauucagguacauauugcccagcuuuccauaaugcaguaauucauaguguacacaggaagauucauuuuuucuuuaacuuguucuaauaaaauuugauuucuuuguccuauagucauaugaugguguaauucaguagaccauuggcuccuauguuauuacaucucaaaugugcuugagaaucaagcacauugagagccaucagugguauguuuuucaguauugggccauuugacaagcaaauaugaccaggaaagacccuuguucuagcaaaaguaugcuuuguucucucuugggauccuagauguagggacuguuaaguguuauuuaaccagugguaguaaucagauauucuugaauacaugagauacaaggauauauggauauaaggaacaugcacuugauauucuaaauggcuuuguugcuugauccuuccucuagauauggcacagugaauaguccuuccgcuaggguuuucuggcucaacaaagcuuguaccugaagccccaacaacugcuguagcugucuucuaacuaugugacauacauacuacaaaugauguuauguugggaauuaguauacuaagugacugauaugucucccucgacaagagguucgguuuaggucuacuucauuuucucaaucuuuccuccuuuagacuagagagauagaauagcauagggagugaaaacuaagacucuagaaucugucagacagacguggauuuuaacccuggcucugucauuuacuaccucuggugaucuugggcaagugcauuagcguuuuugaccccuaguuuucuaguauaaaauagguaaauucaauuuaguaauaaucuaauagauuguuauaaggaucaaaugaaauuguguguguaagguacuuagcagaaugccugacauuaguggcaccauucuuuucuuuucuuuuucuuucuuuuuuuuuuuuuuuuuuuuugagguggagucuugcucugucacccaggcuggagugcaguggcgugaucuugccucacugcaaccucugccuccuggguucaagcaauucuccugccucagccuccucaguagcugggauuacagacgcgugccaccaugcuuggcuaauuuuuuuuuuauuuuuaguagagacgggguuucaccauguuggccaggcuguucucaaacuccugaccucaaaugauccgcccaccuuggccucccaaagugcugggauuacaggcaugagccacugagccuggccuaugguaaacauaaccuacagcagugcuuccccaacuuaagucacuuacaucauaucuuaacaauuuugccaaauuuauauaucauguauacuuuuuaaauuuaguguuucucuuuaaauuugaccaucuuuuauaccuaaauaaaucuauuucaacaugaaacuucauuacccuagauagggaaacaauaugcuuuaccauaauaaaacuagcuauaaaaauaaauuuauaguaacuaaaauuaaaaauauguaucugggccaggcguguuggcaugugccuguaaucccaguacuuugggaggccaaggugguuagauugcuugagcucaggaguucgagacuagccugggcaacauagugagaccccgucacaaaaauaauaauaaauguguauuuguauaccacauuguguacacuacguaccacuguguaaauuuuauuauuaccaguagucuauguaccuuacuuuuagaaaaacuacauuuuuuuuauugacaacuguguggucucuuacuggggcagggaucuucuagauuguuguuuguuuaaaugggccaucacaucuuggagugaaaggcuguuuuaguuuguguaacugcaggauugcuaugaugaaauuguaggcaugccauacauauauauaaaauuuuaaaacuuuuaaaauauauaaaacauuuuuaaaacugagcuaaagagugguagauuuaaauugaagaaguuuaugacuauuguauaauaaucauuuacuugacucaauuauugagaaagagaauaaugucuacucauucauuugguuuaugcaucauaauguuuaggauaaaagauaugaaaagcuaguuaaauauaucuuacuguucuguacaguacacucagugguuaggggaaauguagagaaaaacagagagaauuuaauuucaccuuauauuauuuuuugguauuagaaauaauuuguacaggcaaaaacuguauuugagaugauauuucugccauauauuaauuuuauuuuaacauuaauuuuaggcauuuauuauauggagcaugcuaacaaauaauuuuaauuuaauauuuuuauuguaaaaauaucuauaacguuagauuuagcuuuauaaaucauuuuuuagguguacaguucaguaguguuaagcauauuuacauuguuuugaaaucaaucucuaaagcuuuuucauuuugggacacugaaacucuagugauacgguaaucaguguggguuuuuuuuaguuuacuggcaucuucacucuuuauaucugaauuauaugcaaaguuauucauaauuucauuucuucauacuuaaaccauaaagguugagauuaucacauuuugggugccauucaugauuaaauaaaagcauuauaugcauguuuuuuauagaugaaguguaggagaaaucaaauacauuugcagagggaauuuagagcaacuuuuaugagcuuccugauguacagucuacuuuggcuucauaacuucucaauuuauauagcccuguuuguauguuucuagaaguucugugaaaacacaaaauuugaugauuuuaugaauguaagauggaaauaauuuuaacaucaggauuauuugcuugagaugacaauuucuuugaguuguauuguuuuaauauaaauguuuagguaucuucuuuaugauuuaggagguaaauuauacaaaguugcuuaaaccaaguguuaaugguuuaggccugccuaggauacauauccuaaccauugauuugauauuucaguaaguguucuacaguuaaggaaaaagaagcccauauuaagcucaagauaagugguuuucuguuuucucaauguugaacacaguuuuugaaagcagguaaauuguaggugauggaauuccagccagccagcagacauuuuaugugacuacuguguuuuuuuaauaaacauuugaaccuuuaggccuguaggccaggcaagcuuucuuuaguuuggcauaggcuguaucucucucagucaguuguauuaacccauauauuguauaauuuuauuccugccaggccucggaagauuauuaguuuauacuucgguuuuaggaguuggugauuuauagccauuaaucuagaccuuauucuuuuuuaauuuguagugcagucugauuuucgugcaucuucugauacuauccauguuugugucugaagagcuagaccugcacaggcugaauaaugacuaucccuucuuucuuuucuucuggaauauugagagugggagugggggacagcaaaacgaaacaauaacuaaaugguaaauucuaagacaugccuaucucuuauauugucuauuucuuggccacucuguauuaucaguuaagaguauaaauagcuguauauagcuuuauuuuuccaguuugaugcaugaguuuaugcacgcacgugcccacacacacaaugaagagacuuaauuugaacaguuucagauuuacagaaaaauugagcaaauagcaguuuuuucauauagcccucuuccccaaccuacaguuuucccaguuaaugcuuuauuuauuuauuuauuuauuuauuuauuuauuuauuuauuuauuuauuugagacagugucucacucuguggcccaggcuggagugcaguagcacgaucucaacucacugcagccucugccucccaggguucaagugauuaugugccucagccuccugaauagcuggguuuacaggcgugcacuacuacacccagccaauuuuuauauuuuaaauagagaugagguuucacuauguuggccagacuggugucaaacuccuggucucaagugaucugugugccuuggccucccaaagugcugggauuacaggugugagccaccacaccuggcgucaguuauuaauguauugcauuaguaugauauauuuguuaaaacuaaugaacuaauguuaauacauuauuacuaaccaaagaccaaaauuuacauuaaaguucacucuguuguauaguuauaugguuuuuauuaaauguaugaugucauauacacaccauuauaguaucauauagaauaauuucaccgcccuaaaaauccccugugcuuuaccuguuuaucccuacccacuaacugcuggcaaccacugaucucuuuaccucuuuacuuucucuauauuuuuaucaauuccagaauguuguaugcuugaaaucauaugcuauguggacuuuucagacuggcuucuuucacuuagccagucuuucguaagauucuuccuugguggugguggugguguugcuguuguuuuuaccuaauagcucauuucuuuucaucaucgaguaauauuccauuauauagauguaacacaguuuguuuauucauuuucauucaccuaucgaaagauaucuugcuuguaguuuuuggugauuauaaauaauacugccauaaauauucauguuugggguuuuauguggacauguuuucaacucaguuggaaaaauacauaggagcaugauugcuggauauuauggaaaaacuauguuuagcuuuguaagaaaugaucaaacugucauccaaaaugacuguaccauuuugcauucccaccagcaauuagugagaguuccuauugcucuacauccuugucagcauuugauauggucaguuugucaauuuuagccauucuaagaggcagguagugauguaucauuauuguuuuaauuugaaguuccccaaugacauauguugagcauuuuuucaaaugcuuauuugccaucuguguaucuuuuucggugaagugucuguuuggguuuuuuguccuuuuuaaguuggcuuuuuuuucuuauuguugaguuuugacgguuuuuguuguuguuguuuuguuuuguuuuggauaccaguucuuugucagauuuaaaaaaaauacuucuuacaguuuguggcuucuucuuauaauagugucuuucacagagcagaguuuuuaauuuuaaugcaguccaacuuaacaauuuuucuuuccuguauaguauuuggugcuguaucuaaaaacucaucaccuaaccaaaggucauuuagauuaucuccaguguaauuuucugucugcuuuauaguuuugcauuuuaugcuuaugacuaugauccauuaugaauuaauuuuaugaaaacuguaaggucuuugucuagauucaugcuuuuacauguggauguccagucguugcagcaccauuugcugaaaauacuuucuuuucucaauugaauuaccuuugcuccguugucaaagaucaguuuauacucuaguugugugaaucuguuugggggcucccuguucuguucuauucuguucuguucuguugaucucuguaacuauauauauauauauauauauauauauauguauauauauauauguguauauauauauauauauauguauauauuuagcuauuaccaugcuuuuuuuuuuuuuaguugacagguaaaaauuguguaucuuuauaguguauaaaaugauguuuugauauguguacacauguggaauggcuaaaucaagcuauuuaacauaucuauuaccucacguaauuaucauuuuuugucauuaaaagacuuaaaaucuacucuuagcaauauuccaguauauaauauuauuauuaacuguaguugccaugauguguaauagcucucuggagcccugaaauuuuuuuuuuuaaauuuauuuuuuuuuuagacagucucacucuguccuccaggcuggagugcaguggugcgauuuugguucacuacaacuuccaccuccuggguucaagugauucucaugccccaucuucccaaguugcugggacuacaggugugugccuccacacuuggcuaauuuuuguauuuuuaguagaggcaggguuuugucauguuggccaggcuggucucaaacuccuggccucaagcgaucugcccaccuuggccucccagaguacugggauuacaugcaugagcccucaugccaaauuuuguguccuuugaccaacaucucccuuaucucccaauccccaugcuaucuuaauuacuauaucuuuauaguaaaucuugaaguucaguaguaucaguccuccaacuuuguuuuuauucuuaaguauuguguugauuauucugggucuuuuuuguuucuauauaaacuuuaacaucaguuuguagauguccacaaaauaacuugcugagauucucauugggauuguguugaaucuauggaucaacuugggaagaauugacguuuuaacaauagagucuuccuauucauuaccauggaaacuauucccauuuauuuagaucaucuuugauuccuuucaacagaauuuuauacuuuuccucauauagacccuguguauauuuucucagauuuauacauguuuuuugggggggucagggggagggaaccuaauguaaaugguauuguuuuuaauuuuacauuucaguuguucauugcuggucuguaggaaagcaguugacuuuuguauauuuacauuguauucugcaaccucauuauaaucauuuauuaguuccaacaguuguuuuuuucuuucgauugauucuuugaaacuuuuuauauagaaaaucgucuuccacaaauaaagacuguuuuauuuccuuuccacauguauacuuuuucugucuuccuucuuuccuuccuucccucuuuuuuguaucuuugugucuuucuuacagcccuagcuauaacuuccaguaugauauugaaugagaguugugagaggacacaucuugaccuugcucccagucauaggaaaaaaaacauccagucucucaccauaaguaugauguuagcuguagguuucuuguagauauucuuucaaguugagguaguuccccuuuauucuuuguuugccaggaguagauaauuauugauucaauuuuuuaaguagacauaggcuauucaaguuaaucuauuucuccuuaugugaguuuuggcaguguguguuuuucaaaaaauugaugcauuucaucuaaauuugugggcauagacuuguucauauaauuccuuaauuauccuuuuaacguucauaguaucuauagugauaccccucuuuuguuucuguuauuuauaauuugugucuuuuuguguuuuucuugguuuccugauaaaggcuuaacaauuuuacugaucuuuucagagaaccagcguuugguuuuguugauauucucuauuuucuguucaauuacaauaauuucugcucuagauuuuacuauuccuuaucucuugaaugcuuuaguuuuauguugcuguuugucuaguuuccuaagauuaaagcuuagaucguugauuuuagaucuucuuuucuaauauauguauucaauacuauuaauuucccuuuaagcacuccuuuugcugcauucacaaguauugauaaguugaauucacauuuaguucaaaauauuuuaaaauuucuuucaagaugucuucuuugaccuauguguuauuuagaugcauguuuucaaucuccaaguauuuggggauuuuccaguuaucuuuuucuuacugauuucuaguuugugauuugagaacauacauuguaugauuuguauuauuuuaaauuugcuaaggugugucuuauggccuagaaugugguccauuuuggcaaauguucccugucagcaugggaagauuguguauucuccuguuuuuggaugagguauuguauaaauguuaauuagauucaguugacugaugguacuguucagcucuauuauauccuuacuaauuuuccgccugauggauacgucauuuacugauagaggaguguugaaguuucuaaggaaaauaguggauuuauuucuucuugcagcucuguuuuugccucacauacuuugaugcuuuuuuguuaacugcaaauucauuaaggauaauuaugucuucuuggaaaauuagcuccuuaucauuaugaagugccccucuuuaucucugauaauuuucacuguucugaccucugcuuugucugaaguuaacacggcuauuaguccauuuucguacugcuauaaagaacugcccaagacuggguaauuuauaaugggaagagguuuaauugauucacaguucagcauggcuguggaggccucaggaaacucguaauuauggcggagugugaagaggaagcaaggcaccuucuucacaaggcagcaggaaggaaaagugccgagcgaaggggaaagaagagcuccuuauaaaaccaucagaucugaugagaacucagucacuaucacaagaacagcaugggggaaaccgccuccgugauucaaauaccuccacauggucuugaucccuugacauguggggauuauggggauuaugggcuuacaauucaagaugagauuuggguagggacacaaagccuaaccuuaucgguuauuccagcuuucuuuugguuaguguuaauguaguauaucuuuuucuauaccuuaacuuuuauuuuauuuuaucuuauuuuauuuuauuuuauuuuugagauggaguauugcucugucacccaggcuggagugcaguggcgugaucuuggcucacugcaagcuccgccucccggguucacaccauucuccugccucagccuccugaguagcugggacuccaggcacccgccaccaugcccggcuaauuuuuuuuuguauuuuuaguagagaugggguuucaccguguuagccaggauggccucgaucuccugaccucgcgauccacccuccucggccucccaaagugcuaggauuacaggcgugagccacugcacccggcuucuauaccuuaacuuuuaaucuaucucugacuuuauauuuaaaauggguuucuuguagacaacauaaaguugguucucugccuuuuaacugguguauuaagaccacucacauuugaagugauaauugauauaguuggauuaauaucuaucauauuuguaauaguuuucuauuuauuucacuuuauguuuuuauccuccucuuuuuaugucuucucugguuuuaagcaguuaaacgcuuccauuuuucucuccucuuuuagcaugucauuuauauuucuuaaaaacuucacuuuuuaguguuuguccuauaguuggcaauacacauuuacaacuuucaaauaaccauguacugcuucacagggagugcacauacuucauaacaaaauauuccaauuucucccucacaucacaucccuuauaacauugcugucauucaauuuaauuuuccauuagcuaugaucauucaauauauugucauuuuuauuacccuaaacaauuauuuuucuauuaggucaauuuagaauaaggaaaaugaaagacuuuauuuuacauuuauuacuuuuuggauacucuuuuuauguagauuugcauuucuaaccuguuuucucugaaaaauaucuuucaacauauauuaaaugucauuuuuuucugccaucaaaucugucaguuuuggucugaggaagucuuucucuuuuccuuuugaauuauuuugcuggauacagaauucuagguuauuguuuuucuuucaauguuuuaaccauuuuucuccagucucuuuuuuuuuuugcauaguuucuaacaagaacucuaaugcaguucuuacucuucuauagguaagguuguuuuuguccuucuuacuuccauuaagauuuugucuuugguuuucugcaguuucaguaugauauauauaggaguagauuuguugguauuuauccugcuugguguucugugagccuccugcgucuaugguuuguugucuguuacuaauuuuuuuuuaauucgaagcuauuauucauauauuuuacuucuccauuuuguauuuauuacauguauacuuuuguaauuguaccacagcuccuggauauuauuuuuuauccuuuauucucuuggcuuuucaguuucggaauuuuuauugacauaccuucaaguucauugauucuuuccuuggucauguccagucugcugaugugcccaucaaaagcauucuucauuccugcuccuuuuuuuuuuuuuuuuaauugcuagcauuuccuuuugauuuuuuaaaugacuuuccaucucgcuguugcauuauuuggucuugcauguugucuauuuuaaacaucagagcaacaauaaucauauauauuauauaaaauaaacauauuuaucauaauuuucaauucccauucugauaauucuaaaaucuuugccaaauuugaguuugauucugaugcuuucuuuguucagacuaguuuuuguugcuuucuaauuuuucauugauagcuauauaugauguauuaggauauaggaacugaguuuaauaagauuuuaguaugaaguuuuauauuaaccuagcuaggagccuuagauguguuuaauguuugcuguaauguuaguuguaggugccagaagccucacuuucccauaguuuccuuuuuuuuuuuuuuauuuuaaacuccucuuucuuugguuuuccccaagaacuacuucuuugaauagauucuguguccugcagcucuuuuaguuguaaucugcauuuguuacacuggagcuauguugauauggaaguaagguguuggagagaggaaggggaaauguucuguaaucuuaaaauuaaaucugauuuuuuuuuuuuagucugaauuucugggaugugaccuuuggaaguauuucuuagccauccccucucccugccaccuauuuuucuuuccagaggccagcgaggaaggcugcuucucucucaagucagauaaggcucugguaaaauaguuuuauuuggagggcagaccuuuguuuuggagaauguucuaggaauauuucaaaacuguuacuuugucacuaccucuguccgaaccauagccagauguuucucugauuuucaccaugaaaauaugguaguaucccaugaaaguggggaggucucccuaagacuaggucccuaggaguuuuugucacugagaggaauucacacucauucuucagcaguuagucaauuacuauuuaaguguuccugcugguuauuggcuccaaaggcuucugcuucagguaacuugaucucaguugucauucucuguauuuacccauuuuuucaguuuucagagugaugguuuucccucuguccgcaguuuggugauguaacuaagaaaagucauugauuuuucaguuccuucaguuuuucccuuguucugagaacaagaauaaugacuuccaagcucuuugcaggucaaagcugaaauuggaaguucacauauuuuuaaaucaauauuuuaauguaagaauacauugaacugaaguaagauuuaaaacuuuguugaguuaaaaacugaaauugggccagguauaguagcucaugccuguaaucccagcacuuugugaggccaagguagguggaucauuugaguccaggaguucaagaccagccugggcaacauggugaaacucugucucuacaaacaauacaaaaauuagccaggauugguggugcaugccuguaauccuagcuacuggggaggcugaggcaggaggaucaguugaaccugggauucagagguuacagugagccgagauugugccauugcacucuagcuugcaugacagagcaagacccugucucaaaggaaaaaaaaaaaaaagccaaacaaaccacaaccuaaauugaucuagacuuuucuuuggaauuuaaauuacaucauaaaccuaugcuuuuuuuuuuuuuuugagaaaggaaaaaaaaaccauucagauacugcugucacuagagaaguauaaugaaaacuguuucccaaacucuuagaguuuguuuaguagguauggggcuagcaucuacauuucacaaacucuuuugguaauaacuagcuuaaacuuuauucaggggccaagcuugguggcgcaugccuguaaucgcagcacuuugggaggccacggugagaggauugcuuagaguuuugagaccagccugggcaaaaaaagcaagacccugugucuguugauagcacaacagggugacuauagucaauaauaauuuaguuguacauuuuaaaguaacugaaagaguaugauuggauuguugguaacaaaggauauauucuuaagaugguggauaccccauuuauccugauaugauuauuacacauuguaccccauaauuuauauuacacuuacaguguacccacaaaauuuaaaaucaauaaaagaccucaucucuaaaguaaaaauuuucgaaguagccaggcucaaguggcgugcaccuguagucccagcuacuuaggaggcugaagcuuggcaggauugguugagccuagguagucaagguugcagugaguuaugauugugccacugcacuucagccugggugacaaagugagaccacaucucuuuaaaaaaaggacaaaacucuuuucaaggagaaaaauuaccaaauugugucuuucuucugcacuacuauaauggaacuauaagccuugucuuacacaauuacuguucaacucuuagcagggaugucagagucagcauuugagagcaguuuuguauugaaauaaagagcaauuucugauucuucagagugauuauauaugcaaacgaaggugucuguguguuuuauugaaaucaggacauuuugaaccuaauauccugauaagcuaaaauacuaucaauuggguaaaauugguuauuuauuaucccuaaugguuuaugacagcuuuacucuguauacauucccuuguagcccagugcaugugccaccagugccugugcucuuuacauagcugaaagauugaacuuaaccacaauucaaacacacacauacacacaacuagagugguuucucuaccuauaaaauaggccucuuaugaauauaaguaguauuugagaacuaugaaaaguuauagccuuguauuugucuaaauuuaaucuacaguuggaauuuuuuuuuuuuaacuggagugaggcaggauugcuugaaagcuuacucaaagauucuuaaggagcgaggugcaguggcucacgccuguaaucccagcacuuugauaggcugaggaggguggaacaucugaggucaggaguuugagaucaucuuggccagcauggugaaacccgucucuacuaaaaauacaaaaauuagcuggauaguggcggcugccuguagccccagcuacugaggagccugaggcaggagaauugcuugaaccagggagccucggaggcggagguugcagugagcugagauugugccacuacacuccagccugggcaacagagcaagacuccaucucaaaaaaaaaaaaaaaaaagauucuuaaggguuuugcuuccccugaaguagauauuaugccaguaauauaaaagaaaugugcaaugaauaaucagauguuucauuuguaauuuuuuauuuuuugugguuuaaauuguuuuuguuuuugagagaggguuucaaaacacuccuaggcaggagugcaguggcagaggauagcucacuggaaccuugauauuuuuaaauauuuuuuaaauauguuguauaaugggguuacuauguuguccaggcuaaucuugaacucuuguccucaagggauccucuugccucaaccacccacaguacugggauuacaggcaugagccaccgugccuugucugguuuaaguuguuuuaguuuacuuuguuuacaccagaauuauuauuaauacguuuuaucgaaauccagacauuuuauuuuauuuauugaaaucaagacauuuaaaauuuuguggguacauuauauguuuucaauaguucuuuuugcuuauuugcuugaaagaauccuucaggauucuuucugaguaucacauauugcauuaguauaaggcagugaaucuuugcccuugaacuugcaguuaauuauacuauuggauugacaaauucuuuucugcagucacaagcuuuguggcaaaggccaaaaguuucugcuugggcucugaggaaacacugucauuauagauccagcugaagucaccagaacaguaaauauugucauaagacucccuccaaacaggauacugaucuugcuuuuagauuuuaaaagacuuuuuuauuuuucaaaauuuuaauuaaauacuugugagucaauugcugugguauuauauaguacaaauggccuagacuuagaauuucaagauugccuggaauuuacagcaugcgaguuauaaaaucuguaaaaguauaugucacuauuaugugccuuuccauuuguauuguuugauuauuuugcuucaguugcugugcaaauaugaaagggauauuaaauauucuuauaauauuuuauaauuuucaauaggaggucuaccuauauaaguacuuucacauauacaauugauauucaccauuuguggauuuuguauuuuagaauucacccacuugcuaacauuuauuuguaaccccaaaauauaauugcagugcuuuugcaguaauuuguuuacaugugcaaagcaaugaaaaaugugaguugccugacgcauauguuccuaguuuagaucaagcaaggucuaaugcuuugccuucuuguuuuaauucucauacuguuaacaaauauacuuuuuugacauuuauuuagugccaauuuuuuugcauuuuucugcuuuuuguuagugacuuugcuguuaaaaauggcuuccaaauguagugcugaaaugcugucuaauauucaguguaagaagauugugauguaccuuacagaaaaaauacauguguuagauaagcuuccuucagacauuauuuauggugcugucagccaugaguuuaauauuaaugaaucaacagcaucaaauaagauauccuuaaacagagaggcacaucaagguuauguauugaggguuugaugaaaaugugaccagaggcucauaggaaccuguuuauuuuccuuaggggcagugguucaguguugcuaauucagugcuugagugggcuuuauagaaaauaacuaccucaaauaaugagaauagacucugcagucagaccuuuauaucuguggguuccacaucugcaaaucagccaaccucggaucaaaauauuugaaaaagaaaaaccaauaaaaauuaacugcaauuaaaaaaauacacauuaaaaaaccaaugcgguauaacaauuauuaacauaguauuuacacugcauuugguauuauaaguacucuagagaugguuuuuuuuuuuuuuuuuuuugagacggagucuugcucugucacccaggcuggagugcaguggcgcaguuucggcucacugcaagcucugccucccggguucacaccauucuccugccucagccuuccgaguagcugggacuacaggugcccaccaccacgccuggcuaauuuuuuuuuuuguauuuuuaguagcgacaggguuucuccguguuagccaggauggucucaaucuccugaccucgugaucugccugccucggccucccaaagugaggugguuuuaaguauacaggaggaugugcauggguuacaugcaaauaguaugccauuucauaagggauuugagcauccacagauuuugguaaccaugggaauucuggaaccaauccccugaagacaccaagagauaaauguacuucuuaaauuaagggauuauuuaaaauuaacaaugacauaaucuuuaaaugauuauuugagaucaagugauuaguaaauuuugggcaguugagaagaggaaggaaauuauuuacauguguacagaaaccaugaaagcuagagaagcaggaagcauguuuaguuaacauugcugccuaacaaagacgaagucuuuagauuuuuauauagacccuaggcauaucaaagaaaacuaaaucaugccuacaguuuccucccaaccaaaagagucuuucauuguccgggcacugggaaaaauaaggggacagacugggaaaaauaaggggacagauuacugaaaguauuugcuuuucuuaccauugaaugauagggcacaauuauuaguggagaagaaagaaaugauuucuagaauaaaccauuacuucuagauuuuuuuuuuuuugagacggagucuugcucuaccgcccaggcugaaaugaaguggugcaaucucagcucacugugaccucugccucccagguucaagugauucuugugccucagccucccaaguagcuggaauuacaggcacucaccaccacacccagcuaauuuuuguauuuuuaguagacgggauuuugccauguuggccaggcuggucuugaacucucaaccucaggugauccgcccaccuagaccucccaaagugcugggauuauagaugugagccaccgcaccuggccauuacuucuagauuguuaaugacaacaacauagaguuguauauagugagaagcacuguugcguaauuaauuucuuugccuucuuuauacuugauaacacucugaggccauagcauauauaauacuuuuaaacaaauauaauacuaaaauacuaaagcaaaggcucucauuggaccacuaauaccaguguuugugaucuggcucugugcaaugacacauggacuuauaguagacgguaauaugcugaagaaacucaugaaaaagucuuaaaugaucagcauauuuauuuauuuauuuauacauuguuucuuuuaaucaaaaaguauaugcacaugauuaagaaacaaaaauuucugaaagguccaauaauuaaaaauaaaugaauccuauccuacucaccccauucuucccagacacauucucuuuuuaacuauuauuucuuguuauuuacuuccauauuauuaaaaaguauacgaaauguugcuauuuccucauuuaucaguuuuagaucauauuuauuuucugccaugauauauggguuuauaccuguuucuugguccuuuauggucucaguauuguuauagcaccaucauguucuucggcucugguaauuuuucugcuuucuuuuacaauuuauucuguuuucucucuggaauccguuuuuuuuuuuuuuuuagaaauuggcacuccuggauuguucuguguuccuuuuuuuucauauuuuccuucucuuuuugugaauguuuuguuuuucuaucccuucuaugcuuuuuucauuucagcaaaucuuugaugcuuucuuauuuuuggauaauccuuuucuuugaaaauuagauucucuaccauacucuuuaauuuuaauguacauuagaguuuuguuuaaaaguuuucuuccauuguuugcauuauuucuguuuuccucuggagucauuuuauaugggugaguauguguguguuucuguucuugucuuuuucucugcuuggaggcuuucucuaaauaucaguguuuuugguugcgcucuguaguugagaaugagguaacaaacuguagguuaggaauucugugcauaaucaggcuuuugacuggagaccuucacuucagggcaguguuuuucaaccuuuuuuuauuaucauuaccugaagaagcauauuuagauauuuuuccccuaaucucugcuccuucaauaccaccgccccccacaaucccaugaagauuuaacacuacaagauauacucuauaucugauuauauacucugaaagauacaaaugccaggaagaguuuggaaaaggucauuccucggggccauucaacugcuauaucugcucucuccuaucuguagucauuuucuggggaaguggagaggagguagggagcugccaaccauuuauggacuuugaauuagucucccaauuuucaguacuguaucguaacuccugucaugacuuucccaaaaauuugugagucuugagccucaucuugcuuuaguggggcaaauuagcucuccuuuguccaugucucccucugugauacuaugaccuuauaacuuucucuacucugcuacuucaaucacaauuccaccauauguuuguauuccagaauuucaugaaaucucuaauuuuaauuuucaguaauaguuccuuggcaauuuuuuuaaaauuaaguaauuuauuuuuuaaauaauagagacagggucucacuguguuccccaggcugguuuugaacucugggcuuaagcaguccuccugccccagucucccaaagagcugggauuacaggugugagccaccacacccagcugguucuucucuaauucuauuuguugcacuaguuuaucuguuuucaaaucuuuaggugguguucauuuggggccucagaaacugaagagaggauaaacauuugucuucaauuuuccaucguaucuggacaccuguaauaagcuuuaaaaacaaacauuuucauauaugccuaguuuguauucuagucauauuugcucuauaaaauaacuuuuuguuuauuuuaaaauucuuagcaaugauuauauguucuacagagagcucauuaaagugaccuguucuuauuguuucuauccauuguaauacaucauguuuauauuguuucaaauucaacaaaauuuguagaggcaagauaauucuucucuuuuuuggcuccuagguguuaccagacagugauacugagguugguauuagaauuuauggaaaucucagagaacuuucuagagcaguauugcacaauaaaaucucagccgucagccacauguggcuauuuaacuuaauuaagauaaauucccuuccuuagucauacuggucacaugucauguguucaguaaccacauacagcuaguggcuaccauuucagacagugcagguuuccaucauugccagguucuacuagacagcauuguuuuaaaaaguagaaaguaggacaccauucuguaguucuccaggauugacuaguuucuuaagccucaggcuuuugcaggaguugcuuagucuaguaaauguauagggcuuuguuaaauagauaaugauguaaaaagaaaauaauuaacaucuugaaaguaugcuuugaagccuucaggagaaaguacaagucacaggacuagcuauugucuaaauuaguccaagagacagcuaagaaagcacugugcuaauugugugauaaucuuuuuuuguguugauucaaggaaacacuguagaagguugagagagucauaaaauguagcauguauguauacuguucucgcuguccuuaagaauguuacuagagucuuagcauaggcaacaaaaugaugcagauaaacuguuguuuugaguggguagauggauaagcuguuaccucauuuagaauauuuucuuuuuguacauguaguugauuauuugcgguauauuuaaguacagcauaccccguagaaauguggagcuggaaugggcuuuagaaauuaucaucguauccuuucauuuuacagguaugggaaacaaaugcuuaaaguagggaaauaauuuacucuagggcacacagucacugguggggagagccaacaccagaaccaacauauuuugagaacauuucccaugguacuguguuguugacaaggaaagaaggacuugguccauugucuuuccucaaaagcuuuaauaaucuagauguaaggaccaagcuggcaauauaaacuuaaaauuauuuuaagaguauguaacucuuggaacuauacauuucauaaugugucuuccucuuuuuagaacaacaauuuguaaucuuuacacgaugccacgaauuggagaaccugucuggcuuacaaugaugucggggacuccagaaaagaaccaccuuugcuaucguuucaugaaggaguucaccuuucuaauggaaaaugcuuccaaaaaucaguaugaauuuauuuauuauaacuagauaucuagauuguaaucaaacucaauuacagauguggaagaaucauccauuaucuuuggaauuauuuuauauuauuaaucaaaauuaauaaucagaauucuaaaaaauaauuaaaugauaggguauggaagaguauuacagaaccuuaugaaugaaaagcagugaaaaugucuguaauuauguaauuaaaauuccugacauauuguagaauuaucugaggcugcccauuuuuuugugaguuguauccauuuauaguuuuauuucauagaaaagagguagaaaacauuuaaggauggccaggcgugauggcucauaccuguaaccccagcacuuugggaggcugagguggguggaucacgaggucaggagaucgagacauccuggcuaacacggugaaacccugucucuacuaaaaauacaaaaacaaaauuagccgggcaugguggcgggugccuguagucccagcuacuugggaggcugagacgggagaauggcgugaauccaggaggcacagcuugcaguaaguggagauugcgccacugcacuguagccugggugacaaagcaagacuccgucucaaacaaacaaacaaaaaaaacauauaaggaaaugguaggauucuaaugaugcauuuucaaugugauguuuuaucguauuguauuauuuuaacuauucaagucuuuggaauccagaugaauaauucaguuguuuuuauucucuuugaugauagacagaguuugcuuaauacuuugccucguuuucccauucaguaauuuggaaauguaaggaccugcugguugauucaguaauuaauugugugauuaaacacugaaaauaauccauaauuuuugaaguaaaauggcauuucuguuuuguacuuacgaucugcaauagcucuuaugaauguguuaucuuuauuucaaguaguuuuuaacuccuccucaaccagaaacuauuaacuuucauuuuaaucuugguguuauauacucauccuuuccucucucuucuccuuuuuuuggugccauuuggccacaugaacauauauacuccccuugcuuacuuuuucacuacauuuuaccuaagguuucaugaagacugauuggaaucugaucagauguauuuuguuuucagauucuugccagcucucauuacugcaguucugaccaaucaucuugccuggguuccaacagucaugccaaauggacaaccaccuauaaaaauauuuuuagaaaagcauuccucucagaguguggacauguuggcaaagacucauccauauaacccacuuugggcacaacuggguauguaaucugacaacuguuacacuauguauuagacuuuuuuguagcuaucuguaauuauuuuauagcaaaaccaaaaauaaauaaaaugcuuuuaccuccugcauucuaaagcaucucugcuuugcuuguccuuucaugucugccaauuugucuuauccucgucuuagaccugaaaucauuccuuauagaugaagaacugcagguagagcaagaggagcaggcugauagcucguuuacuaguaacuucagaucuucaggauguuuuaugauuuuguacuuuguguuagguacuuugcaagaaagaauaaaucaacagucaccggugauaccuaaaaucaaucugguuaggagugaagcaauucacugagguuucuguugauccacuuuuguucacuugcugagucauuuuggaaaauguuucccucaguguuaagcaccacuaaacaagucggggaacagaggggagaguagaugguugauaaguucauagacaauagggagggauuguaccagggugcuaaagacacaggcuguggagucaggcacaccacauuugaaucacaguuuccuuauucauaaaguaggaauaauaguagaugauacauacuuuaaaaguuguaaaaauuaaaagagauaauacauguaaaaugguugagacugugucucguaaacguagcugcuaauuaccucugcuccuacucuguugcuuuuagaugaugggggaagaguaagaugagaacauuuuggugacuggguaguaacuuuccuuagguugcucugugauugagcuugccagguggauugucauauggcaauaugucauaugacauauaucaauucauauaaccaaccuccaucccuacuggcuuucucccuuguucccucccccauucccuuccauuuuauugaguuauaauugacauacaguaaaugcauuuuuuuaaugaagucucacucuuuugcccaggcugaagugcaguggcacgaucauggcucacugcagcuccaauuucccugggaucaaaugaucucccuaccuuagucacccaaguagcugggacuacaggcgcguaacaccacaccaggcuaguuuuuguauuuauuguagagaugggguuuugccauguucccccaggcuggucucaaacucccagacucaagcgaucugcucaucuuggccucccaaggugcugggauuacaagcaugagccaccacaccuggcccaacacauauuuaaaguacacaguuugggcuaggugcaguggcucaugccuguaauccuggcacuuugggaggcugagguggguggauuacuugaggucaggaguucgaaaccagccuggccaacauggugaaacccugccucuacugaaaauacaaaacaauggcugggugcaguggcucacgccuguaaucucagcacuuugggaggccgaggcaggcggaucaugagggcaggagaucgagaccauccuggcuuaacacggugaaaucgcaucucuacuagaaguacaaaaaauuagcugggcgugguggugggcgccagcuacucaagaggcugaggcaggagaauggugugaacccaggaggcggagcuugcagugagccgagaucaugccacugcacuccauccugggcaacagugcaagacucugucucaaaaaaaaaaaaaauuagcugggcgugguggcaggcgccuauaaucccagccacuuaggaggcugaggcaggagaaucccuugaaccuggaggcagagguugcaaugagccgagaucaugccacugcaccguagccugggugacagagcgagaaucugucucaaaaaaauaaagcaauuugauaaguuucgcauauaugccucugaaaccaucaccacaaucaaaaugguaaucauauugcaucacuuacaaaaguuuccuuaugccuuuuuguaaucucuuccuccuccuccuccuccccaucuccuucuccccaacuucucuguuccucuuccaccaucccuaggcagccacuggccuacuuucugucaugguagauuacuugcauuuucuagaguuuuauaugaauggaaucaugcaguauauacuuucuuugaucucauucauucaauauaauucagauucaccuauuuuguauguauuaaugguucauuccuuuuuaaugcugaguaguauuccauugcauggaccuuuuuaaaaucaaauuauuaguaguauuuuuuaaauugggacauuuaaauccuuuuuuaauucuacaaucauuuguugacugucuaggcucuguuuaaaaagcacagaggcuguaaagaugaaugauuuggaaauugcccucaagaagucgacagucuaagacuguagguaauauauaugcagacaacaaugauaauucaaggaggaacuauaagagaaaugaaaaguuuagugagaguucaacaggggagccuacuuuuguccaagugaggaugcuuaggugggaagcuauggacuggcagagauauugaggaaagggacaggacaucacaugaguaaagagucuagguguuaaaagugcagagcauauucagugguccaguuuaacuggggcuuugugcgaauaaggaugauuucuucuucugacugccaagaaggaggauaaguauaagaaaauaaagcuggaaaaguaaagugggaaucaugaaagacucacuugccaugccaaagcaauuucaacuuacuugguaauuugugggaauuaugggaguaguuuagaacaguggcauggugauauuugagccaguguguuagccagaagagaaaauuuaucauaauaguaucuauagcuuauauuuauuugagaccuauuuauauuuguuccuuuaaaaagugugagggcuuuguaaaguaaaaauagaggauuuuaaauguguauacugacaacuucaaaaauugaauuaaguugaaauuaauggcuuuguauucuccuuuuuuuuucuuucuuucuugagacagggucucacgcuauugcacaggcuggagugugguggugcgaucacagcucacugcagccucaacuuccugggcucaggugauucuuccgccucagccucucagguagcugggauuacaggugcgcgccaccaugcccagcuaauuuucuguauuuuuuuguagagacaaggguuucgccauguugcccaggcuggucuugaacuccugggcucaagugaucagccugcuuccaccuccccaaaugcugggauuacauguguaagccaccaugcccagcccuauucuccauaguuuuggcacugaaauuacugguuuaauuugaaguauagcauaaauauagaaaugcuaauuucuaguccugccccccucaccuccccugcuuuuaacauaauggcuagucauguuuagaauggauucaaaagugaaaaugaacugcauggcugaacuuguugcccuuucuuuuccuuuuaguaaggaugagucucucucuuccugcccuuucuggccuauccugaguacccaacccucuagggaauggaaggggaaaauaggcuuuuacaaacaugggagcuggugggguggggugcuggcuagaggaacaacaguuaaaguucagagauaugacuuacuuuuuuauuuuauuucuuuuuauuuuuuauuauuuuuauuuuuuugagacggagucuugcucuuguugcccaggcuggagugcaguggugucaucucggcucagugcacccucugccuccuggguucaaguaauucuccagccucagccucccaaguagcugggacuacaggugcccacgacaccaccuggcuaguuuuuguauuuuuaguagguacaggguuuuaccaucuuggccaggcuggucuugaacuccuggucucaagugauccacccaucucggccucucagagugcuggaauuacaagcgugagccacugugcccggccccagagauaugauuuaaaucaggaaugguuaaguguguggugugacgacuauagcuuugcuccauuuuaccacuacuccuuuccucuccuugcaagccaguggauauugugcuuugucuuuucuugauuggacacagcuacagaauccuuguguacauaguacuucaggcaguacuucucuaacaagguaaaaaugcucugcauggagccuggguuagagaauauucuugggauaugugaguuucagaacugacucuuugcuugagguuucugaaccauagcauuuguuuaaagaggaaaccagaaaacccuuaaauucaccuuucucucugguuaagauuauucaucucaucuuccucccuugaauagucacucaucuguuaaagaacuaagagugaggccaggcaugguggcucacgccuguaaucccagcacuuugggaggccagggccaguggauugcuugagcccaggagcucaagaccacccuaggaaacauggcaaaacucugucucuacaaaaaaaaaaaaauacaaaaaauuagccaggcaugguggcacgcgcuuauagucccagcuacucaggaggcugagguagcaggaucaccugagccuaggaggcugaggcugcagugaaccaugauuguaccacugcacuccagccaggauuacagugugagacccugucucaaaaaaaaaaaaaacaaaaaaacgaguaaaaccuaaacuauuacucauacaguaaaagaaguagguuucugaucauuaaaaauagcuuacuuagcugugucaguaaaggacauguccaauaacugauuuuuuccauuacaggagacuuguauggcgcuauuggcucucccguacgguuagcaaggacugugguaguuggcaaacgacaagacaugguccagaggcuacuuuauuuucuuacuuauuuuauaagaugcucugaacuucaagaaacgcaucuuuuagaaaauggagaagaugaagccaucguuaugccaggcacaguaauuacuaccacuuuagagaaaggugaaauagaagaaucagaguauguccuugucacaaugcauagaaacaaaagcaguuugcucuuuaaagagucagaagaaauuagaacucccaauuguaacuguaaauauugcagucauccacuccuugggcaaaauguagagaacauuucacaacaagagagagaagauauucaaaacagcucuaaggagcugcuaggaauuucagaugagugccagaugauuucuccuucugacugccaagaagaaaaugcuguugauguuaaacaguacagagauaaauuaagaacuugcuuugacgccaaguuagagacaguuguuugcacaggaucuguuccaguagacaaaugugcauugucagagucaggcuuagagucaacagaggaaacauggcagagugagaaguugcuggauucagacagucacacaggcaaagcaaugagauccacaggaaugguuguggaaaaaaaaccuccagauaagauugugccugcuucauuuucuugugaggcugcccagacaaagguuacuuuccugauuggggauucuaugucaccugauucagauacugagcuucgaagucaggcagugguggaucagauuaccagacaucacaccaaaccauugaaggaagaaagaggggcuauugaucagcaucaagaaacuaaacaaacaaccaaggaccaaucuggagagucugauacacagaacaugguuucugaagagcccugugaacuucccuguuggaaucauucagacccagaaagcaugagcuuauucgacgaauauuuuaaugaugauucaaucgaaaccaggacuauugaugauguuccauuuaaaacaaguacagauaguaaagaccauugcuguauguuagaguuuucaaaaauauuguguacaaaaaauaacaagcagaacaaugaauuuuguaaauguauagaaacaguuccccaagauucauguaaaaccugcuuuccucagcaggaccaaagagauacacucuccauucuugucccccauggggauaaagagaguucagauaaaaaaauugcuguaggaacugaaugggacauuccaagaaaugaaaguucagacagugcccuuggggauagugaaagugaagauacaggucaugauaugacuagacaaguuagcaguuauuauggaggagagcaagaagauugggcagaagaggaugagauaccuuuuccuggguaaguaggaaguuuucaccuauaaugggcccuauauaaauauguaccauucucuuuuuuagcuguucucugaagguuaguauaaaagagaucauuguucuggauagcucucuuguuuucauauucucuuaacucauaagaaggaguaaaggcuaagcuccagaaacacccuggaaagguuuuaugaagaccucaaauaaaaguuaaaggaucugguugauaaguauaagauuucuuacugcuuagaagguuucaagccauuuaggagugacuuaugccccccaaaggacauaugcugagccuggcaguuagggagcacuaaucccugagauguuagaauagcuguuagaaauagauuuggccaagacuaagaggaaaacagagaauguauacuuugggucaaguaugcaaggagaauauucaugcuugagaaacauuacauaccuagcuuuggacuugugaggcauuuaauuguuuuguuuuagaugauuguuuucauaaucugauuguauuaagaaugugcuacaaacacaagguacaauucucuuaaagucucuuaggaaagauugauccucacuucauuacucaguugcucaucagaccuucuucucugaauaagaaggaguauuuuauuuucugauagagcacuugagccaguuuuuaaauaacgaugauuuuacucuugauuuuacuauuauuaccauuuuacucuuaauuuuuacgauuguuaccauuauauaaggaugauuuuacacuugauuuuaauacagacuaguguaaaauauggacaaguagaauucacuuuuuuuuuuuuuuacugguuaaauauauuuauuacuaaauaaaugucuuuugggggcauuuuucuuccaggucaaaguuaaucgaagugagugcuguucagcccaacauugccaacuucgggagguccuugcuggguggcuacugcucaucuuaugugccugacuuuguucuucaaggaauugggagugaugagagguuccgucagugucugaugucagauuuaucucaugcugugcaggugagugaccuucacuguuuuugaguuuauuuagaagaaacucuguuaagcagcagaacccaaaauugccuuauauuuuuggucauacuuuuuacaacacaaucauuguucucugaauccaucauuuuauauucagugcccguaucuuuguaucugucacugugaaagcaaauaaaguuccagaaaucuauccacauggauaucugaaauacagaaaguacuuuauguauucauggauguccaucaacuagguuauuuauaguaucaaaaauuugcaagugcuuaaguuugaauggaauuauuuucuuaauuuccuuuucagauuacucauugcuuacauauagaagugggguuggcuuuuguguauugaucuuauauccuuuggucuuucugaaacucuuauuagucuauucauuuuucuguauagguucccuaagguuuucuacacacaggcucauguuaucagugaacagauaguuuuaaaucuuucuuaacaaucuggaugccuuuuguccccgcugcccccaacuuuuuuuuuuuuuuuugacucauuguacuggcuagaauuuucaauacaauguugcauggaaguggugaccauggacaucguugccuuauuccugaucuuaggggaaagacauugcaucuuucaugauuaaguauguuguuaguuguaagguuuuugugaugcccuuuauuagauggaagaaguucccuuuuuauuuuuauuuuguuuaaccgaauacuucuuuuagagacaggcaguucucuuuuauuccuaguuuugagacgguuugguuuuuuuuguccaucccuuaaucaugaaugagugugggauuuugucauaugcuuuuucucaaugucuauugagauuguauugucgugucauuuuucaucuuuaaacuauuaaugucauggauuucauuaauuaauuuuuagauguuaaaccaaccauuguauuccuaggaagcaauucccacucugucaugguauauaauuuuuuuuauguguugcuggauuugauuuaccaauauuuuauuauggacauuggagucuauauucaugagaaauauugcuuuuuaguuuucuugugaugucuuugucuagcucugauaucaggauaauauuggcacauccucuauuuucuggaagaguuuccagaagauuaguacuacuuuuuuucucuaaacguuugguagaacucacuagugaaaccaucugcauccaggcuuuuaagaauaagaauauuuuaaauugcuaauuuaauuucuucaccuuuuauacauuuagauuuucuauuuguuucugaguccauuuugguaauuuuugucuuuuaggaauuuauuaguugcauuuaaguggccuaauuuacuagaaucaaguuguuuauauuauacacuuacaauccuuuuaguuuuuauaagguugcuagugauguccccucuuuuguuccugaauuuuguaauguguguuuuuguuuguuuguuuuucaaauggugagggcuucuccaaagagaaguucauucgugguuucacuuaaauuguauauauuuuuugcccauauacaucaaggauuagcaagcuauggacagugggccaaauuguccugcuuuuuauagaugaaguuuuauuagaacacaaccacagucauucauuuauaugcuucuggcuauguucaugccuaacagcagaguugaguuauugagacagagacuuuucagcccccaaaccuaaaauauuuccuguuuguucuuauuuuauuuuauuucauuuuucuugagacagagucuagcucuguuacccaggcuggaguacaguggugccaucucagcuuacaguaacuucugccucccagguucaagugauucucuugccucagccucuggaguagcugggauuacaggugcccaccaccacaccugccuaauuuuuguauuuuuaguagagaugagguuucaccauguuggccagguuggucuggaacuccgaccucaggugauccacccaccucagccucccaaagugcugggauuauaggcgugagccaccgcaccuggccaaaucugacaaauuucgaucuguuguauuuucaguuucauucauuucaaaauguuuuuacauuuugcuuguaauuucuuugacuuaugaguuauuuagaaguaugcuguuuaauuuacaaauauuuauggaauucucaaaaguuguuuugcuguugguuucuaauuuaauuccauuaugguuggagaaccuacuuuguucaccucuuguaaauuuauugagacuguuuuauggcacuugaaaagaauauauauucugcuuuuguugaaauguucuauagcuaucaggucaaguuagauaaccuuuagauaauagucuuaauuaagucuuuuauguccgugcugauuuucaguuuguuucugccaucaauuauugagaaugaaguauugaagucuucagcuauuguuugguugaauuuucuauuucucccuucaauuguacauaucacuuuaauacuuugcuuuaauaacaaaaucuggccaccucucaauuuaaaaaguuaauaaagaaauagagaggcccggaaugguggcucacgccuauaaucccagcacuuugggaggccgagguggguggauuacuugaggucaguaguuugugaccacccuggccaacauggugaaacccugccucuacaaaaauacaaagauuagcugggugugguggcaugugccuguaaucccagcugcuugggaggcugaggcaggagaaucacuugaauccaggagguagagguugcagugagccgagaucacgccacugcacuccagccugggcaacagagcaagacaaccauuucaaaacaaacaaacaaacaaacaaacaaacaaaaaaacagaagugaagaaagccaagugggaaauuauggaugagaaaauguggcuuagugagcaacagucaauuguuagccaauaagguuuaaaccuucugugucuguagaaaguuaccuaaguuguaaaguuugguguuuuauuguauaguagagaaauuauggcaaauauagauaaaaacaauuugugagaaaaacuuaucagaacuugugaucuucauauuuaaaggcuaguuugcccagcuuuugaauaccaaucaaauaaauauuuauugaccuacuguguucugaauauagugccaguacuccaagggauauauguaugaaaaagaaaaaguuucugacuucaaguuuuuaacuuagcaacagagaaaauaaggccaaguguaugaauaaauguaguauaaaacauaacaaaaguagugccugaggaagauacuugaauguauuauugcuucaaaggacagauuuuuuauuaguuggugguauggaugcccuucaggguaaaggaaccguuucuaguuuuuucaaugcuucccucccaauaccugaugaagugccuauuauuuguugaauuacuugguuaaggaauuguauaugaguucuucuaaugcacucugugucuucuaaugcauucuuaucuuucuuuaugucugauccuaguugcuuagucucuuuucuucuuucaucuguacccaucgccaaacacaguaucuugugacuuucucugugaaagccuggcguuggaaaacauugcugucuccugcugaagauaaagacaacauuuugauuuuaaggguuucuuccugcuauuauaggaugaauaauaauaauaguauuuaguuuuuauuguugccuuacugugucccaggcacuuaaguguacuauuucacuuaaucuuauaauaauccuuugagguacuuauuauuguuaucuuuguguuucagauauggcucagagaaguuuuuaaguuacauagauggggaauggcaaaacuagaauucaguucuuaacugccuguucuuaagcugcuaugccauacuguuacuaaaacugaugaacaaagaguaauacaaauagcaaaaucaccauuacaaaguuauaagacuuuuauauuaguggucccaggucuguugcucuuggauuccuuccacuaugguaaaaaggaaggagcuauuugucuuucccccucuguuuuaguaauuggguuucuagucuuuccuucucauauuuucauuuagucauguaaguauacuaucaaagcacuauuauagaaaaauuugacaaaaagaaaaauaaaauaccuucaaucucagcacugacaaguuguugaacuuuguuaucaaucauuuuuccaaagcauguauaggauuucuaaaaaaauuauuuggccaggcacgguggcucacagcuguaaucucagcacuuugggaggccgagguaggcagaucaugaggucaggaaaucaagaccauccuggcuaacacagugaaaccucaucucugcuaaaaauacaaaaauuuagccaggcauggugguggagcuacuacggaggcugaggcaggagaauggccugaacccaggaggcggagcuugcagugaggugagaucacgccacugcacuccagccugggcgacagagcgagacuccgucucaaaaaaaaaaaaaaaaaaaaguauuauuuuaggccaagcgcuguggcucacgccuguaaucccagcacuuugggaggccaaggugggcagaucaugaggucaagaguucgagaccagucuggccaacauagugaaaccccgucucugcuaaaaauacaaaaaauuagcugggugugguggugggcaucuguaaucccagcuacucgggaggcugaggcaggacaaucgcuugaaccugggaggcagagguugcugugagcugagauuucaccauugcacuccaggccaggugacagugagacuccaucucaaaaaaaaaaaaaaaccuaucuauauauauauauauuuuuuaauccuugcauacuuaaaguuuaucauauuuaacaugaaauuuuuuuaugugacuacauggaaaaacauguaggaaccuuuuaauauauaaauaauggaagugauacuuuaaaaaaauacagucuucugaauuauaagaggagagugucuuuucuuuuucucccugauuuuuaauaaaguagcauuuuucuuaauauauauuuauuauacaaaauguugaaaugugaagaaagccaaacacaaauuuuccuaacucuaccaucagcuauucuuauacagaaacuuccuccaggcauuaggcagcauuguggcuucucauaaaacccagaauuggccacuuauugccgguauaucauaagacagaauacuuacucuaggaaagccucaguuucuuuggcuauaaugaaaguaauacugauguuuguuuaccagacuuacacuguguggugauauuagucacacugugcuuugcaucuucuuguuaugauuauuauucuguauguauguguauuuauauaucauauauaugucugaagccuuauauauaaaaugauaugcuuguguauaucuguguaaauacacaauauuuacacagauaaauacacaagcauaucauuuuauauauaaauacacagauauacacaagcauaucuuuuuauauauaaguauauauuuuuauauagcugaguccuuauauauaaaauauaugcauguauauguauuuauauauacccauauuuuuauacucuuuaugauuuuauauuaucuguuuuaaauucugcuuuuguuacauaauaguuaauguaagaauauuuccccauacuaacauaguguguaaacauuauuuuuaauguauauggauuauugcaugguuuugucauaguuuauguuucucaccauucuccuauugcucuuuuuuuuuuuuuuuuuuuuugagacagggucuugcucugucauccagguuagagugcaguggcacgaacauggcuuacuggagccuugaacuccugggcucaagcaaucucccaucucagcuugcccaguagcugggacuguaggcacaugccagcaugccuggcuaauguguuuauuuuuugugaagauggggucucgcuguauuauccaggcuggucucgaacucuggagccucaagugauccucccaccucggccucccaaaaaucuuguucuaaagagaaagccaaguuucaccuuugcauuaguguauuaguaacauuaaacccaauucuuaauaaaaccuuauaaacaaacugauucaaucuuaguuuaaccauaagguaaaauuuuaauaaaccuuuuuuaaucuuuuauaauuuucuguuaagcaguagaucaauucacuaagaaaaccauguuauucagacaugugagcccagauuuuggcccugcauuagugugcucuuauuucaguguucaacauacagaaaaauuaaauaauccccuucaaaucuuagcaaacuugcuuauaccuacagaacuuccuuuaugagaucaacccuucacaaacccucuacaccuugcuuaaaccuucaguuuugucccauuacucuuuuagguuaagacaauuguuaaaacccucugagcuagacaaaauuucauucccuuuaacaaaaaccauauucccaugccuucuuauagccucccaucaaaaccacauucuuuuuuccuucuacaccuuguauauaaaacuguuuuuccaguagucucaagugcaugcugcacuguuaacuuuuagcaaauuuuauuuuuggugagaaaccuaguaaacaagcaauuuuaaccauguauaauauugcagaacccaugacuuuucccagccuagccaggggaccugccuaacuccauaugucuccaggccuuaccuagaaucuauuggcuguagaacagacaaacaauuaguaaaagucacagaagcaguuuaucaccuuaaagcauccagcaaacaguguuugaccugccaaauuuagacuaaauauauaaacuuugaagacauuuucauuuuacuuuaccaauaaucuucuuuuuuauuuacaaaaagauuauuagagucaugagaccuacagggauuaaaguuuccauuuuucugacaauguuugauucaagcgcuuauuuuucuuuaagccaauuaauuggagcuguauauauaaacaucacacacaugacacauauaaauacacagaaacagagaaucaagaaaaaauuccauugacugagaagcuuuugaagggaaggcuggagcuuucaaacaauaucuguauauauagcccaaauaucagcuauuuaauuaagucgauuucuaacuguggagcucucaagagaaaaauucuuuuaaaaucuuuuauuaccagauuucagugaggacaaacucugacuucugaauccuuuuacuagagguaaccuucuaugugaaaucaauaagccuuaacuaaggggaugacuuaaacagggauguaggaggugucuccaaagagaugguaaaugauuuauaagaucuagaauauccccaggccagccgcgguggcucacaccuguaaucccagcacuuugggaggccgaggcagguggaucaccugaggucaggaguucaagaccagccuuaccaacauggcaaaaccccgucuccacuaaaaauauaaaaaguagccaucaggcacaauggcgcaugccuguaaucccagcuacucaggaggcugaggcaggagaaccgcuugaaccugggaagccaagguuguggugagccaagaucgugccacuguacuccagccugggugacagagugagacaccaucucaaaaaaaaaaaaaaaaaaaaaaaaucuagaauaucuccaaagguaguucagagaaaagaaaauucaagauaagaaaugagaagcugugcauggaagggaaaagaaucaauaaauggcaaaaguuccacaaguauuaaaccaaaaaggacuugcucccaaagccuggaauugaacccaagccacccaccacugugggagggcaaagccuuugcaacugaccuacaguacaaggugacugcuguugucuuucccagaaggagucuagagcauuuucaagcuugcaaaggacuucaacugcucaagagaauuuucuaagacuaaccaugucauuauuaugcaucuuucuuuuaauuuaaccuuuuucuuucaaugagguagucaguuccaauagugacacaaucuaagaagccuauuaaaguuuagaugauaauuuuccaguuuuuuuuuuccuuucuuuuuacauuagaagcaaaagguaucuaggguagaagaggcaucuccaugauccccaagaauucacucucagaaaugggcuuaagauagcaaaagaugacaaaugcccuauagagaugggaccuuuucagacaaaacucacccaagggcuugacacauuugggaugaagaaugugcugacucaucucagacucccagcccuuucggauugggugccugacaugaacuugaaaauuccuguucucuggaugguggagaccaagagagaguauccccacauggucacaaagucaugcucucaaggauguaaaacaagauuagagggaagccucauuuaguuuuuguuucagggacccacagcaaaguuuauaacugacccaucgaaaaguacaccagaaucacuacagccucagauuagccucucacagauccuuuuucuuauuaauaaacagugauuuuuaccauucacuuaucuaauuugcacagagagagagaggccagaagccucacugguaagaaauucuuaccuuuuguuggcacggcagguuucugauuucccuuucccucagcugcccuggcgauguugcucaccgcaccauagucacaaaggaaaauuacuuuuguguguuucauugaaccauaggcaaaaaccucucaacuuuguaagaugucacccaauaggcugugugggggagcgagggagaggggcgagagaccaucaaauuaacauucuuuaucucagcuuggugaagcacacauaacaaaacagacacuagucacuuugcucagcaccuaauacugacuuaucaaggcucaaucuuuuucuagugugccccugucaucuuugauccccucaagguagggagggaugaccucugacugggaauucacugggugaugucuggacaacaugaagagcagacagucaccccaggucaaaccuguugaacuuccuuuacugcucagcaaaugugaccaaauaagguucuccgaguuaggucugcuggacuuccaucaccaauuccuuuagagauccccucuagauguacaaacacacacacacacacacacacacacacacacaaaacaaagacaagacggacagaaggucucccaaagcaagaucccugagcaagaauucuaagaguaugcuucuauucucugagaaaccucccugaaaucuuccugauugaggagaagucuccccaaccaagacucuuccuacugauuagggagagccaauugaaaccgccaaaggggccaaacuuagaucccuuaagaagccaaaccagucaggagaaggaaggaggcauuggcaccaccuagaauacccaccagaccaguuuagagaugucuuuacaggaacaauuucucuacugcaauugaauccaugcaccaugggucagcaguguguugcugguagagauagugccagcgucagcccccaguccaagagaacuacgcagccacuugggcuggccucuggaucuauugccggugggggacuaccacaccgugggcagguagccacaagggugaucccagaugagcccccaaauuuguaacugcccagggguucuuccugcccacugcauaaagacuaugguauuguaguagagaaaaaguucaauagacacaaggccagccaccccacaugggagauggaguucauacucaaaucaucuccuucaaagcuuguagguuagggauuuuuaaaaggcaguuuggggaaaggggugcgguggccagguaacaggugcuuacggcugauuuguuggggcagaaauaacaucauaggggguugaagcuauccuacuggggccaaaucgcuucuggauggggcuacaggaguggguugucaguccagguggagccaagggugucagacaugcaaaaaaccuggaaagauaucucaaaaugccagugcacaauagugguguuauuugcaguugggaaaguuucauuucuuauaaucuccagaauaaugucugugccuuagcagaacucaaacuccucuccuacuuucagccugauggcuuccuuuuagcuuuacaaaagcaguugaguuuugggcaaggccuauuaucauuuaaacuguagccuggaccaccaagacuguguccacccugcaagcacagagccucacccucaccacucugccgcccauccacaccugccaccaguucaccauggauaaugauauugcugugcuugucgucgacaauggcucuggcauguggaaggucugcuucacgggcaacgaugcccccgggccgucuuccccuccauaauggggcacccgaggcaccagggugugaugaugggcaugggucggaaggacuucuaugugagcaacaaggcccagagcaagagagguaucaugacccugaaguaccccauggagcauggcaucaucaccaacugggaugacauggagaagaucuggcaccacaccuucuacaaugagcugcauguggcucccaaggagcaccguaugcugcugacugaggucccccugaauccaaggccaaccacaagaagaugacucagaucauguuugagaccuucaacaccccagccguguauauggccauccaggccauguugucccuguacaccuauggcuguaccacuggcauugugauggacuccagcgauggagucacccacacagugcccaucuacgaggguuacgcccucccccgugccauccugugucuggacguggcuggccgggaccuuacuaacuaccucaugaagauccucaccgagcacagcuacagcuuuaccaccauggccgagcgggaaaucgugugugacaucaaggagaagcuauacuaugucacccuggacuuugagcaggagauggccacagcggccuccagcuccucccuggagaagagcuaugagcuguccgauggccaggucaucaccauuggcaaugagcuauccugcugcccugaggcgcucuuccagccuuccuuccugagcauggaauccugugacauccacaaaacuaccuucaacuccaucaugaaaugugacauggacauccgcaaagaccuguacaccaacacaguguuguuuggcggcaacaacauguacccuggcauugcgaacagggugcagaagaucgucacucugguguggaugggcagcuccauccuggccuugcuguccaccuuccagcagaugugggucagcaagccaggaguaugaugagucuggccucuccaucguccaucgcaaaugcuucuaggcggacuguuacuuagucgcguuucacccuuucuugacaaaaccuaacuugugcagaaaacaagaugagauuagcauggcuuuauuuguuuuuuuguuuuugguggugauuuuuuuuuuuuuuuuuuuuuuuuuuuuuggcuagacccaggauuuaaaaacugggacagugaaggugacagcagucagcuggagcaagcaucccccaaaguucugcaauguggccgaggacuuugauuguacauuguucuuuuuucuaauagucauuccaaauaucgugaaaugcauugcuacaggaagucccuugccccccugaaagccaccccauuucucucuaaggagaauggcccaguccucucccaaguccacacagggaaggugauagcauugcuuucauguaaauuauauaaugcaaaauuuuuuaaucuucaccuuaauacuuuuuuauuuuguuuuacuuugaaugaucagccuuuguggccccccuuuugucccccaacuugagauguaugaaggcuuuuggucacccuuggaguggguagaggcagccagggcuuaccuguacacugacuugagaccaguugaauaaaauugcacaccuuaaaaaaaaacaaaaagcuguagccuaaaugucuuccgaaguuagcuuggccccauaccccaggaauaauuaagggaaaggccaaaauggguuuuggguuagcuuaguucacuguuauaauguucucacuaauauaacuuuugcaaaggcgguuucaguaucauagaagggcccaugugguaaaagaaauaaaaaucagucuugaauaauaugaacccuucugcuagauugucuaacgucaauuuguuuuuuggccuugcugcuucuacgucuuguuccucauugucuggcacuaguuuggaagcacucgucucuaucgaguugucuuuuguucauuccucugguauggugucuguuagcucuugaauuucugcaagauccauaucuuuuuuuuuuuuuuuuuuugagauggagucuugcucuguugcccaggcuggagugcaguggcgugaucuuggcucacugcaggcuccgccucccagguucaugccauucgccugccucagccuccccagcagcugggacuacaggcacacacugccacacccggcuaauuuuuuuguauuuuuaguagagacaggguuucaccauguuagccacgauggucucaaucuccugaccuugugauccgccugccucggccucccaaaguugcaagauccguaucuugaaagccuucacccaccguuuuuuuuuuuuuuuuuuuuuugccuuauuuucaagcucuuucaucauuuccuugaugggcucuguuguuaaguucugugugcaacaucuggacacaguuuucuccagcuggaaguuauuguuucaggcuugauggcuuucauggcuuuuucuguaacagcaauggcaucuucuauggcgugauucuucggacugucaugauauucucuccacugggguucuuuuccauagcacugacaaucauuuuuauagaauauuguguuuaaugguccuuauggcacccugaucuagaggcugaguuagagauguguuuaggggcaauuagacuacuucaacacuugcaguguuaaacucauaggguucuggguggccaggggcauuguccaacauaagaacuuuaaaaggcagucacuuacuggcaagguacuucuugauuuuagaaauaaagcauggguggggccaggcgugguggcucacgccuguaaucccagcaccuuaggaggcugagguguguggaucaugaggucaggaguucgagaccagccuggccaacauagugaaaacccgucucuacuaaaaauacacaaaugagccaggcaugguggcaggugccuguagucccagcuacuugagagucugagucaggagaagcacucgaaccugggaguuggagguugcagugagcugucugggcaacccagcgagacucugucucaaaaaaaaaaaaaaaaaaaaaaaaggcauggguggauucaauccagaaaaagaguuuuuguuuuucaggcuuucuuguucuacuaucagaagacuagcagggcugguguuuaucuuuuuuccuucaagguccagagguuagcagcucuuuauauaaggguaguucugaucuuaaucaugacugcauuuacacaaaacaguggaguuagcuuaucccuuccugccuuaaaucucggugcuugcuccuguuccuuacuaauaaauguacuuuguggcaucuuuuuccauaauaggauucuuucaucagcaauaaaaaccuguucaggcagauaccuuuuguccucuaugauuuucuugaugguguccaagaacuuguguauugccucuuggucagcaaaagcuguuaucuugauauuuuuuaagcuaaaacucuuucuaaaauuaucaaaccauacuuuccuagcguuaaauucuccagcuuuagauccuuuacccuccuuuugcuuuaaguugucauauaaugacuucaucuaaaaaauaauauuagagucuuuaguuagagcuuucuuacagcaacccuguacccacauaagagcugcauuuucauuaugagauuuaaaagguauucugcaaaaguaccugguuuucacaccuaguggcauugcugcaaugacagcuucacaaauuuccuuuucuuauuuuacaacuguccucaugguggauucauugaucuugaaaugauggguaaccacagcuacuuaaucuaugguccauaucaagccauucaaguuuuucuuguaauaucuuaacuucucucuacuuuucuugagagcauuuccagcaucacuagugguacuccauguggaucccaugauguuauucaggguuugcuguaucacacuaaccaugauggaaaauacaugagaaccuuuaaacaccaguuuuguuaucuuuuuggcuuuuuguuuuauuagagacagagucuuacucugucacccagacuggagugcaauggugcagucauagcucacugcagccucaaacaccugggcuuaagggauccuccugccuuagccucccaaaagagauuaguuuuuuuuuuguuuuguuuuguuuuguuguuuuuugagauggagucuugcucugucacccaggcuggagugcagugacgcaaucuugguucacugcaagcuccaccucccggguucacgccauucuccugcgucagccucuggaguagcugggauugcaggcgccugccaccaugccuaacuaauuuuuuuuuuuuuuuuguauuuuuaguagagacgagguuucacuguguuagccaggauggccucgaaaagagauuaguuuuuaacugagauaugcuguuuauuggagagcggaacugcuccugcagagaugauuaaguuggcaggguguuugaaguacauacuugcaacacuugagcucugggcaauagcaacaggaaguagcuacaaaacuauuauaguagugcaguagguacuacagcuaguuuuaugcaguuaugauuuaauacuauacauuuguuaacauuucucugggcugugaaugucaccuuguaugccuuguaaguguguaaguuuuuauaaauuuuaacuucuuauaguagauuuguauuuuauaguaguaaaugauaaaauauacuaccuacauuuuuuuguuuguuuguuuguuuugagaugggucuuacuauguugcucagguuagucucucgaacuacugggcucaauugauccucucgccucugccuccccaguagcugggauuacaaaugcacacuacuguggcaugcauccacauauauuuuauguauucaugacaugccuaacuuuucuuauuuuccguauuucuaggcuacacgguuuugucuaaguuuuucaaauuguugcaaauuuccaaaaacuuuacccauauauuauauuggaaaaaauuggcaucuaaguggaccuguaguucaaacccauguuguuggucagcugaauauauuucacaauaucacagauguauauaucuuugccaaaauuauauuuccauaauuaagugaugaauaacaaagugauuuaucccuggcaagagaugaauaaauauuugaauacuguuuuauaaaaaacaaauauaaauuuggggcuccauggaaaaucuucccaagguauauuuuuggacuuuuccuuugccauucucuucuuauuucucaauaucauuucucacaaauguagccauuugcaucuacuucuauuucugauucuuacucuuaccgaauuauccauguucuucucccauuuuuuucaccaguaguccuaucuauacacuucaaugucauaguccuaugucccuuucacugcgaaacucccuaucacacagaucccacgauugcccuccucuacuucccagcacuugguuucugcuucaucaguaacacauuuuuuuuaaagcuagauguauuuauuuugaucucccucacaagucuaugaguucuguugucuuuguuucuuuaguuuccaggaaagagcuuuauucagaguaguuguucauuaacuaggcaaaggaauaucauuugaggaugccaaaccugggcuuauccaggaguaaacuuuuguccuuauugugguaccuuauccuaauuguaguaacauuaaaaguuagagaggaaaagccauuggucucaguauuucauauuauaguuuuaaucucagucuuguugcugcuauuccauuuggccaguaguaaaaaaaaauccuuaccuuuccaaauacagaaaaauauuaaagguagggucacuaucuguuucuggcagacaugcucuguacuuaauugucauuuuuggucuuuguuuguaaaccgggggaagguaaggacauagccauaugccuuguggcucuuucaugacuauguauauaugagucaaaauauuauuuuucacugucuuaacauuuuuaacaaugaaaguaaaugcuugugauaaaaauucaaacaauaagggcugggugcaguggcucacgccuguaaucccagcacuuugggaggccaagguagguggauugcgaggucaggaguucgagaccagccugaccuacauggugaaacccugucucuacuaaaaguacaaaaauuagccgggcgugguggcacacaccuguaaucccagcuacgcaggaggcugaggcaggagaaucacuugaacccgggagguggagguugcagugagcugagaucacgccacuguacuccagccuaggcuggugacagagugagacugucugaaaaaaauaaauaaaaauuuaaaaguucaaacaguauaaagauauacagaguaaaaaguagaaguccuucauacucuuaacguucuugcuucacagagaucuucaauacuucauacuugauuugaguauuuucuuucuuuuuucuauacacuuucauuuagauguagaucugaauuuuuagaaacauaacuguauguauagugacuuuuuuuuuuuuugagacggaauuucgcucuuguugcccaggcuagagugcaauggcacgaucucagcucacugcaaccucugccucccggguucaagccauucuccugccucagccucccaaguagcugggauuacaggcaucugccaccaugcccggcuaauuuuuuguauuuuuaguagaguugggguuucaccauauuggccagguuggucucaaacuccugaccuuaggugaucgguccaccuuggccucccaaagugccugcauuauaggcgugaacuaccacgcccagccugaauuuuuuuuuuuucacuuaacaaugugucuuggagaacccuguuaguauauuuugaugugucccauuuuuaacugcuguauucauacucuggacagaugucuuagucaaacagaaaaaucuaauucauguaggcagcaaagcacuucaugacaucaaggaauaccuucucuggugcugagggauauuaaugccugacauauugggauaguuagcacagaaucuuaccauugacuuauuugugugaauaagucuuguuucuuuguuguuguuguuguuuguguuuuuuuuaagacagggucuuacucuuugacccacacuggagggcuguggcacaguuuuagaucacugcaaucuugaauucuuggguucaagcaaucaucccaccucagccuccuaaguagcugggaucacaggugcaugccaccauuccuggcugauuuuuuagauuuuuuuguagagacgaggucuggcuauguugcucaggcuagucucaagcuccuggccuuaagcaguccucccaccucagccucccagugugcugggauuauauagaugugaaccaugucaucuguccuguccuguccuguucuguuuuuaaaauguuugucucaggccaggugcagugucucacgccuguaaucccaaaacuuugggaggccgagguggguggaucacaagguuaggagaucgagaccauggugaaaccccaucucuacuaaaauacaaaaaauuagucaggcgugguggcgugugccuguagucccagcuacuugggaggcugaggcaggggaauggcuugaaccugggaggcggagguugcagugagcugagauugcaccacugcacuccagccuggcuacagagcaagacucugucugaaaauaaaauaaaauaaaauguuugucucuuucaggguaaaaaaacauuuucuuucaauugccuggcacauaguagacacuuaauacauuugucaaauuaaugaaugaucaaaagacuguugaaaguuaaguucuggacuaaauaauacaaaguccuuguaaugaauacaaagucucaaucuacgaugauaucuauaauaugucucaggguauuuguuaaugaguuaauuauucuucuuggucaaggagauauugaaauauugaaguuuaauuuuuuuuucuguuuuuguuuaguaaaccuucauugcugaauuaccauuaucuuuggaaacuucauuugcuaaacauaagaugaauuauucuuuuauuuccagcauccaguuuuggaugaaccaauagcagaagcugucuguauuauagcugacauggauaaauggacuguucaaguggccaguagccagagacgagugacagauaauaaauugggaaaggaaguauugguuuccagucuuguuuccaaucugcuucauuccacacuucagcuuuauaagcauaacuugucuccaaauuuuguaaguauguguaacacugcuugcauuacuuuaagcacugcuuaaagcuuucaucauuguuuuuucugaaaaaaagcuguuagggacugaauguuugugucauuacccgaacucauauauugaagcccuaauucccagugugacaguauuuggagauaggaucuuugggagguaucuaagguaagauuagaucuugaggguggggugcucugaugguauuaguggccuaagaagaugaggaagagaaagauuguucugucuccaccaugugaggacacagugagaaaacagcugucugccagcaggaagagagcccuuaccagaacccaaccaugcuugcaccuuggucuuggauuuguagcuuccagaacugugagaaaauaaauaucugggguuuuuuguuuguuugagacagugucuuaaucccaucaccuggguuggagcacaguggugcagucuuggcucacugcagccucaacuucuugggcucaggugauccuccugccuuagccugcugaguaggaggaacuacaggcacgugcuaccacaccugacuaauauuuuguauuuuuuuaguagagauggcauuuugccccauugcccagacuggucucagacuucugggcucaaguguuccuccugccccagccucccaaagugcugagauuacaggcaugagccaccauucccagcuauauaucuguuuuuuuuuuuuaauccauccagucuaugauacuuuguuauggcagcccaagcuaagacagaagggguuguguacaugucuguauguucugauuucagcagccagaauuuuugaucauguguaguauagucaugcaacaucucccagcuuuguguagaaugccaguacauucuggauccucauugucaugucaggacuuuuauugaucucuuuauaauacugguaaccucuuucuaaagaucccauuuccaacuuucaagguucuuucuuucacuuauuaggagaacuauaacauaccauaguuaaaaagcucuguaguucaagaugauaaaggauaucuaugacaaacccauagccaacaucacacuaagugguggaagacugaaaguauuucucuaagauuaggaaaaagacaauaagacccacuuucccuacuucuguucaacaugcuacugagaguuuuagccagagcaaucaggcaagaaaaauacaaaagacuucaagauuggaaaagaggaaauaaaauuaucucuguuugcagaugacaugaucuucucguacauagaaaacauaaagaucccacagaaaacugguagagcuaauaagcaaauuaagcagauuugcauaauacaaaacccauaaaaauaaguugcauuucuauauacuuauucgaacaaugaacacucugaaaagaaaauuaagaaaacaauuccacuuacaauagcaccaaaaagaauaaauuacuuaggaacaaauuuagggagacaaaagacucccuuguacacuauaagguauaaaacauuauugauagaaauuaaggacauauauaaaugaaagcacuucccaugcucauggauugaaagacuuaauauuauuaggauaucauuacuacucaaaguuaucuacagauugaauguaaucccuaucaaaauccaauugauauuuuuugcagaaauagaaaaacccaucuuaaaauacauuaagaaucucaagagaccccaaagagauaaaacaaucuugaaaaacaacaguguugguagauuucacauuucuugauuucaaaacuuauuacaaagcuacaguaaucaaaacauugugcuacuggcauaaggacagguauauagaccaauggaauagaauggagauccuaaaaguuaacccucacauauaaguuuaguugauuuucaacaaaagugccaagaccauucaacagggaaaggagucuuuucaacaaaagaugcugggaaaacuggauagccacauacaaaagaauuaugccacguacagaaaugaacuccaaauggaucaaagauuuaagagcuaaaacuauaaaacuuacaagaaaaccuaggggauaaucuuugugacauuggauaugacagugacuucuugaauuugaaaccaaaagcauagguaacaaaaguaaaaaaauagauaaauuggauuucaucaaauuaaaaacuuuuguuuauuagcuaucaacagagugaaaagacaaccuauaaaauagaaaauauuugcaaaucauauaucucaaaagggauugauacucagaauauauaaauaacuccuacaacucaacaggaaaaaaauaauugaauuaaaaaauggcaaaggacuugaauagacguuuugccaaagaaaauauacaaauggccaauaagcacaugaaaauaugcucaacaucauuagucauuagggaaaugcuaauaaaaccacagugagcugccauucaauaccuguaaggaugacuaugauaaaaagaauccacaaaaaauaguaaguauugaccaagauguggugaccuuggaacccucaugcauuguugaugguaauguaaaauggugcuggagccguggaaaaguuuggcuguuccucaaaaaguuuaacauuguauauuaccauaugaucuauuaauuccacuucugcguuuauacucaaaacaauuaaaagcagggauucaggcaguauauacucuuguucauagaaacauuauucucaaucgccaaacguuagaaauaacccaagcauccaucagcaaaugaauggauaaacaaaaugugguauaauauauacaaugcaauauuuauucagccaugaaaaggacugaaauucuaauacaugcuacaacauggaugaaccucauaagcauuaugcuaagugaaauaaacuagacacaaaaggacaaauauuguaugauuccacuuauaugagguaccacaaauaggcagauucauagagacugaaucuaaaauagugguuaccaggggcugcggguaagaagagaauaaggaguuauuguuuaaugaguacagaguuuuuguuugagaugaugagcacagaguuuuugagaugauaaaauguucuggaaauggaugguggugaugguugcacaacaucgaaugcucuuaggacuauauaauuauauacuguaaaguggucaauauaguaaauuauauuacauauuuuauaucuacauauauucugcaguuaaaauuuucuuauggcauuaucagccuaaagcauugugaaaaaacauacacuauaaaaccacaaccauuugguuguguuuuacaauaauaaaguagauuuuuauuaggagcuuuuaauaacugauuuucauuggaaaggaacacucuguaugaauuuaauguuuagcaccugaaacuucuguuuuuuccucaaacauguuuagcaucaauucacaugauaaaucaccuauuuuaguaaauugagcaaguuaauugacauuaaacaaaauguauguguuucagguuuuuuuuuuuuuguaacuuuugucacccaggcugaauugcaguaguaaucauggcucaaugcacccucaaaaccccugggcucaaguagcuaagacuacaggcacgugccaccaugcucggcuaauucuuuuuuuuuuuuuuuuuuuuuaauuuuuguagagacagagucucacuguguugcccaggcugaucucgaacuccuggccucagaugauccuccugccuccaccucccagaauguugcgauuacaaguaugagccaccaugcccagauguguuuuaauuuucagucuuucagcuuagaaauuggggaaccacauagcauucuuugugaacuuuugcaaacuguuuuuuauucuccacaggagaauacauccuuuccuauguaaauacauuugaaaaguauuaauuuauaaaaauuuuauauuuaucaaauuugaaauaaaaacauagugaaaaaaguuuuggaaauggauaguagugacgguugcacaacauucugaauguacuuagugccacugaaguauauuuaaaaaugguuaaaaagggcuggacaugguggcucacacuuguaaucccagaacuuuggaggcugagguggguggaucaccugaggucaggaguuugagaccagccuggccaacguggugaaacuccaucucuauuaaaaauagaaaagaaauuagccggguguggugcgcauggcuguagucccagcuacucaggagacugaggcaggagaauugcuugaacccgggaggcggaaguugcagugagcuguggucgcgcuuugcacuccagccugguuaacagagcaagacuccaucucaaaaacaaaaaacaaacaaaaaaugguuaaaagggcaaauuguauguguauuuuugcacaguuaaaaaaaaaaaaagacgcuguagaagcuaaucuuugauaugagccagaaaaaguuucacuucucuuuuuagcuaaaacuacauacuuuaaaaaugugcuccaaauuuuaguucauauugaaauaaacaaacagaauugucaaaaacauuauguuuuggaguuugccaugacugagaguugcaaacuguuuucugaccugguucuugguuccucccuaacugcaguguguaaugcaucuugaagaccgguugcaggagcuauacuucaaaaguaaaaugcugucugaauaccugagggggcagaugcguguucaugucaaggagcugggagugguucugggguauguuaaugguuucuuuuuuggcuuugcuuucauugcccugucaucaggcaaggaauuuuccucagaauugcccuuuuuccuuuuacgugucuucuccuauuagaagcuggaggcuguuaucauuuagguugcccuguaccauguaauagcagguucccugucauccacuaaucugaaaggcauuaucccuugugccauuacauacaguagguugagaauauaaucacagugaauuaaaaucugaauuuuugucucagaaacauaaguacauacucauuuauuaaauauguugcaaacucauuauuccaaguaucugcccugccuuccacaugagcugguugagguaacagaagucuguagaugguaauacguuauccauauauuacuccuucccccccauuaacuauauauuauaucugucuacucugcauuauucucuggcagaaaacaguuaucaaaaaugcuuacugaaggaggaaugggaaguugguagggggggcauaauauagcccuauuucauuauguucuguggucacuuuucuuguguucucuggccacuuuagguggguucauaugaauuauuucuugaaaugccauuaaagaaagcaaaacaagcuagaacuuuuaucuaauuuggcuuuuaugaugggaaaagaaaccaauaucacugagaaccuacuguaugucaaaccacaugaaaauuuuuuacuaguguuauuucuucauucuuacuaucauccugcaguguguaggcaguguuauccagguuggaaacagaugauucugaaguuaacaugccagaugucacacacugguaggacuaauuagggauuugaaugacucuauaucuuuuuuacuuuagacccuauuuauauucuguaguaccacacuguugguccagacuugaugauuuugacuugaguuauacagagagaauuguucuccaguauuuggaaaaucaguaacaggauauaaccuuguuuuucuggggagugagcuguguguuuaaugccuuuauguaaaaauauuuaagacaaguuuuaaaaaguaacauaaauguaaccaaaauucacagugcauuuuggcauacaaugaaaaguaagucauugucuucuucccccaacuuccaaccccuacucaaacacuguuaacagauuguuuuguagaauuuuuaaaugaauauuauuuaaaaaucuaaguugaguuauacucuuguguccuuguacaacuugccuuuuacuauaucuugaauguucauauaagcacagaauaaucucauucuuccuaauggcugucuagcauucccuuauauguuggaauuuagauuauuuuuaguuuuuugcuacuauaaaccagugccagacugaauauaagucucugacauuuguaggauaaauuccuugaaauagaauuuuugguuaaagggccuguauugauagauaguuugacagauuauacugaauacucuccagaaaguuucaaaaugaauucccacaaacaguaagaggcacucuucucaguacuggcuauuaccagauuugaucuuugcuaggcuacuaucuaaaaaaugguaucugauuuuauucacauuucucuaaccaugagggagucugauuaauauuuucuauguugguuggccauuuuucuuuuccuauaaauuugugguaggauguauuuugaaguagcucccauuacuuccaauacaucuuauuauagaaacauuugaauccaaaacaaucuggguacacauuauuauucuuuguuuuuuuuuuuuuuugagacagggucuugcucuguugcccugcuguugguacauagcugacuucagccucaaccucccaggcucaagagaucuuucugccucagcuuccagaguagcugguaccacgggcacacaccaccaugcccagcuaguuuuuaaaauuuuuuuguggagacagggucucauuaucuugcuuagguuggucuucaacuccugggcuuaagcgauccucccaacuaggccucccaaaguguugggauuacaggcacgagucaccucacccagcuauuauuacacuagauugcaguuguuagucauugugccaugccccaguucauguuccaucagcaugucauugagacacuuuucuacguuuaugauguuguuacucguaucuguaguucuguguuuuauuuacugagaauuuuuccuuucggccagaguggccuagcuccuuaaccguugagguauagugaccuuacaguugguggucauugccuguagaguucauguccucaguacagaaaaucaaaacugacauuuuuuuccccuuuauuucaggauugaauccagugaucuuccacuucuggcugcuguagcaagcacucacucuccauauguugcacaaauacuccuuuaauauaccuaaaaauuguuagaaauuggugggaaaauagguagaaaccaaggaagcagacacaacaugcauuuauggagauucuuuuucccuuuuagacuuccaucugaaugagucagucaccaggguauucugcauagcauuguauauucuguguaugucagauggcuuuuucuuuuugacuggacuuuuggguggugguagauuuuuaaacaaaugaaauuaaagcaacaauaauuuugaagcauuugaaaaagccaaaguguacgguagaaauuucuacaaaaugaauauuaucaagaguuucaugugaucacugcaguguugucacagcucauaaauagcaacagugucucaugauuuaauggcucagaaauaguuauucauuaguuuuuaauuuuuaauuucuaagguacagagaucuauaaaaccuugauuauuuguuaguuuugcaauucaaaacagcuaaugucugguuauuucucaaaguaaguauuuuaaacagccuguuaauuauaagaaacucagaauaaugaguguaaauguguuauguuauccacccaaguguacauauguaccuauuuuuuuuuaaaaagcagaaauagaaauacaagacugguaaacaugccuuuaaaaauauauauauuuucaacuaguauugucuauaaugcugaaauauuacuuauuggugauuuuucuguuucacacacucuaaaauauaaguaaagccaaccuuuuuuuuaaggcugagauucccaaaaugagaauacuacuuuauaccauuuguuuauaaguaugaacuguucuuauaaauauuaauauuuacauauucacuaauuuaacauaaaugaaaauuaggauuaaaaauugcaccaaagcaucggcaaaaacaauacuauauucuuuaaaagugcucagguagccaaggcccuugcuuuugguaucaacccucaugaacccauaggagcugaauauuuguuucacugcuuaauaauccucaauuuacacuauucauaacucuuaaaauuauucucuuuuuuucuaagagucccucccuuccaaaaguguauuuuuuucaaagauuuucacuucucaauuguugccuuuguacauacuauagaguguugcuuguaagaaaggcuaauauggaaccaaacucuuguaaguaauguaaauagaaagguggguggauaaaguuuucaauacuuucuacuaccucaguuuacuugaguacuacauuauaguuuauucuuugcuuaucuggucuaagagacuuuuaaugcuaguaguaaaguugguuucugcuuucauugacuauuuucaucauaauuucaucauugauuaaaaaaagaaaaccacuuguuuauucaguuauuaaauauauuuacuauauaacacauccauucuugcuguuuaaauuuucaauaguuaauggaaaguugucuuugaccuugaauuuacagcauugggucacauuuugccuugcuguguauguauucaagagacuuccaacuagacaaagaaaaaauuguuguuuuaauggaauguaaaccugaaauuggugugucugcaaucuguuuggcccaugaccuuuuaccuagucccaguuauuaccugagucucccauggaugacuugcugccaaggaguguuuguggauauauuuucuuuggcuuaauuuucuuauucugugcauuaacaaaauuauccaguugucugauuuuggaauucuaugagucaaucuuuuuggcagaauucagaauauuaaaaaguucauacauuugcgggccauuguaccuuuuuuuuuuuuuuuuuuuuuuugacggaguuucacucuuguuacccaggcuggagugcaauggugcgaucucagcucacugcaaccuccgccucccaguucaagugauucuccugccucagcccccaaguagcugggauuacaagugugcgccaccacacccagcuaauuuuuuauuuuuaguagagaugagauuucaccauguguuggucaggcuggucuugaacuccugaacucaagugauccaccugccucgaccucccaaaguacugggauuacaggcgugagccacugugcccagccuuguacuuuuuuuuuuuuuuauuguagcucuguauagcacuuggauaaugucugggugucuccuuaaccaucaaacuguucuuuauuuaaaauguuuaauuaccguuuagaaauucuaguccucaauaaguggguggcucaugcuauuguuguuccuaaagcuaagcuuugcugggaaggaaaugaccuauaguuucuuaaagaaucauuaauccuuauaggauuccugaguuacuguuuuguuccuccccacugcuucccauuccugaguuuuguaauuccuaauccuucuauaauuucuauuaccuucaccauagucauucuuuccuuacgcaaagcccaaggaaugagcugcugcuacuuuaaaguguggucauuaugaugaaugugaaaagaguuuuggcuuguucuaaauaauuuuuacaaguuaugguacagacaguuguuacauaucaaaaaaaaccuguuuauugaaacaggaaauaaaaaagggaucuuuuacauuauagaauuaaaacuaauuuuuucuuguauauaaacuaauugguuugauuuuaaauauuucuggcuuuuauuaauaugucuuaauuuugaguuugaaaauguuaagugcaauaaaaacauacuaguacagauuuuguuuuguuccaauuggcauacucuggggaugaucacuuaaaaaaacagauuuuacauaaugccuacuucugguagaugucuuaugagauuguucugcuuuuucuaaguuacuuagauguuggauauguacauagcuguuucuuguucuguauacauuucucaaauguacacuuguauuauaauaaccucccaguucuaggggauauuugugcaauaaauacacaugucaacuuga

SEQ ID NO: 192231 - RNA, 211316 nt, Homo sapiens
cccgcgcagacuugucuccggccagucgcgcguggguagaggccuuaggcgggcguugcgaaggguuguuugcuagaguucggaccuuguuacggcgcgaaguucccuccuuggggcgggggaaagguaccgcacccgcuaccuagugugaaugaacuguggcgugggcugcuaagggcaggcugcggaguacccgggccguggccaugaacucacccguggacccuggcgcuaggcaggcguugaggaagaagccacccgagcggacucccgaggugaggcugguugaccuuuaugugcgucucacaguccaguagacagcauccuccugucuguccgaaauccgcggcgacugcccucuugccagagucucgcaccugcuacugggaaucuguucgcuugagucucuucccugacccaggcccuugucgccagcagggugccgaccgcccuuccugccugugaugcggucuuaacccgcguacccguccuugccgggggcuucugagugucguuaagaaagcaccauuacuaagucguauuuucugaguuggguaauaugaguuucgcaguuagaugcccauucguuuaaguagacuaugaaaaacgagauggaaauuguaagggaaguaucucagccauguaauuuagaaauaguuuuucuuuaaaggucucugaaauauuguacaguugccuaaaaaaaagauaaaguuuucaaaguuaguuuaaaaguuuacauccagucaaauggugaauucuguaguagaugaugcauguuuaaagaacaccacuguagguacuuuuucagacugucacugggaaauuuuacaguauuuuguacuuggauccaaaauuugcugugucgaguuaacaguuauggcaucagcuuaaaagauuuuucauucgaccuucaugaaggcuaguuuucaggcauauaacuaaaaccuguuagcuuugcuuaucccgguagaaugcuaagguuuuggggaagguuuuccuugauuuggagguuucuauaacaagugggacauauuuucuaaacaaaacacuaaacagugugaguggauuauuggauuguuuuguuuaaaguugcaguaaaugaaaugaaaugcuuugguuaauucuucacuuuggaguuuuucagauauguaguguuuugcauacugagucucaguaacguugggcugaccuuuugggucgugacaauuauucaggucacaacggaagccaugauaggucaaauuauguuauugaagauccugauguuugcauaggaacaacacaaauucuaccacuuuccagaguucucuuuuugagauauacauuuauaauucgaugaguguuuguuuccuuaugaugauucuugaagucaaugugagcugauuuaugaauuucaguaggcgaauuaucuuacagccuuuauagcauuggaaaguauuauacaaggcuuacgauguguauugcagguuucaauuuaauuuaauuuaauguuauuuuauuuuuuauuugaaacagucucacucugucacccaggcuggagugcaauggcgcgauauuggcucacuacaaccuuuaccucccggguucaagcgauuuuucugccucagccuccggaguagcugggauuacaggcaggcgccaccacgcccggcuaauuuuuuguauuuuuaguagagacgggguugcaccauauugcccaggguggucucaaacucaugaccucaagugaucugcccgcguuggccucccaaagugcuggaauuacaggugugagccaaguugcccggcugcuuuuaauuuucaacauuacuugugcuacuaaauucacauuuuaauggaaaaauccuacugcucuuuaacagcagaauuauuuauuuugaaauugccuauuuuauuuuuuuugagacaaagucucccucuauagcccaggcuggagugcaguggcacgaucucugcucacugcaaccuccgccuccugggucccgguucaaguaguucugccucacccucccgaguagcugagauuacaggcacacgccacuaugcccagcuaauuuuuguauuuuuaguagagacgggauuucaccauguuggccaggcuugucuugaacuccugacaucaugauccgcucgccucggccucccaaagugcugggauuauaggugugagccccgcgccuggcugaaauugccuauuuuugagccuuaggaaauuuucuaaacuguucauaaaguuauguuggccacugugugcuguguuaaguacuuuauugugcuuaauuggaacagaagcauuguucaagggaaugcuaaacagcugcccacaguacacagaauguagcccugacaucuagcagcauaagagguuaacugaugcauugguagugcuuuugaaugaguguagaauuuguuugggguaaagaaguaugaagaaggaaaucugaauccuagugaugauuuguuugugauaaauaauuugacaaaauucucccaaguucauuucuguuuucagaagguccuuuuacuggacucccaagggucuauuaugaauauauuagcucuauaguugcuuauugggagucuagcagcugaaggcacuagucugugcacuauguuguauccauaaacaaagcaggucugcccuaguaagacuuacauucugauagcaugaagaguggggaaggcagauaaugaauauacuaaaagguaaguuacauaauauguagcuuauaauugcuagaaaagaaaagagcagaguaagagggauugaaagcaaggggcaagggcuggguugcaguuuaaauaaggugguucguuuaacuugguugagaagaugauuuuugaucaaagacuugaugcaugugauggcauuaacuauagggguauauggagaaagugcuuucccagcaaagggagcaaucguugcaaaggcccuauguugagagcauguuuugaugcauuccagaaauagcaagcagcuuugugugacuggagaagggugaacaggugugagaguaguaagagaugaaggaggaguggagauaaugaugcauagcauagggcacauccuauuugacuuuucagugagggggagcacugaaagauuuugaagcagaggagugauauugaccuacuuaaccuuuuuuuuuuuuuuuuuuuuugagacagagucuugcucugucacccaggcuggagugcaguggugcagucugggcucacugcaaucucugccaccugagaucaagcgauucuccugccucagccuccugaguagcugggacuacaggugugugccaacacgcccggcuaauuuuuuguguuuuuaguagagaugggguuucaccguguuagccaggauggccucaaucucuuguccucgugaucugcccgccuuggccucccaaagugcugggauuacaggcgugagccaccacgccuggccuaccuuuuuguuuuuaaagagggucucacuauauugcccagucuggucacuaauuucugggcucaacagauucuccugcuucaaccucccaaguagcuggaacuacaggcaugugccacuacaccugacuaccuuacuggguagucuccuggcugcuguguugagaauagacuguagguguuuaagggcaaaagcaggagguuaacggcuguuauugcauaaaaucagguuagagaugauggucacucugacuaaagugauagugauaguaauggaaguggugagaagugguuaaguuuuagaaauauuuuguaggguuagccaacaggauuugcuaauagaucagauguggaccuugaggaaaagagaagaaucaagcaugacuucaagguuuuuggccuaaauaacuggaguguuggaguuauugucagagagguuugagcugccaucagcgagaugggaaaagcugcaggaggaguagguuuuaggggcaagaucagaaauucaguuuugaacaugucaaguuugaaaugucuguuagaaaugaguaagagguugcauauacaaauuuguauuacuaagaagccugagcuggagauaacaauuuuauagucaucaguuuauagauauugaaagucaugagacuggguaaaauuaccaaguagugaguguacguagagaauagaagaggaccaaggacagugaguaccaugggacaugagaucaguauaaggucggggagaagaguagaaaucagcaaaggagaaugaguggaagcaaacagugcaguaggagaaaaaccgagagagugguggugcccuagaagccaaauuaauaagcuguaaaauagaaggggauaaaauuauuuguuuggcuuauuuuuccuugaauaccuacugggugcaaagcguugugaaaaauauacaaagggaugagaauuaguauguugaaaucauuuguuugcaucguguaauugaugaguaaauaaugaguaaagaacuccuuguguuucugggacaaaaugaaugguuccuuuauuuugaaccaucugucguccuuaggugaaacuaucaacucaggcauaauccuagugagccagacaucaaguacagacacauguuguaaagugugccauuuagauaucuuucuaacacagugugugugugagagauuucuccuacuuauagauucagcuuccacagaacauugucuuuccugagcuaguucuuucucaauuugcaaagauauucuuauggaaaauuucagacuuaaauacuccauggacaauuaagugcacuaaaacaacaaaaacuguuaagguacagacauaccucccagauacugcagguuugguuccagacuacugcaguaaagccaauaucccaauaaagugagucacgugaauuuuauuuccuagugcacauaaaaguuguuuacacauauaguaguuuauugugugugauagccuuaugucuaaaaaaagauauaugccuuaauuuaaaaauacuuuauugcuaaaaaauacuaaccagucaucugagccuucagcuaguugucaucuuuuagcugguggagggucuugccuuaguguugauagcugcugcugaccaaucagggugguaguugccgaagauugggguggcugugacaguuucuuaaaauaagacaaugaaguuugccacaucaauugacuuucuuucaugaaagauuucucuuuagcaugugaugcuguuugauagcauuuuaccuacaguaacuucuuucaaaauuggugucaguccucccaaauucugcugcugcuuuaucaacuaagcuuaagcuuaugugguauucuaaauucuuuguugucauuugaacaauauguacaucaucuucaccaggagcagguugucucaagaaaccacuuuuuuuacuaaugcauaagaggcagcuucucaucuacucaaguuuuaucaugagauugcagcaauuuagucacaccuucaggcuccaucuucauuucuuuuuuuuuucuuuccuuuuuuuuuuuuuucuuuuucuuugagacaagaucucauucuguugcccagguuggagugcaguggcguaaucacagcccacugcagccucuacuucccaggcucaagugaccccaccucagccuccugaguagcugguacuacaggugcaugccaucaugcguggcugauuuuuuuuuuuuuuuuguagagacgaggccuugcuauguugcccagguugaucuugaacuccugggcccaagcaauccucccaccuuagccucccaaagugcugggagccagcccaggcucuauuucuaauucuaguucucuugcuauuucuaccacacaugcaguugcuuccuucacugaaguguuguacccuucaaagucauucauaaagguuggauucaaccucuuucaaacuccuguuaguguugauauuuugaccuccucccaugcuucacaauuuuuuuuuucuuuuaagugauagucucaauacauugccuggacuggucuugaacuccuaggcucaagugauccucccaccucagccucccaaaguguugggauuacaggcgugagucaccaugccuggcccacagaugguuuuaauggcaucuggaaugaugaaucauuucaagacaguuuucaauuuucuuuucacagaucuguuagggaaucacugucuaugucagcuguagcuuuaugaaauguguuucuuaaauaacaagacuugaagguugaaacuuuuccuugauccaugggccacagaauggauguuguauuagcaggccugaaaaaaaucacuaaucuccuuguguaccuccaucugagcucuugagugacaagaugcauugucagugaguaguaguauuuugaaaugaaucuuuuuuucugagcagugggucucaucaguggacuuaaaauauucauuaacccauacuguaaacaaacgugcugucauuuaggcuuuguuguuuauuuacugagcacaggcagaauagauuuaacauaauucuuaagggccuuaggguuuucagaaugguaaaugaucauuggcuucaacuuaaagucaccagcugcauuauccucuaacaggagucagccuguccuuugaagcuuugaagccaggcauugauuucuccucucuaguuauggaagucuuagguggcaucuucuucugauauaaggcuguuuugucuacauuaaaaaucugauuuuuaguguagccaccuucauuaauuaucuuagcuagaucuucaggauaacuuacuuuuuauguuaguggagguggcuuuuuuucguaaacuucaugaaccaacuuccaccagcuucaaacuuuucuucugcagccaucucaucucucaaccuuuuuagaauugaaaaguuagggccuugcuguggauuagguuuuggcuuaagggacuguuguggcugguuugaugguuuaucuagaccacucaaacuuucuccauaucagcaauaagacuuuuucacuuuuuuuuuuuaaaucauuuuuuuguucacuaaaguagcacuuuuaauuuucuccaugugccuuuucuuugcauucacaacauggcuaacuguguggugcaagaggccuggcuuugggccguuguuagccuuccuaaguuuaaucauuucuagcuuuugauuuaaagugagagauaggugacucuuuucacuugaacacuuaggggccauuguaggguuauuaauuggccuaauuuccguauuguuaugucucagggaauagggaggccccaagagagggagauagagaagguggaacagccaguggaacaguuggaacacauacaucaguuacguuugccaucuuacaugggcacaguuuguggugccccaaaacaauuacaguaguaacaugaaagauugcugaucacaggccaccauagcaaauauaaugaaaaaguuugaaauguugugagaauuaccaaaaugugacacggagacaugaagugagcaugugcuguugaaaaaaauggugcuguuggacuugcuugaugcaggguugucaugaaccuucaauuuguauuuaaaaaaaaagaaaacaaccccacaauaccagccaagcacaauaaaacagaguaugccuguacuucuuugcgucauuaugccagaauuccuuaaagaagccacagucauaauuagaccuugaacuuggcuguuucucagcucaauccacauuuaauaccauucuuuauaacguuccuuuuuuuacuucagaaugaacuccuuauauuucccuuaauguuuauuucccucucagugcuuaaugccaugauuugcacauauuaaaugaugaauaaauauuuuacaagccaaaauuuggaaauacauuuuguaaagucaucauauguuaaaaagguagcacuucguauucauuggaacugcuaacuuuuuguuucuuggacagucuuacucagcagcuugguuucaguuaguuguuauaggcuaaugccuccuaggauuauguuuuccaacuuauccccuaaauuuuaugugcuucagcuucauauaucaaccaucuuguccuccagguucuucaaccacuuguccuaaauugagccaucauuauuccucuuccuucauaaucuguuggcagcuggccgaguugcugucucuaggaauuuguauuauuucucuucauuccucauagaugcaacuugccacuaaacuuuguccccugaaucuuuuuauuugcccuuuucuuacaaguuuuacuacucuaauucagucuguuuuauuguuucuacccccaaauuauugcuugagucauugagucuugcugcuagagugaucuuccucucagaucugauuauguucuacucuugcucagaauuuuauuuccuauauuuccuagguauagauuaacaauauguuguucaaaucauuuuugugaauuaaaagagaagcuguuaauauuuauuucagaguaacagguuaaagagggacugucccgcuuaaacugagauaugguuaccucacccagaugauaacauuaauuuguacauucauuuaagaaauaauauaucugauauauuaaaaaccaagguuguagagaggaguuagacauggucccuauucaucaaugacuugggagacauaagaaaacauaaauguaauaaauguuuuaguuauuagugacaaagguaugaguagggcuuugggauugcaagauggggaagggaacaagcuucaugggggagcauugaauucccaguguuaaaugucaugaauugauuucuggaugaucaagagaggucauuccaagcagagaggcaggagcaaaaguacugaugauggcaagccauguauacuuguagaauaagaagccaaucuguaagucuagagcaggcauucccguuggaagugauaucgcucccaaagaugcaaaaauugccuuuuaugggagugggaaaaaaaaucacagcuauugguaugguuuguggcccucuaaaacucagcccuaaacugacagugucuuauucuuuaguauuuaauuagagauggggcagugcuuacgaaaaauugucugaaagguucuuugggaggggaugaaaaugaaaaaaagguugcagaacacuggggcuaaugucuaggauguuuggggaugaugguacaugaugugagauguuuaaugaugaagcuggacguacuagcaggguuuggauaauuucagaaauuuggacuccaucuuauaaauaaaggagaaagaaccguugcaggguuuaaagccuggaaauaagaucaguuuuauaaagacuacuaugugagcauuuuggagauguaauugaguggggaggagcagacuagagacagggaggcuuauagguauacagguagacuggacauguauuuuauccaaacugggauauuuuccaugugaaagguaagacuacuagugauuauacuaagauaauauggaaaccaagaaguaugguuuuuuuuuuuuuuuugagacggagucucugucacccaggcuggagcgcaguggcgcuaucucggcugacugcaagcuccaccucccggguucacacaauucucuugucucagccucccgaguagcugggacuacugccgcucgccaccaugccuggcuaauuuuuuuguauuuuuaguagagacgggguuucaccauguuagccaggauggucucgaucucccgaccucgugauccacccaccucggccucccaaaaugcugggauuacaggugugagccaccgugcccagccaccaagaaguauguuuuguuguuagaaacaaauacaguaguucaggugugagauaagguccuggacccagugguggcagcaguuaagugggauagugagguauuaaggagguagaauuggcccaaccuggucacugguuggaaagauaauuucuccuccucccccagacuuuuuugaaaaacuuugaaaugaacuauaaaacauaaaguccauaugcccuaaauauacauuggcagaugauuaauuuguuuuguuuguuuguuuguuuuuugagacggaguuucucucuugucucccaggcuggagugcaguggcacaaucucagcucaccgcaaccucugccucccggguucaagggauucuccugccucagcaucccaaguagcugggauuacagaugccugcuaccacaccuggcugauuuuuguauuuuuaguagagacagaguuacaccauguuggccaggcuggucucgaacugcugaccucaugaucugcccgccucggccucccaaagugcugggauuacaggugugagccacugcacccaugcccggcuacuuuuuguauuuuuaguagagacgggguuucuccuuguuggucaggcuggucucgaacucccgaccucaagugaucugcccgccucgaccucccaaagugcugggauuacaggcgugagcaacugcgcccagccauugccagauuaauuuuuacaaacauauuuuacuguguguaucaugauacagaauacagauaaagaauauuaccagcacuccagaaauuuccccuuuuuccuucucagucucccaaaggaaaccacucuucugguucugucauugcagauuuuuuucuuugugccuuugaacuuaauuugaguggaguguuuuuguuuguuuguuuguuuguuuguuuuguuuuuaaagacaaggucuugcuguguugcccagguuggccuccagccccugggcucaagcaauuuucccaaguagcugggaguacagguguauaccaccaugcccagcucauuguaaguauucuuucuggcagccaagaggacuaugaagcuaccuugguucuuugcauuuugccuuuguauuggacuuuuaaccuccucucuuggggcuuuccuugcuagucaucugauuaucuauccuuuauauccugacacuaaaaucucuucuguuucugugcauugcauaggaugggaacaguaugguaacggugucacuggccuuugaauuuugcauuuggacaagccuacuucaaaucuggacuccaguucugagaauuugaccauaggcaaguuaucuaacuucucuaggauugaauaucuuuuugggauucuuguguggaccaaaugagauaauauaugugaaauaauuagcaaaguaucuugauaauaaacaguaaaugauagccuacauauuagcugacuauuuucucugucuggaaaaccauccucuggccugguacauucugauucuucacugaaagcucuagugcucauuugcagaauugugcauccuuccuuccucacuuuuccacuccucuguguuccuagauacuuugcgccuucuuccaccguaguaauuacugugcuguguuaugauuacuugcauauuucucucugauuguaagcuccuugaagacagugaguguacccuuaucucccaguguucauuacacaguacuugguacauaguagauaucuaaauauuuguagaguaagugacuuuaaaaagaaaaucaaggccgggcgcaguggcucacgccuguaaucccagcacuuugggaggccgaggcgggcagauccccugaggucaggaguucgaaaccagccugaccgacauggagaaaccuccucuguacuaaaaauacaaaauuagccgggcgugguggugcaugccuguaaucccaucuacuugggaggccgaggcagaagagucgcuugaacccuagaggcggagguugcggugagccaagauuguaccauugugcacuccagccugggcaacaagagugaaacucugucucacaaaaaaaaaaaaaaaaaaaaagcaaugugaaaaauacuguuccuuuacuauucuaguagugauuucuacuggucuaauauuuaaaguguucagauaaaaaggcuugaugaaguuuggcaaaauggcaaaaugugcuauuacuauucucauuaagaauaaaguagaguugccauaaacaguguuuuacuuggcaguucuugagagacaauucagauggaggaaacuuaguaauaucuugaaagaaagauuccuuuucugcauggcuucaaaacacauuugcagggaacaucacagaaaaauauagauuaaugcccauuuuaacuguuuauguucuuucaccagaugauucaaaacgucugggcaaauuuucaugcucugcuagguguuaacguaauugccuacuuagaagaaguuuuuuuguuuuguuuuguuuuguuuuagaacuagguauuuuugguuauuaaaaaguuaaagaaggagcugggaauuuaaaaaauguaaaauuuaguauaaccauuuauuaaucuguuacagaauuuagaaaaauggucuucaaauguacacuugcagaguuuuuuucugaauuggcgagagagcaccauuguacuuggagucauuuuuggagugagucacugugcacaucccugguuggcagaacaaagauucuguugugcuuucccacagcagaugcacauucagaggguuccuuggaaagaaaaagaacuuauuuauacuucuggggccccuugaccuucauuuguaaauccaguuggauagaaggggaauguuagaucuggaugagaccuggauuaucuggaugaacaucuuuuccaggcccaucauuuuacguguguuggagauucccaacucgaugagcuugacuauagaaugagcgauuuuauuaaaaacuuuagauuguggaggcauaagcaacacauguuugaggcauaagcaacgcauguuuggcauuacaugccaaaggugagacacauucuccacuauuuuaauaaaauugcucauucuguuuuuauuuacagccagaccuuaguuuaccuaggcugguccaagguaaagucaaaugauaaacacaguguuauagaguucacagucagucugucccuugcaaagaccaagauuuuugucguguagucaggcucaucaugccugccuccuucuucccuuuggagaauucugagggaaauuccucaaucucucagaaucaaaaucuuaagugucuaaacuuccaaaugacugcagcuuuucucaaguuaagaagccaaacuaaaauagguuaccauccucuuuuuuuuuuaggaaagaguuuaugagugucacaagugccugguguggaguuuggauuauuuauaggauuauuaaaugacucucugaggcacaggugaauacauaauuuuuuugagggagauugccuaaugaacauuugugcgguaaauauuaaguaagcacuguuucaugugccagggauaaaagauuaaagauaguucuuccaucuggggaggagauagcaaaacacauggacaauuaaaauauggccuaauuaaauacugugauaauuauaaauaucaggugcucagaaguuuguaggaaggccuuugggggagaagagcaaaggguaggcaggugcuguucaaguuguuuuagaaaagggaacccugaugaguuuaggauacaguuggcccuccauaucugugaguuuugcauuuguggauucaaccaaccgagauuggaaaauaaguuaggcccaugaucguugugccugugcugaacagguacagacauuuuucuugcuaguauucccuaaacaauacaguauagcaacucuuuacauagcauuuccacuguauuagguauuaauaaauaaucuagaguaaugauuuaaagcauacaagggccaggugugguggcucgugccuguaaucccaaaacauugggggcugaaguggauccucaaacuccuggcugcuugagcccaggaguuugagaccagccugggcaacauggugaaacccuaucucuacaaaaaaguacaaaaaucagcagggugugguggugcaugccagcuacucaggaggcugagaugagaggaucgcaugagcccaggagguugaggcugcagugagcugugaucgugccacugcacuucagccugggcaacacagugagacccugucugaaaaaaaaagaaaaagaaaauaaagccuaccagaggaugucuguagguuauaugcaaauacuacaccauuuuauauaagggacucaagugucuauggguuuugauauccacaaaggcucuuggaaugaacccaguggauaccaaggaacaacuauauauagaaauuuaaguguagaagggaagguguguuucuugaaaggguaacagcauaugccaaggccacaggauacguaugguauguacaugcaaguugccuaggcagcuggaacacugggacaagaaugaaugguaaaguagaugaagcuggaggaauugucaggauccagaucaugaggaauuguguucuccuuauuaaggaauuuagauuuggcuuccagaaagaucgcuuuggcaguauaugugaagaguggauuuuaccgugggcaugguuugucaugccuguaaucucagcacuuugagaggccgaggugggcagaucacuugaggccaggaguucgaggccaaccuagccaacauggcaaaaugcugucucuacuaaaaauacaaaaaauuugcugggcauggugaugcgugccuuuagucccagcugcuugggaggcugaggcgugagaauugcuugaaccugggaggcggagguugcagucagcugagauucagccacugcacuccagccugggcaacagagugagacugugucucaaaaaaaaaagaaaagaaaaaaaaaagaauggauuuuagaauccaguuauuucaguuauucacugggaaauacugaauuucuaaauugccucauuugcaauaguaaacggagauauuucgaaaguagaauugacagauuucuggccagagccaaugaaccugaguacuguuaacuaaauuagggaaccaguaaugaauuuugcacuugaguugcugaugggucagccagguugaaaguguucaguguccaguagaacauauaguaucuaaguuuaguggagagcuuugggcuagaaauacaaauaugggagucauaggcauaugugauaguugaagcuauggauguggaagguauuccuaacaguagagagucucuagugaauaaaaggcagcuguuggcaguucugguaacauaaacuuuauaaacauuuauaggaauaagaaaaaaaugagaaaccuaugaaggagacuuagauggagcagauggacccaaaauaacaaaaaguaaaaacugaaaaaaagcagccgccgcagaaagcuaauaauggaaauaaaauacugaagacuugcauacuguauggugguuauuggaugccuguugcuguuaugaaaacuuuauauacauuuaauccuucaagaaacccugugaaagaagguauuauuauccacauuuuacauacggggaaauugaaucacagagagauuaauuagucuaaugucacacagcuagacccaguguagucaggauucaaaccuaggcagucugauuucauagucugugcuuauaaucguugcuuaauguuucucauuaagacgagaauccagaaagaaccauauuacagaagggauaggagagagaaugacaugucagcagucaaaugcuguagagaauucgaagagagauaaggauugaaaaguacauguggaauuuagaauuaacaaguauuaggugacuucauaaugcaugguaggaucagaaaagugaagugaaaggcuacacuuugaacuuauaaacaauuggaugcucaaucuuuugauacguuguaauuucagugguuaauuauugaaguccuaaaguuuaagcauaucauugagacuuucauucuuaaaaauuaaaauuuuaggguguaauuuuuuaaaauuauacuuuaaguucucagauacaugugcagaacgugcagguuuguuacauagguauacacaugccauggugguuugccguacccaucaaccugucaucuacauuagguauuauuuauccuaaugcuaugcccccccgcccuccagccccgccgcaacaggcccuggugugugauguuccccuccauguguccauguauccucauuguucagcugccgcuuaagagugagaacaugcaguguuugguuuucuguuccuguguuaguuugcugagaaugauuaguaaaugcgugagccaccauaccuggccaucucacaccucuguuucauuuuucaauccagggucuagucaagguauguuacguuacauuugguuaccauagucuccuuuaaucuagaacaguccuguuuuuuuuuuuuuuccuuucaugaacauugcacuuuugaagagccuggccggcugccuuauagaauguaucaugaucuggauucaucugguuguuuucucaugauuagauuaaggugaaaugauuuuguugagaaacugcauaggugguggucuguacuucccguauugucccaucacugacacacauugucaguucuuuccauuauugggcauacuaaauaggaucaucugcaucucuuuuguuuuaaagguacaaugcuauaauuuauaagugauccaaaguuauaguuggagaaugugugaaugucguguucuccaacagugguuuuaccuugugauuuuagcauucauugauaauccucaccuaaauuaacuauuacuuugcuguuacaaagugauaauuuucuuuuuuucuuuuuuugagacagagucucccuuugucacucaggcugcagugcaguggugugaucuuggcucacugcagccucugccucccagguucaagcgauucuugugccucagcuuccugaguagcugagucugcaggcaugugccaucacacccggcuaauuuuuguauuuuuuuuuaaaguagagaugggguuuccacuguguugccugggcuggucuggaacuccugaccucaagugauccucucaccuugaccucccaaagugcugggauuauaguuguggaccaccaugccuggccauaauuuucugauucuauauuucuuuuacauuuguuaguuguuuucuguauagaagagcuuuccucaccuuccuuucuccucucuuuuuuaaaucacuaugaaguaauggauuauuuuuuguguucaauauugucauccuuuuuaauuauuaaagugcuccaaauauagccaguggaagcccuuucaaagucagguccuauguccuuuugaugugaccccauuagucuuuaaguacuuuuuugcuuucuggcauaaaaagauguuccagguccugacuuucuuugcucuaguacugaagucagccguuuauccaaagaacuucaguccccuuuagugagaaaugaauuuagaaaccaaagucugggcuccaguugugguaaauguuuuauaccucuuuacugccauuuugccgaauguuguuuauaccuccaugaaugagaaaaucaauaaguucuauguuuaauauaugguauuaacuuuggcauauuguuuaaaucuccaaaaugcuuuaguagucuguguauuuuaauccuuauuuuguaauuuuagaauauauuuaccaugugauagccucucugcugcacauuuaauaaacauuuaaaaauuuuguauuuuuaguagagacgggguuucacuauguuguccagccuugucucgaacucuugaccucaggugauccacccacuucggccucccaaaguacuggagauuacaggcgugagccacugcuaacugggggugguggugggcgccuguaaucccagcuacucaagaggcugaggcaggagaaucgcuugaacccgggagguggagguugcagugggcugagaucguaacacuacacuccagccugggcaacaagagugaaacucugucucaaaaaaacaaucguuuguguucagagauauuuuaucuuuucugugguacagauaauaaacguuaagcagauuauccaaguuuacacaaguaguaacuaacagagcugaaauaggcauaauuuaaacacgguugucuccagaguccaaauuggguuuuuuuuuguguguguguguguggugcuguuuuuuuagagaccaaguaucuccacauugcccagauuggccuccuacuucugggcucaagugaucccuccugccucagccuccugaguagcugggacugcaggcaucugccacugcauccagcugucuuccacauuguuagacugccuuccaaaugauuuguagaagauuccucagcauaacuuuucauuauagaaccauagcugcagaauguauguaugauacaguugaauuugugcugaccuuaggaucuauccugggacauuuuucuuuguuaaaauuccugggauagauuuauuuucuagguuaagaagagaaugaauaaaauaucuugguuaaugaaaguuuuggauaaugauguuuuauugaaaguuuugugugccugggugcggugacucacaccuauaaucccagcacuuuggaaggccaagguaggaggauccuuugagcuuaguucaagaccauccuaggcaacauagaccuugucucuacaaaggaaaaaaaaaaagcugggggugguggcacacucgagagucucaggagggaggaucacuugagccugggagguugaggcugcagugagucgugauugugccacuguacuccagccugggcaacauagcgagagccugugucagagaaaaaacguuguaugugaugaauuaaguguaucauagguaagaaauucacuuguuuuaaacuuuaagaaccagaaaaaugcaaaaauuuuuuaagcaucccaguuugaguuuuccaaguuuugguugauuuucuaaacaccuguagaaggacagugaggagaauugggaaauggaguuuccgagagcagcacaguugcuuggcauaacauuguaaacuaaggaaggggaaaaaauuccaaccugcuuaauuagaaauauauguuuaaauuaguaauuacuuguuuauacagugcuccaaauaugaguuuauuuucauuuaacaacuaaauugaaaauccacagaauauaccugcaaugaaugcuguaaguaagaauuguuuaaaggguauacaagaguugucuuguuauacaauggcagcuguccacccaccucagcuuaucccaccuucgcuauaaaaacuacuggcugagaggguguagcuuaucuguuuuaggaaguaccaagucaucaccacuuccucaccuucuucuucuuuuuuuuucgccccuagguagaacccauuauuuuauucccuaauccugagcugguacuuguuuuucuaauaccccuggacaauuucugcaguauuuuguugcaguuacagaacuagugcugaaucagauguuacugaucugggaugucaggauaugccagguggauaguuuucccacccuucucaugacuucccucuuuuuuuuuuuaauugagacaggguuuugcucuguugcccgggcuggaguacaguggugugaucuccgcucacugcagccuccgugcccggguucaagcaauucucaugccucagccucccaaguagcugggacuacaggugugcgccaccaugcccagcuaauuuuuuuguauuuuuaguagagacgggguuuugccauguuggccaggcuggucgugaacuccuuaccucaaguaauccgcccacucugccucccaaagugcugggauuauaggugugagccacuguacccagccgacuucccucuugaaagcuacauagagcagcuuucaagugcauucagcguaaaugauuagcaccuccuugaaucuagcauuuaaauuuuuuacugccgaagacugucuguaagacuuccagucugacucugucaggguucuuucuuuuuuuauuugugacuuuaugccuaauagauaauauaguaccucaagcuuaucuugcagauaauugacacaaaagccccaagaaacccuuuuccaagcucagcauuacagacuccacaacuccaugcuguccuguguaaacaaaaugccauaacccccacaucauaugaaaaagaauuaaucagcucaccacuacaaccauucuuuauucuguuuugugaaugcuuagcauucuugugacccucaaacuagguacacaaagaaagggacuaggauuuacuaggcaucuuaaugcuuguugucuuucgcuauuaauaggucagacaauccagagugacauagaucccacuuauaaacagugguucucaaacuuuagugugcagaagaaucaccuguaggaccuauuaaaucacagacugcuggucccuacaacccagauauucugauugacuagaucuggggugaggccugauaauuuacauuucuacaaaguuccuaaaugaugcugauugugcugguucaggaucucacaggguuauuacuuacaugcaacagaacccaauuuuggccaaucgaaagaaauaauuuacugaaaggauucuggguagcuacagaauuacuuggaauacuggaaaaccagacuuggggcuaggcuugggauacuagaaaaacaggcuugggucugugacccuuaucacagauuugguagauacuacugcuacuagcagugaauagugagugccacaguuugcacuguggaccaccuguacuguccauugcguauguuguagacccuugauaugguuuggcucuguguccccacccaaaucucacguugaauuguaauccccagugaugggggagggaccugugggaggugauuggauuaugggagcagauuugcccccuugcuguucucgugauggugagaguucauucucuugagaucuugaguuguuuaaaagcauguagcacuuuuguucuacuuugcugucucucuccugcuggcuaugucgagaugugcuugcuucccuuucaccuuccaccaugauuuuaaguuuccugaggccuucccaggcaugcauccuguacagccugcaggaccaugagccaaaccucuuuucuuuauaaauuaccgcggcuccgguagucuuuuucuuuuucuuucuuucuuuuuuuuuuuuuuuuuuuuugagacagagucuugcucugucacccaggcugaaaugaaguggcaugaucuuggcuugcugcaaccuccgccccucagguucaggcgauucuccugccucagccucccaaguagcugggauuacaggcaccugccaccacgcucagcuaaucuuuguauuuuuaguagagaugggguuucaccauguugaccaggcugaucuccaacuccugaccucaggugauccacccaccacagucucccaaaaugcugggauuacaggugugagccacuguguccagccggguaguucuuuauagcagugugagaauggacuaauacaacccugcugcagccacuggcugcccaagcggauucuaugcaguucuugcuucucggugucacuagcuucugauuuaaagucugggaugaauaugucuaauugguaacacuugaauaauuugccccugccuuuguuguaugggagguuggaaaaauaaaaauuugguguuuucagcuuucauggugggagacagaacuccacugaaacuuauaagguggucuguugucagagaggagcucauucaugcuuggccacacuguagcuauuuuugaccauauguuucaggagcuaacaaaauaugaccagcuauuuuuguaaguaaaguuuuauuggaacagucacacccauucauuuaccuguuguccauggcuguuuucauauuauaaaagcagagcuaaauaguugugauaaaaaaccaucugggccacaaauauuuacuauuuggcccuuuauugaaaaaguuugucaaccccugacaggaauaaugcugacauacauacauauauauauauauaugaagagagagagagagucacacacagacagacagacacacggagucucgcugugucgcccaggcuggagugcaguggcgcaaucucagcucacugcaagcccugccuccuggguucacacuauucuccugccucagccucccaagaagcugggacuguaggcgcccgccaccaugcccggcuaauucuuuguauguuuaguagagacgggguuucaccguguuagacaggauggucuugaucuccugaccucaugaucugccugccugggccucccaaagugcugggauuauaggcgugagccaccacaccuggccauaaugcugauauuuuaguucagggucaugcagucaacauuacagauguugugaaggacuacauguucauuuguccaaauugucccuuuaaaauaaggagauuacaaacaaauauuugaagcucuuugaggaggggcuuuucagauuuaaagugauaaaccuuauuagucucucuuuaggcagagaacugaagauacauguauaucucaaacuugugagugaaauucucuuucagacuuuaacauugaaaaguuaauuucuaauucuuucucauauauucauggcauuguuaaugaugugccgaagauguccuguaacuugagaaaggagaaaauuauaugauauaaguuuaguugagagucuuagaaaauucugguucccuguaacacuagccuacccacauggaguaagucaaguuaugggaguucuguuugccauaaccuaacuuuuguguauuacaauuuucagaacuuguuugccaccagaacaaguugucuugucaaaaauuacaagcacauuuccacaggauagacauuuugugagugccugccugccuacaccuaacucagugguuggggcccaggcagccguguuuguaguacagacauuccuugacuuacaaugggguuauaucauaauacaaccaugguaaguugaaaaucuuguaagucagaaaugcauuuaauauaccuuaccuaccaaaaaucauagcuuagccuaccuuaaacaugcucagaacacuuacauuagccuacaguugggcaaaaucaucuaacgcaaagccuauuuuauaauaaaguguuguguaucugguaugauuuauugaauacuguacagaaaacggugaaaaacagaaugauugaauggauauucaaauuaucguuucccaggcugucaucaccaaaaaaaaaaaaaaaaaaaaaaaaauuagcugagcaugguggugcacgccuguagucccagccacuuggaaggccaacgugggaggauugcuucaguccuggagaucgaggcaucagugagcuaugauugccgucacugcacucagccugggugacagagugagaccccgucucuaaaagcaaaacaagacagaaacauaauucaguguccacugaaugcauaucgcuuuugcaucauuguaaagucaggaaaucuugucgaaccauuguaagauggggacugucucuauauggccacacuuacuccggcuauuguuacauaauaaggcaugaaaaaaugggggaaaguguauaauuugggaagaaagaaauaauacuguauucauaggcagggccauuguauaugcagagaaucaaaaauaaucuacaaacucugaaaauuaagugaauuuauuaacaagaugguuggacucaaguuuauuauauagaaucaauugauuuauguaaaccagcaauaaaccaaaaagccucuaguuuaaaaaaugacucuuuuugagacaagaaucucacucugucacgcagauuggagugcaguggcaugaucccggcucacugcaaccucuaccucccagguucaagugauuuuugugccugagccuccugaguagcugggauuguaggcaugcaccaccacacauagcuaauuuuuguauuuuuaguagagacgggguuucaccauauuagccaggcuggucucgaacuccugaccugaguugaucuccacucacuuuggccucccaaaguauugggauuacaggugugagccaccacacccagccaaacaugacauuauuuaaaaauacuagaaaacuaaauauuuaagaauaaauccaacaaaaaguauagaaaauuuauuuacugaauacuacaaaguguucguguuagucuggguucuguuagaagcaguugucacaacaauauuagacaugcaaggaauuuauuagggaaaaugccucugagcaaaaauggagagaguugguagagcauucacaccagaaugcucaugugacauuugugaaggagagacgaaaggaaguuugaguggaagagccuuagacugcacuguaacagugguuuagcaagguggaaggagaauccuugaacccaucagaguauuccugagucucccagaacaggcauuccuuaguauuuuuaccaggcucaguuauugauugggaguaucgcaugggaagcugggccccaguucaaacauguugauaaauuacagagccccguaauagggauuuuguucaaauacacucccuguaguuuggaaucugagaggcauauuuucaaggccaccugagcuuacacuuugcaccacacaaaucuacuucuucacauagguuugaaguucagggagcagcuccuccauggcucucaaugagcuucuuuuccugagaagaaacuuagacaagagaugguggugggaagaauuauagccccuguaugguugaucucgggguugcaacugguacuuauccucucuccuccacuaugcauuuuguuuucuccucacauaaucagcucugcaggucucaguggcuuauauguugguaugacucaagccuucuuuccugaaaugucugaacccuugguaaucauucuucucaggcuaaugcugggauauauauccguuuacaguuacagugagguaaaggaauaaccaagcgagucauguggauuccacacauuccucucuguucacauuacauaaaagcagcccugcguccaccuacugcucaggaucaguuaucccugccaaaauggcaacucuucuuaccugcugauucuugggcccugguguuuaaagugcccugguggcagcuguaaacuuguucacugagacucuuguacuguugccuggcaagaguauaggccuuuggaaccaggaccugcaaacaugcagaguccauagcuguaggaaugggaaguacaaaaucccuuuguggcucauugggaauaaugauaaaugggugacucuugcuucuacucauuuguuucuaggcccaucuguucuuccugcuguauacacugcuccauauagaggucugugguuugauguaucuucauauuaaaaggugucauuccauuauuucacauuauugccuuuaagcugaaaguucagcuaugccuuuauaagguuauuacagcguucugugaggccaguugcuucuggauugugugguaugugauaugacuaguggucccaagguugugaucauacuccuguguuugcuuugaauuggguccacugguuggacucugguaugugggauucuaguccugugguucaggcauucuggaagccccuggauuaugauccuggcugaaccucugagguaaguaagauaaacccaaacccagaauauagauaucuaucacugugaaaugaacuacuggccguucugggaugagagacaccauauauagucuacuuguuaucaaaugacugguugcucuucuugaauaauaggaucauaucaggaacucauacgguuggucucuguugcugacagguuggacauucagaaguagcaguagcuagacagaccuugauaaguggaaguuuauauuguuggacacauguguagccucuaucuagugucauuguggucagucuaaucaucuauuaauugugccaguucugggauauccuuuuuuaucuucaugguuguucagugccucuuccauguuuaaugccuuuuggugggcauuaguguggaauacagaaaacuuuauacacuuugugcccauucccaugucuccauccugugucuuuacccuaucccuccuugucccugaucuuuuugucuuuuuccuucuagaccccugaccagacauccaugcacuggaauuuacauauauuuucaccuugggccacugucuugucuguuuuguguugcuauaacagaauacuugaggcugggucauuuauaaagaaagagcuuuauuuggcucacaauucuggugacuggaagauucuagauuggccaccugcauccaaugagggccucagacugcuucuacucauggcaaaaagugaaaggggagcaagugugugcaagaucacauggcaggcugggcgcaguggcucacgccuguaaucucagcacuuugggaagccaaggcagaauugcuugagcccaggaguucgagaccagccugggcagcaaagcaagaccuugucucuacagaaaauaaaauaaauaaauaaauaaaacuaaaugggcaugguguugugugcaugugccuguagucccagcuacucaggaaucugaggugggacgauugcuugagcccaggagguuggggcugcagugagccaugcugaugcugcgaaaaaaaaaagagaucacgugguaagggaggaagcaagagagagaaaccaaggaagccagacuuuuuuuaacaacccucucucgggggaaccaauugguuucugugagagugagaacucacuuacccccucagacaagcauugaucuauuuacaagggauccacccgcaugacccaaacagcucuugcuagguccuaccugcuaacacugcuacauuggggaucaaauuuuagcaugaguuuuggcagggacaaaccauauccaaaccauagcagcugcuauccuuuggcaugacccauaucuacugcucacaacucuacccauugaggagauuuuuccuuuucucuuucuuuuaaggcuguuccugaaugugacuucaacauagccugucaaaaaaagaguuaauagaacagaucugagacugcuguccuuaggaagaccuauuuguaaaguagucuuuuuuggcggcuggcaucugggaacuuggauuucaggaauguucccagcauuucauaacugauaagauuuaaaauauagacauucuuauccaggguuaacagacuuuuucuauaaagggccaaauagugaauguuuuagguuuuguggcccagaugauuuuucuuacaacuacuuaacucugcuuuuauagcaugaaaagagccauagccaauagguaaaugaaugggcauggcuauguuuagcaguaucucuucuaccuacaugaugccaguagcaccacucccucaaaauugugacagccuaaaauaacuccagacguugcuaaauaucaccaagaugggaagaaucagucuuaguucaggacuacuacaaugauuuuuucagguggaucuuuacuucacuuuagauauuuccggauguccuaucuuaugaaaaacguuuuauauauuugucuuuuuuguuguuguuuuuaguuguuuuaggugaagaguaagucuaguuucuuuuauuuuaucuugaccuaaagccaaagucacuucgacauugcaggagguguccugacgugcccccaaccacuguaucccgaaaaacuucacugaaauggcauaucuuuugagucuucauaguguuuaucucccauuuucuggagccgcauguguguuaccaaggacucuaaggguaccagucaccucuagccuauucuuuuauucauucuguccaaucagcaugauguaauauauguaaauagaucaggagguuuagaugucugucccccacccaacccccacugacuguguuaugacagagagcggaagaguuaagaguccuaagauaaaacuguaaguuaauauugccuugcauggaugcagauuuuuuucugaucuucuaauuggaauggaaaguaaaguaauggaaaguaacaccacaucaguauuugaggcuuaaucagcuucagcagcaauauuauggcugagacugcaggcugugauuagggcuagaauuugguucauucugugguagucugcacagucauuuuuuaggaucugucugcuuucuccauaaauuaaauagaauacaauagaaacuauuaccucugcguacuucugagucuuuacugguggcacuagucuuuauucugugccccucuggaagaaauagucuuuuauuuacugucuuguucuggggaauggggcagagguuuccacuuggcuuuuuccauugugacggcuuuuaccacacaggucauggacccauuauuuaggguauucuaacugccaaguauauaaauucuaauuauaaacugagggaguggggaaugaccauuauuagguggaucugcagacucaguggacccacugugagccacacuuuugccaugacucucuuuauuaccuacauucagcagguucuggcugagugguuggugcuuuuaccccguagagccucaauugggaucauucuuuuaguuccauucaauugguagcucuaagcugcucuaggaaggcauaacuuacauaucuaguaccuugguguuauuccauguggccuuucugccucccuaaggcuagcuggagcuuccucacaacauuaguggucucagggugcuugaaucuuuuauacaaccucacuucuaucguauucuuuuggucagaacaagucacagagccaacccacaucuguggggagggcacauagauuccagguuuugauggguaacuggcaagacugcauugcaaaagagcauaugggauaagaaauaccucuguggccaucuuuggaaauacaguuuaccauaucagugcuucaucugcuaucugcuaaaauuugguagaccuuucuuuuaaccuauucaaaucuuuauuuuuauauacuuaaauaucuuuuucacuguuacuuuaguaaggauuuagcagaaauaaaugugguuguucaauucacugugguuaauugacaguuguuaucuuuggaauuagagauuauugccuuuuuuuuuuuuuuuuuucccuugagauggagucucaaucgccuagacuggagugcaguggugcgaucucggcucacugcaacuucuucccaggcucaagccaucccucacaccucagcuuccuaaguagcugggacuacagauguguaccacaagccuggcuaauuuuuuuaaauuauuuuuuguagaggcaaguuucaccauguugcccaggcuggucucuaacuccugggcucaagugauccacccaccuuggccucauacagugcugggauuacaggcgagagccacugugcucagcuugaugcuuuucuuuucuuuucuuuuucuuuuuuuuuuuuuuuuuuuuuuuugagauggagucucacucugucacccaggcuagagugcaguggcacaaucucagcucacugcaagcuccgccugccggguucacgccauucuccugccuuagccucccgaguagcugggacuacaggcaccugccaccauacccggcuaauuuuuuguauuuuuaguagagauggaguuucacuguguuagccagguuggucuugaucuccugaccucauguuccgcccgccucgaccucccaaaguguugggauuacaggcgugagccaccgugaccagccuagcuugcugcuuuucuuaauggcuccguguugucuuauuaaccuacuagaaaacaaguugucuuuaguuucucccccaguacccccacuacuaucugauaauuuucuuggccaguuguauaucagagugggaaggcaguguuuggaaguaguuugcccugguauaaaggcauuauuccucauaggaaauaggaaguauguuuuuuauagcgaauuuaagcuugucugcuuuuuauuuuuuauuuauuuauuuuuuauuauacuuuaaguuuuaggguacauaugcacaacgugcagguuaguuacauauguauacaugugccauguuggugugcugcacccaucagcucguagcuugucugcuuuuaaucuuaaaugacaucagugguacaauacuauuugcuguuagggaucuauagacucuuuccacuuucuucugcuaugccacugcucuuaguugagguuauacuaugucaucuugagguuuuuguuguuguuguuguuuuaaugccuaguuaucugggugaggaauagagaaagauguucuaccucuuucacagagugaacaauaggauuguaccauuggaaaucuuuuuuauuuagugguagauuaugucauuuugagucucuuuagaaagaaauucuuuagaaagucauauuuuaagaggaauauugauaaacugggucaucucuagagaugucagccaggauauuggauaucaaauauuuggaggccacuaaagaaggaaaguuuacaucugcuuagaagugaaauaaugaauuaauauacuuucauauaaaauaaugaauuugggguucuggcauuguuugaaugaauagaggccauuggucacguugaagaggaguuccuuugagagcugagggaucucuucucugccuuuucaaaucuuuuaugauucagagguuuuaugauuuuuccauaguuaacugcuuugccauaagugguuguuugcuuaaaaucagaauuguggggugccuuauauuuuaaacagcauauuugaaaaauaaucuaauuuuuuucuucuguuccacaggacuuaaauacuauuuauucuuaucuucauggaauggaaauauuaucaaaucucagggaacaucagcuuagguaagugucguucuguauuuaagagcacacgcuguauagccauucauucauuuauucaccaaauauuuguuaagcaccuuuauauuccuuauuguuuuaagcccuugguauaugcauuauagauuagaucccugguuuccuggaguuuauauuuugguaggggugauuuuggaguuggggaaaaacacugacaauaaaaacugaauuuguuuuucuuauucaguuuuucuuagccaugggaccuuaagucagaacuaaccuuuaacugugguuuugucuucaauaaaauagggguaaugauaguaucuuuguugaaguauuucaaggauuaaaugaaaauaaguaccuaaagcaaaacacaguguugagguugugcuaguuaguaaagacaaaacuccuguuaucuuuuuguaguuuguguugauauuuauuaugccaaaugcuucagcuggguaugguauguuguauuauaguguuguauuauacaagugaaaggagcaggaaucuugauuuggccuaagcuccuguggagaaaacccauaaacuuucugaaccuuguuuuuuucuucugaaaaaugggcuggcuaucuguccugguuaucauauaucauuaugauuauauuuauaaaaacacuuucgagugcuauaaaacacuuaacuauauaauauuuuaauuaaacauguguucccaccacgaacagcuuauccagugacuuuuccuggguuuucaucaaguuucugguuauugaccagauugauaaaauauaauuauuagagauuuauuauuuauuauauauuuucuguauaacauaauucagcuguuaguguaugccaaauaauuauaucaggaagaaagaaaacugaaaaauuagcauuuuguaauacucaaaauauuuuuuauugcaaacugauuuauauauucagcaauuuuuuuguauguacaugccucugccaguaacuguucuucacacugaggauucaguagugaaucagacaaauguauauuuuuuguaaugaaaacauuauuuggugugaacugacagauuuugacagauuuuguaauguacauaaagaguauuaagguugaugccacugaauauuaccuauauuauugcauuauguauauauauaaaauacacauauauuucuaaacucucuguaguuuagugacaacauacugguagauuuggucauuuucuaacaaucaauuagauuauaauaauuaguugaggucaaauuauaacaauuuuaaaaacaaaauguaagauaaaaucuucaauuuuuuuuuuuaauagauuaaugucugcaagagcacgcuaugagagauacaguggcaaucagguucucuuuugguaaguauuuccauaauucacauaaacuaaugacuuuuauguuuaaauuuuaacucuuagcauugaaauucauuugauucugggacaauuuauguagagcacacugaaaaauauucauagaccaugaaguauauaacauacauagaauccaccaaaaguguacaaagcaaugaauuuuaauaaauauauacuaaauguguaaugacuacucagaugaaaauagagauaccaguuuuccagaaggcucuaaucaacuuugaaagguaaugacaauucugacuuguaucacuguagguuaguuuugccacuuauugaacuugguauagagagaaucuuuuggugaugcuuuuuuacuuaauaaauauccaaauuuuucuguuuuuguauguguucuuuuucacugcuguacaauauauaauugugugcaaauaaugauuuguuugucccuuccacuguuaauaguuggguuauuucuaguuuucuuuuuguuuguuuguuuguuuguuuuugagauggaguuucgcacuugucgcccaggcuggagugcaauggcauaaucuuggcucacugcaacuuccgccucccagguucaagugauucuggugccucaaccucccaaguagcuggguuuacgggcauuagccgccaugccuggcuacuuuuuguaucuuuaguagagaugagguuuuaccauguuggucaggcuggucucagacuucugaccucaggugauccaccugccucggccucccaaagcgcuggaauuacaggugugagccaccgugccuggccaauuucuaauuuuuaguauuauaaauaauacaguuucuauuaacauucuguuauuuuugugcccuuauugcuuacuccuguugaggauauuccuaggaauaaaauuauggucaugugccacauaacguuguuucagucagugauggacuauugugucaaguugccugcaguauucaguagaguaacaugccgugcaaguauguaaacuaggagcaauaggcuauaccauauaaccuagauguauaguaggcuauaccaucuucuagguuuguguuaaguacacucuaugauguuagcaugaugaaaucaucuaaugaugcauuuuucagaaaguaucaccaucauuaagcaaggcaugacuguaguggaaaugugcauguucaaauucaggagauugugacaguuuuuuaaaauuaguuguaccaauuuuuuuuuuuuuuuuuugagacggagucucgcucugucgcccaggcuggaguacacuggcacaaucucagcucacugcaagcuccgccuccuggguucgugccauucuccugccucagccuccugaguagcugggacuacaggugcccaccaccaugcccagcuaauuuuuuuuguauuuuuaguagagacgggguuucacuguguuagccaggauggucucgaucuccugaccucaugaucugccugccucagccucccaaggugcuaugauuacaggcgugagccacugcgcccggccaauugugccaauuuuaauaaccauuagcuguguauaguuaaguuccaguugcucuacauguuugacaacccuuaauguuuguguuuuauuguuugcuuauuuugaauuuuugcuacucugcugcugauuacauuauguuaguucauugugauuuuauuuuacauuuuccuguuacuaaugaugaugaaugacauuuauguuucuaucagguauuuggauagcuucuuuuauuaauuggguugucuuuaucauuucuguugauuuguaaaaguuauuuuugaauucugaguggaaguccuuuguuggguaugucuagucuauuaucuauuuccacugugccacuuuuccuuuuuuuuuuuuuuuuuugagacggagucucgcucuugucacugaggcuggagugcaauggugugaccuuggcucacugcaaccucugccucucggguucaagggauucuccugcuucagccucccgaguagcugggauuacaggcgcccgccaccaugcccagcuuauuuuuuguauuuuuaguagagaugggguuucaccauguuggucaggcuggucuugaacucgugaccucaggugauccacccgccucggccucccaaagugcugggauuacaggcgugagccaccgcucccagccuucuuuuuuuuuuuuuuugaaauggaguuuucuugcguugcccaggccagucuugaacuccuaggcucaagagauccuccugcuucagacucccgaggauuacaggcauacgccacuacacccagcucuuuuugcucuauuauuggcaucuuuugagaaagaguaauuccuuucucaacuuguccccuugugauuagggccuuuuguguccuguuuuaaaaaaaaucaaaucuuuccuuucuucaugauugcgaagauuuucuuuguuucuccuccaaaaguuugguguuuucugucucaaauauagaucuacaauucaucuuggaauugaguuuuacuuuugaugugagguagaauucaagauucauuuuucuuaauuuuaaaaauauuuauuagucauuuuaaauuuaaugagaaacccaucacguuucuuuuuuuccuuccuuccuuccuuccuucgcucccuccuccucuccucuucucuccucuucucuccccucccuuccccuccccucuccucuccucucuuuucccucccucccucccucccuuccuuccuuccuuccuuccuucucguuaguucuuuucgucucaccaugucacccagguuggagugcaguggcgcgaucucggcuuacuacaaccuccgccuccuggguucauacgauucuccugccucagccuccgaaguagcugagacuacaggcgcgugccaccacgucuggcuaauuuuuguauuuuuaguagagaugggguuucaccacauuggccaggcuggucuugaacucgugaccucaggugaucugccugccucggccucccaaagugcugggauuacaggcaugagccacugcgcccagccucauuacauguuaacacaauuaacauuuaugagaaagaacuauuuucauaaaagauuuaauuauaguuuagcaaaucuaauaucuuucugacauuaaucggauugucauaucuguugcauucagucuguugugauauauuuuuugaaugaaagaaaucuucauacagagaaguuguuaaaacaaaaaaaaaugcgggaaaguucuuuucagauaaguuggguauucuucuuuaaaacaguaccaaaacuugacagguugcuuacagauuaguuucaguauggggucugagacuuuauccaugaacuuuuuacuguguugcauuagaaacaauuggucuaucuugcacauugaauaaaucauuucucuauguuugauuuuuguaaugccaugcguuggccauuuggaaaauauucaugguccugguguauguaguuuuucucauuuuggcacuuuaaaaaaaaauuuaucaaaaauggcauugcuaauaucaccaccagccucuucugaaaaguuuagggaagugucaagcucacaguaauggauacaaauuuucuaaaauguaaauuguugauugaaggcauggauuuuauuauuggcaagauucauuagguaucccuauggacauccaguugauccagcaccauuuauugaaaaacuaucuuuuucucucuugcgcugcaguguccacuuuguguuaaauuaagugaccccguguguguagguguguguguguguaucucuguguggucucuuuauuuugcucaauuguuuauugcucauuuguuuauuguuuauuuugcucauuuguuuauuuugcucaugccuguguucaugcaaguacugcacugucaagcuguguaguuugaguuuuuuuguuuguucguuuuguuguuguuguuguuuuuuguuuuugagacagagucucacucugucacccaggcuggagugcaguggcaaaaucucggcucacugcaaccucugcauccuggguucaagcgauucucaugccucagccucccgaguagcugggaccacaggcguggaccaccaugcccggcuacuuuuuguauuuuuaguagagacaggauuuaguaaagacgggguuucaccacguuggccaggcuggucucaaacuccuggcaucaaguaauccgcccgucucugccucccaaaaugcugaaauuacaggcgugagcccccacgcucggccuaagcuguguguuuugauaucugauagcaugaguuuguauucaguagaguaacucaggcuuguacucaggcuuguucuucaagauugucuuggcuaucacuguugcuuugccuuucuguguaaauucuagaaucagcuugucaauuuccacacacaguuauacacaagaaagccuuugggaggcugugggcuuuggauuaggauagcauuaaauccauaaaucaauucagagagaaaugacguuguuacaaugaaucugucaaucugcaaacauguauauucuuccauuuauuuagucuucuuuaauucuucacagcaguguuuuaggaggguguuuuuccaacauaaacaguuugagcaguuuuuucuguaacacuuuuaagauguuuuaucauguucuugcuucuauuuauguugaagacucaguaaucaguguucuuguuacuccuuugcaguuaauauguuuuuuccucugacugcuucugagauuuuucuugcuuuuugcuuuucagcaguuuugucuaauguugcuagguaugguuuucuuuggauuuauucuguuuaggguuuauagaucuucaugauacccugauuugauaucuuucaucgauuuuggaaaauucuuacagaguauuuuaaaaauuauugcuucuguccuguuuucucuuuccuccuuccugcuuuauuuugucccauauuuccuuuacacuguuuuccaucuucccguccuuuuuucugucuguguuucagucucccauuuucuacugccuuauuuucuaauuugugaauuucugucuucugcuguuucuagucuaaaauacccacucaugugaauuuuuaaguuuuaauuguaguuuuucaauucuagauuuucauuucuguuucauagauaccaguucuuugguugaauccaucaucuguuuuccuuuuuucuugaacguaauaaauauagcagguuuuuuuucuguugguuuuagguuauuuggucucauuuccagcaauguugauacuuuuuuuaacuuuuuaaucgacacauuauaguuguguauauuuauggaguacaaguugguauuccaauacaguuauguguuauauaauauacaaauuaggguaguuagcauauccaucaccucauacauuuaaucauuuuuugguggugaaaacauucaaaagccucucuucuagcuauuuuguaauauacaguacuuuacuguuaaccauaauaauccuacugugcaauggaacaccagaauuuauuuuucuuauuuuguuguaacuuuguacccacuacccaaccucuccucaucuuucucucccaccuccccacuccagucucugguaaccacaguucuacuccacuucuaugguaucaacuuuuuauuuuuuagauuccacguauaagugauauucugcaguauuugccucucuaugucugucuuauuucacuuaacauaauauccuccaguuccauccauauugcugcaaaugacaggauuucauucuuuucauggcugaaugauacucuauugaguauauauaccccauuuucuuuaucuguucauucauuguuggacacuuggguugagucuguauuuuggcuauuguaaaauaugggagugcagauauuucuguaacauacugauuucauuuccuuuggauauguauccaguaguaggauugcaggauuaccuagaaguuccauuuuuuuuuuuuuuaguaaccuccauauuguuuuccauaauaacuacuaauuuacguucccaccaacaguguauaaguguucccuucuccugaaauccucgccaacacuuguuuucgucuuuuugaugguagccauucucacuggaaugaaguggugucuuguugugauuugaguuugcauuucccugaugauuaguuuauuugaauauuuuuuuauauaccuauuggcuauuuuuaugucuuuucagaaaugucuguugagcuauuuugcccauuuuuaaucaguuuuuuuuugcuauuaaguuuuuuauauauucuggauauuaacccauugucagagguauaguuugcaauucucuccuauuucuguagguugucuauucauuuugucaguuguuuccuuugcugcgcaaaaacuuuuuaguuugauguaaucagauuuaucuguuuuuguuucuguugccuguguuuugaggucuucgcuuuaaaaauccuugccuagcacaguguuguauagcauuuuccccuauuuucuuccaguagauuucgugguuucagguuucacauuuaagucuuuaauccauuuugaguugauuuuuguauauagugagagguaggaguuuagucuuauucuucugcaaggagauauacauuuucuaagugucuuuggcaccuuuuuugaaaaucaguugucuguuuaauucugggauauccauucugcucuauuggucuguuuuuaugucaguaccaugcuuuuuugguugcaguagcuuuguaguauauuuugaggucuaucgaucuguccauugcugaaaguaggguauuugcauucccugcuauuacucuauuauagucugucucucccuuuauaucuaaugauauuugcuuuacaagcuugggcacuccaguguuugggguguguguguuaauauauacuguaaauauauauaugagacacaaauauauauuauauaaugauuauauaauauauauuauaaauaauguaauuguuauaucuuccuguugaauugaucccuuuaucauuauauaaucaccuuuucugucucuuuuuacaguuuuugacuuaaaguaagcauggcuacuccuguuugcuuuggcuuuccauuugcauggaugucuuuuucuauccuuuaacuuuuuuuuuuuuuuuuauaugauggagucucgcacugcuccccaggguggagcacaguggugcgaccuuggcucacugcacccucugccuccuguguucaagcgauucuugugcuucagccucccaaguagcugguauuacaggcgcguaccaccacacccagcuaauuuuuguauuuuuuaguagagacaggguuucgccauguuggccaggcuggucuugaacuccugaccucaagugaucugccugucucagccucccaaagugcuaggauuacaggcauaagccacugcacccaaccucugucccuuaacuuucaaucuaugucuuuaacagugaggugagucuguuauacgcagcauacauuuggguuuuauuauccauucagccauucuauaucuauuaauuggaggagcuuacccaguuacauucaaggcuguuauuuauagguaaggauuuauuccugccuuuguguuaaugguuuucugguuguuuuauagauuuuuuuuucuguagccuucuuucucucuuguucaucucugugguuuuguggcucacuguggugcuauacuuuguuuccuuucucuuucuccuuuguguaucugcuguacuuacuuuauguuuacuauagagcuagcauaaagacucuuguuauaaugcacuauuuuaagcugauagcaaauuaacuuuggucucuguauuacuccauucucacgcugucauaaagaacuaccugagacuggguaauuugugaagaaaagagguuuaauuuacucacaguuccacaggcuucacaggaagcaugagugggaggucuuaggaaacuuacaaucacagcagaaggugaaggggaaacaagcacuccuuaccacggugagcaggagacagagagagaaugcgauggggggaaaugccacacuuaaaccaucagaucuuguggaacucacugucaugagaacagcaugggggaaaaucuguccccaugauccagucgccucccaccaggucccuccccugacacaugaggauuacaauucaacaugagauuugaguggggacauagagccaaaccauauuauuccaccacuggccccucccaaaucucauguccuucucacauuugaaaaccaaucaugccuucccagcagucccccaaagucuuaacucaauccagcauuaacuuaaaaguccaaguccaaagucucaucugagacaugggaagucccuuccaccuaugagccuguaaaaucaaaaacaaguuacuuccaaaauacaauggagauacaggcaugggguaaaugcuccuguuccaaaugguagaaauuggccaaaauaaaggggcuacaggucccaugcuaguccgaaacccagcagggcagucauuaaaucuuaaagcuuccaaauaaccuccguugacuccaugucucacauccagggcacccugaggcaaguggugggcucccaaggccuugagcagcucugccccuguggcucugcaggguacagccccuguggcuaccuucaugggcuggcguugagugccuguggcuuuucuaggcuccuagugcaaacugugguucuaccauucuggggucugaaggacaauggcccccuuuucgcagcuccacuagauagugccccaguggggacucugugugggggcuccaaccccacauuuucccucugcacugcccuaguggagguucuccaugagggcucugccucuacagcacacuucuuccuggacauccaggcauuuccauacauccucugaaaucugggcagagauucccaaaccucaacuuuugaccucugcguacccgcaggcccaacaccauguggaagccgccaaggcuugaggcuugcagccucugauucaauggcuugagcuauacuguuggccccuuuuggccacacaguuuuaaacuagcaaaucuugugagagcucacuaucaugagaacagcaugcgguaaaucugcccccagauggagcuggagcagcugggaugcaggguaccauguccugaggcuacacagaguagcaggguccugggcccagcccaugaaucauuuuugguuggccucugggccugugauaggagaggcugccuugaaagacucugaaaugcccuggaaacauuuuccccauuguguuggcuauuaacauuuggcuccuuuugugcacauuucugcagcgggcuugaauuucuccccagagaaugggguuuucuuuucuaccacauuaucaggcugcaaauuuucuaaacuuuuaugcucugcuucccuuuaaaauauaaguuccaguuucagauaaucucuuuguucaugcauaugaacguacacuuuuagaaacaaucagaucaccucuugaaugcuuugcugcuuagaaauuucuucucccagauacccuaaaucaugucucaaguucuaaguuccauagaucuguagggcaggggcaaaaugccaccagucuaauugcuaaagcauagcaagagugaccuuuacuccaguuuccaguaaguuccucaucuccaucugagaucaccucagccuggacuucauuguuuauaucacuuaucaguauuuuggucaaaagcauucaacaagucucuaggaaguuccaaacuuuuccacaucuuuucugucuuuuucugaguccuccaaaccauuccagccucugcccguuacccaguuccaaagucacuucuacauuuucagguaucuuuguagcagugccccacuauuacuaauaauuuguauuucuauuauugcacauauaauuauagcaaaauuagaaaacauaggcagugagaaaaacuucaucugaaacuuuguugugaagaauaagaaugauuucucugugguaaauuccuugggauaacauuguggagcuaaagguuaugacauccuuguggcuugugcugaagauuccuauauugauuuggaaaaaggguuuuggugauuuugauuuguaguauuaguaagcagugaauaaauuuuuaucacagccccuguaaaauggauacuauauguggauuugguuaguauuuuagaguuguuuucauuugcauuuucuguuuacuagugacucuguguucuguguagcuguuaagaauugucuguuuuaaucuucuguucauuuacuacuugaaauaguaaugcauuucugugaguacugauaccuauuacagguauuaucuuuaauuguaucacauuugaaaauuauuuucuguucaucuuuuuguuguauucaaguuuuaacuuguaugugcuaauauacuucagaauuaaauguuauuuucuucuacaagugugauacaauucuucuguuuucuuuuuuucuaggaaacauguuucuuaauugcuuucuuagcuuuaaagcuuuaauuaaacugaaauuuauuucaaggaacaguauaaacaaugauuguuguuuuuugcuaaaauguauuuccaaaauacuuuauucacuuuaaguauugguguuuuauaguauguaucuuaagauagugauuauacuuuuauuucacauaaacguggucuguauaaaaccuuaggcaacaggcaaaauauuccaaauuuccagguaguguuacuucauuuuuaauuauuuguacuauuaucagaauauauuucuuauugaauucauauacauaugaacauguguguuguuuugcucauuuauuuacuuauuuauuuaaacaguucagaaacgauugccagauguugguauauccuacuuucuggaucugugcuugugaaaggcuccauggucuugccuccuugcagguacguuuacauuugcuauauggcaggcaaaguuaauguuaaacuauuuuguauaggauguauauuuucuuucaguaagugauacaucuuuuaaaugucuuugcuuguuggcaccauuggaaauacuuggcaggaaucaguuaaucuuuuguuauuucugaggguauaaucuguaagcuuacaccaugacaugauaucuucuuccugucugaaaauuaguuuuauggggcugggcacgguggcucacaccuguaaucccagcacuuugggagacugaugcgggcggaucaccugaggucgggaguucgagacuagucugaccaauguggagaaaccccgucucuauuaaaauacaaaauuagcuaggugugguggcgcauaccuguaauuccagcuacucagaaggcugaggcaggagacucgcuugaaccugggagguggagguugccgugagcugagaccacgccauuacacuccagccugggcaacaagagcgaaacuccaucuccaaagaaaaaaaaauuaguuuuauguacgauuugaucugauuuaucuaauugguuuuugauucauugcuguuauuggguguagagaggugauauaauaguuaagaaauugguuuuuggaguaaaucaacuagauuaaaauucugauuccaucacuaguuaugugacuuuggacaaauuuuaguuuucuuggcugacaaaugggaauaauaaugguaccuacuuaaguauugucaugagguguuaggaaacuacuacaaauguucucaacagaagucuauaaggguucacacucuggagccagacuucaugaguucauaucugcucuacuguuucuugggcagauuacuuaauuucuuugugccuuacuuugcucauuuguaaaaugagcauaauaauacaaccucuuucauagcauaagcuaguucugagaaauaaaugacuuacucuacauaaagcucuuagaacagugccuggcuguuagaaguaauuguuaauuauuuuaacuauuagguaaaagagaagggugguagaaagaaggucaguuguggaauucuguuaguaauuauuaagauuuuagggccucaacguaugcuuuagugacauaaaaauguaauuuuuugugacuuuuuucccaaaauguugagaagaaauuucuaggcuuuuaaaguaagacuuccaauuguaguuaauuuaguggcauaacuauuuaacauaaauaucaggauaugggacaucucaauuuaaauaucauuuuagaagucaugccuugacuccugaaacuuuacaucauuggccuuugguuaaaugaaaugugcuaauugaccaguugaauaacacauauaguugacuguauuuauaaauauauaguaguucuuggcuuuuuuugagcuuuuuggccauuguuccuuuucccuguauuugugaaacucacauuaaugaauuuguauuguuagucccugagaacugaauaugcuggauugauauugccuaugguuauauuuuaagauuauuaguauuuuucuguugaacacuccugcuguucugaauggucaagaucuuuguuaugaggacuuuuaauagcccuuaaucaacugcaauaauucacuacuaguuugugaucaagacaaugaaguuuaucuuuuuaaguaaauaaucagaauguuugagauuuuagaaaaaucaugguaugcauuaauguaaucauaaacuucacaggaaacaugauuauggaaguuuaaucuuuauucuaaagaauaauacugauuagggaauuuaucuuuugugugaaagauuuauaauaggcuauuguagguucauuuuuaggauuugugaguuacuauaacaaauaaacuaccuggaauaaugcuuagcauauauuaagcaucaaguaauuuuuggcuucuucagucagaauacagaaaccauaccguaauuggaacaagugaaguuugauuuuuuuauuauuaugauuuuuuaaauuugagacagagucgcuguugcccaggcuggagggcaguggcaugaucuuggcucacugcaaccugcgccuucuggguucaagcaauucugccuuagccuuccgaauagcugggauuacaggugugugccaccacacccagcuaauuuuuguauuuuuaguaaagacaggguuucaccauguuggcuagacuggucucaggcuccugaccucaagugaucugcccgccuugggcauuacagugcugugauuacagacaugagccacuguaccuggccugagcagguaaaguuuaauuuuaaaauuaaacuaguucaagggauuagcuacuaagaaggauaaagcagaauacccuacagcugagggcgaguucccaaagacaaaacaaacuugaaagggagacagaccccuuccucacgacuagaguugagacuugguugaagaauguuaguugcagcccaauaaauagcagagacauucacuggguugcucugggacagagcugguccacaguugucuggucaaggcuggcaggaaggggaagggaacugcugaccaggaguggcacuuaggagaccccccuuaccaggaugcagauggccccugaagcuggggacaggaaacagaagcccuccaauugcagaggaaagacuuucuuacugcaguguuacucuagcacccucugcugacaaaacuguaacauuuucagcuagcaaaggagaacauuuacacaauucucauccuuaucacaaaguauggcaauaaaggguagauuugaagcugagagccaguauguuuggagaggcaguaaauaacugucacaguccacuccccuggcugcucagcuuccuuaugaaugcuucuaaacacacuugaaauuccauucaacaaucugugucuacguaacaagacaaaacuauccuuuauacaaauggaguucuuacccucucccccaaauaaggagacacacaacaacaaucauugcuagcuauauuuguauguaaucugucauagugccucugaauauucuguuaacuaaagacuaccuuauaaaguuuaccuucaauaucuuauacuauauauauaguaagcaaagagaaaaugcaaaaagcuacuuacuacagucuuuguuucuauaaugggacacaaggcuauaguucauaucucugucuuucacuacccauucaguauuucuugccuuaacuaaaacuucagcuguucuguguccuuuacuuugugauuggaacaaaacuuuaauuuugaugugucuucaacuauccugccuuuuucuuaguugcuguaguuuuucauuaaccuuuuuuuuuuuaagacagagucucacucugucacccagguuggaaugcagugaugugaucccaguacacugcaaucucugccucccggguucuggcaauucuccugucucagucucccaaguagcugggauuacaggcaugcaccaccaugcccggcuaauuuuuauacuuuuuguggagacaggguaccauguuggccaggcuggucucaaacucuugaccucaagugaucugccucccuuggccucccagagugcuaggauuacaggugugagccaccucgccuggcuguuuuccauuaaucuuuauuguuuuuguuguuguuguuguuguuuuuuaagacggagucucacucuguugccaaggcuggagugcgguggcucagucucggcucaccucaaccucugccucccagguucaagugaucccucugcuucagcaucccaaguagcuaggacuguaggugugcaccaccacaccuggcuaauuuuuguauucuuaguagagaugagguuucaccauguuggccaggcuggucucgaccucuugaccucaagugauccaccugcguuggccucccaaagugcugggauuacagugugagccacccuacagugugagccaccgcaccuggccccauuaaucuuuaauagugggcauggcaauacuaacaggagcauaagagaauggccuaaguuccagauguagucuuucuugccuacauuuugugcaguaacccauuuuuccucugcuaauuggaaucagucacgugggccaguagacuaaccucuuuugcugccuguugguuuaaugacuagguagaagucucuaguucaguggaaccauuguuguguuuacugguagaagcaauacucuuuuguacacuaagccuccaaaccagcagagcuuagaguuguugggaggggaagcaaaaauagugugaaugaguuuaugagaggaaaauaaaucucaggacccccaaaucacuaagucaaagagaaaagucaagcugggaacagcauccagcaaaacugccucccauuuuauuccuaaauaagauagcuacaaaaauuuaaaaaaaaaaaaaagcuacauugcucccucaugauuuguccauaaggaaauaccuuguggaccuaagaucuuuacucuaaacagacugagggagcaaacccagcaaggccuuuccagauuuuucuuggccuauguagcauuccuuccuuccagguagggggcaggaccccucuggaaugaggguuuucaagggagaaaggagaguaacauuucuagguuuuauggcuuccuuuggggaagaggaguucuacuuucuaugacucaccuugggaaagagguuucuguuacucacuuugagggagaaagaggggcaagagaaggucagagacuuugccuuugagucguuucaauauccuuuaaagaacucaccgugccaaagcaccauauuuuggaguauuguuuucugaguuccaacaacucucuaguuuuagcucuuuuauugagaaauauaauauggggaaaagugcagauaacauaaaucuacauguuagugaguuacuauacauugaauguuugucuaaucacuacccauaucaagaaauugaacauugucauuaccuagaagcagcuuccaugccuuuucuuaaaucuacucucuuacuuuuccucaacaccaguuuccugaauuuuaaucagucuuguaucucugaagaguuuuggccuguggauauguauaccuuaguugaggguuauuauaaguaaugcagcugugaacauuuuuguauauuagaugcacauguggauacauuucuguuguauauacuuaacaaggaauuguuggcucacaguguuguaggacuuccuuuuaguucagcuaagagccgggucuuguuacacagccaugaaauacuaggcucacagacacuuugaaggaugagaauaauggaaucuauugggcaaaaaggaaaaaggggaaacaagaauucucugcaaaaccaauuucugcuaguaugcuucccaccuggcagauugaaucccagguaccaugcaggaagaggaggggccaggcucuuccucacagcaaagggcacagacuucuguggcuccaccccugugugugcuucucccagugugcaggccaguuagaauuuuucugggaaccccuuuacacuugacugucucaacagggugugccuacauuaagcuuuguuaauuccaaguugcauuccaaauugaugcacuaauuuacacacccaccaguggugugugagaguucccauuguuccacauucuaaccaacacuuaguaauacaagucuuuuuacuuuaaaguuuuuggcugcuuaauuucagucauucuuuucaauuuuauaguuuugauuugcauuuuaaugacugccgaugaauacauuuucauuagaaugacuuuuuuuuuuuaagauagagucuuacuuugucacccaggcuggagugcaguggcacaauuuuggcccacugcaaccuccaccucccagguucaagcaauucuccugccuaagccucccaaguagaugggaccacaggugcgugacaccacgcccaacuaaauuuuguauuuuuaguagagacaggguuucaccacugcuggccucaaguaauccaccugccuuggcuucccaaagugcugggauuagaggcuugagccuccauacccagccuagaaugaccuuuuuuguaaagugacuucucaggucuguuccucauuuuccuaauaaguugucuuuuuguuuuugagauguagaaauuuuuuauauauucugaauaagaaaccuugcuugguuauuuuuguuggaaauacuuuuccccacucugucuuauucauugucguauucauucuguuaguaacgucuuuggaugaacaugagcucuuaauucuaauguagaaaaauuugucuuuccuguuucugagguugugaaccccaaaaaucugagacaggucuuaguucauuuagaaaguuuauuuugccaaggcugaggacgugugccugugacacagccucaggagguccucaugacaugugcucaagguggucagagcacaauuuuguuuuauacguuuuagggagacauaagaccucaaucaacauauguaagaucagcauugguucagucuggaaaggcaggacuacuugaaacagagagggggcuuccaggucauagguagauaagagacaaaugguugcuuuuuuuguuuguuuuuuggggacggaguuucgcucuugccgcccaggcuggggugcaauggcgcgaucuuggcucacugcacccuccaccucauggguucaagcuauucuccugccucagccuccccaguagcugggauuacaggugcccgccaccacacccagcuaauuuuuauauuuuuaguagagacgggguuucaccaucuuggccaggcuagucucgaacucgugaccucaggugauccauccaccucggccucccaaaaugcugggauuacaggugugagccacugugcccagcugguugcauuuuuguuuuuuuuugaguuucugauuagccccuccaaaggaggcaaucagguaugcauuuaucucagugagcagaggggugacuuugaauagaaugggaggcagcuuugcccuaagcaguuuccagcuugacuuuucccuuuagcuuagugauuugggaggcucaagauacuuugcuuucacaaggccauggagauauauauguauguauguauguauguauguauguauguauguauguauguauaguuuuuuuuuuuucuuauuuucuagaacuuuucuuguuuuccuuucacaguuaaaucuguagucuaccuggaauugaguuuuggguaugguauaauguugcgucguuuuccauagggauaccuagauguccuuuucucacucauuuagugccaccuuuuauguaaaucaaauauccacauaugugugugccaguuuuaauuuucauguuuuugaugaauaaugauguugaacacuuuuccuuaugcccuuaugcuuauuggccauugcuuucuguuuuuucuuuaauaaaguaucccuuaaauuuugugugccuguuguuaaacuccuguuauuacuguaacuguccaguggauucuuccugcccaccuguacagacaaaaccaauucacugagaccauggcauuguaauaaagaguuuaauugacacaaggcuggccacgcccugugggagauggaguuauuacucaaauucaucucucccaaaauuuggagguuaggauuuuuuaaggauaguuuggugggccagggaaucuggauucugggugaagccacaggacugguuagcaggaggucuguggguccugguggccacugaugaaucaucagaaaugcuaaaaaccugaaaagacaucucaauaggccaaucucaaauucuacaauagcacuguuacuugcaggaguaauugagggaguugcaaaucuugugacuuuuggaauaaugacugguaaucauuuaugucuacagcuuagcagaauucagcuccucauccuuguaaucugguggucuuucuuucauuagcuuuacaaaagcaguuuaguuaucauuuaaacuauaaauguuuccuaaaguuaggguggccggggccaaggaaugauugagggcaguuuagagguuaaaggaaagcuggguauugguuagaucagaucucuuucacugucauaauuuucuuaugguuauaacuuugcagaggcaguuucauuauuauucuauaagaaucuuucuacauccaggaugcaagcugucuguuaaccauuuuaucccauuaauuugacuugcauuuuuauuuauuuuuaaaacuuuauugaaguauaacugacauacacugaacagcacgauuuauaguauacaguuugauaagcuuuggcauauauaaacacauguaaaaccaccaguauuacaaagauaauaagcucuaucacuagaaaaaguuuccucaugccacuuuguaaacuuucccucucauaguucccugcucccuuccuuggucccaggccauuacucauuuuucaucaauguagauuaguuuacauguuauaaaauuuuuguguaaggugaaacauacaguauguacucuuuucucauucagcuucuugcacucaguaaaauuauuuugagguuuauccguguuauguguaucaauauuucauuucuucuuaaugcaguguucucucauggauguuaacaggaaaaccaaacucuguaaaauaucuuaaagagauuuauucugagccaguaugaauaaccauggccaggggaaaagacaaauucaggaagccuugaguaaguggcccuaaggugguugggcuacaguuugguuuuauauauuucagggaggcaggaguuaagaggcaaagacacaaaucaguauguggaagggauacaauuaguucagcccaaaaaggcaggaugucuugaagcaggggguuauagauuauagguggauccagagaaccuuaauugguuaaaggaguaaggcucugucgaaaauuuggaaucagcagaaaggaauguuuaaguuaagaaugcuauguccaagucaguuacaauaaaaugaccuguucagugacauuguuggucugcaggugugacuuaauccuugccuugcauggccuuaggucuuauuuauaauuuggcaucuuauugccacaaagggucuguuuugucagucuuaugaucucuguuuuaaaaaacaauuaauacucauaaguugugucuaaacuucacaauggaggggauauaacaaggcaugucugaccucccuucccaucauggcugggaacucaguuuucaagguuucucuggggugccccuggccaagaggggguccauuuagucgauugggguuuaggauuuuauuguuaguuuauauggauguuccacuauuuguuuagcauucaacugcugauggacauuugaguuguugacuguuauugacuauuuugcaaagaauguuguuauggacauuuguguacaagguauauggucauauacuuucaucucucugcauaauauguaggaguagauggcuagauuuuguacguguuuaugugaauacauacuuucauauauuuugaaaaauaccuagcaauaaguuauauggucgaugcauguuuaaccuuuaagaaagugccuuacucuucuccaaagcuguaucauuuuauauucucaccggcagucuaugagaauucauaucuuuuaugaagugucucugagccuuugacccauuuuugauaauaaaauucuuauuuugugcuucaaaaguucuguaugugcuucaaaaguucuuguaugcuauauguaaguccuuuaacagggauauaauuugcaaauauuuucucccuauuugugcauuguauuuucccucuuaauuguguuucaaagagcagaaguacuuaauuuugauguuaaguuuaucauuuuuuucccugaauggacuauguuuugggggucauauguaaaaucugcuauuaacccaagguugcaaauaauuuucuuaauuuuuuuuucuggaaguuuuacaguuuuagcuuuuacuaugaucuauuuaggugugugaucuauuuaaaccaauuuuuguauaugauaugagguguggaucuaauuuuaucuuuuugccugugcauccucaauuguuccagcaccauuuguugaugaaaauauuuuuucucuucuggauugccuuugcaccuuuauuagaauuuaauugacaguguauuuguggguauauuucccaacuuuuuguuucacuuauuuuucuaucuugauaccauaccacauuauccugauuacuguagcuuuauaauaaaucaugaaaucaggugguauguguuaccugcauccauauaagagaccaucugagcaggcuuagugugagcaacaaggcuauuuauucacuuggaugcagguaggcugagucugggaaaggagucagugaaugguggugggauuaucauugguucuuauagguuugggauaggugguggaguuaggagcaauuuuuugccggcaggggauggauauuacaaaguacauucucaagggcugggaggauguuacaaaauacauucacaagggugaggaggauguuacaaaguaacauacuuucacaagggcagggaggguguauugucacaaggguugguggggaggaauguuacaaaguacauucacaagggcagggaggaauguuaacaaaguacauuugcaaggauggggaauaucaccaaguacauuaucacaaggacugggggaaugucaccaugacuugaccauggugugcccagcucagaggaccuuacauuccugucuuuuuauguuaauaaugaagaaauaaaaugaaaaagaguagugaaaacuuggggugaaaauuuugggggcgguauggaggggugaugggugagguuucucagggcugcuuugagcuggauuaggggcggcacgggaaccuaagugggagagauuagacugaaguaagauguugggguaaggggugauauuguagaguuaaaagcagcauuuguuguguagagugauuagugauagccuggaugcaguuucguaggaauugagagauuaaucggaagacccaaggccugaguaagaagagaaggaggaagauagguauuagaggacuaacaauuggaagaagccaggauacucaguuagagaguagccagguggguccaguguaauuaguugccugauuagugaguuuuugagcucugucuuugaguuuuuugauguuauauaccaagccagauuaauuuaaguaaaaacaacacuuuucauuaagaaauauacagaguccuccuuuuucagcagugaguaaaucaaggccucggcgguucuagaggacagcugcggcuaaagagucaaccugagcuuggaggacagauaaaguuugugauaugucuguaaugcuagcagagaagucauuggagaggcugcggaauguugugacagagguugagaugccugcuauuccaguuccaagucugguaguggaggcagaaaguccuagauccacaaguaaagggauuacugggaugacucuuuuugucguguuggugucaugagggagacaggcaguuguucauucccaucugcaagcuggauuuuggggguaaggaagacuagaguacaugugcccuuccaguuggcggguaggcacauguggguggaagaggcacauaaaaagaagagaccuugugucagucagaacuggaaauguaaagugaaaaggugagaggguguacugcaagaggaguccugcaccccaaauccuagagauccagcaagggcagcagccauuagagguuguaaugggaacugauguugcaacugcguagagggagagguucuguucucaugguguaugagaaaacacauagugucuaugaauaaccuuucacugcuauucaccgugagaggugacaacgugcuggcggcccucucucgcucucaccgccuccucggcaucugcucuggccacgcuugaggagcccuucagcccgccgcugcacugugggagccccucucagggcuggcugaggcuggagccagcuuccucugcuuguagggaguuguggagggagaggggugggcaggaacaggggcugcgcucagcgcucgugcggccagcacaaguuccgggugggcgugggcuuggugggccccacacucggagugaccggcuggugcugccggcccugggcaguaaggggcuuaacacccgugccggcagcuguggaggaggcgcugguucccccagcacugccggccugcccaugccacgcucgaauucucaccaggccucagcugccucuccauggggcagagcuggggaccugcagcccgccaugcccgagcccccccccacagugggcucccacgcggcccgagccuccccaaugggugccacccccugcucugcggcgccuggucccaucgaccacccaagggcugaggagugcaggcgcgcagcuugggacugacgagcagcucugcccgcagcccuggugcuggguccacuaggcaaagccagcugggcuccugagucggguggggucuuggagaacuuuuaugucuagcuacaggauuguaaauguaccaaucagcacucugugucuagcucagggauuguauaugcgccaaucagcacucuguaucuagcuaaucuaguggggacguggagaacuuuuaugucuagcuaaaggauuguaaaugcaccauucagcacucugugucuagcuaaagguuuguaaaugcaccagucagugcucugugucuagcuaaucuaguggggacuuggagaacuuuuguuucuagcuaaaggauuguaaaugcaccagucagcacccugugucuagcucaagguuuguaaaugcaccaaucagugcucugugucuagcuaauguaguggggacuuggagaacuuuggugucuagcuagaggauuguaaaugcaccagucagcacucugucuagcucagggauuguaaacgcaccaaucagcacccugucaaaacggaccaaucagcucucuguaaaauggacuaaucagcucucuguaaaauggaccaaucagcaggauguggguggggccagauaagggaauaaaagcaggcugugccagccagcaggcaaccugcuccuguccccuuccacacuguggaaacuuuguucuuuugcuuuuugcaauaaaucuugcugcugcucacucuuuggguccauacugccuuuaugagcuuuaacacucaccgggaaggucugcagcuucacuccugaggccagcaagaccaugaacccaccagcaggaaugaacaacuccagacgggaggagcgaacaacuccagaggugccgccuuaagagcuguaacacucaccgcgaaggccugcagcuucacuccugaagccagcgagaccacgaacccgccagaagaaagaaacuccaaacacguccgaacaucagaaggaacaaacucuggacacaccaccuuuaagaacuguaacacucacuacgaggguccgcggcuucauucuugaaguuagugagaccaagaacccaccaauuucggacacaauggggcuggauauaagcaagcaagaggaggugcugggcagagagucagaugagcagggggagcaaagccaaggauugagugagaugcagaguaggugucuucuuaaacaauagugacugcuaauguuuuuuaguuugucaauaaugauagagggcuuaucaguaaugcgaaguuggaaugcucccaucuguuuguuaaugugcgugacuggguucuggagauaaagaauaaaggaacauuuggacgguggaaguuugccuaaagggauuccaguaagcuguuguuggaagaugcauaaaggaguggcaacagggauaguuguuugugugguuagggguccaaauauggggggauggaauugacauaaggagaaaggugccauaaguagaugcggaguaguguggcagcuuguuggugugaaaugucuggggaguucucaccaaaucugucuagaaaguaaagaaguuccucaggcagguaaagaugggggcuauuaaaggagguuuggaggugccgggagacaagagagguagcccagucagccuauagaguggggacaucuguguaagagcaggaagaaagggaaacacauagccaacaauucuuugcuagagaaggauuggaggcagugaggagagagugggugcaauugauaguaugcuggagguaacuagggagagguagagagugacuggagaauaggggcagggauaagagugaguagaaaaguuaaaaaaaaggacuucaucaggauagaagaauuggaguguaccuugccacugaagaucuucuauccacuccaagagagaguuaaggguggcgguuugaggaaaaaccagaagauaaucaguuacgaugguucggaggaaaaguguaaaccggcaguguaaacaagggcagggcauuuacgaguaguugagaauggugaauaggaguauaacuagacagaagauaguagggaugacaaguuuuuggggugcaguccaaguagugggggugacugcguaaagccauguugcaaaaaguaggguaaggacgaauagaccuaauaggaugaaaggauguauuaggcucauaaggguuauuacuguucuucagaaaugcgagugaguuuaagggaaguaggggagaguacuugugacuuccaagaggaagaggagggaucaggcuggcuguccaauggacacagcuuuauuccagaauggugaacccaauggggaggguccugcaggcggacggcaguuaggguacuguagaugacuaaguagggucugguccaucaagauuauagaguuugagggaucagauucuuaacaagaacugaucauccagcuagggugucuucauauggcugggaaucuggaguagacaagagaagauuagcagccuggcgaauuuccugucuagccugcuggaggacuggaagauagucgccuagagggcuggugucuggcacgagauugaggcccaacaagaagguacauccauauaaaaguucaaauggacuauacccuguagcuucuugaggacaggcucuaauucuaaggagggcaaaugguaaaaguacaguccagucuuuuuuaauuuggaggcugaguuuggugagguguuuuuaaaagaccauuaguucuuucuaccauuccugaagauuuaggaugguagggggaaugaagguuccacuggaugccgaaggccugggagacugcuugagggaccugacuaaugaaggccgguccguuaucggacuguauagaggugggaaggucaaacugaggaauuaugucugacaggaagaaaugacugcgguggccuucucagacccugugggccucuacccauccagugaauguaucuacccagaccaaaagguaucuuaguuuuuugagucggggcauauggguaaagucaaucugccagucuugugugggggcagauccucgagcuugaugugucggaaagggagggggccugagauaucccugaggggugguagaguagcagauggaacccugagaaauaauuuccuugaggauggauuuccaugauggaaaagaaaugagagguucuaagagaugggccauuggcuuguaacccacaugaaaaaggucaugaaagaaugauaagauagaaugagccugugaggcaggaaggaggaauuuuccuugauccaagaaccauuugccuugaguaggaagggauugauaaguaauaguuucagugggagaauaggugggagugauaaaugagaaggaaaaaaacuggucgugagggacagaugugagaauacuagcugcuacuuuugcugcauugucagcauaagcguugccucaagcagugggaucuggugaccuuugaugccccuugcggugaaugacuccggcuuccuugggcaguagagcagccuuaaggaggauucuuauuaaggaagcguugaugauggaggacccuuguguggugagaaaaccucuuucugcccauauaacagcauggugauguaggauguggaaagcauacuuggaauuaguguagauauugacauguagucccuuugcaagggugagagcccggguuaaagcaauaaguuuggcacguugagagguaguggaagcgggcagggcaggaagcuucagugacagauguggaagacacuacagcauagccugcccuugccgaugacuaacgauugggccuugaagaacuaccaucaguaaaccaagcgcagucuggauuaggaacaggaaagagggaaauauggggaaauggggagaaugccauauggauuagagagauacagucacgagguucagguuuggugcuagguauaaggugagaggccggguugaagucugugccaggaauaaugguaauuguaggaguuucaaugaauagugaguacgguugaaggagucgggcagaaaguauaugcuucaagugugaggagaaaaauagauuuugaaaguuaugagaguuguagagaguaaguggggaaugguuugugaucuugagggccucuagaaguauugaagugguggcugccacugcacguagacaugagggccagccuagaacugugagguuaaguuauuuggauaggaagacuacaggucaugggccugauuccuguguaagagaacuccgaccgcacagccuuguuuuucagccauauguaagaagaaggauugggaugaauuagggagugcuaaugugggagcuguuucuagggcugucuuuaaggaacaaaaagaagaauggggaaaggacuuagggucuguggggucagucagguuucccuuugugaguuuauauagugguuuaguuaggauggcaaaaccugguauccaaaggcgaaagugugcaaccacgccuaggaaggaaaggaguuguugcuuuguagaagggguugggguuucggagauuagcuggacacagcagggagagcacuuguguuuugaugaaggacuaugccaagaucgguaacggauggggaagaaaucugggcuuuagagggggauacgcgauacuucuuugagaacagauguugaaggagcaggaggauguccuguugggaagauucguaagaggggcugcagaggagaaggucguccauauauugaauaaggugagaaacggauggaaagaaaguagaucaugagaaagagcuugacuaaaguaaugggggcugucucugaagccuuggcaguacaguccagguggguugcugagauugguggcugucagggucaauccaugugaaagugaaaagagguuggaaugaggggugcaaaggaauagugaagaaagcaucuuugaggucgaggacagaauaaugaguuguggagggagguauggaggauaggagaguguauggguuuggcaccacaggcuggauagguaagacaauuugguuaauaaagcgaagauccugaaccaaccuguaagauuugucugguuucuggacagguaggauaggagaauuguaaggagaauuugugagcuuuaaaaggccaugcuguaacaggugagugauaacaggcuuuaguccucuuaaagccuguugugggaugggguacuggcguugagcgggguaagggugauuagguuuuaaugggaugguaaggggugccugauuggucgccaaggagggaguagagguaucccauacuuuuggauuaagguagggagggagacacgagaggaggauucaaaggaggccuugaaucggguaaaagggcagcaaugagguguggcuguaguccaggaauagucagggaaacagauaauuuaguuaaaaugucucggccuaauaagggaacugggcagguggggagaacuaaaaaagagugcauaaaagaauguuguccaaguuggcaccagaguuggggaguuuuaaggggucuugaagccuggcugucaauacccacaacaguuauggaggcaaggaaaacaggcccuugaaaagaagguaauguggaguggguagcccccguauugauuaaacagggaauggacuuacccuccacuguaagaguuacccgaagcucggcauccaugaugguccaggggucuuccaaggcgaucgggcagugucagucuucagccgcuaagccaagaucugggaaggaguuggccaaggaacauuggguuugagcuccaggagcuuuaggagcagcggcgaugugaauuggacaaucugacuuccaguggggucccgcacagauagggcacagcuuagaaggaaucccgggcugcaggcauucugaggcccaguggccaggcuuuuggcauuugaagcaagguccaugaggagguuuugauggagcccaugggagcuguggcuuggauguucugaagguuuuguaugcuggagacaugguuguggguugucucacagugaaggcaaguagcuguaauuuagagauacgcugcugcuugguggcuucuucucuguuauugaacaccuugaaggugagauuguuuaaauccuguugugggguuuaagggccagaauccaacuuuuggaauuuuuuccuaaugucaggaguggauugggugauaaaaugcauauuaaggauaagguggccuucuggccccucugggucuagggcuguaaagugucuaaggguagcugcuaagugggccaugaacugggcuggguuuucaucuuuaccguggguaguuuccuuuagccugucauaauuaacaacuuuguaugcugccuuuuugagccacuugacuaggcaggagacuguguaaucuugccuagcuauaccuggggaguccgucugguauugccaaugggaauccucucggggaacugcccuggugcccucuuggaagccuggcucaugaagccgguggguaucugcguaggacugggcuagaaaguaaacucuuucuuguucaucugaggagaggguagaggucaggacgaccucuccauuuaaauggagugacuccauuuaagucacuccagguuagauuguaggacugaguuagauauuggaauuccuguauauguuuaguggagucugaugagaaagacccuaaacgcuggcugauuugggaaaggucugauagagaaaaggggacacguacccugacuaugccuucagcuccagccaccucuguaagaggaaauuguugggcagguaggggagagcuaauugcuaaacgaaacuguaagccagaccaggugugaggaggggagguaauggaaggguuauagagugggggagcagaggcugccgaagaauugggaccugauucagccuggcaaggugcggccaggggagaaggagagaggucagaguggucaguggaaaaggaggauucagaggacucugagcuuggagcagagacugaaaggagcagaugggagagaaagaaggaaagucugggaugagucgcacugggagcagagacuagggagggagcgaaguguaaaaaaugcauggauguaaggcaccucagaccauuugcgcaauuuuugacaaaaauuaucuagguuuuguaagaagacaaaucgaaagugccauuucucuggccacuuggaacuauugucgaguuuguauuggggccaagugguauuacagaagaaaauaagacauuuagguuuuaggucagguguuaguugaagggguuuuagguuuuuaagaacacaggcuaagggggaagagggaggaauggauggcggaagguugcccauaguggagaagguaaauuuaaggacgaagguagagacauggagaaauggagaugggcagcuaccaggcuuccaguaggcgucccugacugagucuugggcuguaaugugggugagcagccaaagcaggcaugaucagccaaagcaggcaucuccacaguugaccugccaccaagggaaugugggugaaugaucaaggcaggcgucccuguggugaucagacaccaagggaagaugugucuucccaagucaguaaccgacgucagaguuuuuaaaugcucagauaaagugugucuccuuuuugucucuaccuggaagggagagaaacugaaauugaaaggagagagauugaagggaggcgagagagguuagguagagagcgaaaaaaccgcuuacccgagugugaagaaccgcuuaccgauuugaaauuggugagaugguccuuggacuggcuggucugaugacccagggucauagguggaucuccucacggagggagcgugaggacaggggaccggucucccgaaggaguuccccuguccuggguguucggcaccaaauguuacgcacguccauauaagugaccaccugagcaggcuuaguuugagcaacaaagcuguuuauucacuuggguucaagugggcugaguccaagaaaggagucagugaaagguggugggauuaucauagguucuuauagguuugagauaggcggugguguuaggagcaauuuuuugcaggcaggggauggauauuacaaaguacauucucaagggcugggaggauguuacaaaguaacauucacaagggcggggaggaauguuacaaaguacauucacaaggguacauuaucacaggcugggggcggugguggcgggaaugucacgauggcuugaccaugguguggccagcucagaggacuuaccaguauggauccuccaacuucguaaaaauuguuuugguuauuuguuuucauauguucuuugcaguuccguaugauuucuagcaucaguuuguuaauuaaaaacaaaaacaccugcugagguuuugauugggaaugcacugaaucuauaaaccaguuuagggagaagugaacaucuuaauaguugauucuuuuaaaccaugaaugagguacaucacuccauuuauuuaggucuuuaauuucucucaaugauguuuugcaguuuucaguguagagauauuguauaugcugaucuuacaucuugcaaccuuauuaaaucacuuauucuaauugcuguuuuauauuuuuuuaguauuuuuguacguaagugaucuugucaucugugaauaaacagcuucauuucuuauuuuugaauaagaauuuuugaauucagaucuuauuuugaucugaaugccuuuuauuucuuuuuccuuguuguacuaggggaaaacuauaguacauuguugugacagaguggagcaaacauccuuguugucaaucuauuaauaaaaaguaguugggggcggggcaugguggcuuacaccuguaaucgcagcauuuugggaggccaaggcggguggaucaccugaaguugggaguuugagaccaaccuggccaacguggugaaauccuggcucuacuaaaaauacaaaaauuaacccggugugguggcauguacccaagccaccuacuugggaggcugaggcacgagaauugcuugaaccugggaggcggagguugcagugaguggagauugcgccacugcauuccagccuggaugacagaaccagacucccucucaaaaaaaaaaaaaaaaaaaaguaguuggggaugaagacguggggaguuggaagcguucauucaguuuuucaccaacuguaaucuuagcucuaaauuuuucauagaugaccuuuaucugguugccccucuguaaucucuacuuuccacaccuucuucaucagacaaccacuguuuggcuuucuggagagagaguauuuuacauauagagagaguauuuuacuuaaaauuuaauuuucugcuauuuuauguaaauggaauauguuguauaguuuuuuaaucuaguuuuuuucauuuagcauaauguuuuuauagcucacccauguuuuagcacauaucaauucuagcauguccauuuuuuaaauuguugauacugcauuuugucuauccauucagaagauuuuaaaaauugaaaauuuuaguuuuaauuuggggcugucacaaaaaugcuucuaucaaaauuuacauaaaagucuuuauauggccauguguuuucacuucuuuauuauagauaugcaggaguagaauugcuguguuauguaaguacauguuuaacuucuugggaaaagaccaaauuguuuauaaaaugacuguaccauuuuacauucugaccaccacuugguauugacagucuuuuauauuauuugccauucugguguauauuuaacagugucuuacugugauguuaauuuguaguucaguagugaugagugauguagggggucuuuuuaugugcuuacuagacauuccuguaucuucuuuggugaaaugucuauucagacauuuucuccauuuuuaaauuguacugucuuaucaaauuguaagaauguaucuauuuuggauccaaguucuaugucauauauguaguuuucauauaauuucucucagucucuggcuuuuuuuuuuuuuuuuuuuuuuuuuuuugagacagagucuugcucugcuccgcagguuggaguacaguggugugaucucagcucacugcaaccucugccucccggggucaagcaauucuccugccucagccucccaaguagcugggauugcaaaugcccacuacuacgccuggcuaauuuuucuauuuuuaguagagauggggguugcaccacguuggccaggcuggccucaaacuccugaccucaagugaucugcccaccucagccucccaaagugcugggauuacaggcgugugccaccgugcccagccagucugugacuucuuaauagugucuuuugaagcauaaaacuuuaauauugaugauaucuacuuuaagguuuauuuuugagaauagagcuuuuggugucauagcuaagaaaucuucaaccucacgauuauuucaucuuacaguuuuuucuaaaaguuuuaaaauuuaguucuuacauuuuggucugugauccauugugaguuaauuuuuuguuuuguuuguauauauauauuuuugcauauggauauuugcauauucauuuuaccuagcaugguuuauugaaaaggcuguuuuuuuccccauugaauugccuugguaccuuuguugaaaaucaguuaaccauaaauauguguguuuguuuucuguaccauuuguucugucuccuuuaacuauuuuucugucuugguaccaauccugacugucuugauuauuguagcuuuauuguaacuucaaauccaguaagucuuacaacuuuguucguuuuuauaauggcuuuggcuauuuuagguuuuuguauauucauauacauuuaaggauuugcuugucaauuuauaccguaaagccuguugggguuuugauaggaaaugauuugaaucuauagauuaauuuggggagaauugcagucuuaacuauauuguguuuccagccuaugaacauggcuugcuucugcauauauuuaucuuuuauuucuuucagcaauauuuuguauuuuucaguguauaagucuuacacuuuuguuaaaucauuuccaaauauuuuauucuucuuaauaggauuaugaauggaauuguaucuuaauuucauuuucauauuauucauugcuaguauauagaaauacaguugguuuuugcauauugaucuuauauccugugaccuugauauaaucuuuuauuagaucuaguaguuuauauuuguagauuccuuagaauuuucuacaugcaggaucagucuacuauguuaaacauaguuucauuucuuucuuuccagucuguaugccuuuaaugucuuuucuugccuuauuguacuggugagagucuccaguauggaguagauuggaaguggugagaguggaccaccuuugcuuguuccugaagcauauugcaaucccacagauuaaccaucaagaauauaacaaaaaucagccagguacaguguggcucaugccuguaauaccagugguuugagaggccaaggccagaggaucacuugaggccaggaguuugagaucugcuugucaacauagggagaccccugucucuacaaaaaaacguguguggugguguacacuugcagucuuugcuacucaagaggcugaggcgagaggauagcuugagcccaggaguuuuaggcugcagugagcuaugaucaugccacuucacuccaacucagcaacagaaugagacccuaucucuaaaaaaaaaaaauaacaaaaauaacauuuaaaaaaucaacaaaggaauuaaaaugggauacuaaacaaaaauauuugacagaaaugauaguaguacaggaagaacagaggaacaaaacagaugagacauuuaaaaaauaggaaaauggaagacauaauccagacaaguuaguaauuucauuacaugugcauagucuaaauauuccaaucaaaagagauuaucagguucugugacaauucaaaauccuauuaucugcuguauacaggaaacacacuuuagcuguaaaagcacaaauaaguugaaaaggauugagagauauaccaggcaaacuauauucaugagagaacuagagccugagucaaaauagauuuuaagacaagaaauauuacuagagaccagaagcaaaauuucguaguguuaaaaggauuaauacauuaggaauacauagcaauuuuuauuguauauuuaauagcagagcuucaaaauauaugaaguaaaaacugacagaauugaaaggauuaguaggaguucaacuauuauaguuugugauuucaaaagucuuucaauaauagaaccacuagacugaaaauuaguaaagguauagcuugaaaaguauuaccaaccacuuugaucugauauauaaucuuuuuuuucaagauuuaugggucauucuccaggauagggcguauaaucuaguaacauaacacaagucucauuacauugaaaggaaugaaaucauuugaaguuuguccacugacuacagugcaauucuguuauaaaucaauaucagaaagaaauaggagaacuuagauaacauuuguaaaugaauaauagaccaaggaagacuucaagagaaauuagaagaaaauauuuugaacacaguggaagugaacacacaucaaaauuuaugggaugcagcuaaagcaguacuuucagggaaauuuagaucauauuuaugagaaaagaaugguuuugaucuagucaucuuaagaaugaaaagaacagaguauacucaaaagcaagcucaaggaagguucaaguggaaaucaaugaaauaaacacaagaaagauaacagagaaacaucauugaaacaaaaaguuggcucuuucaaaaguuuaacaaaacuugauaaacuuugaguuagacugaccaugaaaaaaaagauacaaauuuccagaaucaggcauaaaagaggggacauuaacauccuaaagaaauuuuaaauauuacaaaggauuuuuuuuuuuuuuuugagacaagaguuuugcucuugucgcccaggcuggagugcaauggcaugaucuuggcucacugcaaacuccacuucccggguucaagugauucuccugccucagccuccugaguagcuaagauuacaggugcauaccaccacgcccagauaaauuuuguauuuuuaguagagacaggccaggcuggucucgaacuccugaccucaggugauccaccugccucggcuucccaaagugcugggauuauaggugucagccaccgcgcccggccuacaaaggaaauuuaugaucaacuugcuaucaauaaauugggcaaaucuugcaaagacauacauuacaaaaaaaggcucaaaaaaaaaaaagaaaaagaaacuuugaguacagagagaagucuagacccagauaacuuuacagcugaauguuuucaaacauaagaagcauuauuacauacauuccaaaagacuuuguauuaggguaaugguagagaaaaugcuuucagcucauuucuguuaguccaguauuacugcuaccaauacuaggcaaaaaucacaagaaaaaaaauuccagauuauuauuccucaugaauauacaugcggaaauuguuaacagaauaacagaaaacagaauccugguuuauauuuaaaguauuuuauaccaugaucaaguugggauuaucccaggaauggaagguugguuuggcauuuguaagucaguuaacacaguauacuuuauuaauaaaauaauaggcaaaaaccacaugauccuuucaauaaaugcagaaaaagcuucugggaaaaaucuaaaacucauucagcauaaaguauuugaacaaacuagacauacagaagggaacuuucugauauagggaauguacaaaaauuuuauuauuauauuuuaguuuuaauuuuuaaauuuguaucccugauccuuuuuuuuuuuucuuucuuuauugagacagagucucauucugucacccaggcuggagugcaguggcaugcucauggcucacugcagccuggaccucccaggcacaagugauccuccugccucaaccuuccgaguaacugggacuacaggcaugcaccaucaugccuggcugauuuuuguguuuuuuuguagagacgagguuuugccauguuggacaggcuggucuugaacuccugagcucaagcuauuugcuagccucugccucccaaagugcugggauuacaggcgugagccacuauaccugguucugauccacuuauaauuaauuuuuguuuaugguguuauauuaagagcuccaucccccacugccuuuguuucuucuguauugauaucugguuguuucccaccauuuauaggaaagauuaucuuucuccauugaauucuuuugguaccuuugccaaaaaucaguugaacauguauuuaugggucuccuuuuguucucucuauccuguuuuauugaucuauaaguugaucaaauaccacauugucuugaguauucuagcuuuaauagugugccagaaucugauauuauaaauauuucaacuuuguucuuauuuuccaaaguuguuuuagcuauuuuaggcucuuuacaauuccauguaaauuuuagggucauuaugucaguccuccaaggugacuuucugggauuuuuauugugauuguauugaaucuguagaacacuucggagagaauugccauuuuaauccauaaacaagauauaucucuuuuuaaucaggucuucaauuuuucucagcaauguuucauaguuuuuaaauuuguaacuuuguagaagucuuguguguauuuugauaaauguaucauuuuuauucuauuuuuaauggagucaaaagauuuuauuuucugauuguugcuaauauacaauaaaacaauugauuuuuggguauugcgcuuuuauuauucaaucuugcuaaauuaauauauuucugaagcuuuuuuguaggauucacuuuauauacagugaauucacuuuauauaaacaguaguucuaggaacucaaauaguugagaguuuauauuagugcccccagcuaauaaauucagaaaggaugaucaaaauauaaaauacguauuuuaauagcccuaauaaugcuuucagucuacguacugauaaaaaaaaugcuaaaacuaauagauggaaaauugagaggaaacuuuauaaauggugggucaaguugacacugucugaagcuacucaccaauuuuaacauuacugauaaauggaacaaacagaccuuaugugucugcauaugugauuugauagaacauugcauuaggucuuuuuuauaucucucuguuguguucguauuuaucguuacuuucuuuaacauacaaaacacacauagcaauagcuauuauaauauuguugucuguugauuucuauacuucugauaguucugggucuguuuuuauugguuguuuuuuucucuugguuauggauuauauuuuccuguuucuuugcaugccugguuuguuguugcuuguuucuuuauugaugucaucaugaauuuuaugucacuggguuccagcuuuugcaucucuuuaggugguauuggguuuuguucuaacguauagucuagcuaauuggaaucuauuugauuauucugagcuuuaucuuuuaaauguauuugcgcaaguucagcacuuuagugugggacuaauuuauuuuguuacugaggaaauacauuccugaggacccuaccuaguaccccauguauuaugucgucuuuccucugugacucuuuguucucacauauccacaguacucacucaaagacucaagaggaccuuucuucaaagcauauaugcacacaaaugcucaugcauacucuugugcacaauguuguucucucucuccccguaucucuuugcugcucucccucuuuucaggaacacugccuugcaaauucuaaguaucuuuccccugucauccacaccccaaaacgcuuauuagcuuuucaacucagcgaaauugucaggcuguguuacgcuucucuugccuguaggugguaaaaugguguauugcaagagucaucuuaguuuuuuguuuccucccucaggaauuacagcccugcccugccuucuuuuuggugucuugaaauuguuguuuuauauauuuuguuuuguuuucuguuuuuguccucaggugggagaguaaacccagucccuguuauuccaucuugcaugaaagcaaacuuuuacagauuugcuuuuuuaaauguauuaggugauacaagaauuugggggaaacaaaagauaaggaucuucugcuuaagaaaaaacaagugaggccuggugcaguggcucacgccuguaauccuagcacuuugggaggccaagguggguggauugcuugagcccaggaguucaagaccagcauagugaaaaugacaaaaccccugucucuacaaaaaauuuaaaaaauucgccaggcaugguagugcaugccuguagucccagcuacuugggacugauaugggaagaucaccugagcccagggaugucgaggcuacagugagccgugauugcaccacugcacugcagccugggugaucacagagugagaugcugucucgaagaaaaaacauaagugauuuuuugguuauguucaaaaguuauuuuguuuggauuuugauuagaauuuuguuauuaacuguuauuuguauagaaccuuauacuuugggaaauugacauuuuuaaauauuuaaccuucccauaaaaguauagcuauguuacuuuaagcuuuguuucuagcccaucaaugaaguuguauaauuuucuuuauaaaugacuuauuuauuuauuagauguuuuuugguauuuuguuuuguuugaaugauuaauguuuuuuuuccauuugguuauuuuggaguaauauuuauauguuuuauuuacuaacugacacuggcacuaaauuuucauauaugauaauacuuuugguugcuuuaucauuauuuugagugagcucuguauauuucauauguaagucauuugugucuuaguauaguugacagggcuuuuuuuuauucuucauuaaaaaaaauucagguuaucuuuuaaaauggaaaccuaucuuuuucucugugguugcuuucuuuuugauaugcugagaaaucuuucugagaccaagaauauaaaaauacugucuuuuaguacugguccagcuuuaguuuuuuccaaagagcugugacuccaacacuuucuuuuaagaagucaucuuuauaucuaacuacauuucuuuauauauaguuggcacuucauauccguggguuucacauccauuaauucaagcaacugcugauccuggaaaaaaaaauggaugguugcaucucuacuaagcauauauagacuuguuuuacuugucauuauucccuaagcaauaaagcauaacaacuauuuauguagcauuucccguguauuagguauuauuaaaaaucucaaguugauuuaaagcauauggaaggaugcacauagguuauaugcaaaugcuacaucauuuuauguuaggcgcuugagcacugguagauuuuuguauccuuggggauucuggaaccaaucccaguuggauaccaagagacuacucaagugugaauauuuuuuaaguuuuuuuauuuuuaguaucuguugucuuaacacugcucccaaaagauuauaauaauuuacuuuuauuaaauugccuaaucagguuaucacuuuuauuagauuuuuacuaaguguauuuuuuucuuugugcaacguauauugacagauguuagaaauuugagauuagacaguuaucuuuuauaauuaauuuuagggacuaguuaaaggcagaaguuuaaaaagaauuuucauauaguauugagaucaguuauaucuggacaauuaagagaaagguuuuuuuuuuucuuucuuuuuuagaaaaucuuaacauaaauauugugacaggaucagaauuucuuggauaauaucucagggcuuuuuuguuguuuguuuguuuucuuuuccuauauugauauauuuuauuaauaaccuuugcuaaagaaauuguuuuucuguuuuuauaguuuugguaagcaguuuggaggaaaaagaggaugugauugucuuguauuagagccuucagaaaugauugugguaagaacuuuaaagaaugcugaauuguuuuugauaugcuucaguuuuaacuuuaaauguaguaggcuuuaaacacuuaaggagguuuuauuacuaugaccuuuuagagauuucaucaaguagcaucagaacuaucuaccagguuuaucuauuucugucucuucagacuuuuuuugauccucaagagagugugaaacaugauacacuuacauauaauuugcagauuugguauuuuuuacccccuucuaccagaaaauuagaaguuuuaaaaggggaccaugaguuuucaagugauuuuuuuuuuuuuuuuuuuuuuugagacagaguuucauucuuggugcccaggcuggagugcaauggugcagucuuggcucacugcaaccuccgccuccuagguuuaagcaguuuuccugcccuagccuccugaguagcugggauuacaggcaccuggcaccauucccagcuaguuuuucuauuuuuuagcagccauggggguuucaccauguuggccaggcuggucucgaacuccugaccucaggugauccaucugccuuggccucccaaagugcugagauuacaggcgugggucacugcgcccagccucaggugauuucuucuuucccauucaauuuuacuuuuucaauaaacuuugaauucuauagucugugcccuagacuagagagaaugaaguagagaaaaguaaaaagacauacaauuagauccaaguaagaaaugguguuaguauuuucacuuuuuaauuauuuaagauaaguuuuuauuuaagaguguauuuaaggaauaauucuuuauuuuuucuuaaaagagcuaaguaguugauguaacuuuagaauuuuuuuuuuuaaguauuagaagaaucaagaacacagcuugcuuuuuacguuguucuaagaugaccugacuagaaaacagcauauaccgaguggacucauuguccuacuaggaucucauguagaugaccaugucaucugauuagauuugaacugucaagaagagaaauugaauucuuaaugaagcauuuuaauguaagggcucaaaaccaaacuacuuuuccauuucauggugcuauagucagauugauaccuucaaauaguuuguuuucucuuucuuaaacuggaucaucuguauaaccaugaacucacuaucccuaauuuuaugugagcaacuggauuuuaagcucuuacagggcaaagauuaugucuuauuccacuugugucuccgagaguaucgcagaguacugccugcauaguaaguauucagugaauguuucuugaauucaaguuuuuucaaggauggaguauguauuguuucaaauuuauuuucuuuaagcacugaauauaugggauuccuauuagagccucagaauucuuucuuuuuaauguauguauugaggaacauggcaagaaaacugcccaggcaguauugauuuucugacuuuuuaguuguauuuuguauuucucauacuauaugcaaaagaaauacugcuuuuacuucaguguuauacauucuguuuuagugcuuguuuuacauacuuuauguaauauuuucauaugaggaggaagaaaaggagaaaucauaggcauagcuauaaaugacauuguuggugcaauugaugaauucaaaauaugcacuacagauuggauaauaucaaauucccugaguuugauaaccauacugugguucuguaagacaaaguccuuauuguuagcaguuacauguugacauauuuuggggucaagaagcauuauaucuccaauuuauucuucaguauuucagaaaaacaaguauauaaaauaaaaagucacaucaaguauauguauuuauggcugguaauuuuuaaauuucaaaaauuuaaauuuauugaugauugguauaauuuuaaaugcuuuaugaguuauaggagaaaacaauccaaaauaggugaaauuuuucagaauuguuaaaaaugccuggucaaaugguuuugucuauuuguacagauuugauuaacuccacuggugauuggaagugucuguuacugaacacauucuugaucaccugauaaguuagucaucuuaaucugacacauuguaaaguaaucuccuuguuuuaacuuuuuuuuuucuuuuuuuuuuuucuuuuuuucuuaaagaaaaggggcuuaccgagaguagagugugcgguggugcgauagcucagcgcagccuuggacuccugggcucaagugagccucucuccucagucucucaaguagcugggacuacagaugcaccccaccauacccagcuaauuuguuguuguuguuguuguuguuauuguuuuuguagagacagccuugcuauguuucacaggcugaucucgaacucuugaccucaaacaauccucccaccucaaccucccaaguguuggacuuacaggugugagccaccaugccuggcccaaaguauacuuuuaggcaagaagcauuauuuaauguaagaaugguacuguauagugauaaaagguuaauuguaucaagguuacacaauccugaagcuuuacaugccuucaaaauacauaaaacaaaaauuguccuuaguaaaaucagaacuagacaaacccacaaucacagugggagauuuuuauuuuuauuuuuauuuuuauuuucauuuugugauggaguuuugcucucucgucuaggcuggggugcaguggcauaaucucagcucacugcaaccucugucucccagacuuaagugauucuccugccucagccucccagguagcugggauuacaggugugcgccaccacgugcagcuaauuuuuguauuuuuaguagagacaguguuuugccauguuggccaggcugguuuugaacuccugaccugaggugauccucuugccucggccucccaaagcgcugggauuaacaggugugagccgcuuugccuggccaggagauuuuaauauaccucuaaaguaacugacaaaacaaccaccaugagucaguaaggauauugaggauuugaaccucaucauguacacauuuuaccuaagagacauaacagggaacacuacacuuaucaacaacagaguacgccuacuuuucaagugcacauggaauguuuuuuaaauuugaccacaugcugggacauaaagcaagucucaaaauuucaguauuuaaaauuuuauaguuucugaccaccaugaaauuaauuuaaaaaccaauuauaaaaacacagcuagaaaaaaaaauacaacuucugaaauucaggcguaugcucuaaaucgcuugucaaagaagaauuacuuagaaaauuagaaaauauuuuaaaugaauaaauaugaccuauuaaaauguguagaauucagcguaagccuuucuuguugugaaauuuaagcccuagugcuauaagagcaaaggcugacaguaaaguauucaugucaggaaauuaaagagcagcauaugaauaguaaucacaagccaagaaauaguaaagaucaauauaaaaauaaauaucaguggcauaaaagcaaacuuagaauaaugaggauugacaaaggacaagguugagucucagaaaagacuaagaaaauugauaaacccgucaaagauaaucaaaaauaaaacaugucauacaaucaguaucaggaaggaaaaaggauucacuacuacgaucuagcaaacauuuuuaaaaugcuaauaagggagaugguauggaaagcuuaaagcaaguaaguuugaaguuuuagucaaauuccuuggaaaaaaaaaaaaaaaaccaaacuggcauauacacacacaaacagaagaucugcacaagccaauaucuagaaaagaaagugaaucuguaauuauaaaccuuuucauuuagaaauucagacccauguggcuucacugguaaauuuuuccaaacauuuaaagaagaaauaauacuuagcaucuaauaggaaauagaaaaacuuuaacuucuuugccuuauuuuaugagccuauuuuaauuuuuauaacagccuaacaagggcauuauacaaaagcaguauuauagguuaguauuuuuaaaugaaaauaaauguaaaaaucuuaacauuuuagguaguccaauuucaguaauacauacagaggauaaaacaacaugacuacauugaauuuaguuccagaaucacaaauugauuuagcauuugaaugugugauucacuacauugauauaauuaaagaaaaaaaucagguaaucauuucuauggaugcagaaaaagcucuugauaaucagaacccguucaugauuuuaaaagcuuuuagcaagcuaggaagggaaugaaacuuuuauaaccuaauuguuaccugcagaaacccuauaauaaacauugaaaacuuucucccaacauuugggaauauauggagaaagcucaccauaccaaaacuauuggcuaggagaugcauuuaggcaggggaaaaaagagauuggaaaaaaauauaaaacugugauuuacagaugacaugauuuguauguagaaaaccccaaauuaccuaagugugaacuuuugaaauuuaugucauuucaacaaggucguuggauacucguucauacauaaaaaucaauuguauuuuuccuuacaagcaaguagaaaauugaauuuuauaaacguaccauuuauaaacaucaaaaccaucuauauacaucagauuaaaucugaaaaaaguuguaggagaccuuuacacagaaaaccuuaaaaaguuguuuuuagaucuuuuuaaaucaguugagacaauauuuuuaagauacaaauuaucucaaaauuugucuaaaauuuagugcaguccccaucauaaucccaggauauuuuaaaaauggggauaaaggaauugaucuguaacauaugucacauaagggaagaagaauauauuuacaaaaacuguaugagaaguacuuaagcuggguguugugacacacgucugcagucccaauuauuccugucugugaauagccacugcacuccagccugggcaacauagacucccgucuauaaaaccaacaaacaaaacacuuaagauuaaacuuaacaaaugugcagaaauaauguguuuaaauaccccugaaauaaaaaaauuaaacuugaacaaaaaaagagauaccauguucuuagguauggaguuaccauaguaaggauauuacuuuuuguuaguuuaccuuaugaauauaaugaaaucccagugaaauaugccaucaaguauaguguuuauuuuguguuuugcauuuugugccauuuaaaagaauaaaaaaagcaaggagaacuagaagaaaccugagaaagaagagcaauuuuaggggagccauguaaaucuuuuuauguacuaaaagcaauucaaaaggagaaaaaauuuacucuuccccccaaaaaacaaaauaagugauuuuaauauauguaaaauuuugguauaauuccaugaagaauuauuauuucuggugacuuuaagacacaguauuuuaacuguacauuccuaauguaguaugucucauuguugguguuacuaggagccaguugucucauuguugguguuacuaguggucuuuucuucuucuuauuauuauuuuugagacagagucuugaucuguugcccaggcuggagugcaguggcaugaucucggcucacugcaaccucagccucccgaguagcugagauuacaggcacacaccaccacucccagcuaauuuuuguauuuuuaguagagaugaguuucaccauguuggucaggcuagccucaaacuccugaccucaggugauccacccaccucggccucccgaagugcugggauuacaggcgugagccacugagcccagccuacuaguggucuuuuuacaguuuuccauacaguccugcacugcugguuaugacugaucacauguaugacaaugguuccauaaaauuauaauacuguauuuuuacuguaccuuuucuguguuucgauacacagauacuuaacauuguguuauaauugccuaugguguucaguacaguaacaugcuuuacagguugguagcuuacgaccaauaggccauacuauauagccuagauaaguaguaggcuauacugucuauguguaagugcacucuaugauguucacacaaugacgaaauugccuaacaacuaguuucucagaacguauccuuaucguuaagugcacauggcuguauauguguguauauagacgcacguuauauguaacuaauuauaauuaauuuaacauaacacauauacauaaaucuauacauauauaaauauuaguauccaagaugauguaaccaggauguuagugguaauguugauuuuguuaauuuaaagcaauuauauauguauagguaauauuuauguguauauuaugaaaaauucuguaugauacauuuaauuggaaauaauugaaauuuauaauuauaguuaauauaacuaauagaugcauaaauaaaugucauuaguaaucaagauuuuuauuuuagcauaagaguuguguaaaauuaaagauguuaagaaaaacuccagucuaaaaugucaguaggaaaugucagcauugacacgacuauuuuuuucuuaaaaguauuuaccaaauuauuucaccuuaagaaaaaaaauguguuuccuaggguuguucauugcaaaaguuuagaagcagcgauauccaaguaguuaaagcauuccuagugguuauagagcucagauuuugaugauaaugaguagguaccauuuccccucuaaaaggauaacaaaccuucguuaaguuaaugauuuauagcagauguggauaccaagaaauuuauuagauugggauuuccuucacuaggaagcagagaaauauuuaaaauuauugggcuucucucaaaaauaucaggauucugugaaccuuaauacuuggggucuguuucuucuuuuucuauauuugacaugagauucuuuuuuaccuggaaagacuuuucuauuuguauucauugugauugcugauagguuugaauuuacuuucaccacauuaugugcuuuuuauuuguucuuguuuuuuccccucuuuuuuuuauuuucccuccuuuauuuuaaguucuuuuuuccuuccucuccuccccaccauauucuuguagaaaugguguuuggucucuucuuuuagugcuaauucugacuauuuuuaaauuccuacuuaggccaggcacaguggcucccuccuguaaucccagcacuucgggaggccaaggcggguggaucaccugagaucaggagugcgagaccagccuggccaacauggugaaaccccgucucuacugaaaauacaaaaauuagccaggugugguaggcgccucuaaucccagcuacuugggaggcugaggcuggagaaucacuugaacccgggagguggagguugcagcgagccaagauugugccacugcacuccagccugggcaacagggugagauuaugucucaaaaaaagaaaaccuauuuaaaaacaccugaggcuaauaaguagcuaaacugauaagaauuuaaugcuaguauccagauguaauuccuauuguccaguauuuuagcuuuauguauucuguaaaucauuauuuauuccuauuuaaccacguauuuaauauuuuuugcuuuuaguucuuucuuauauaugagaccguccuaauaguaacacuuguauuauguuuaaaguacacccauuaaaaauucuuuccugaagaucuucuguuaagucucucagguauuuuuucuuuuuugucugaaaauaacuuuauuuuucuucauucuuggaggauuguuuugccauuaauacaacuuuaggaggagaauuauuuuuauuaacacaauuaauacauucuauuuuuuuacauucaucguauuuugaggagucagacauuaauugccuuccugaucucuuuuuucuuucuggcugcauuaaaagucuucuguuuauauuuucucuguaauuugguaucguaguuuuucauuauccucuuuuggauuuuuuggacugcuuugggcaucaaaaauucuuuuuuuccuuaaauauugucuuguucuaucaucuucuugacauuuuuuuuuucaaccuuuccucuuagcuuucuuauuuuuuaccucuucaugaugacuuugugcuguauguugaguaagucuucuggauuuaucuucccaguuuacuaacucccuuuuuaguugcaucuuaauauaccauucaguuccuucauuuuucuuauuuaacucuuuuccucuuucucuuugguaauuuuauuguccuauguuuaauuuccuugaucuuaacucaguuguguugagucugccaaugagcaugucagagacauuccucaucucuauuacuacgucuuuuguuucuaacauuuucauuuuuauuuuauauuuuuauuuugucugcuaaaauuaucaaucuguguguguugucuauaccuuuuccagugaaccuauaacauguuuaaucauaguugauugaaguucucucucugguaguuccagcaucuggauccacucuaauucuuguagacugcucuguugauugcuuugucucuugguuuuuguuuuuuguuuuguuuuaccuuuccuuuuuuaugugaguuauaauuuuggauuuaauguugggcauuagguuauagggcuauagcuuuuaagccuagagaugaacacauuucuacuggaguugagcuagguuuggauucucuugcuguuauggugcaccagugguuucaaauuuguuuaguguuacuuuguccuugaguuugcuggaagauuauucucaguguuccugcuccacucaguuuuaggccuucucugugcucuugugcuucagcagggucucuucauguucucaucucuccuccaaauguagauugcuauugguuguuccucacuguuugcuagccuggcaguugggaggagggcacuuagggcuuucuuguccuggucaagcuucaacugcuugguuacuguuuaucaucucuggcucauuuucaaauuuucuuuuguuugaaaguuuuuaaauuuugacuuucuauucucuaauacuuucaguauauuggaguauuugcaggugucauuccacuuuuuuaggggcucauuuuuaauuaugucuugcuucuuacaugauguugauguaguugggauuuuuuuauauuugucuaugaguucauaugucuuggaacuuuagguacaguaauacuuugagguuuauguuaaaguugcauuuuuguuggccuggugugguggcucacgccuguaaugugagcacuuugagaggcugaggcagguggaucaccugagaucaggaguucgagaucagccuggccaacauggugaaaccccaucucuacuaaaaauaccaaaaguagccaggcgugguggugcaugccuguaaucccagcuacuugggaggcugaggcaggagaaucacuugaaccugggaggugaagguugcagugggccaagauugcgccauugcacuccagccugggugacacaagaaaaacgccaucucaaaaaaaaaaaaaaaaguugcauuuuuguaaggaaguuuugcauuuguuauuucugcuauuguuuauuaauagugcugaaucucuuuuaguuuacuugcaugcuugagguauugugaauucaaacuacagaucuggaugaaggaugccuugugguuuugaauucucaggggaaggcaauuuuuguucaguugcucccccuccucuuaucccagugccaggcaaguuuucuuccuguccccuucugcuuguaucuugcuuacccuuguaaugaggguguagcuguuugggaugagcuuuaugaguagguuucuauuagauuccucaacuuugguagagucucuuguuucaucucuugucuauuucacucccuacaaacaucagagugaaaaaucuuuucuucagaguuugacagaaacugucugguagaucaaggacuuuauugguuucccaaguucaaguauucuugcuuucacaucauucuuggcauuuggauucuguaccuuuugugccauuucaguuguguuugugguuuuauuuuuuuuaaaucuuacauuguuuuuaaugcaggcuuuaauguuuuaaauaccacaauucaguuauauucagugggaacuuuguuaagggcauuuaacucuuuauauuccuggaauaaaaaucaugauuagauuuuucuuugcauuugguacuuuucccaagauuuugaaacuuagaaagccuuuucuuaaauuuauuuuacuuccauuuuuacucuguaaagccuuuauuguuuaaaucucugcauugcucaauaagugguagauaguaaaagaccuaagaaucauguaauauuggacuuuugucuaaaguagauaaucucuuuuaucuuuugggauagagcaauaugaaguuggacuuuuuagucacacuuggguuuugaguccugauucaccuacuugugugaauuaacuuuuuuuuuuuuuuuuuuugagauggagucucacucugucgcccagacuagagugcagugacacgaucucugcucacugcaaccucugccgcccgguuugaaguaguucuucugccucagccucccgaguagcugggauuacagcgccugccaccgcgccuggcuaauuuuuguaguuuuuaguagagaugggguuucgccaucuuggccaggcuggucuugaacuccugaccucaugauucacccgccucagccucccaaagugcugggauuacaggcgugagccacccugcccagccugugaauuaacuuuuaugagacacuguaccaucuauuacaauaggaaaaguagcuauguaauaggguuauugugaaccuuaaaugagauaagcugcaguuucugguauauggccuuguguauaccuuuugaggacuuuauacauaauuccaaggaccuaauauauuugaggcaaaagggaaaauuuaauuaaacaccuauuuuggcaaaugucuugaauauuaggugaacaaagaugaauauaauauuacauaauacgguuccugccuuagagaacuuguuaucuuauuagugagguugguauacuuagugcuauagaaggaguaauacuuuucuggaguagaggagggauugguugaacuaggucauaagauguaaguaggaggccaauaugcuggcaaagagggaaugggcuuuuagccagaagugacagcugcauauguaaaggucugaaggcaguagagaacaugucccauuuuugagaagucuagguguguauacacaauaagccaaucgaggucugaggagaggaaugucuuugguaauuauggaagagauggccuuugagauagguagugucuaaaugauagcaugugaagacagaauggguaugauaacacaaauugaagaaauaaguuacuuggcagauuauaaguuauuuauacauaggggcacaugaauagucacauugaguuggcugcuacuuauucuugaauucacaccugaacaaagcagauuagacaucaacucuuagaaaucauuaggaaauuuuguguaucuaauuagaauuuuugugggaaagcaaauaagggagcagcuuuuccaggauuguacauguaagauaaggugauaaaaguauuuuggggauggaguuuauaauggcuuugaauaucaaauguaagaguuuaaaauuuauuugguguaaacauuagagguccguuguggcauuuugaacaggaaaccugaguaauggugauuaucuaggugauuuguuugacccugcaggauagaauuggagaggaacaugccuaaagcagcaggaucaccuauugcugugguuugggacugaggugauuaagacuuaaauuaaggggaggugguaaugggaaugaaagagcauuaugggagagauuuauagagaacugacaaucugagagagaauugaaccaaagauuuggaagacaagcaggggugcugagaauguugauaugauacaguagucucccacacccccauaucugcaguuucgcuuuccacauuuuuaggacugucguacuguggaaagagagaggagcuaaaugaugagaacacauggacacauagaggggaacaacacacacuggggcauuuugguggagggugggaggagggagaggaucaggaaaauuaacuaauaggcacuaggcuuaauaccugagugcuaaaauaaucuguauaacaaaucccaugacacaaguuuaccugcguaauaaaccugugcuuguacugcugaacuuaaaauaaaaguuaaaaaaaagagagagaccauauucacauaacuuuuuuuuuuuuaagagacagggucuugccguguugcccaggcuggacguuaacuccugggcucaagugauacucucgccccagcaucccugguagcagggacuacaggcacucgccacugcgcccccucacccccacauaacuuuuauugcaguauauuauuauauuuuauuauuaaucucuucugugccuaauuuauaaauugaacuuuaucauagguauguaaauacagaaaaauacaugacauauauagaauuugguacugucugcaguuucaggcaucuaguggggaucauggaauguaucccccucagauaagggggcaccacuguguuugggugggugccuaggaaauuuuugguaauaucaagaacucugacauuagcagaaagaguaguuaugggggaaaacuaaaaccaccauuuauuauuuauuagaugugagcuuaguuauaaagguagauuuuuagagcauaucaauauaccuuuauaaaaauaguuaauuuaaaaaauuaugguuuguucugugauuggacaggcagugcagucuuguaucaguggcauaagcuguugagcuagauaggucuauauuccuccucaccuuaaaaaaaauuuuuuuuuuaauuuuuugagacaggguuuuuguccugucgcccaggcuggagugcaguugugcagucauagcuaacagcagcuuugaacuccugggcucaguugauccucccaccucagccuccuaaguagcugguacuacaggugcacaccaccaugccuggcuuauuuuuuucccccuguagaaauggggucuugcucuguugccagguugccaacucaccuuuaauaaguaucacuguugugagacuggaaugucacuaauaucuuuggguuuuucuuugucuacaaaguagagacaguaauaccugcuuacagggcuguugugugaacuaacuacuuaauauauaugcaugcuggccuauuuuaaacuccuaacaaauguuaauuuuccauuuuauuuucuuacuuagaagaugccagccuuacuuguggcuguugucaugcauuaaguugaaaauuaaagaauauugcauaaaguuuucuuguuuuacuuuuuaacaauuaacuaaaaccauaaccaggauuguuugcuaaguaaaauauguguauaaucaggcaguuuguaauuagaggaacucaaguuguaauuauugaauguguagguguaguuaacagccuucauuucugguaagugacuuuacuuagaggauguauguuuaugugcacaagagagacuguuuccuggacggaaacuguggucuccagaucuuuauaauaacaucaccucuaaucuuuaacucaugagcguugugcuauacagacuguuuucuugaggcaguuucuuguaagaaguaaaugaagcuuccuuaugagucuguuaagacuccauagauugucaauaauauggaaaaauuugauauuucaucaggaauaugaacauguguuucagguagagaaugccaaagauaaugaagauaguauucuacaaagagaaauuccugccagacaaucccgaagaagauuucggaaaauuaacuauaaaggagagcgccaaaccauuacugaugauguggagguuaacagcuaucuuucugugaguauauuuaggaacacuucaugaaucuuccuuaauuuucauaucuaguaucuuuaauuuacauguaucuuugguaauaucaacaugcugggcucuguaugugaaaauuuggggcagguaaauauauaaucuuuuuaaaugcuucuguuugguugaauugguuaggaaugcucuuaccagugggaguucugguuuugcuuuuuuguuguuguuuaaauagugaaaaaaguuauuaggcugggugcagugggucaugccuguaauaucagcacuuugggagaccuaggcgggcggaucacaaggucaggaguucaagaccagccuggccaauauggugaaacccccaucucuacuaaaaauacaaaaauuagccaggugugguagugcaugccuguagucacaguuauuugggagacugaggcaggagaauugcuugaacccaggaggcagagguuguagugagccaguaucacaccacugcauuccagccuggucgacaagagcaaaacucuguugccaaaaaaaaaaaaaaaaaguaagcugugucuucaaaagucuuuaauugugaauagcuucuuuuuagacugaaaaguagcugaaucaagaaauaaggguaaucuaaaaaaaucagguguauuuuugaggggagagguuucauaguuaccaguuuccaaaguacucacgauuucuagaauauuaaaacaauuaguacagagcauuuccucuuguuugcauuuguuaaaaauaauaauaaaaaggaugguugaauauagugaaauucccaaggauguguuuaguuuuuucaguugucauaaacagauauuuauucauuccauguuagguguuaggaguaagaaagauuauuucgagaguuguuuguacuggaauaaguguuagaauuaaggcagcucuaauguuugucacauuugccuaauugcauugauucaauacaagaauaugaaauaguccuaaaauuuaucauauccagagccacaacaagguuuauuuccuguucucacuauuuaacaauuucuguuuuuguauuguaaauuucccaucacuaauuaaggugacauauuuugcuuuacuguguaaguaauaugugucuuuuuuugaaaaauuagaaacagauuguuccuauuacacaguuauauaacuauuugaugauauuuugcaauucuuggauaaagcuuuucaacauacagauaaaucuguaagguuuuugcuaacuauugaaaacuuaaauauguaaauuuuuguuaacuuuuaaaaacaaauauauaaacuaaacaucuuugaauguuguuaaauguuuuucccauuauuccuaaugacugcacaguacuccauuauaauaauaugcuauaauuuauucaguucuugauauuugauaaguuacauucuuuccaguucuucauuauuuauuuauuuuuuuuuuuugagauggagugucgcucucuugcccaggcuggagugcaguggcacgaucucagcuuacugcaaccucugccuccuggguucacgcgcuucuccugccucagccucccuaguagcugggacuacaggcgcccgccaccacgcccagcuaauuuuuuguauuuuuaguagagacugguuuucaccauguuagccaggauggucucgaucuccugccuugugaucugcacaccucggcaucccaaagugcugggauuacaggcaugagccacagcgcccggccuuuuccuuauuuuuuaaaaauuaaggugcuaaguacaauguaugcccacauuuucauuucuauagaaaaaaugucaagagguagaauuaauaaaugaaagaaucuuuaacuguaauauuuaguuuuccuagugugagcuagaguguguuuugacugcuugcucauucuagucucaacuucaguaucuucuuuucccagauuuuuuugguguccugucaugaauccuagacagauuucauauuuucucuauuagcuguggaucaugcucaugagucauuugcuuuuagcccuccucuguacugagaguugucaucuucuagauauacugauuuccugggaucagaaagagcaauaggcauacuccuuagggauucuguuuguuugauaacgcuaaguauaguggcauuuuugcauguauaccuaguguuacauggugauccuacuaaguacugucaagaguuugacaaaucaugaaaaggagaaauugauucauuuuagacaaaacugauuuauuaacuaugagaccggguuagagaagcuuuuuggucauguuagguacaugugcuguuucuugaauuaauggaguuauuuuuuccuaaaaaggauauauuucaguuaacuuagaaaauaugguauugaagguuucauuuauuuuuaauuaaugcuaccaauuauguaacaccuguacaucuggccaguguccugcaauauuggcaguuggucuagguaaggaugcuauguagcaaaaaucuuaaucauguuuaugagagcagcaaguagagaauugguuuaauggccuuuauaggguucuuuaugucuuuuguucuauugucagcaauucagagagaaaaagaucaggaggaaucauuucuucuuuuagacagcaguggaaauuugaguuuguuuuuuuuuuccuuaauguguaaaccaucaucuacuuuuucuuucuagagugcugaaggguaaaaaaaauuaaagauguuaacuguuguuuaucauaauuauucuuuaguacccaacuuguacaaggguuuguauuaaagauuuugccuguauuuuaguuauuuuuuaacuaaauucuuagaaugacugaaaaagaugauuuauucauaugaaauauuuuuauaguuuuguuguacauugcuuuguauaaacaugaauccuaaucuuaaugugacuuuuuuuaauguagaauaagcacuucuguaaugguaauaacauuuuugaagcuccguugaguguugcucugaguuugcaacaauuuuuuugauacaauuucuuaucacuuuauugagauauuauuaaagguaauguacuacucauauuuaaagugcacaguuugggccaggcgugguggcucaugccugaaaucccagcacuuugggggccgaggcaggcggaucacuugaggucaggaguucaagaccagucuggcuaacauggugaaaccccgucucuccugaaaauacaaaaauuagccagacaugguggcgcuugccuguaaucccagcuacuugggaggcugaggcaggagaaucacuugaacccggaagguggagguugcagugagccaaggucaugccgcugcacuccagccugggcuauagagugagacuccgucucaaaaaaaaauuuuuuuuaaaugaaauuuugauuuugaucaauuuugacauauguauaauaaaccuuugaaaccaucaccguauucaagauuaugauuacuuccaucacccuaaaguuuugucgucucccauuguaauucaucuuuucuaaauacccauccucaagcaaccauuuaucugcuuucugucacuguggauuagucuuaguuucuagaauuuuauguaaauggcaucauauauuguggauuuuuuuugggggggugggcuucuuucacacauuauaaugauuuugagaccuuucccugucgugugcaucaauuauauuuuuuccccucucuuguggguauuauuucauuguaugaauguaccacaauuuguuucuguuugccuguuuaugaauauuuggauuguuccaguuuugggcaauugcaaauaaagcuacuguaaacauuuauguacaaaucuuugcugauacuuauacuuccauuucucuuagguuaauacccaggagugggugacuggucauauggcaaauguaugcuuaacuuuauaagaaacuaccaaaauuguuauuuaguguggcuguugcauuuuacauaauuuguguucuuugaaaaugacaguuuccacauccucaccaacacuugguauugucagauuuuauuauuauuauuuuuaaaauuuuuaauagguagugguaucucauuuugauuuuauguaucccugaugacuuacgguguugagccucuuuucauguacuuauuagucacuuguauauucauauucuuuuguaaaauauucaaauauuuuuaaaguuugcaacaaauuuaaaugucuucauauaguuucagaaauuucagagcuuugaucuuugaggcagaugacuuugguauuuagauagcagaaaggugaucaagagcaauauuuagugagcaggauaaguaaucaagccaaguauaaaaacuccaguauuuagaugagccaucuaucuugaauucuugcuucacuaacugaaugaugaggacaguucaucuaaaucuucggugcuucaccucuaaaaaugacgauauuguaauaccggguuugccugucuuagggggugguuguugaaauuuuuagaauguguguguauucacagucuaaucacucaauaauaucuauagauucuuccuuucacauguuucagaauuugugcuuuucacuuaauuugcccaugucguuucuuuaguguucacuuuuuucuuuauaggacuguuguaauagcaucucucaaauucucccagccaccuuucacuguaaacgcaguauuuuuucauuuuaagagauuuugaaaaauuagaaaacgugaaaaguauuauuuaauuucuuuaucagaagauaucuacuuaaucaguuuauuugauuuaaaauuuuuuaucuucucucugaacuuguugcccuaucgcuagcccugcuuucuacauccuccccuauacccuugccacuaacuaguccauuuauuuugcuucugugaguuguaagugaagcucuaacaaugucacuuguuuuaaacucuuaaaucuguuuauggccuaccaucaguuacagaaaaauuccaguaaucuagcauauaaguaccuucauagucuagaccaguccuguuuaauugaauuuucuguuaugauggaaauauuuuaugucugugccaucgaaauugauagcagcuagcuagccauaguauugagcuauugaucacaauguacaaguaaauaaccacaugucccuaguuggacagcacagaucuggacuuuguucaguucuccaacuuucucuuuuaccuguuuucuauguauuuccuauuuuuuggccauacugaacaaauuugcugacccuugaagaaaccauguguuuauguacaucucuuguauauacaauuccuuuuacuuaagauguacuuuuauucuuuguccucuuaacaaaagucucaagaccuacuuucacaucaugucauggaggacucugauuucuuucuugggaaggauuaagcacauaucugcacucccauaauaucuuguuuaugugccuguaagcacucauuaugcugaguauaauuacaauuauucuauauugcaguguaauuguuuauuuaaauaucucucucaucagaauggaugcuccuagaaaaugucaaccaucauaauuguaaccuuagaguauauugccugccaaagaaaauaagagugccuguucugucagcuugcuuaguguccuguguaacuuugggcaaguuguaugaccuuuguaugucugucuugauagauaacuuauagauuuguaaaaggauuaaaugagauaauauauaaaaaagggcucugccuagugucuggugcucugaaaaauaguaauguuaguagcauccuauugcuguuguuguuauugugaauauucaaaaaaccuuuguuccuauugcuuacaaauuauuuauuccauaccuggauauaaaaagugcuuaccaaaauauguaaauauauuaaaguaaauauaaacaaguaagcuaaagaaucagaacaaagggagaauaaagguaagaaaaguuaaaccaaguuagcuugaaguuagaacaaucagacaauuaaaauuuacccucagaaucacucacuuugaacaaguaauuucuuuguccaaucuugaaagauaaaaguaguuacaaaauguguaugaaagucacuggaugagucacuuuauagaauguguagcuagaagccaaucaaaugagauggagaaugucugccaagaaaugaugaaucugauuuuggaauuaaucacuuguaggccuaucugauaguaguuagcaaggccauucguuuagcccaaaacaaucuccaggacaugggaagaaaauacuauuaucuuacccuuuaaaguuucuagggauuuuguguauauuucauaaugaauacaaaauauuuugccaguaacacauguauuaguuuuuaaauacauuaccuauguuagaaauguaacucauucuuuuccccaaugcuaugugugauuuuuaaaaguuuugaggccaaaugcaguggcucaugccuaauucuagcacuuugagaggccaagauggaagaaucaccugaagccaggaguuugaaaccaagcugugcaacaaagcaagacccugucucuacaaaaaaaagaaaaaaaaaaaguaaaaagaaaaauuaagaaucuugagaguauauggcauauaaauccuuuucuuauuuagcuccaguuuaucuuucagcuuucuggccccauuauguuuggaggucccuaacuuugguccuguucucuuucccuggaaggcucuuauuggcuucuucacuuaauauaguucuacccuuugaugagucacuuugaaucuugccacuugcugcuuuuauccagaaugggcuucugucaugcucuucugacaaagucauguucagcucccaagaguccauucauccaugaccucuuuagagaaggcuuuccugacauuuccuguucauagagugcacuucucuucauuggucccauaggauaguacuugcaugaagugugcccauauuauucugcaguguucugagauaacaaaaaauggaauuaacaguuuacuuaagaauguuuuaaaugccuguauuuuuuauauaauguucguuguuucauuuuaaauagcauauaacgguaaacauuuugaaauguagugaauugaauuuuuuuugagacggagucuugcacugucgcccgggcuggagugcaauggugcgaucuuggccucccaaagugcuggaauuacaggcauaagccaccacgcccagccugugaauugaauuuuuaauauugguacauauguagaguuaaaugguaaaauuaaaccaggaccaauaaacaugaaacaucuugguuucaccaaggucaagcaccaagugugccuuuauuuaacuuuauucucuagaaugucaggucucauuugugcucauuuuuauagaaaugugauugagccaaauaugaaucuggacauuguucaaagguuuaaaaaacuuuguugguguuugcauacuuuaguuaagaaauuauaguccuucuccuugauuucuccuuccuuuugcuacuguauauuuuugucguuguugcuuuugagacagggucucgcucuguugcccaagcugugaaaugcaguuaugcgaucauaguucaccauaagcucaaacuccugggcucuaacgaccugccuuagccuccugaguagcuaggacuacaggcaugugccaccacacuugacuaaguauuuuuauuuuuuguagagacagugucuugcuguuucccaggcuagucuuaacuccugggcucacgcagucuaaucacugcagccucccaaaacacugggaucauagacaugagcuucugcacccagcaagcugcuguauuuuuaaauagcagugugccuguaugaguguugguuauauguuuguuguguuauuaacuagaucucaaguuccuuaguagacuaccucauaauuuuuuuuauuucuuguucucuguguugcuuaggaugcuuuuuauauucucagggacaaaauaaggugcuagucuuccucucuuucuucagcauagcgucugcacagacauggagccagccagcucuuccuaaaagaacaucuggaaagaaugauuuccauggcagcauuauggauugggguuuuuaauuugaagggauucccuuugcugugacaucuuuauguauuuucuuuccaucuagucuuuuguucugggauuguauagugggugguaggaugaugugacacgcuagaaucuacuuuuucauuuuaggcucacacauuacuaauguagcaggcgguucuuucucauugcuacuucucugauuauaucacguucuccauucucuuucagugcuccauguuuuguuuagauccagagcauauuagagaguuaauguacauuugucaaugcagcucaauaagaggugauuauuaggacaccacaucacuuaccaacuuuguggugauauacugaaaaauggcuggaugcuuuuacuugaccaugggugugaccucuuaagguauuauugcaaguguguuucgcuuuuauggaguguguguguaugugugucuuauucaucaagccauuccuguaguaagaaauagguccaugcccccaccuccucaugagaaacuagaggacuuugguacaaacaugugauugcuuaguucucuucauggagcaccaguaaacaaaaaguuuaaauauuuauucaagucaaacuaaaggagguguaagcacuauuguuggaucaaucauuaggagaauuuagaauuugaacuguuuaagugaaagucacuguuugaugaagaagcuuguuaacauugugaacuuuauuuuguauuugugggcuugauaaauccugauuguuuuuaauaugguauuucauaaguacuuucagaaugaaauaaugaaugaauaaacagacuuuuguuacuucuaaacucaggaaguuugcaaaugggaucuuugauaaucuuauuuguauauaagacagugaaugcugaucacacuacuacugagaaguuuggauccccaccucuaagaaucuucagcuuuucaauauugcuucucuucucucuuuauuuacagccccaaauacucugaacagguguauauucuuugugauucuuucuaccuuaaaaacaaaagaagacuuucuguuuuuguuuacgaguaucuaacauccuuuaggagaauacuccuccuuuaucuucuaggaaauaauauggaauucuugauagguuuuuguaccuaguuagaagguauugaguccacaaauagacaaaaagcauagaagugauacaacuaaaacuaggacaaaugccaaguuagagcagauuuuguuuuaauuuugugaagaaaugcuuauuguagaaauguaaaauauauagaagaguaugaagaaggaaaugaauuugcugucauccucaaaacuggagauagcuacugucacuuaaaauuuuuuuaauguaccauggucccucaguauccaugggggcuugguuucaggacccccugcagauacuaaaauucgaggauguucgagucccuuuuauaaaaugguguaguauuuuuguguaaucuaugcacauccuuccauauacagucauguguugcguaaugacagaccacauaaaugacaucagauuuugcugccuguuuuuacuguacguuuucuguguuuagauacacaaauacuuaccauuguguuacaguugccugcauuauucaguagaguaacaugcugagcagguucauagccugggaaccauaggcuguaccauguagccuagguguauaguaggcuauaccgucuagguuucuguagcuacacucagugauguuugcccaaggaugaaauugccuaaugacacauuccucagaauguaccccaguuguuaagcaaugcaugacuguauuuugaaucauuucuagauuacuuauaauaccuaauacaguguaaaugcaguguagauaguugcuauacugaaauuuguaguuuuuuuuauuguuguagugguuuuuuguuuuugguuuuuuagguuuuauuugagacggucucgcugucaacuagacuagaaugcaguggaaugaucacagcucauugcagcuuugaccucccaacucaagggauccucucaccucagccuccugaguagcugggauuauaggcacaugccuccacacccagcuaacuuuguuuuuuuuuguagagacggaguuucaucauguuuuucagguuggucuugaacucgugggcuccagcaauagccugccucggccucccaaacuguugggauuacagauguaaucaccaccacccccagccucuacuguuauuuuuaaugggauuuucccaaaauauuuucugucugcaguuucuucaaucugcagguacagaacccauggacacagagggcugacuguauauaucuuuugauuaauuuaaauauuuuaauuaauuuagaugaugcugaauguuuaguuauguauccuuguguuuguguuucucaugcaguuaaauuuuuuccaaaacauuacuuucaauauuaauauaaugcuguaugaguguaacgaaguauucucacguggcuuccaauuuuucuccuauuacaaacaacuuuuagggaaaaaucuguacaugacugauuauuuccuuaggauugaguuacagaaauuacuggguuaaagguaugaaaauuauuuuaaguuucuacaugaauauugguaacuucucaauaggcauuuuaaaauugucuuuauuauucacuauguauaaaaugcuugaguacugagaggaccagagcagggcaugccccucugguugucuggggcaguucuuccucccuuaauggugugacacuaauucagacagauuugcccagggaaccagaauuaggaagacuuuuuaucauacuugaaauauuuuauggaguaauugcuaaagaaggagcuuuugauaauuguuuaaagcaacucagauacuaauguauaccaguggucuaagacugauuaugacaguguuccaguuggaaggggaauaacaacuacucagacauagcaaacaaauuaaugcugaccuaacguuauuaccuuuuaguuugauuugguauguguuuauuaagugugcuaucuuguguauguggcuuuuacagugcuagaaaauguaguauuuaaaaguagagaagggacguaauggucaucuuuaugaacaagggauauaaaggaacccaggaauucacagauaguuuuaaaugagaguucauuuuuuaucauuuauauauguuacucucuuuuugaagaaaauuaauacgcuguuugaaacuuuagguuugcauauacuugaguaacuauauacaaaauguauccuuuugugcagguaugaagaugcuugauacgcaguguagacggaaagcagaagcauaguggugccuuuuauuguucuuucaauuucacugauucuaauuauagaagcuuacaucaccuugguugaugaugacgguuucucucuccuucuugguuuuucuuccucuauuacucccuaaggguggaucauauuucauagugcauguguguccagcugguggcugugacagauuuucaacaaaaaugggggugaucaguuaguggauauauaugacaguaugcugaagcacacuguuucuuacaagagaauaaaagagcguugguacucuugccuccccuccuucaugaaggcugaggaauagguaugcaguuugaaagcagaaguccuaaggggcaccaguaauuagaguuaacugugucugauaacugcaaagaugcauuucagauguucauguuaaacaugggggaaaacggguggaaaagauuguuaugauccuuugaaagggcuuguauguuaccuaugaucauuucagucauuuauucauuuauuuuccaaaagacuuaaaguguuuucacuauguaaaucaguacaauuuaaguuuauauuucaaaaaccaaauauaacuaaaauacagaaaugaauauccucuuuauuuuguaaaacuacagaauuuuucuuuuguucuuuaacuucuuuggcguuugacuucucuaaauuaugauuauaauauuucauugcagauugggaauaaauuccauuuaaaaauauaauaaguaaauaaaaugccuggguuaguauaaauccaguuuuuguuaucauuaguuuuguuuguuuuucauaaugccuagaauguuuauccucuuauggcuuaccuucaucuaugguaaccuuucucuguccuucuuuucaguguugucacauauuaacauaaaagauguguuuacaguuaguuuaguaacuaucagaaccuuaucuuuggcuuucuaaacaauaugauuuuaaguauuucaguuuguauuuuuguuuauaaauaauauacacaguuaacauaaauuuuaauaacuacauggcauuuacacuuuuauaaaaguauuuugucaugauuugaaucuuugcaaagucaacauacauugcucuauuuuauaguagugcaaaagaccuuucuaaagcuaaagauuucauuaauaaggguuagcaucauggcauuucauaugcaggggaaacguguucauaaguggcuguccuguagugauuccuagacaauagguagaucaggacauucuccuuugcugcacuuaauucauuugaauugauaagauaaugagaugagaucgugauaaaauucuaaaagugaugcaagggaaaaauagguuauucaccuagucauuuauuuuaguuauuugauaaauuacuauucucuucaaaggauguuuauuucuucauucaguaguuaaaaggugaagucauuauuuccucagaaugcugguggauccccguguugaguauggaauuuggccuguuucuuuucuuaguauuguuacacagggagauuuagcaugauagguucacuauacaguucccuggaaucgaagauacuaugagaugauugguagaaaaggaaaaggaugaugucaucuucacuuacaagccaaacuaaaggaaaagagaauuuuguuccuuuacugaguugguguuuacuacaguaggucuaacauauggcacuaguggauugcauuucucacacugggcagcaguuuuuuaaagcagcuaagagauggcugucucccuugcccagcuugagguccuucuuuguguguugaucagcaugauuuauaaaaagggggaaaggugugcauuaaaauuuugcuuuuugauucggcuauaauauauucuguugguacuauacaugaauauaauuacugucugguguugaaauucuugguauucuugaaucuugcuacugauauuuauguguaaaauacucaucuuuuagaaauuuuaucuuaagugaaaguuugucuucauguacauacaaaguaccuacuaucauuuuucuguuuuaaagaaugauuaacauuagauuuuaauuaauguacaauauuaaguaucaaguggaauuccaacucacguaugauugauuuaaauuaaacugaaaaaaaaaaaaacacauuggugcuugaaaaccaaccuguauaaauauugcauguuuuauguuuagaaaacuagucaugcuuguuugcauuugugagauuuaauuuuauauuuaaaugcggguauuguguauuuugguauugugucuuuuggaauuuuggcagaaaaacauucuuaaaagcuuuaugaaaaucuaaauaauuacauauuuugaaagcauaacuugucuuuguucaaaauuauacuuaguuuaacuuaaauucuaguuuuauaaguagcaguguaauucagauuggcagcauaguguuguucagaaagugacucagacuuuucucaaagauauugaagaacuuauuuuuuuugugcuuaacaacaagauguuucuucugcagucaguggaguccuuuguuaaaagaccugucucccagguaacaucuccucuuauguugcacaccccauuuuccccaaaauaaaaguguuagguaaauaaagcaaaauaauuauauugcuuugauuuguucagugauuguuuuucucauaauuuugccgccuggagguauaacuaacuauauuuuacuauugggaacugucuuucuuuggccacuaggagcaaccauugcaagcuuaguuggaguaucuaaugccuuguagcagaagcaugaagaacaaggauggguacuagugguauuguguuucagauggaagaggguguggcaaaauuaaaaucuuuuucuguaauuucuauagaaaaauggggcaauuuuuuuuaguccacacucacucuggaagcagguuuaauccuuuucuuugauuucuucugagugaguuuugcuggcuucuugucuuuuucuaggaauucagcauugggcuacaggaaaguaccauguuguguagauuauucuuucucaaagaaguaggugcaugcugcaacuauugguguacaucugauuuuuuuccagcuucccuuugcaaaaugaaauucuauuguuuccauuuaaauuuacuaucuaccuacaaaucuuaguacuaguuuguauauucuuaauguuaauuuagagugauccugaagguuauaucuuucagaacaguuauuugauaaauagcaaauuuugcaagcagaaaccccuuguuaacaaauacaugugacaucugagaaccuaggcugccuuguuuauuuggaaugcaaugguaucuuaucagagcuuauaauuuuaccuugggaggacaauacuguauuacauuugaauaauaauaggaaauauggcuucccaaauauagcuguguaucaauguacagaauuaaaaaucaaaauggauuuuuaaaacugugaaguagaaagggugcucaagccaauuuuuuucuuaaagaauuuagcuugcugacgugucucauggaaaggaggaugggguguguguguguguguguguguguguguguguguguguguguguauguuuucaauaaauugcucuuggggcuacaucugcagauacaguagccaauugaucuaaugcaguuucuggaggcuuucuguacaggugaugucauccuuuuagcucuauucuccucccacucucuuuccuucuuauuagauauuucaucuuacugcagagcauagaaucaauaggagcuucuccuuagggagcugcuuugaaacaggcaaggacaguagaaauuaagacacuaacauucagucuugcuuuagcagaagauauaaugguuuuguaccauauuauauaaaaauguuuaaccagaaaagcuagacuuaaaucaacagugcuguuuuacugauacauuagaauaaggaacagugcugcagagcuguaaacagugcaugugaauagagaaaauaauuacaauuuuggagauucuuagacauucuacaggacaaaccuguuacggcauauaucaucuaacugccauuugcucaacuuuuuuuuuuuuuaaaccucuggagguuaagaauauaaagaagaaacuuuaaucuucaggauacaauguuugcuuuugaugcagaagaaucacugcagugcuuguucuacagaaugaaauaaguugaagaaaagacaaagcuauauuacagagaggaaagguuucacggaauccaggaacacagauuuggugcauguugccugauuugcuuugacugauaccguauuaacuguugugcuaccacucugcaugucugugccaggugccugaggccgcauguauaugucuguauauucugagccagaauuguaaacaucuucauuuacugugauuugcuuguuaaagugaacguuuuaauuuagaacaauacugaaagcuccugauuucaguuuuaaaagggguuuggagaggcugccuuuauauaaacacugcagugguguaugauuuguaaaaagaaacuuaacagaauuuuaucaccguacucaucacuguagcucugguuugaaaaggaaacuacccuuuccagccuaggaaauggcuuuucuuguucgcuguuaugccaauugucuucagccaugggccuccaaaguaaguaauuguuauuuucuuagcaauugauuuaauccaguuauuaaauuuuauuuugaacuguaaaugagcuuuauugcgcucuuuucuaaacuuuaaaaauaagaacuacaaaguagucuuucucauugccauuuuuuuuuaauuuaaauaucuaaaacauucuaacgugaccucuaagagauuugaaaggugcguuuuaaaucuguagacuuaaaaugcagugcauuugagauguacucucuucagacugaauuauuuuuugauuauggcuauugcuguacuuaucagugaucauacucuaacuugcuucauuuucuuaaaugguugauauauuuagguauguuagucuaauugccagauuauaugacauuuuucauuaauaugaugcugucauaaauuaugauugaauugugcuauuuuacaauugaauugugcuauuuuacaaagauuaguugauaauucuugagcagugaaauaauaugaagaaaauacucaugaaaaucaauuauaugaaaauauuuaaauaaugauucuaaguauuuucaagauaguaaaccauuagcagcuggagacuauuuaaggucaucuaucauacuugucauuuuuaaauaaacauaauaacucacaaaaaagcaaagugcuauacaaccuuccaggcuagguuguaggaaaauauauacucuaauucagugaguuuuauuauacacaguggcuauuuauauagucuguaauuugaugccacucaaguuaucuuuccugucucauguauguauuauaaaacaguguuuuuucaaaacauuuaaauuguaacauuuauuaagauuuuuuaugguucucuugcauacagacaggcacaauagaggcacuucuuaguauggucugaaaucaugucuuuguuucaagguuguccuguugauggugacuaaggaagaaauccuaugauagcaucgugguguuuuucuguuuuaucuggccuagcucacugcaugucuuucuuaaaggcagcuucuggaaagacauuuaaauucacuguccauuuggcaaacagcugauugaaauguaaauagaugaaaagaagccuagguacacaauguauuugugcuauuaucuggcuaaggcuuaaauggccuuuuuagugaaaaugacaccuauauggcccaagcauugcugaugcuugauagcugcacuauacuacaaagguuuaaaccacuuguagaaaggaagugagugagaccguguaaaaaaaacuuuaaagaaaauuaagaaugagauauagggguuguuuuuuaagguaaccagcaaaauaaaauagccuuuggaaugcugauagccaacuuuugaucccagauuuaacaaauauggaagagucaaaauuucaaaaucagcuucuaagguuucaugaaaugccagcaaacauuauaugagcaggauucuggauugguacucuacuguguaaaucaaguauuuguaagaguacaugucuccaucccccuucccucauguuacuguugaugaaauuuugacucuggauugcaauuaaacacauaaaacuuagaauuuuguuauacuucuuuucauuuuccaguacauuuuacugguuuuauuuuuguucauguauuuuugccuaugcuacuauguacuugcauuuuacuacuucugaauucauuaauuuucuugcuaaaauaaauagucguauuagcaugguucuacuggggguuggggaagaaugaaucauaaaugccuuccuuuauauuuacucuuaagauaauuguuuaguucaauauaaaauaauaaauccaaagucuuuuuucuuuagcaguuugaaaaaguuacuacacugucuucuggccuccaguguugcugaugagaagucugagcucaugcuuuuuuuuuccuuuguuaauuacuuuuauuaguaguuaguuauguuuuuguuauuuuacuuuuuuuuuuuuucuuaagagaugugguccucaagcuuggccaacauggugaaaccccgugucuauuaaaaauauaaaaauuagccagguguggugccacauaucuguagucccagcuacucgggagguugaggugggagaaucgcuugaauccgggaggcagagguugcagugagcugaaaucgugacacuacacucuagccuggguggacagggugagacccugucucaaaaaaaaaaaaaaaaaaaaaaagagggagacaaggcccugcucuguugcccaggcuggagugcagugguguaaucauggcucacugcagccuugaacuccugggcucaagggauccucccacacagcugggaccacagaugcacaccacaucccuggccaauuuucuaauuuuuuuguagagacaaggucucuccaucuugcccaagcuggucucaaacuccuggacucaagcaguccucaugccuuggccucccaaagugcugggauuacaggcaugagccacuguguccagccuuuguuuuauuuauuuuuuuuaauccuugaugccaugaaguuuugcccuggauugccuaauguuuuguuccccuauugacacuuuuggaguaguacucucgcaagcugaaaauucucuuucgucuucaguugugagauuauuauuuuuuuuuuuugacagagucucgcucugucgcccaggcuggagugcaguggugcaaucuccgcucacugcaaccuccaccucccgggucaaagcgagucuccuguuucagccuccugaguagcugagacuacaggcaucugccaccacucccggcuaauuuuuguguuuuuaguggagguggaguuucaccauguuggccaggcuggucuuaaacuccugaccucaaaugauccacccaccucagccucccaaagugcugggauuacaggcaugagccacagugcccugccuguuguuguuuuuuaauugcaacucuuuuuuuuuuuuuuuccguggucucucuagagagaaaucaaauugaguuuuuuggguuucuuucaggagguugacuuaagugguucuuaguugggagcucaucuuccugaucuguuagaguugcuuguuugaggugacuguuuacuggguggaggaagcauuaccacuuuggguucuauuuccuucuuugaggugcuccuccagucacuggucacugauugauuuauccacagcuaaagcugcaggucauuucuuugcccuuaucuuacuguaccuaucugcagcacuugacacagcugaucacuuccuccuugacagacuuucuucaaaguccaaguccucaccaugaccuaccaaacaguuuaugcucccuccuccacuuaucuccuacuacacuccuccucauucacugucacugcccugauuuccuugccuguucucagacuugccaagcauucuuauacugauuuucuccuaaauuguaguaauuuacuuuuaguaaacucaccauuaaaaaaugaauauugauugaaagcuucucugugguuucaaaaauauuaaaguggggagauuacuuugucuuagaauugaaaaacuuuuuaauacuuauuaguuacaucauuuagaaacauccuuccaacucucaacuuuugguaaaaauaaugaguuaggaauguuccauguuucucuuguaguuucacauaccucaggcacagugcugugaucucuugguguauauacccaagguucuccuuuggggcuuuugggaaaugguaaauuccauaaaacaggcuccauacugccauauauauauauguguguguguguguauauauauauauauauauauauauaauauaaauauauuauuuuauuuuauuuauauauauauaauauaaauauauuauuuuauuuuauuuauauauaugauauauaaauauauuauuuuauuuuauuuauauauaauauauauaauuauaauauaauauaaauuuauauguaauauauauuuuauauuauauauaguauauauuauauaauauauauuuuauaugauauauaauauauaaauuuauauuacauauaauauaaauuauaaauuuauauauuauauuauauauaauuauauauaauaauaauuauuauuauuuuuugacacggagucucacucugucccccaggcuggagugcaguggcgcaguuucggcucacugcaagcucugccucccagguucaugccauucuccugccucagccucccgaguagcugggacuacaggcacccgccaccaugcccggcuaauuuuuuguauuuuuaguagagacaggguuucaccguguuagccaggauggucucgaucuccugaccuugugauccgcccgccucggccucccaaagugcugggauuacaggcgugagccaucgcgccuggccccuagaagcaucuuauaauucugguggcuuacuuuuaauuuuguaaggccuccauugucuugugcuucaacuagugucuccuaucucuuguguguaucauuuucuucuauuucaccuucugugcuuccagagugaucuuaacaguagguacccuaagaggaauauugagucauaagguauauacauuuuaaauguagccuuacauuugcuccccaaaguggcuacuccucaaauuguuguccaaaauguuuauaccaguucauacucccauuagcaguuuaugagaauauuguuuuccuccauaauuuuuccugcauuuuguauuaucauacuuguuuuuugccaauuugauggggaaaagguauuuguuuuaguuuuuauuucccugauuacuugcaagguuaacauucucuuccagcuguuuuuuuuuguuguuguuguuguuuuguuuuuuuccugcuguugugaccuaaguggccuuauguugagauggcagagccaaaaauaccuaaacaguuuggauaucugagucucuguauacuaaggcaguugccccaaaaguugccuguacacuucacuaggguaagccuuagugaucugagggcccccuauuguuguaacaaaaucuagucuaacugagaaauauaguagcucuuauaucacugcccuucccagaaaccuauaguagcucuauauugucuauaggaaccaaauucaaaaugccuagcuuggcauugcugauuauauucuaccucuagccuuuucucaauaccucucuuuccccaccccccucuauauauacaaaguauucagcagacuuuguaacuucauaaugucuguauucaaguuguuagcuaaaaaacuuucuugcugcuucaaauaaaacuaacaguaggccuuguggacaugugaucuccagcagagcacagaaguucagauauaggaaauggaugaaggaugcuguggaaaaugggaaguuuugucagaccuggugggcuggaaggacaaugggguaaaugaauugaguuugcugaugaaagaucagcuguugaguccagguagaucaggaagagaaagagaaagggcagguaagcugagagauaguggagaagauuuagggaaccaagaacuucucuuggaggaaaagccuuuccuuuuugcuucauuugauacaaagaaaagauaaacuacuggguguugugaacucccaaccaaguaucaggaaacaacuuaguaggaaagaguaacggauuuagucaggcugccuggguuucagaucccaggaccccaguuuccuagccaugugacccugggaaaccuuuauaacaucucuaagauuagguuuccuacucuauaaacuggguauaaucauaguauuaccucaucuuguuguuugaauguuagguuagauaauuaugugaaaggcauguagaaguguauguuugguacaaauggugggcacucaaauguucauugcagucagcaucauuauucccauuguguaaggagguugagggaauuccuguaugaaguuuucuucaugaaguagaaaacagaugcuauuugcuuauaaaucugucuccacuguccaguauuagacugagcuccuugaaggcagggcccauauguuuucauuuuuaugucaucagcagaguuccuggcacaaaguagaauauaacagaaaaaugcuagagucagaccuggguuugauucccaacucuacugcuuacuugaguguaugaucugggauaaguugcuuaaucguacuuccucuguuuccucaucaguaaaauagagauaauaauaacacuuccuuuuuaggguuuagugagggugaagauugcucaguacauugucaguacuaugaagccacuugggagacuucuggcuuugguucauuguguuacuuuuaugaaugacauucuucuccuuggucuucuuaccucuguaggaauuugcaauauauacuaucuccuaccccugacaccccaaccaaacaccacacauuuugaaacuauuuucaguguuugccuuuccaacuacuucauucccagaugagguuuuuuuuuuucauaucuaaaugauagaaacuaagugggaggaaggucuuugaacuguaucauacccucaucaauauucuguauuguaagcaauuaugacuuuguuaaauuuuuugcugccuuuucugauauacauaguagagcuauaaauggccucuaagcaugacuuuaacuuaucccacagguuuucauauauagcaucuuaauuuucuguuuuaauauuuucuaauuuccaaugugacuucauggauuuaugggcuauuucaauagaggauuguuuacaauuuucuaacaugauaguuuucuauuuaucuuuuuguuauguauuucuaccuuauuugcguguuauugcugaauauucccugguuucagucuuuuguaauuuguugagacuugccuuaauuguaaauuuuuacaaauguuuuuauuugugcccuaaaagaaaaugcauucuggaguuuuugguuccauuauucuaugucuauacucuuuaggucguuuguuaauuauguucguaucuuuuauaucuuuacuuguucuguuuucguguauuuugcuuauucagacugcuacugaaaucuguauuaaaaauuuauggcauaauuguagaugacauuuuugccuuauaaauuuuuuuaauuuuaauuuauuuguaauucacaaauaauaauugcauguauuuaugggguacagugugauguuuugauacauguucacauugugaaacaaaucaagguaauuaauauauccaucaccuuggccaggcaagguggcuuacgccuguaaucccagcacuuugggaggcugaggcaggcagauuacaugaggucaagagcuggagaccagccuggccaauguggugaaaccccuucuguacuaaaaauacagaaauuagcugggcauggugguauacaucuguaaucccagcuauucaggaggcugaggcaaaaggaacacucaaacccaggaggcagagguugcagugagccgagauugcgccgcugcacuccagcguaggugacagagcaagucucucucucucucucucucucucucucucucucaaucucucucuccccccucccucucccucucucuccuccucucccucucccucucccaucuauaagcuauaucagcuuucuuuugguuguguuugcauggucuauauuuuuccauucuuugauuauuuaauauuuuccccucuguuagcuuuauaguuauacacuuuuuuacuaugcuuuucuuaaaucagaaauuacaaaacacauucuucaccuaucaagucugcuacuacagcuucauggacagugcaaggaacugagagcacucuaauagcuucauuuacccuucuccagacuuacauucuguaguuguauuuuaauuacuguauuuuaaacuucaugggauauuaauguuacuauuuuauauaguaagcauucauguagauuuacccacacauuucccauuuuccuugguuuuucuucuuucuuguuccugaaagcuuccaucuggagucauuuuucuucucccaguggauuuuauucauuguaggacugcuaaggaauuauuuccuucaguuuucuuuauuugaaaauuauuuuuucccuuuuuugaggacuguuuuugcuagguauagaauuuuagcucuuggagauaucacucaauugucuucuggcuuccagaauuuauguugagaagccagcugucaguuuaauugcuucugccaaaguaaucuaaucacucugguuuuuuuuccuggcuacuuuaaaacuuuucucuugauacuccaccucacccccugccacauguacccuggugugcauagguauggggggauuguuuguuuugggguggguuuuuuguuuguuuguuuguuuuuuuaucuugcugggaguuuuuaaaccuccuugaucugugacuuuagaucuuuugucacuuuuggaaaaugcuuagcuaucaucuugcuucuguguacuugcucuucucaggcucugguuuuucagaugucacauucucucacugaaucuccuguggcucuuaccccuucucucccaccuucaccuuuuuuccucuccaugcuucauucuggauauuuuucagacuagucuuuacuuuucaaauucucuucuuagcucugucaaaucuuuaauuaagcccacuuguuggcuuuuuaauuuccauaauuguauauuuuaguucuagauuuuucauuuaauuauuuuucuuucuuugcugauauuguuagucuuguauuuuucucuauauauaugauagaucacuaacuggaccaauucugaccagugagcuauaugaccugugagcuaagaaugauuuuuacauuuuuaaggaguuguuaaaaagauguaaaaaaaaaaaaaaaaaaaaaaaaaagcauacaacagaaacuguauguggccugugaaaccuaaaauauauauucuuuggcucuuaacgaagauguuugccaaccccugguauauauuaaagacaguuauuuuagagacugugucugguaacccuauuauuugaaacuucuuuguuaguuucuggaguuuauuccauacuuuuuaucagugccauccugucucgucauaugugccugguuuuauugggcugagcaauggauguuguauaugugaaaaaaaauuuuuuuaauugagaccuaggaugacuuucuuccuauagugaggauuuguguuugcuuccaacaguugauuggaaaugcuaguaauccuguauaaccuuauuuuagcaucaggcauugaggucauucuaaaauuagcaucaguuuacuuuugggugacauuuacucuagagucuaauuuacucuccagggucccagugcaaagauggcccuuccauccuaggccuuggaauuuaacuuuugucccuuuagccaguggcugucacagguacuucuuggccuuuuagccuuuucuuuaggaaucagaaaauauucuuaggagaaaaaguaacgucagaggccagauacuguguguguguguauguauguauguacuucagguuuucuguuugucuuaguacuaggauucgucugaauuaucuaacauaccauuaucagcaggggaaguucgugauguacuuuauguguaauuuuuauaauuacauuaacuccucuugagauaacauaauucagacucagucauucccucagaauacauuuaauauacacuauguguguguuucuuuaauguuuuucauuaguaaagcaaugaggaacccuauuuuaaaaauuaaauugauuuugauagcccugaauagcaaguugcagagaaaucauuuggaaaauaaauuagcauacuucuuaugcaaaacuuuuacuacucuggaaugcagugguuuguuuauugucuuaauuucuguagcuuguauuuugugagaugucucuuuuacggcaugaaauauauuguacagccugcauaccugguaagaaugcgaccauauuaaagaugaggugguggagucauuuacuuuuuguguuucuuguauaccugugccuaguacagacauucauuaaaucauguugauuacuaagaaaucucucaggggccaacuagaagcuaauucaauauuaaguguaaagaugcucacagaauuuuuggaauauuuaauguaaucaacuuguuacuggucuuaagucuugcugccaguagcugaacuugauuccaagauauugcuguuuuauucuuguaucagucaccauuuuuuauuaggagggagggagggagagugagugugugugugagagagagagagaguguguguguguguguguguguguguguguguguguguguguguguguguguaggguaacauuccuacccuuaaauggacaggucugauauuuuuauuugggaggauagaagggccaaguuuuuccucugaaauaucauuaguaauggcuuuugaaaacuguucagugagcuuaccauuguaggauugucuaauaguuucagagaguaccauaugguucuuauuucaaaagaucuuuuugcugaaaguagagaacuuggguuaaaaaagagauugcacaguaauguacauaaaaauuuguugaacaugucgaaaccgcuuaaaaagguaaagcuugacauuuagaauaacuuaaauuauuuuuuuuuucagcuuccagcugaucuuaccaagaugcaucucacagaaaacccucauccacaggugacucaugugucuucuagucagucugguuguagcauugccagugacucuggaagcagcaguuuaucugauaucuaucagguaauaccuuaggaauuuguaugcugcguauaugguuuuuuuauuugccagauauucugugauugugccuuagaugguuaacauaucuuuuagaguaugaaauucaagcguaaggucuuuagaaaaauaagcuuuauauacugugucaaauuuguaagcaugauuaaagacgugaucugucuuuugagaaugauuaaguaugguucagcagaguaugaaucuaguguucucuuucauuuauccaggugaauccauauuaauaucuaaugcuuguuuugguuaaaaaauuaguucuuggaauaacugaacuuaaacuuauaaaaaggcugauuuuuguuauaauugacuguauaugucuucuguaguuagaagucaugaagaaaauuagagcugcuuuucuaccauaaagccucuguuguagucuagcgugaauuaaauagcaaauuagugagaauauugauggacuuuuccauuuucuaaaacccaagaggaacaauuucaaaccuacugagcuuuucagugaucauuguaauauuggggagaagguucuaggaagacccauaaacugagagaauccucacaugauccugcugagauugaacccaaguuagguucaagccaggguaauaaguauuucaggauccagauaguggaacuucuaugaugucuucuuuaaugcaaguuguaaggagcaguucccuggguguggagcccagugguugauuuugucagagaucaugaguauagaacauaaaacaguuuaaauaaaauaacaagaggaugcaugauauugaggguugguuuguuaaggaauucaaauauauuaccuauuucagaacugucaaauagaaauuuaaugugagccacguauuuaauuuuaaauuuucuaguagccacauuaaaaaauauaaaaggaaacagguaaaauucauuuuaguaauauauuuuauuuagugcaguauaaccaaauacuauaauuacaacauguauuuaauguuuuaacauuaugcaugaguuaccuuacauuacuuuugcauauuaagucaucaaaaaacagaguuuaauuuaaaguuacagcacaucucaauuuggacuagccauguuuuaagugccuaauaaccacauacggcuaguggcuaccauauacuaagaauuguagaaauaguaucauugucugaggaaagcauuuuagacugguucuacaaaguuacccagauugagauauuuuaggaaaauagccuucuucuauucagggaaguuuguaggcagaugcaaaauggaacaaagacaauacccauuuuuugguuuauauguggcuuuucucaacaaagguaauugcuguggucaucuauaucucccuguuugcuuuuuacaguauacagaacaaggaauuuuucccuguucuccauuuuauaguagagagaacaaagaauuaaaagagagaugaaacaaguuaauacaauagcucuggcaccacuuaguacuuguguaccuauugggcuucaugcuuucugccccuccccaaaagaauuaucuugugaaagaagaauuguugcacaccuaaaaaucaaaguagacuguguuuuuccagaagaaaacacugaggaagauugacccuggaucagugaaauucagggauguggcuguagauuucucucaggacaugugagaauaucuggacuuuucuaagacuauacacagagguuuaguguugaaaaacuauaggaugggaggccuaggcgggcggauuaccugagguuaggaguucaagaccagcaugaccaacauggugaaacccugucucuacgaaaaauucaaaaauuagcugggcgugguggcacacaucuguaaucucagcuacuugggaggcugaguaaggagaauugcuugagcccaggaggcggagguugcagcaagccaagagcaugccacugcacuccagccuggccgacagagcaagacucugucucaaaaaagaagaaaagacaagaaaaacuauaagaaccugguaucacugggauauccacaucucuaagccaggauagugcacagauuaagauucaaggucacuuggaaagaccaaugcuuuauugugaacuagaagauggacuguacacaguuggucccuacaucuuugcaaagauacuacaggagcuccuauaggagcauugcacuuauauuagcaccugcagauuacuccccuuuuagcuggacaaccugaggaugagacuggaguacaccugcugguguugguuggagguguucuauugcaggaccauggcauagccuauaucaauauguagaauauuuccaucaccucagaaaguauccauaugacccuuugcagucaaguaccuucuccugaccccuauccuaugcccuggcaaccaccaaucucuuuucugaccuuauaguuuugccuuuuccagaaggucauauaaauggaaucauauaguuuaaaaaaauaugaugcaaugaaacuuauaaauuaaccaauaaaagugggaaugaauuuagagagcaugaaaagauaaaaggaauaaagauaaaauaaauaagauaaaacucuagaaccaaaauaggaaugaagaaauuuaaagaagaaacuuauaauaauguuaacaucaaauauauaaaaccuaagauaaaauuuuuuaagaguagucaaagaagauaaaaauuuucaaacucugcugcugggcacaguggcucaagccugcagucccagcacuuugggaggcagaggugggcggaucaccugaggucgggaguucaagaccagccugaucaacauggagaaacccucucucuacuaaaaauaaaaaauuagcuggggugauggagcaugccuguaaucccagcuacucaggaggcugaggcaggagaaucacuugaacccaggaggcggagguugcggugacccaagaucacgccauugcacuccagccugggcaacaagagugaaacuccgucuccaaaaaaaaaaaaaauuucaaacucugacauaacaguuaacuuuaggaccauagccaaaagauagaaacagcauaaacgccaaaauaaaaagaagccaauaaagauaaacacaaaaggaaaaaaaucaaaaucauaaaaauauacaccuacauacuuauauauuuuuuauaucucauauguauaaaaucuuauauaucauaucuaugagauaaguagguauuuuuaacauuuuauuuauauuucguuaaauaaauauauauaccuguauacuuaaauauguuauacuuguagauacagaauguaaauccgaguucaagaacaccaguuaguaacaguguuuuucuacuagugguggguuuguggguaguuuuuauuauguuucuuaaacgaacauuuuuauuuauuuaacaaauauuaaggaggacguaaauagauuguauaguuaaaaguugaaaaaaaaauuggaaaauauuuaaaggagaguaaaaggaauaaacacagaauuauaauagauugauaagauauacccuccaaaguacaagauuucuauaauuuuaauccauggguaagagaaaugucuaacuaaauuuuguguguguguguguguguguguguguguguguguguguguguacaugcgcgaauguuuccaaucagauccucgggaauaaacaaggagaagaauuaaauaucaguacuggacccuugaucuuuccuuucaccuuaggcugccuuuagauucccuuuuggagcuaugaauauaccccuuaguuacagguguacauugccaauguauguaucuuagccugggauagcugaagugauuugucuaguuauuugaauuuuagcauuugagagauuuuuuaagugaacaccuagccuuuaacaccauaagaaaagccuugugaaaugauagaaguauuuuuaauuuggacaguugaggggaagauauccuaacagcaauuuuuuuuuaguguuucugcuuuuauucuucuagaaauuuagaaacguuucaagugaaauccagcuuuuuuuguggggcagaagacuauauauagauuaauuugggcauuuuuuucuaacguggagucuucuuauccagaaaaauggaugucuccccaauuuuuaaaaauaauuucaacuuuuauuuuagaugcagggggguacaugugcagauuucuuacauaguauauugcguggugcugaguguuugggguucgaaugaucccaucacccagauagugagcauaauacccauucggugguuuuucagcccuugccccucucucccugcccuaauagaccccagugucugguguuccuaucuuuagguccauguguacccaauuguuagcgcccacuuauaaguaagaacaugcgggauuugguuuuccugacagcaguucuuaacaggaaaacuguuuacacuguuuuauauggccaaauguguggcuacacuucuaugcauuuccuucuugagaguuuucaugucuucuggucuaaaaauaaaagcccuuggcccucaaagaaacuucaaaauauagcauguacuauaguguggagggaaaaaaaggcaaaucaaugauuccagugugaauguguuucuaaucagcauagauuaaaauuuuaaaguauacauuaagguguaagaguguucuuagauagaauauuuucugcaucuucaaagaguauucaagagaauaaggaguacuucuuucuagauuccuuuuucuauuuauuucagucuuuuccaugagcuggaaaacugugaaauauugacucuugaacaaaagcauguugucuuuuuguuaacucauucuuaaacaacuccagacacacauuuauccaccaccuaccuuuucaguuucuauauaggcaguaagcguguucuuaaaaaucccaagacuucaguuaccaccucuauggcaacaugauuuccuaaugcacagcucggagugccaaucucuucagaacucuggugccacguuuucaccaguauguucuuuugucaacucaagucaccacauguucucuuacaccuuucuuuaauauuucuguuaagaauaucaucugaggcuggguucgguggaucacuugaggucaggaguuugagaccagccuggcuaacauagcaaaaccccaucucuacuaaaaauacaaaaaaaaguagccacgugcgguggcgcaugcaccagcuacucaggaggcugaggcaagagaaucgcuugaacccaggaggcagaggugcagugagccaagaucgcaccacugcacuccagccugggugacagagaaagacuccgucacagaaaaaaaaaaaaaaaaaaaaaaaaaaaaaaaaaaaaaaaaaaaaaaaaaaaaaaaaaaggauaucaucugaguccuagucaaaaucuguuaucaucuuuugacuaucauuuuuaaacucccacuugaaauaaauugcucugauuuuuaauuacucuuguauuuaaaaagcuuuaauucuucacuguuaucuaaauuacacucuuaauuuuaaauuccaagccuuuuaccucuaacuacaauguaguuuuauauuuuacuguucccccacuuacacauucuagauucugccccaucacauauguacguuauucccugaacaugucugccuuuuccuagucuuguguuuuaaucaugcucuucuacccguagcuucaugaagaugacauuuucauguuaucucccaugucuuuccaacaagaagaaaugucuccuuccuuggaaucccucagcaguuuuucucucggacaugucacuuuuucucucugcuuuuuuugguaguuacuuguaaacuugacauuuuucaucaccagaguaaauuuauggagugcagaguugaugucuuaaauuuguaucccauggugagucaggcacaguguuggcauuuaggaaguacucuagaaauucuuuuuuugcacugaauuauauuugaaaguagaaaccaauauuggcuucaaggaaaaugcagaucucugcuaacuaaaacuuuauuauccagggcaaaagagacuugauuuugccugccugccguguuguagagguuaugaaaugggucaaccuggacugaaagauuaacuucauagaguucuaacccugaccaggaagaccuaagaacuaaaugguccaugaaaagguuaaaugaaauacuaaagaugggaauacagaaaagagaggcacugaaagucuaaggcuuaacacuugcccuaaauuugaaaaugugguuuuuguaaguuuguauaacucuuaguuccaaccuauaguucucuucauuguagcuucauguuuaucuagauggaaacaggaaaaggauauccucuggugguuuauuuggggaaggccgagucaucagaaaaucaccucagacugucugccucaccaaauuauauuuauguauacagagacacauucauaugucaggaaaagaaaaaaguuucaugcugucuuaauccuaucaccaauauauauauuuuuccuggacuuaacucauuuaucauaauuaagggucugauaugucccaggugcuaggauaaauuaauugaaaggcuggggaugagucuucuguguacccuaccuucacgaauacggagugucuuuugacccacauauuuccacucgugguauuaugauaugagucucuaaggcuuuauuaauuuuuuuuuggcuuuuuucucaucucuacuucagauuggguagcuuuuguugcccuuucuucaaauuuauucuucuuacaguuuauaucuccuuacugagauuauccauuuuuccucuaauuguuuuucuucuaaauucuugaacuuauuuguaguaaauguugaaaguucuugucucuuacuuucauuaucucuaucauuaucgagucucuuuauagugguuuguuuccuguuuauaggucacauuucccugcuucacuuauguaguaaguuuuuauuguaugcugaacauuguggauauuacguugaaaaaaauucuuaccuaauuauuauagaauuaaacuuucugcccaggaacugcaucuucagaaguaucaugcagugacuucuuguccuguggucauaaucauaucuaccuuucucuuaaggaccugacuuuccuuuguuuaaucaaggaguuggucuuuacauuuuuaaaaauucauuuuaaguuuaaaaaaaucccuuuaaauuucuuagcauguuuuugaacagucuuauuuuuuauucuuaauuccuguuuuaucaccuuaugcucauguauacucuuaauauuuuaauaguuuaauguauuuucuuaacuaauuuuauucuuuuuauacuacuauguaaaaaguagagguauaagaaagguaguugugguuuuugggggguuuugguuuugguuuuugagacacguucucacacugucacccaggcuggagugcagcagcaagaucucggcucacugcagccucugccuccaaggcuuaagcaauccucccaccucagccuccugaguagcugggagugcaggcaugugccaccacacccggcuaaugccaccacacccggcuaauuuuuguauuuuuuuguagagacaggguuucuccguguugcccaggcuggccucaaacuccuaggcucaagcgaucugcaugccucagccucccaaagugcugagauuacaggcaggagccauugugccuggcuuagaaagacaaauuguaaggguagauuauauucuuuccuuugcaguugguauuaaaagguuccuaaaaaaguucuuuuaguagccuucucucagucccaacccaugacuuccauucuuccuaaagagcuaucuccuuaauugucuuugcuucucaugcagaugauaauuagccuucucuacuguccauauaacuaaauuccaucuugccuuuuuauguugugagccaucuaucuuuuuauccaacauaaucuaaaauaugggaaugagaccagauugaaauaaucugggucaggggaugaaaaccuuagauuaagaugaagacagagugauuuaaaaaccugaauuuuuaaugcagauuacacuuaaaaauugauaaaauagaaaagggauauacuaggagugagcucuccugcauauugagaaauuaaauuguguagaaaauacugcuuuagguuuuuucccagucguuucuuagauuaaaucaguguauauaaauaagguuuuuggaaagucuuuuuagcauguacacauauuuaaauuuaaaacuacuugucuuuaaaaaaggauuauaaccugcaaacaaguuugugguucuauguauuauucagaaauauacuccguuuaaacccuguaauuucauagccaguaaacaacucagagcguacuagucagucaugagauacaguugccccuauaugauccugucuuaguccauucaggcugcuguaacaaaauacuguagacugggggguagcuuauaaacaccagaaauuuauuucucacuauucuugaggcuggaaaguuuaaagaucaaggcaccagcaagcagauuuggugucugguaaaagaccucuuucugauuguuagagguaccuucuaacuguagcuucacagaguagaaggggagaaugagcucccucaggcuucuuauauacuaaucccauucgugagaguucucaugaccuaaucacuucccaaaggccccacuucauaauuccaucacucaaaauaagaauuuugaggagguacaaacauucagacaaucgcagacccuuaagaacuagcuugucuaauuuaaagaucacaauuugaguauuuagucuagauuguuaaaugacuauuacuuaaagcugugcagaaauccaaaggaaguauaagacauggucuuaggaaacagauccagacucuucuaguuguaggugucagagccuuaacuugaauuaacaaaagccaaaaggccagugccugugguccuagcuacuagggaggcugaggcuacagugagcugugaucauaccacugcacaacuugggugacagagugaaacccugucuuuaaaaaaaaaaaaaagaagaaaaaaaauguaaagccaaaagguuaguuuauugaccaccagagaaagcagaggcaacucuagccucaggguaccuggaugcuugcagguacgucugccccgucugccuguuucuggucuuuuggcuccguacggcuugcuuauuuuuccuugcuugcuugcuuugugacacuuucugucacaaaugcucuuugcagcacaugcugugcucuuucuuucucugcccugcaugcucuguuucuguugcuuuguugcucugagucuuuguuugacucucuuguucaguguccuccuccccauucccuuuccuauuucccugccuauugguuucauuuucuucugccacaggaaggcguuuccaugaggcuauaggcugccuacucucauauucuuccaauuuagcaaccaguuaagaaaggaugcucugcuuccagaucuaauuguguacagaaaucuagagaaaagcucuuucuaacuuaguuuacauagcuagggaacagggcacuguuucccacuguaaucucuggguuuaagauggagaggaaagguaguccucaaaagaaggaagaucagcugggcaugguggcucacccuguaaucccagcauuuugggaggccaagguggguggaucacaugagcccaggaguucaagacuagccugggcagcauagcaaccucccccgagucucuacaaauauuuaaaaaauuaguuggguaggguggugcauaccuguguucccagguauucagggcguucaggagagaggauuucuugaguccaggaggacaagguugcagugagccgagaucugcagugcacaccacuacacuccagucugggugacagugggagaaccugucucaaaaaaaagaaaaaaaaaaaaaaaagaugaucuuuuuggcaguaaaaaaggguaaauguucaaaacaugagauacuuaaugaauuaagauucuguagucuucacuaauauucauauuugagugcuuucuacuuauuagggaauucuuguguguucacucauuuuuucuauaaugccuuuaauacccaugcuuuuucauuaacaagaugacucaagugaguauaauauuuagaaauauuuuuuaagaaucuacuuaguaccauuuuaucuucuaaaagacauuuucauuauuuucuaugaaugacuuuuuaauauaugguuuuuaaaaauuuuauaguuucuuuaaaauauguaagacuaauauguuuccaaauuguaguuguaaguauaaggucauuuuauagaguucaaaaaucacagcucuuugcacacuuuuagauccuacaguaaaguauugggaaaugaagaguauuuguucaguccuuuacgaugggucuauuuuagugcauuuuaguacuguucuuuaccuuacuuuaaacuucuguucuuaauuuauaugauuaccuacccuacuaagccuaagucucugugaugaaagaacaguaucuucuucacaauacccagcauagacuaauagguacucauaaggugauuguugguaaacuuuuucuuuccuguacuucauguuuuaguaaacuuaguacuuuuaggaaauacaaguguuggguggaaaacagauauuaauacauuuagugauguuugagucuccugaccauuuuacauuuacugauucugauuuaucaccuaguugucacacuguggaaagaugagccucuaaauuuggggcagaaagaaccuuuuauaaauaaguaucauuuuauuguauucuugaugcagcauccagcguugcccaagucuuuuauauuuuguagggauggguaguuuugauuaauucagacugugacuuauaauauuuuuuacaugaaaugguaagugaucaagauuucuuuucauaggcuacggagagugagguaggagauguagauuugacacgucuuccagaaggaccuguugauucugaggaugacgaagaggaagaugaagagauugaucgaacagauccauugcaggggcgagaucuuguucgagaaugucuugaaaaagaaccugcagacaaaacugaugaugacauugguaagaaauauauguguucacaauaagaauuuguaacuuaauuuauaugguuaccuauuucugcauaacaaauuauucuaaaacuuaauaaauguguguuguguuaagccauuaucuuagaguuuuugugagucaaauuuaggagcaccuuagcugagugguucuggcuugguaucucccaugagguuguugucagaauugacacagggcugcagccauccaggucuucccugggcugagcuguagaaucuguguccaagauagcuauucaaauggccuuuggugcaugaccuucaguuccucaugugggccucugauaggcugcuuaauuguccuuacaacauacuuaaggggaacuuaggcuucccccuaaguaaguaauccaaaggagaauaaggcaaaugccacaguuuuuuauuaucuguauucaagaguaaugcaucaucacuucugcuaaauucuguuuguuauaccagguaacucugauacaguauagaaugggucuguacaaggacaugacuaucaggaggcagggaucacugugagccaucuuugagguuggcugccacaauauauaaaauaaaagcuuugauugcauuaaacugauuuuucccuucaugucuauaagacauuuaaagcacaagcauaguacaauguucagugucugugaauuugcuuuuugaaaaacuugcagauuuuuuaaaaccuuauauuuuuauuucccuagcuuaaauauauguauguuuuguguguacucuuauuuuuuuuuuugagacggugucucacucugucgcccaggcuggagugcaguggcgcaaucuuggcucacugcaagcuccgccucccggguucacgccauucuccugccucagccuccugaguagcugggacuacaggcgcccgccaccacgccuggcuaauuuuuuguauuuuuaguagcaaugggguuucaacguguuagccaggauggucucgaucuccugaccuugugauccgcccaccucggccucccuaagugcugggauuacaggugugagccaccacgccugaccauguguacucuuaaaacauuauaaauuuuuuuauguaauauuuuacagaacuaguuaccauacuuuaguugggaaguugaaugauacuaaagauguuaauguuaucuuuaagaugcaaagaucacuuagugucaaacauauauuguuaggauuuaauuaagauuuuuuucuuagauugcauuuuuauaauagcuacccuuccaauuagaagaugcugcuacuauuaaaaaucauuuaugugaguaaagaucaauguauuugaacauuccuugccauucuaaagauauaauacaguuaaauaaccugcaguguggauuuauguuaugaacguuaucucgacagaaacugaaagugcaauuuuacugauaaagaauuguauacuauacuauuuucauaaaacuuuuuaaaaauugaaauauagcuaauuccuauguccuauggauauauagcaccuuauaguuauucuuaaucucuuugcugacugcuuauauguguuucuuauauuuauaccuuccuuacacauauauccauaccagggaguggccugaggcacucauaaacauuuguuaguuaaagagaguuaccuaguuaguuagacaaaucuugagcuagaauucacauuuauuaucccuguuuuaauuacuuuuuggauuuuauuaauggcauuuuuaaauacuuuuguuuaguaagaacuagacaaaagacuuuuucacuaaccuauuagaucaaaggccauaacuaaacccauggaguggcuaggaauauuagauaaacgcuccgcuuucaucugaaccuguaugguccuuguucucucuggagguugugaauucuguuaucuuccaauaugcccagguuuauaugugagucugaauauacauauuaaucaaauaauugauuuuaaaaaucaacggucaaauaguaccuuaguuucucuacuuuagcaacauaaauuuauaaguugauugugaaauugggaauugaauucuagauuucguuguauuuuuaagguauaguccucgauggucuuuauaccagaauuucuguuuucuuauagaacaauugcuggaguuuaugcaccagcucccugcauuugcaaacaugaccaugucuguaaggagagaacucugcucagugaugauuuuugaagugguagagcaggcuggagcuauuauucuugaagaugggcaagagguaggucaauaaauaaauuacauacauuuauuauggauacuaacuuuuaaaauaacuuaauuuccauaaauuuguccugauuuuugaguacugauuuuugaaauuuauacagauuucuuaaauaaaugccaaguuugaguuaguuacaauuucugaagagguaaguuuuuguuuuugcuuugcccuaauuuuaaauuuauucgcaguagacucugcacaaagucagugcuccauaaauaauauucaaugaaccaaauguuuuuacuucucagauuacauuaaauuuaaauagaugaaauagauuuaaaagauucuugaauauuuuucuauuuguauaauuauaucauuauuguuuaaaauguuuaucaagaauuuuucuuauuccuuauuucuauuauacauuuaaaagaaaaagaaugaggaacauguguugguaccagugcauccuagggaacugcugacaguugaagcguuuaggugacaauucuauguucaaaaaugcucggaugacagcuuguggauggguggaggaaggaugcaaagggauuggaagguauuauugccaucaggaagugcuucauuauuuuuccuaucaaauguacucauuugauuaaugcugagauaucaguaaaugaacauugucuucuaguggaaauguaaauugguacagcauuuccagauaauuauuuuaaaauucuuaacaugguccuccaaguauucacagcugcuagccuguuauuccacuucugagugucuaaccugaggagacguguagaacucaaagaguuauuucaaaagguguucauugcaguacauuuauaauauaaauuauauacuuauauaaucuauaaguaaguuauauauaauuacauaauuucauacuauauauauaauauauaauauuacauauauuauauauauaaguaaaaauuggacauaaccaaaacauccagugauaagcgaugguuaaguaaauuauuauauagcuguagguuauaauauauagguauccaaauuauuuuuaaaauuauuugauagaauaucuuugaggaucccugucucuaggcucuguuuacauauuuucuccccguauccuagaaaacaucugucauagaggauggacuccccccaaaaguuugaugaacaaaugaauauaguauuaauuuuuuuaaacaggauauucuaaauauuucaauaauauaaaauauauacauaagagagaaauaagcuuuaaacaacugaauggagugggauuuuaaguaacuucuauuuuauacaaguuuuugcauucucuuaauuuccaguuguaucagcaaaaauuuguuguaugccuacuuugugccagguacuguucuagauacggggauauaguggugaaaaagccagauacacucccugucuuccaguagcuuaauccacaaguuguguagugaguauaucuuauuuuuaaaauaauaaagguauacuuuugaaaaaaaauaccuuauugccauugauuacccuucagaacuaaccaucuugauuucccuuaaaucacauuaaaacuauugaagguucaggcuuauaagaggguuugauauuaaaggagaauaaguggucuuucacugauauauaguagaucuuuaaaauacaucuucuuugggccaggugcaguggcucaugcuuguagucccagcaccucaagaggccuagguggaaggaucaccaggaauucaagaccagccuggggaacauagcaagaccugucucuauuaaaaaauaaauugaccaagcauggugguggacaccuguagucccagcuauucagaaggcugaggcaggaggaucacuugagugcaagacuuugaagcuacagugagcuauaaucauaccacugcacuccagcuugggcaacagagcaagaccccaucucucaaauaaauaaauaaauaacuucuuagagcauuaaauauuuccauauaaaugaaggcauuauuuucuuaacguaggagaaauuuugaaucuuuuguuagauaugccuuaaaauucaggcuuuuaacuagucuuucugaaauaaucauuagcuaucuauuuuuuuucuuaaauguuugcuuuuugccaggcacuauucuaagcacaguguauguguuaacucauuuaauuaacauaauaguucuaugauagauacuuuccauaugaccauuguagcaguagagaaacugaggcccagagagguuaaauaauuuacccaaagucauucagcuaguugguggcaugguauggauuaauauuccaagaguuugugcucuugaacauuacacuauuuugucucagaaucuggucaguuaugacaguucuuguuuggugacuaaaagaagaaagaguaaaaauaaacuuuaguaguuugcauagacucaaagcauaggguguuacagaguguuugguaauauaaccagauccuccuuuuuccuuuuuauucaaguuauauauauugauagauucuuuuucaaaguuaacauguaacuaccuuuuuuaaaaagauucauaaaaccuuuguuuuucucuauagcuugacucaugguauguuauuuuaaacggcacuguggaaaucagucauccagauggaaaaguugaaaauuuguuuaugggaaauaguuuuggaauuacucccacucuggauaagcaguacaugcauggaauugucaggacuaaaguagaugauugucagguaagauuaucucuuuggucaagucuucuugucuguugguuuaaaguagcugagccuguuuugucuuccucaaaagaaaauagcuuuauuugagaauuaggaguuucaauagcucacaguuaauaaaggaaaguagauuuuguaucugccucaaauauuuguggcauuuaacaagcuauaaguuuucaaaagagauuauaccaaauaaaugcugguuuguuacauuucuauuugauauuagccagcucagaguccuuuauuuaaaaaaaaaaaaggaaagaaauaggaacuucugaguuguuuguuucuaacuuacuccugcuucauauguucuuuacauagugucaguuuugagagaaguggaaguucacuucuccuuuuaaagagcaaaauucaaacagauuagacuucuuuagucucuucauacgugaauuguuucaccuugauuuuuguuaaagauuaaaggaauuaagugaaaaagaacuaaugccgcuagauuucuuaccuuugugcucugcauugguacauagugauauauuuauguacuauagguucauuaacuguccccauguuguucuuggacaguuugucugcauagcccagcaagauuauuggagaauuuuaaaccauguggaaaaaaauacccauaaaguugaggaagagggagaaauuguuaugguacaugagcaucgggaacuagaccggaguggaaccaggaaaggacacauugugaucaagguggguguuuuuacuuauuuuucuagucacugauuuuauucuaucaucaaagcuuucaucuuguuuuaaaccauuuuuuaaguaaugcaagauaauucauuaacacuuuggcaucuaacuuaaauguugacucuuugucuuucucuaaaauuuuuuuuuuuuuugugauggagucucacucuguugcccaggcuggagugcaauagcacaaucucagcucacugcaaccuccgccucccagguucaagcgauucuccugccucagccuccugaguagcugagauuacaggcaugcaccaccaugccuggcuaauuuuuguacuuuuaguagaggcgagguuucaccaucuuggccaggcuggucuugaacuccugacccugugauccucccaccucggccucccaaagugcugggauuacagguuugagccaccaugccugaucucuaagaugguuuuuacacauuuuaaugaugaaggaugacuuauugccauuuaauaucagaguagguaggguauuauuuuagaauauacuggucagaguuuuccuuuucaaacuuaauauuguaugccacugagagcgggagucaguuucaucaaagacugcaauauuuagaaacaaaacagaaaauuuaaggaccagucauaaaagcauaaguaauccuagauuaagaugcagagugcuucuggaucucuguggcacugaaauaugcauugacuucucugaaccucacuuuucuuaucuggauauggagguaauucaagacuuuauuagggcuaaaugagguaaaucaaaagccuuagcacaauuguagagucugaguauuaacccccauacuguuuucccuucuguaaguucugcccucuccuaauacuugccuucucaccuccuuuucucuuuaaagacuuggauauaaacugaacaauuauaguugaaagaggggaaauaaacacauaacuguuucucuuuucaagcuagucuuggcgaaauuauugccacuauuaauugcagaugaagcaguuuacuuaauaauaugagggaguuaaaucagagagauaauuugaagucugaugucauacuucuucuucccuuagagucaggcuauuccucagagaucuuucuuuuccuaaacagaugaguguaagcuuuguguguagaaaugauuaacauacugguggaaugccauaggcuuacacauauacuuuuucauuuuaauucauuuuuaucuuuuugugaggacucauguguuuuaguaauuuauuucuaaauaauuucaaacuuuauagaaaaguugcaagaacaguagagagaucugucacugauuccucaacuguuaauauuuucacugcauuugcucuauuagucuuuuuucugaacgauuugagagcagucugcaaaugugaugccucaucacuccuaaauaucuuauuguguauuuccuaaaaacaaggacacucucugacauaaacaccauagaauccuucaaguuaggaagugaacauugcuaaaauaaaaccauucagggccgggcaugguggcucaugccuguaaucccagcacuuugggaggccaagguagacagaucauuugaggucaggaguucgagaccagccuggccaacauggugaaacccuauuucuacuaaaaauacaaaaauuagcuaggcauggugguggccgccuguaaucaaucccagcuacucgggaggcugaagcaggagaauugccuggacccaggaggcggagguugcagugagccgagaucacaccauugcacuccagccugggcgacagagugagacuccgucucaaaaacaaacaaacaaaaacagauucaguccagaaacccuauuuagauuuucaccagcuaucccaauaauaacuuacuucuggucuagaguguuguccaagaacacaguugcauuuaguugucaugucacuucagucuguaccaguuccucaguccuucacuguuguuaauauccuuagcaguuuuaaagaauacagaucauacauccuguaguauuacccuccaccuggaucuuuccaguauuuccucaugaccagauagauucaagucaugcuuuccuggcaggaguucacaaaacucagagggcacacaaugucaaccuguuguccuaccaauggugaaguuagccaugauuacugaucauguuggugucugucugcccaguuucuucaguguaaagucaucauuuuacccuuuguaacugauaaauauuugguggagagauguucugacaguaucaaaauacuauccucagacuuuuaguuuauguauaguaugcacugaauacaaacuucuauucggcacuuuuuacuuccauuacuauucuugucugaaauggugauuuuaaaaauaauuucucaugcauuuauuaacucauuguauugaaggaaugaacugucuugucuucauuaauuuauuuauauugguauaaacuuauguuaccaucauucuuauucugauccucaaauugucccagguuuuagguagugggacucuuaaacugacaccuguauuuuuugacauauccccaucauuugagcacauccguauaaucuggcaaauaauaaggcucaucgugaacuuaacuguaccagcucuggaauuagccauuucucaagaagacccugaaucuuuauucauuguuacugaagugucauugcuuuuagagucuuucaucagagcuaggaaauauauguauguauuuguuauaaacacauacacaucuauaacuuuauauauauauuaaacaaccaugaguuacaauuccacuacuaccuguaccuccaguuccaguaccagcaccacaguuuucccuagucuauucccuucuauauuuguaaauaccuucuccaacaaugccucuuguuauacucuguauauuauuugcucauuguaagcaguuucuaccaugccaguauaacaacaccagccaucucuucugcuugcuaccucugugcacccugucucccagcaucccaccuucuaauauauuuuacaauagauuuuaaacacuguguugauuuuuuuaagugaaaguucagaacaucaaaaauacuugaacauaaauuugccgugaguuuauacacaccuuaaaauguuuccagauucugauugcaugcugauggguugcuuuugugacauaaauauugaaaauauguuauuuuuacuguacuacaaucuucacauugagauuuaauugcaaaucauaaccaucuuuugcucauagaaggauugaucauuugauuuuuuuuuuuuuuuuggagacaaagucucacucugucacccaggcuggagugcaguggcacgaucuuggcucacugcaaccucugccuccuggguucaggcaacucuugugccucagccuccuagguagcugugacuacaggugcaugccaucacucacagcuuuuuuuguuuguuuguuuguuuguuuuuguauuuuuaguagaggugggguuuugccauuuuggccauuuggccgggcugaucucuaacuccugaccucaagugauccucaggucaaggccaagcauggugccucagacauguaaucccagcacuuugggaggccaaggugggcuccagaagugcugggauuacaggugugagccaccgcaccuggccuugacuuucuguuuacacauaaucacacagaaagcaguuacuacuuuucauuucauucauuucuucauucaguucauuucuucauuuauucaacaacacugacuuuaugguacucuaugccaggcccugugugagaucugggagauacuaauauauacuuagauucugcuaucagugaacucacagucuuuugagaaagacaaggcgauaguuucagcaugacuugauaaaucuuaagauggaagagcaagagagacauaaaaagagggaucuaaauuaggcuagaagaaauagcaagaagauauagggaggaaggguggccagacagagacauaugcaugugcuauauaaaauugcauaauauauuuaagaaaaagcaggaaauuuguguggcugggaucaagggcauuuugagguaagauagauuuuagucuaaagagguaagggcucaucuuuaaauaaaauuuagaaugcaugaccuagucucuauagggacccugccucugugauuuugccagucagaauaauggccuaacauguugaacaguucccaucccucacucagcuauucuaggaaauggaauuaagugaaccuaaaugacccuaaaccaggauuggccugaguaauaaaacaauuugguacucuuaggcuuagaauguuuuggaggauaggagaauaggaaugaccuaugauuuucuuaucucuuaaggagguuguuucugaguuccuucuagagaaacgauuuucguaccuuauuuuuaauuaauaaaauagggccaggcacaguggcucacgccuguaaucccaguacuuugggaggccauggaggauggaucacgaggucaagaguucgagaccagccugaccaacauggugaaaccccgucucuacuaaaaauacaaaaauuagcugggcauaguggugcaugccuguaauugcagcuacucaggaggcugaggcaggagaauugcuugaacccaggaggcggaaguugcagugagcugagaucgcgcagcggcacuccagccugggcgacagagccagacuccgucucaaaaauaaauaaauaaaaauaaaguaccuuuuaauaaauaaaguaccuuuuuauuuuuaauagauucuuagauaaagaacauuguuaguauuaauguauguuuaccacacaguuauucuaaacaaugaaauuguuuggaugacugcaacaaauugaagguuggguguuauggauaacaguuuuuauaucaggcuuaacaucuuguuuguuucuguauuuguucuuguaccaaccuuugaaaaagcuacaaaggguaauaaacauugguucagaagcucaaagaagagcaguauggaaauuuuuguuuauauucuuuuuuuuuuuuuuuuuuuuuugagacaaagucucgcucuugucgccccagcuggagugcaguggcaugaucuccgcucucugcaaccuccaccucccggguucaagcaauucugcugccucacccuccugaguagcugggauuauaggcgccggccaccacacccagccaauuuuuguauuuuuaguagagacgggguuucaccauguuggccaggcuggucuugaacuguggaccucagguguucugcucuccuuggccucccaaagugcugggauuacaggcaugagccacaccacgcccagccuguuuauauucuuuuauaaaguuggaaacaagcauuuaaaacucugaauuaauuucaaaacugucuguagaacuucugguuccucucaauauggugaccuagcauggagaggaaacuguaugagaggaacuguagaaaaggaaauauuuauucugggaaguaacaauaaugaaacaggcucucuugaacugguguguucuuccuacagccuggucagaaaagauuuuugagguggauuaaauuuggagaaaagcuuucuuuuuucuuucuucccuuucauuccuuucuuuuucuuucuuucuuuaguuuaacuuucaccucuuuuguugccuugagacaauaaauacaugcccugguuguaggagaaguggcaguaacagcccacaccagggcuaaguuagugaaguucaaagguccugcuaugaugaaaugccagugaaaacagcuucagcugagugagugcuguuggcuauuuauuucucugccuuuucugucucucaaccucugggugcugguggauuacaauuaaguuugcauuccaauucucccagcgcuaaggauuuaaaggcgaaacuguacuuugacgauuugucuaauggaguagcuacaaagcggaguaaucaacaauaguucuuugguucuugggucauuuguuuauuuucuaauccuuccuauccuuggauuuuuaggcaacaccugagcgucucauaaugcauuuaauagaagaacauuccaucguggauccaacuuauauagaagauuuucuauuaacuuacaggacauuucuugaaaguccuuuggauguugggaucaaacuauuggaaugguuuaagaucgacagcuuaagagauaagguugguuuuauaaggggcaugaaagugauuuuaacccaaaauuuuauucaugaaacuuuuauaguugauagauuaccuguuuauuaugauaauaagauucaguacaccuaaaaaaauuaaugaaccugaaccaucaguauaaacauucucugcuuacuuuuaugacagaauagcaugcuaaaaguggacgagagccuuaaaaggcaaaaacugaaauaaagcucugguauagcuauagguucaggaaacauaauaguuacaugagaguauuuuagaauuuuacugaaauacuugauuguuucuggagaucaauaaaacauuuuaaaacggauuuaauauuuuagaaagaauauucaucaaauacauuuuuuuaagagggcagauugcuuuuaagcuucaaaaugggaauauuuuuauuuucuugaguuacagacuucacaaucauuugaaaacaauuuaucaaaccuuaauaugucucuccugugacuuauuuaaaucuaccuuuugaguauuuuuuuguauuaaauguuguucacuauuuuaaauaaauuagcuuauuucaugggauauguuugcacauuuaauggaaagacuaguaauacuuccacaaauugguaagaaauaaguuguuucaagaaaauaaaaguaggaucauaauugucuggugugucuuuuugaguuauauuuuaaaggaaauaaacuaguugcagguaaacugcagaauucuuuuauuuaggagacuaacaucuaaaacuacaggcuugcacaccucucacccuuuuucuuagaauuaaauauauuuaccuugguugccaagaaaauaaaggcaugcuuuggaaaugaacaagaauaugauuuagugauaauuauccauaugcaaaagaaugaaaauggauuaccaccuuauacuauaaacaaaaauguacccaaaaugggucagagacagaagagcuaaaacuauaaugccuuaaagauagggguagauuaucauggccuuggauuuggcguugguuucucaaauaugaaaauaugauacccaagcacaagcaacaaaagaaaaaagagauaauuggaccucaucaaaauuaaaauuauuuuugcaucaaaggacacuguccagaaaguuaagacaaugcacagaauaagagaaaauuauauaucugauaaagguuuaauauccaaaauacauaaagaacuuuuacaacucaacaacgaaaagacagcacaguuuaaacauggaccaaggacuuguauagacauuucuccaaagaagauauguaaauggccaacaggcacaugacaaagauguucagcaucauuaaucauagagauaugcagucauaaccucaaugagauaccacuuuacacccacuaggauggcuuuuaaaaagggggaaaaaagaaaaaguaacaaacauugccaacgguauggagacauugaacccuccuccccacccccacccuacacacauugauggugggaauguaaaaugguauuaccucuguggaaaaaacaguuugagcaguucuucaaaaaguuaaacauaggguuaccauauagcccagcaauucuaauccuagguaaauacccagagaauuaaaaacaggugugcaaacgaaaacuugacguaaauauucguagcagcacuauugacaauagccaaaaggaagaaaugacccaaaugcccaucauggauaaacaaaaugugguauagccguacaauaaaauauuauucagccauaagaagaaaagaaguacuaauacuuacuacaccaugaugaaccuugaaaacauuaagcuaaguaaaagaagccaaucacaaaaggcuagguauuguaugauucuauuuauguggaauagccagaacagacaaauagacagaaaagcagacuaguggccgccaggggcuggagagagggcagaaugggaagugaaagcuuaaugaguuugagguuuacuuuuggagugaugaaaauguuccagaacucagaacuagacaguggugaugguuacacaguauuguuaagguacuaaauuaugaacuuuaaaaucauuaaaaugaugaauuuuauguggauucuaccacgauuuaaaaaaaaugacucauuucuuacauuguuaggcauguuauucaaaucagcuuacauucguuaauuuuuaacuuuucugaagcaaaguaaacgauucugcaguuugaaaauuuacaguguuuauaaugaaagaaguuucagauuuguaaggguuuuuguuuuguuuuuuaauuuuuauagagacaggguuuugcuaugcccaggcuggucucaaacuccuggacucaagggauccuccuugcuucagccaccugaguugcuggcauugcaggugugagccacugcaccagacucagauuuguuuuuguuaccguuuugguuaaacauguucuugaccauggaaacgcuuucgguauggauuuuugauugauaggauugccugcuuuaugacaugaaguuugcauuuuaaggugcuaccugaaauagacauucuguguacuucuuuuaucuuaacaaacaggcuugugucuucucacugaguggacaguguccuggcucuguuacuucugugcacagggaagcaaaagcucaaauuaaaccaugccuuucuguuagaaugagccuuuuuuacacaagggagggaacaagaggguugucaguucuucaugaguuuuagacaugcuuuuggaauccacuugugcagaaggaaugccucuuauaaccauaugcugccucuuuuauguuuccacaggugacacggauuguauuauuauggguaaauaaucauuuuaaugauuuugaaggugacccugcuaugacucgauuucuagaggaauuugaaaaaaaucuggaagauacaguaaggcucaaaauaauuucuauucuucagaguguagugguccccccucaacacuagcaaacucagaacagcaauagcuuucauucuuuccugugucuuaaauguccauucuuagaacuuccgaaucuguauucuagacuuuuguucauuuauucucugccaccucaauuaaaacaacauuuacacuccuuccugacucuuccauuuauuuuuuauuuauauuuauuuauuuauuuauuguauuuauuuguuuuuuuuuugagacggagucucgcugucgcccaggcuggagugcaguggugcaaucuuggcucacugcgaccuccgcuuuccagguucaagcaauucucuccuaccucaaccuccugaguagaugggacuucagacgcgcaccaccacgcccagcuagguuuuguauuuuuagcagagacaggguuucaccagauugcccaggcuggucucaaacuccugaccucgugauccgcccgccucggccuuccagagugcugagauuacaggcgucugagccacggcgccuggcccaaaucuuccauuucuguauugacauucuuaucucuuaguuacucaggcuuauaaaccugguguuauauguguacccucagucucuuuuucuugaauucccuggccaggauuuccagucaguugcuaaagucaccuaggucacugauuuagucauacacauguauguucacauauuuucuuauggucucucucagccauuucuuuuuuacucccuaguuuaggacuuaauauaucugaucuauuauaaucugcucacugacccuaguucuaguuucucuucuaguucauucuguguggccaaaagauugcuuuuaaaacacacaugugaugacuauuauuuucuuugucaguaaucuauacuuccuaccaaagcaguuccucacccauauauucaggucccuugccuaccuuuuugcccuuuuuccuguguacccuagauuauagccaaaucagacuauuuuauuuuccaguucugcauccagaccaugcuagaauuuucuuuuccucaccuauugaaacucuguuucacuaucagugcauauccuaaauaucaaaucuauauugacuuucuagguuuccuuucuauauaggauucaucuguucuaaauguacagcaccuaagauaauucccuccaaguccacaguagcuguucgugaauucauuuuaaacucccugucagauauaaaacuuugagcugugacuugguugccuccuucaagcaacuugaaauuuuaggaaauaaguaguaaugcagcauaguguuuuaggaguacagcucaagcuccaccauuugcuagauuuguaaacucagacauugccugaucuuaugccuuaguuguguuauuuguaaagauaguaguuccuaguucauugagauuguuguaaggauuauaaugagcugagaggcauaacagucuguacacaaaaccugugacauagcaaaugcucaagagcuguaauuaauuacuuacagagcauaaguggauugaguugaaugaagugggaaaaauuggcaaauuuggucccuuucauuaccccuugguuccuauugacuucucggcagcacaugugcucuauacaaaauggggagagugaacaacacugggaacuugauuaaaagguuauagagguacuccacuaucauuugagucauccuguguuggcuuuguaaauauucaagggacaucagaaugugggaaaaaaagucaugggauuuuuuuuuccaguaaucaguuagccaucagguauucauugcauucuacuuuauacucaaagacaucaauguaggaucagaacagauguaagacuuggugucugcuuuaaaaaaaaaaaacuuuagcuuuuuguuauggacaugagauuugcacauauuaacacuauuugagauaauugaaacuggaauuagaacugguagacuauuacugaguuuaaggaagagcuaaaauaauacaagaaggaagucuuuucuggacgagaugaaaacuugaauguuucuuugaacauuggacaauauuuaaaaaggugguucaaguuguucaagguuuugaauaaagguuuuaaaagauucugguuuuauauaacagccaggagauaagcaaggugggaguagaguguguauuaggaaaaguuuaagaaaugauaaguaggucgggcgcgguggcucaugccuguaaucccagcacuuugggaggccgagacaggcggaucacgaggucaagagaucaagaccaucguggcuaacauggugaaacccugucucuaccaaaaauacaaaaaauuagccgggcaugguggcgggcgccuguagucccagcuacucgggaggcugaggcaggagaauggcaugaacccgggagguggagccugcagugagucgagaucgcgccacugugcuccagccugggcgacagagcgaggcuccgucucaaaaaaauaaauaaauaaauaaauaaauaaauaaauaaaugauagguaauuuuuugucaugucucuguaaaugagacaucacuuggaaaucuaccuaugauaauuuaaaagucuuauaaucauauuuagaaaucuuguugagagugcuuuggcgugggagugcccccuucuucaauuuuguuuaccucagcuuauacauguauauuuauaacucuaauucuaauaauuuucguugacuuuuuaaaaaccuauaggaauagauacauuuauauacauuuauccuuuucugcuuaacagaagaugaauggucaucuccgguuauugaauauugccugugcugcaaaggcuaaguggagacagguugugcugcaaaaggcuucccgcgaguccccucuacaauucagccuuaauggagggagugagaagggauuugguauuuuuguugaaggaguagaaccugguagcaaagcugcugauucaggacugaaacguggugaucagguaaggaaauaaccaaccacuuauauucaagccuucuuaaaaguauuaugccugcugcuuuuguucucaucuuccagaaagcaugaucaguuuaaggaaauauuuuucugagccuuuuuuuagagguaguaucugcauaugguuuauuuuuaaaaguauuugucauauauuuauuacuuuuaauggaaaauuugguguaguauggccagaaauaacauggucuacugagcucuaucaacaugaccuccuuugaaugggccugccuauccuucauggauuaggaaacuguauaagcuggcaacuugagaauacuccagaacgaucaauauaugaauuagcacccuugcagguuuugaagaagacagcacuucuaccucauaguacucucaaauguaaguggcugcagauuacugaagguuaugguaaucauuaaauuauguucauaugguaacauaacuauauccauaagcaaagugagccaaaugggggacuaggaaaaaagacacucuuaggaauuugauggugauuuuuauuuuuugguauaggcauuagguaaguauagagcagccuauuccaaaugugaucugcuggcaacuuuguuacauaaaaaauguaauucucaggcuucucucaauccuguuagucauauugcccacauucuuaagcaaugaugucugaacaucuguauuuuuaacaaagcucucuagaucagugguccccaaccuuuuuggcaccagggaccaguuuuauggaagacaguuuuuccacggaccagggaguuggggcuggggugauggagaugguuuuuggaugaaacugauccaccucaggucaucaggcauucagacauuaaauuuucauaaggagugcccuagaucccuugcauuugcaguucucaacaggguucacacuccuaugagaaucuaaugucacugcugauuuaacaggagguggaggucaggcgguaaugcucacuggcccacugcucaccuccugcuguguggcccaguuccuaacaggccaugggucuguguccuggugguuggggaccccugcucuagaugauucucauguacuucaaagggugguuucccaaaucugccugaucaucagaaucauuuaggaaacuugcuuucuccccauuuaaaauuuuguucuuucauuuuagaauguggcuuuauuuuaacggagccauguuaucauuuuuuaaaaauuaugagcucauucauauuaugaaagguucuacacucuagaacagugguucucaacuaguggcaaugucugcagauauuuuuuauuauuaugacuuggggauuauuacuggcauguugguggacagaggccgaggaugcugcuaaacagccuacaauucccaggacagcuuccacaauagaguuuucugggccugaccccagacuacucauuaggaaugucuaauagcuagaauccuguaaucaguauauuuauuguucaguuauuuguaucacagacacauuuaauaaucuaauucacacacacacacacacgugaaaucauucuugagaaugaaauuuaucaugcuuuuacuucuuccuucaaucuucccaacuacuguugaaaugaucugagauuuuagaucuacauuauuguuacuuuuuaacauuauguaucuucuguuucaagaaggcuuuugauguuugaguuaaguuucauaagcuuuuaaacaagcauuuagacauuuacaccugcuuaacugauuucauugaucacuuuuauuucauuugcacuguauauccccauuauuucaacucauuucacaguugucuuugguacuucuuuuaguacuuuuuuaaggaacagaugggugauacaguauuauauguucuugccuuccugaagauacuuguguucaauagagcguaacauuuuuuucccacagugacuuuucccucagaauacuaaagucacagaaaguuaucacaucaacuuaauguugcccaagagaaguccaaacucuuugcgcuucuuuuguagguaccuuuggguuaucuucccacaaugauguuuauagauucuuuauucuuucuucuuggaacaaagaaauuucauugggauauguuuuuaaaaauagaucucuuuuuauuauuuuugcaugguacuagaugagacauuuuagugcauagaugcaagucuuuuuucaacucugggaauuuuacuucuauggaauuuuuuuuucuuucccuaauauuuuuucacucuuuuucuuauccuuuagaaauuuuuauguugauccccuagaucugcucucuguucugacuaguuuuugcucauuauaucuuuuuauccuuuucccuuagaaucaguacuucuugaaauaaacugcuucuaugauucugagguauagccaaauuggggaagcccucuugugaagggucagcaguguuuaccuggaagaagaacccauuucaguugugcuucuugcuguuuggcugccugauucaaucaguggcagaaaaucauauuaaauauauuuagaguacucccuuuaaaagaauuaccucucuuugaaauucaguaaauuuacauugagaauauuugacaaauuuguauauacauuugcaggcaauaauuuuuaugagcugaucugccaugauuaaauguuuuccuuuguaaaccaucugguguggguauuuuuuaaauuuccucaguaugaucccagagggcauuaacugucaaaaaaaaaaaaguuuauaguaaagaauuuggaaaauacaacaauauagagaaaaagaaaaacaguaguccagcuucucacagagauaacuguuguucacauaggaguacauuuuauucaaguuucauuuuauuuauucacuauuaaacuuuuaagguuguaggaguaacuaauacuguucuguauuaauuuguauuuuuuaaauacuuuuaagauuauggaaguaaauggacaaaacuuugagaauauuacauuuaugaaagccguugaaauuuugaggaauaauacucaucuugcacuuacugugaagaccaacauuuuuggugaguuuuguuguaaaaauugccugaacucuuucuucuuaauuugguaauagaaaagucauuacaguggaagaaaagauaguaaaauauaaacauguuuuugucuaagcucuucagcuaguuucagaaucuuuaguuuugaacuauuauguauucuagaauuuucauuuuucauuauguuuuuaauuauuuugauaguaaguuuuaaaauagguguacagcuaccuucaguuauuuaugaaauuccuauggagcguguauuauguacucugcuggagggauacugaaugaaauauagaauguccggaauaaaacuaagaagucauaaucaggcauuuuuucccccagcuagugugcaaauuagucuacuucuaaucuuuaagccagcuuucugaaguaauaugaaugccagauuagcuguuuuauggaaauaaacugaguaaagcauugacuuaaguacuuagugaauuacagauuucuaauaagagcauacucuaccuuuguguggaaaaaugauuacagugccucuguuguguuuuuaucauguuuauauuuaaauaaaaccagugacuaagcucauacuuuuaaccaaaucuacuguguguuuuuuuaaacuuuuaggaaagauuuaaugugauuugauugccuuagacacuuuaggauuuuucagaaauucugaaaagaguaacaguaaaaaucauacagcaauugaaauaacaaagaaacuuuaagaguccuuaugaaguagggaggaaaacaaaucucucuagguuuuuuagguuacaauuugagaaguaagaguuggcuuuaaaagcuaugccuacggaagggaagugugaguuuuauuuuuuucacuuuggcuuuuuauauugugcuuagucauaaugaaaaaugaaacgugggguuuuuccucuuuuugagucccuuugacugaauuacaucauguuaaaucugguaaacugucaauuggcaauuuaguauuauauuacuuuagcauagaauaaguaaguaagccuucagaauuuuuugauuuccuggaguuucgacuaauaucuagaaaugccaacuuuuagguuaaaugaaagagauuuccaguuucgaaaaauaagaaagcaggacuugcucucuuacuuugagcaaauuauuuagucuuuccaagcuucaguuucucuagcacuauuuccuagguuucuucuaaguaucuaauaccuuuaaaccuuuuguacccgucacauaaagauuacuaacugguauuaaauauucugaauaaaaauacagagauagugugaacccccaugaacucugggacacagaaaaguagaucugaaggaugcaaaagacagaagccauacccucagaacccuuugaguagugggaaaacaguuggccaacagaacccuagguuggauauagcagaggguagaaguuacauggagcugcaaagggggaacauagcagucaccucuuucuuccuuacccuaggaggaaagcaaaacaccaaggagaaagcuaaauaccucauguuuagauuuagaaaaugcacccagagaagaaaacagcuggcaaucucaguuuacucucuuucuauucuggaauuuuaauuuaucuauuaaauuacaaaggaauauuuguaaaauauuuguagaaauggagcauuuuacucuagauguggugaugccccuaauaaagcccuaauaacucuggcauuaccaugaaauagaguugagcaguuagguuguccuguaucaaacuuacagugaggacaccuacaaaaaggaaaccugugaccagaagacauugguucagugauacugagaggugaagccagcuggacuuccugggucaaguagggacucggagaacauuucugucuagcuagagauuguaaacgcaccaaucagcacucuguaaaaacacaccaaucagcgcucugggucuagguaaaggauuguaaaugcaccaaucagcacucugugucuagcuaaaggauuguaaaugcacaaucagcacucuguaaaaacgcaccaaucagugcucugugucuagcuaaaggauuguaaaugcaccaaucagcacucuguaaaauggaccaauuagcacucuguaaaauggaccaaucaagcacucuguaaaauggaccaaucagcaggaugugggcagggacaaauaagggaauaaaagcuggccaccccagccagcaggggcaagcugccaggguccccuuccacccucuggaagcuuuguucuuucauucuucacaauaaaucuugcugcugcucacucuuugggucugcaccaccuuuaagagcuguaacacucgccgcgaagguccgcggcuucauucuugaagucagcaagaccaugaacccaccggaaggaagaaacuccggacacaucugaaggaacaaacuccagacacaccaucuuuaagagcuguaacacucaaccgugaaggucugcaucuucauucuugaagucagcgagaccaggaacccaccggaaggaaccaacucuggacacaauacuagaacaaaccauucucaguccuuuuauuacuuaaaacugacgaucagggaucaccaagcauaaggagaaucaggaucauugagagggugugguagagaccuaaugagugaucuuauagauucuggagaaaauauuuaaaggagagaagaaaaacauuucuaggacgcugcacagagcaauuuaaaaauuuaucccuugagaggcagagcuugcagugagccgagauugcgccacugcacucccgccugggggacagagcgagacucuaucucaaaaaaaaaaaaaaaaaaaaauuuaucccuugaaacaagaacaggauauuaggaaagaauaaacaacaaucauugagaaagaaguaacucuuacagacaaaaacauuuguuugaaagaauagauaauaaaguugagaaaaaucucccauacuauggaacaaaaagacaaaguaaaauuaagcucuauuccaggauaucuaaaagaaaauguaaggaagaagauguuuaggaaauaauagcagagaauaucccagaguaaaagaaggaugugacucucguauuucaaaggccucacuaugagcugaggaaaauguauuaaacaaaacuugugucaacuuucuacuuccaguauugacugaagacaacuuaaaagagcuagacuaaauaugaaaaacuauaaacaaacauaacaauccaaaaagauagugaaaaacucuggaugugucaaagccuuuucccacuccugggaccauaucccaaagugaugucucuuuuuccagggccauuuucccauccguagaauaaaacugagaggagcuccuugauaaacuuacagguuuguaguuuagugcccaccaaaggauaaaauaguagcauuacaaccuuuguuaggauugagacuuugaaaaccucucucugaaguggaugugcgcuguaccuaacugaccaucuaggugaccaagaaaaacuuacaguuuuggcccuggacuuagauuauaggugccugacaaaagaaaauaaauauguucuuuagaggauacuaacagcaacuuguuauuucuaaaaauaauuuuuuaaaaacagagucaagcaaagauuaugaggcacucuuaaaagucaguaugagccagaaccaacagaaacagaagcacaguugcuccagaauaucagacacagauuuuaaguuugcuaucuuuuauguccaugaagauaaaaaucaaauuaaguguuccauuuccagauaagauggaguaaacacacaccacccuucaucucucacugaacuuaauaguaaaccuggacagaaucaugacccacuuagcugagaacucugaaaagcaaauagcaacaggcaauucgcagaagaauaccauaauucaaaguaccacuaccagcaaugaauucacuauuauuuuaauucuaguaugcccuagguuggacucaaggcaaccuaaaaccuggaugugaguacugugguacagacagagauccaggagaagccuggcuugaggaaugagaaaagggaacuccuacuaauagcaguuguccuguggagaaaagugacacugcuuuuaggcuucauugaauucuaguuuucaugcaagugcucacagccaucuaaaguucucucucuccucgaagagucccucuaccugacccacaccucauguuuagauuuagcaaaugcacccagagaagaaaacagcuggcagucucaguuuacucucuuccuauccuggaauuuuaacuuauuccucuuggcuuccacagcuuucuaaaaucuuuaaaaaucccacuucuagccaagcaugguggcucaugccuguaauccuagcaauuuaggaggcugaggcgggaggaucacuugaggcuaggaguuccaagaccagccugggcaacauagugagaccuggucucuacaaaacacuaaaauuuagcugggcaugguagcaugcaccuguagucccagcuacuugggaggcugaagcaggaagaucacuugaacccaggaguucaagacuauaaugagcugugauugugucccugcacuccauccugggcaacgagcaagacucugucucuaaacccaaaaaucccauuuuucagauaacuugucuuuuuaaguuuuaauaaaaguaguaagugcauauauuuugaaaacuaaaauacuaaaaauagauauacaauggaaccauacuguguacaauauucugugcuuuuucacaucaguucauacagaccuacuuguuauauaauuuuuauuauuacauagaauucuauuauuaccauaaucuguugaguuaaugucauauugauagauauuuuagauuguuuauaguuuuugcuauuaacagagauauaauaaaaauucuuuguacuuuuaugcucauauagauccaccuauaugauacauuucucaaaguggaauuacuuuugacagacacugcaggguuuuacuuucugaaaguuuaucacgaucuaugcuucauucaucaguguauaagaaugucuuggccaggcacaguggcucacgccuguaaucccagcgcuuugggaggcccaggcaggcagaucaugaggucaagagauugagaccauccuagcuaacucugucucuacuaaaaauacaaaaauuagcugggugugguggcaugcaccuguagucccagcuacucgggaggcugaggcaggagaaucacuugaaccuugggggcggagguugcagugagccaagaucgcaccacugcacuccagccuggcaacagagcaagacucugucucaaaaaaaaaaaaaaaaaaaaaaagccucugcaguggguauaaucagucuuuuaaauuuugauauacauuauuuaauaacaaguaagguugagcaccuuuuuuguguguuuuggcauuucuuuucuauaaagucuuuuuuuuuuuuuuuuugagauggagucucgcucuguugcccaggcuggagugcaguagcacgaucuccacucgcugcaagcuccgccuccuggguucaugccauucuccugccucagcuucccgaguagcugggacuacaggugccugccaccaugcuaauuuuuuguauucuuuaguagagacgggguuucacuguguuagccaggauggucucaaucuccugaccucaugauccaccugccucggccucccagagugcugggauuacaggugugagccaccacgcccggccucuguaaagucuugacuucaucugccccuuuuuauauuguuacucaucuuuuauugacuuguuugaccacuuuauaaauuaaaauaguaucuuucaacucuuuuuaaagaguugaaaaguugaaaguauuuucccuaagugguuuguguuuugacuuuuguuucguguguuugugaacgcauauauacauaugugggaagagacauuuuuaauuuuuauguagucaguuuuauuaagcuuuuauagauucuuuggcacuuuuacuuuugauucauguacaaugucugauauugcuguuuaauagcauuguaguuauguguacucacuauccuuucauuuuugucccuauuuuuuuuaauuuaacgcaaucauuucucuucuuuaaaacaagcuacaagcuccacaaauuuuugcuuauaauuacauacucauguccaguggagaaauuuaacauuuuuuuuuuuuuuuuugagacagagucuuacucuguugcccagguuggagugcaguggcucgaucucggcucacugcaaccuccgccucccagguucaagcgauucuacugucucagccucuggaguaacugggauuacaggcaugcgccaccgugccccgcucauuuuuguauuuucaguagagauggaguuucaccauuuuggccaagcuggucccgaacuccugaccucaggugauccacccuccucagccucccaaagugcuaggauuacaggcaugagccaccacacccagccaaauuuaacaauuuuaaaaaauaauucaguuaccuuauauacacacuacuaaggaaaucgccccuucaaaguuuuccuuuugcucuaacagaaaauuucaauacuuuagcauagcauuaacuggccucaucucuagcuuguucucuagucauuuuaauuuucuugaacuuuccuucuaccacagggacuuugaacuugagauuuucucuaccuaagauuacucauccuuugccuaguuaaaaucuucucaucuuucugauuucuuuuuacaagaugacuugcuuaaggaagauugcccuuuccuacuguuuuaaguaguuccucugguuauguuuuaugcgucuuagacugacuguaaguuccacaacaguaguaauauacaaacaucaagugaagugccugaccuauauuuacagguugacauuuuuugaaugaaugucugaauuuuagauuuaaaaaguauuggccagucgugguggcucaccccuguaaucccaucacuuugggagggcgaggcagaaggaucauuugagcccaggaguucaagacuagccuaggaaacauagugagaccacaucucuacaaaaauagaaaaaaugagcugggugcaguagcacaugccugucaucccagcuacccaggaggcagaagugggaggaucagaugagcccauaaagucaaggcugcagugagcuauggucuccagccuggaugacagagugagaccugacccuguuuccaaaaaaugcauauauaaauguacauauauacauguauacacacacacacauacacacacguguguguauauauuaccauauggcuuaaaaucaagugaaauuuguuaaauauuuuauuuuaaucaugcagacuuuauggaagguaacuucuaaaaagucuccaucauuuugauagcagaaaaaugugcuuuucauaaacuugcgcugugcuuugguaaugugguaucauccuucuguugaaacccucaaaucaguccagauuuacaagugaauaccaaguuguaaguauuuuaauccauucuuaaggcuuuauccauuucuaucuuacuuguaaguucuuugauuuugugggaaacucuuacuuuccuuuucugucguuuuccaaaaaaauucucugugauuggauuuuucagugggcauauuuacacaauuuacaacuuaaaaaauaaaaaaaggugcagcauauacugcucaaagcuguauguaaugauaagcugaguguuugcuuccacagcucaugcagcugaagccauuuaagucuauucuaagaauaugcaaccacuguuucucuguaauucagacuucuucaggcaccaugacucaucauuucuagauauuuaaccuuauacagauuuaucuuugcuuuaucccaaggagauguagccauccucacaaggcaaaaauuugguguaggcaaauagauugcuaaacagguaauuucccaaauguaccugcacccucauuaaggaugaaauaauucaccagacuuaguuagacuugauagaaagauaucugaggccgggcacgguggcuuaacgccuguaaucccagcacuuuggaaggcugagacgggcagaucucuugagccuagaaguucgaggucauuccugggcaacaugucgaaaccccaucucuacaaaaaaauacaaaaauuaacccagcaugguggcacacuccuguaaucccaacugcuccaagaggcugaggugggaggaucaccugagcuuagggagguccaggcugcagugagcccugaucacaccacugaacuccagccugggcaacagagugagacccuuucucaaaaaaaggaaaaaaaaagggccaggcaugguggcucacgccuguaaucccagcacuuugggaggccgaggcagguggaucaccugaaguugggacuucgagaccagccugaccaacauggagaaaccccaucucuacuaaaaauacaaaauuagccugguguggugaugcaugucuguaaucccagcuacuugggaggcaggauaaccucuugaacccaggaggugaagguuguggugagccaagauugcgccauugcacuccagccuggacaacaagagcgaaacucugucucaaaauuaaaaaaaaaaaaaagcaguaucuaagauaugauugguuguuacuuguuuuuacuucagaccacugaaguggauauuuuuuuagcagcuuuacugaaugacauagccucauaaaugugaccgugaggaaucgauauauauuaccaaauuaaaauuaccaaaauuaggccgggcaugguggcucaugccuguaaucccagcacuuugggaggccgaggugggcgaaucaccugaggucaggaguucgagaccagucuggccaacauggggaaaccguauuucuacugaagauacaaaaauuagccggguguggugauacaugccuguaauccuagcuacucuggaagccgaggcaagagaaucgcuugaacccgggagauggagguugcagugagcugagauugugccacugcacuccagccugggcgacagagugagacucugucucaaaaucagucaaucaaucaauaaccaaaauuacugcuuuugguaaaaguaaaaauaaaguccagcaaagcuuuucucaucuaaauuuuacaaucugaaccugacuacaguagugaggucucaucucaagugacauauguaguuaucccucgguauaugcauaggguugguuacaggaccuccaccccauguacacccaaauuugugcauauucaagacccacaguugguucuucagagccauacgcagguuuuugcaucccaagaauacuguauuuucaauccacguuugguugaaaaaaauucaaguauaaauggacccacauaguucaaacugguguuguucaagggucagcuguauuauaagaaauaacauaaaauagaaccuaaguaucuguuucuauaaaauuaguugauuagcaguuauguuacuuauuaccuaaauaggaaccucuguuuuuuuucaaacuugccugcagccugcccacuuccuuucccuuuccccccacugacuuuccuuuuauuaguguugggcaacaucagaaguauaaucagguauaaaaacuaaagaaagaagaagauauagcugcuaaaggacggguaaauacuugacaguguuuaguugaaugagacugagaaaguucaaauaauggaaagucacuguguuuauccuuaaaauuuguuguugguauaaaaauuuucugaagagaagaaauaaaaugacgcauuuguuuuauuuccacaguguucaaagaguuacuuuuuaggacugaacaagagaaaucugguguuccucauauucccaaaauugcugaaaaaaaaaguaaucgccauucuauccagcaugugccaggagauauugaacagacaucacaggagaaaggaaguaagaaaguuaaagcaaauacuguuucagguggaagaaacaaaaucaggaagauuuuggauaaaacacgauuuaguaucuugccuccaaagcuauuuagguagguaaugccgaucuuagcuaugcaggaauuuucaucuucacuguaaaguuuuuauuugggguggggggaggcuuggguaaguuuugcuuuguuauauaacuaauguaucauaaagucuucaaacaguacucaaauaagaauacauuugaacuucucccuaucacuuucaugaaguuacuacuuucagauuauauaauagcauuauuuugaauuuugggaaagacuguccauuuuauuuuaugaaauccauuuuuaaauauuuuugguccacuuuuagucuccugaucucuacaaauuguacaccuuaaaucuugggacuuauucaccaguuuuuuuuuuuuaaucauuuuuccuuugcagcaccauuuauuccuucuugaauucuaaaguugaacuuuuuaaucagaccuauuucuauuuccaaaaugggauaucaccaaaacuuaguaauacuugaagauuuuaaauguaaauuaaggucuguaaaauacugauggaauuaguccacuaaagugucaugauuggcgaugacucuaguauauauuacauuagcagcuuccugaagcaauuacaaaaguucuaaucaagagcaguacaauacuuagcacauaguaggcacucaguuuauauuuauugaauaaguuaagacagugaauaaucagugaaugaaauaaagcaaguucaaaaaauacauuaaaagaaaauacuuacuugccuccugaaaguuccugguaauugugccagauuauaguuauaggaacaaaaagggaugguccuuaccucugagaaauucacaucaggaacccuuacucuguacacauuuauuauauacuaagccagagacaggaagauaaauagaucaagguucuuauccuccaagaguugauaaucuaagcaaauugcaaaguucucauguuacagguugauaaguggaggcaggaacaaacuuguuagguuugaauagauuguguuucuguauauguaacuagagccagagcaagagaaguagguuaugagggaccuugaauauuaugcuaaagauaauagacuucaucaugucaugacagggagccauaagaagacaugggauuugauaagaucuguucuuuuaggaagaccucucugauggcuguguuagugauuugggguuguggauacagcauaauauagcagugauagcagagagaacaauugggaggcaacuuggaauugugucaacucucaucuuuaaugauagcuauuuuuaaauauuuuuucaauaauuaaaaaucucgaaguuuuuccaaucagauauccucaucuuccugaguucuuauuuccagucagggaaacacauuuucuccucauuuaauuuggaacucagaggauuaaaauacccugaguuuuuucuaaaaguucauuacucauucuauccuugaggugaguggcuuauaaaaaucauuacuuuaaaauaccaaaauuuugaaugucaaguguacuguagcaaacacuguaagaaaaggcauggucucacaaauggggaucgaguaaggagaauguuagaggggccagcccacacugaagaggucagggaugguuggggaugacuggaagucacugugaaaaagggacaaaaccgaggauccagaaggcagaaaagaaugcaugaggagaauuccucaggggguaaugcccugaguuccacuuccagaagccuuaauggguuuugucuggaauagaucuuucuuccauuaacugcgucucauuuugaccagcgacacaguugugacauguaucaucuaaagacagacaagacuguaauuacaacucucuucaacuuguuacuaucacauucucaccagcuguacucaaguuuuaggcagcuaaaucaguaucucaucuccacauuauccuuuggugagggugugggaauuaguuacuguaccugaauucugucuuugguuacagcaagagguguaaaacugaggucgccaggaacagucaguugaguauuuucaagcauuauaacuuuauauugguacccaaaaaagaggacuaucugguaaaaauaguuuugcuuaaacucagaagggauuauugggucucuugcuuugugccaacaagaaaaugcuugguuaugaauauaaauaugaauaaaaugcugcacugcagaaguuuauauuaaccugucugucccuuccaaacauguuuccaaggaguaaaaugcuaauuauuucagccacauaaauacagaaaaaauaguuuaucuuggaagucaaagguuucuggagccuauuuuguugggagagcugucuuaccuaucagacuggccuuuuugcauuucggagaauguaucuuauauuucuugacagucaucugaagugaauucagacaauuccuucugcuacacaaagguauacuacccuuuauauauaaagagcucucagaaaucaaauaggaaaaaaaaaucacuaaaacuucaauggaaaaauaggcagaaaacaugacucagaugaucuauauugauauugauccaggauauacaguuuaauacuggauaccauuuguuuccucacagauugacaaaaagaauggucagggacagaauugaaaauguuauaaguuuauaaaaguuuagacuggugugcuaauauaaagugaugccuuucuauuaaaagcuuuaaaaguggcaaaauucuggcugggcacggugccucacgccuguuaucccagcacuuugggaggccgagguggacagaucacuugaggccaggagguugagaccagccugaccaacauugugaaaguccaucucuaccaaaaauaaaaaaacuagcuggacaugguggcguacaccuguaaucccagcugcuugggaggcugaggcaagagaacuacaaaaauuagcugggcaugguggcacaugccuguaaucccaguuacucgggaggcugaggcaggagaaucacuugaacccagggagauggagguuguggcgagccaagcucgugccacugcacugcagccugggugacagagugaaacuccgacucaaaaaaauaauaaauaaauaaauaaauaaauuuuauuuuuaguagcgacaggguuucaccauguuggccaggcuggucuggaacuccugacuuggaacuccugaccucaggugauccacgcgccucagccucacagagugcugggauuacagguuugagcuaccgcacuagccaauaaauauuuuaaaaugacaaaauuauuugauucaguaguucuguuucuaauaguaauuagaugaagauuuauauauagaugcuccaaguuguuuuaucuacacuaaaaguuggagcacccuaaauguccaacuacaaggauugguuaaauaaauucuacuacacaucagaaaaaugacuagaaggaaaaauaucaaaauguugauugugguuuuuggaaggcauaguuucauagguaauuuuucccuuccuucucugcuuucuuucuguauuuuacaaguuuucuucuugaacauuuguuauuuuuuaauugaaaaaaauguuuaaugaguucaguuucacaauuucugagcaucuccugugugccagaccucuuuggaagaggcaccaagaacagaaacuuguucucugccuuuagcagcacucaguucuguaagaguagaggaugaguugucauagaaaagaaagaauguaaggaaagaacaaauacuugagauaagaauagauaauuccaaaaucccaaacaaaccaugauauaauuuuaaaagaauguuccuaaaaauuaaagugaaaaauguuacuaguuugaauuacaucuguaaguuaagacggaaguaugguuuuuauugaccuaagaauucuucacauuucaggaaaucuguuuuucuuuuuuaaaaaucacauagcuuuuauuuuguuuuuaaaaucacaguugccuaaguaacaucucuguguuauucauuguaacaaucccagaaauaaacugccuugcuugcuuaacuggaauuauauuuuuccuccccauuucuugucaacguauuuuuguuugcuuuuuaaauauugggauucuauuuuauuuacauauuggcgauauuuauguagccuuuuuaguuucauaauaugaaaccaaguacuuuuauccuaaguaaauuuaguguuggggaaguauugaggaauauuuuuaaacgauuuuucuucuguuacugcaucaccuucucaggagacuguuuugguaagaaugauacaauuacuugccaaaugggcuuuaucaacucagcuuucaaauaagcauggauauuuugccaacuaaauacuguuucauucauggcauagcauggauuguacauagcaguauaguuuucauuuaugcaccucacacuuuaauuacuacgaauuuguaaccagcuuuacauauuuauagcuauacaguguuuucucuauugagcauucaaaagcagaagcgauguuaaauagcaucagcaagagauauaaggacuuuucguauuuucuguacaucuuaauuuguauagugauucagcuugcugcaguugaugcaguuaauucccuuuaauagaaaauuguaacuuuuuaacauuguuaaaguugcuucuacuuaauuauuaguaggacuggacaaccucuuuaaugguuugcuuccuuggauuguugucgcacccucuguguccaaaaauugauguguuuguuuucaaaagucaauuaaagaaagacuguuuuuuuaaaaaaucuuuauuuucuguauacuuuaaauaccuuugaaagcccuuuuuccucuuauuuucucuuaccuaaccuuagaacauuuaacucuaaccuuuaggaauacaaaccaaauuauaaggagucaauuuagaguaaaugcaaauuauuuaucaaaugagauaucuccuuugcuuuaucugucaaauuagacugccuucucuccccaggaaagcacuuccuguuucucuaguaccuuuacucggaccugccucuacuuuuuaauauaaacugaguaaaauaaauaauucucccuucuguguuuguacaauucucauuuuauuuuuauuuauuuauuguuuugauacggagucuugcucugucacccaggcugcucucugcaaccucugccuccuggguucaagcgauucuccugccucagccuccagaguaggugggauuacaggcacgagccacccgacuucuggcuaauuuuaguauuuuuaguagagacgggguuucgccauguuggccaggcuggucuuaaacuccugacucaggugauucacccaccucugccacccaaagugcugggauugcaggggugagccaaugugccccgcccuauucucauuuuaauuuuuguaaaaguaaguccauucuuaagaauuaaaguccuguuuuccuuuacaccacaacauucgccuauauuaccugauuuuucaguauuccugggggagauaguguugcucacauuuacagaugagaaaaccaaaguuuauaaagagaacgaaauuugccugaagucaagcagcuaguagcucaggucugucugacaucaaagcuugcccuugaaacacuaaucuuugcuuucuuccaugucucuuugcuuuucucugacucuucagcucugucauauccuggccuucucuuucaugucugacuauuaacaguccuuuagcaguuuauuuaacagucuaacucuccaucuugcauaguuuucuaaucuacguaaaauccuauauuuuacaucuaguguaauuuaaauguauuucauauuauucauuuauaauacuauacuuuaaucuuuuucaugauaauagguaaguauucugugauacuucuguugguauguauagcaaguacuaggcagaaugcugcauuugauaaaauauagacaagaauuaauaguaacagagcauugguuuuaauguaaguacaacccuuagaaguaguuuuugguuauugauguugauggaaauuuuuuucacugcuaucuuauguuuuuauaggacuguuuugcuuaaaaguaagcuaaaauuuggggguaucuaaaaccuaagugacaguguuuguuucuuuguuuuuauuuuuucucuagguggauuuagaaguugccuaugucacauuucuaaaauauuuuaaaggaagaauauuuuguuugcuuaaauaauuagacuugagagauuaaauaagaaauaauguacccuuagaaugaacuuuagagacuguaauuuucauaauucuauuuuuuuucugguccaguguuuaaagaccacucuuacuuugucacuugaccuuggccccauuguuaucuauuaccugccauaguuuuugguuugaauguagacucuuuuuccuagaggaucaccaagauuuucuggagaaagggaaagagaaagagaacaccuugcuaugguguggcugugcauauuuggauacauguauuaguguccacuaaaacuggcaaauuugaaggguucccuaaauacucagguucaguuucuucacccaaacugguagacacuaaauaagacaauuuaauuaggauguaguagaauuacuuagauguauaaguuagauuuuauuuuaauguaauuguuaaaaauuuuagugccauuuucaucauuacaauugucuuuuaaaaauugcuguaguauuucaguuguuuaaaucaccucuuugaauugguucuuuuaugccuuagugcacagggaacagaaacguuuacuacuuaaguacucucaaauacuuuaaagugauauaugacauucuuuugaagugauggaggccuaagccaaucacaagaugacagcauugugggaacaaggcacuguaggcauagucuggcuauaaugcccaucccuggaacacucucauccagcagcccugaucuccugcagccuaccaccaguauguuggauuuuuccaauccuucagguaauuuucauaugugauuuuauauugccguauugguaccaaaugaacaaauagaugguuaagccuugugcagcaagugcuagaguuacuugcagcccucuuaacucuagauuaugacuugaugcaaaaaacuaaagggagauugacuuguucuguuaauuugaaugguacuuccucuaaagugaaacagaaguacauaaaaaagagacuaccucuggccaggcgcaguggcucacgccuguaaucccagcacuuugggaggccgaggcgggcggaucaugaggucaggagauugagaccauccuggcuaacauggugaaacaccaucucuacuaaaaauacaaaaaauuagccagacgugauggugggugccuguagucccagcuacuugggaggcugaggcaggagaauggcgugaacccgggaggcagagcuugcagugagccgagaucggaccacugcacuccagccugggcgacagagcaagacuccgucucaaaaaaaaaaaaaaagaaaagaaaaaagagacuaccucuaaccacagaauuagguaucuuuuaguaauccuaaucuaagcaguagaaugaaaacagagacacuucucaggcaagauauaucuuacccaggguguggaaaagaauaagggagauuauuuuaaucuaaguggccucacuuaccuuuuucuauaauacacagaaaaguguuaguaauuuuguaaaagcagauuuuuccucagacacuugaagcugaaguuguauuugucauguauuguuaucagagcguuauagcauaauuuucauuguuguuuggacuuccagugugggaugucaaguuauuuuuuuuuugcgucuauucaugucuugaggcaaaaauugucacaguuauauaaucuaaaguuuuguuacaaagaagaaaacuuucgacuuugaauaauuauauauccaucacuuaacggauuugagaugguuuucaauaaaaggcauauacaauuaagcacugaaacauauaauuggguccaaggaaaggugggagaaaaaaugcuucuacaaagauaagcauaguucugauucaccuucaauuuugacucuaaaguuccuagcagcuaguguagaaagggaggaaacuuaguuccaucucgguauuagaaggaaauauaaguacaguaguaaaguucauguuuuauuauagcaacuuaaauaaaaaccucaggacauaaccuaauaacaguuuagugaaggucauucugcacaugguuucuuccuuuauauuucaguugccacuuaaccacuagagcgauuauuaaacccaguaaccuguucuggcacaucacacucucuacauggcuaccaguguucuuuuuagaacaaagauuuaaugagucauuacuuuccuaagacauuuguagugauuuuuauauuagugaaaugucauucaugagacagaagacacuccaguuauuugauccgaaguuaaugugaagauuguuaccaaaguauaaaguuaauuaaacuauuuaccggaaaggguaaaggaagcacuaagauaucacagagguaagaaaacugcaaacuggauucaguucuuggcacguaaaagaaaugucacuaccagggugaagaagaaguguugcugaccugaacccccuuucuagccucuuguucugucauucucuccccacuauuacuucaacccuccuuccugaguauggaaugaacuuucagaaugcccuuucuuugcccauguuugccacccauggcccucuccuugcauguccaguaagcuuuuuuauuugucagugcugaacuccaguguuaccucaucugggaaacccaccucccucugccacagagucagucucuccuauuguuugcuauguggcaggaugggaauuuauuucuuugucucuguguguguguuuuacagcagugcuuuucacacuacguagaacauucaaaaauaaagugucuucacacuuccaaagcacaaauuaaauauaugcuuucaugagacaaguauuagggaucuuaugauuuguaguuuuaauaauuuauauggcuguauguuugccauagguauauguaggauguggggcugagggaauaagggauaggguuguaggaggaggcaagagagaaguaaguuggagauuuagcuggaggaacaaagagaagagguugaaauuauuaaguuuuagaaacuaaguccccauggagcugaaauucagaccuauaaagaaaagguguguuacuuaacuugauuucaaguugauuacauaauucucuccuugagaacauguuuaaaggacuaaagauaaagaugccuuuuuaaaaucuguucagagaacaucugauaugucucagucugcaacaugugcuuauaccaguaaugugaacacauauaugauagguauuuaacuuauauuuuuaaacccccaaauguguaauuuugugaaaggcuuuuuaucuagugauggauauuauuuauauuuggauugaaaaaaacaucaauucccaguuaauuccaaauucagcuucuuauguaauuuauacaacacaaaaauuuaaaugagccauguacaucacauauguauauuauaggacauguguaacagccaaguuugauuaauguuuauuggucuugagcuuaccuauauuuauccuucauuuucaaaguuauuacuagaucaaaaugaaagugggggcaaagcuacagaacuguaaguuuguuuuugauugcuuacuuugauuuugcuuuauuuuugcugcauacagcuguugguuuuuauuguaaguaucuuaaagacuguaguauucuauugcccuuguuuguauguauuauuuuguuauuuuuuaaaaguccaaugauacagaauugaaugaaguaguaagcacaacuuuucuuuccacuuagaagguagccaguauuaacuggcaugugucuuuuuagucauuuuuuugaauauauauauguuuuuaaguuuggauggaaucaguauacaugcuauucuguaacuucugaaauguucuuugggauuucugacucaauacaaaaugaguccuaaaaaaaauuaggaguguggcuaagagaaauuugaaaaggaauuuuuuucuauaucugcauguagaacuuacagcuuacuucuuuucacuuaauagcccaaacccuuaauugauuuauuucauauaguaaacuuaauuuuuucuucauugaaaauuuuuuauuauuaguuuuuaauuauaaaggaacacagucauagcuuuaaaaaaauuaaacugccagaauaagauagaauauaaaaguuuccacuccucagaauuuaguuauuauuuacuuguauauccuuccagaaauuucauugcacauaaaaugugucugcuguugcuuucaccccaaaugagauguuuuacuuuucuuccacuuaacuguuucacuuuagcaauauaccuuugaauacuuuucuguuucaagguguguuguucuaccacaaauuuuuaaacagcuaacagaauuuuuuuaagcaguccccauuaguagacauuuacaguauugccuaaucuuuguguucacguaucuuuaccuguuuuauguaugcauuauuauauuuugaguuuugaaaaacuauuuugugagaauuuguuuucucauuauauaagugccuaaaaaauauguguuuugccauuugaccugcaaaacuuaaaauguuuacuaucuggcucuuugcagaacaauuuuuucaauccuuaauauaccacuacccuuuguuuuuuuguguggcgcuuuuugcuguaugaauucucuuccuuacucaaugucuugucuuucgucgagcucguguuuacucacuugaauguaaguaaauucccugagaguggaggcuuaaucugucucacuuagcacuguagcuucaucaccuggaacccuguugacacauaacaggcacuucauaaauauuuauucaacaauuaacaauuuaaagcagaaugaaaagucagucuuuuuuuuuaaagaucaucuuaaauaccuaaaaguucucccauuuuuaguguaaucucagggucaguacauacauccuucaaguauucauuuuuuaauuuuaccgcuguaagauuuauaaauuagcucucuagaaacuucaucucugauugaaagucuagauaucagguuucuauuuaauuuauuuaccuauuacauaagauuucuacauaugaaauacaaaccuugauccuccaagauuuuuuuuuuuuuuuuuuuuuuugagauggagucucgcuuugucacccaggcuggagugcaguggcgcgaucuuggcucacugcaagcuacgccucccggguucaugccauucuccugccucagccucccgaguagcugggauuauaggugcccgccaccacgcccagcuaauuuuuuuguauuuuuuuuuaguagagaugggguuucacgguguuagccaggauggucucauucuccugaccucgugauccgcccaccucggccucccaaagugcuggaauuacuggcauaagccacugcgcccgaccccaagauuuuuuuuuuugacagagccucacucugucacccaggcuggacugcaguaguaugaucucggcucacugcagccucuacuuccugggcccaagugauccucccaccucaaacucccgaguagcugggccuauaggcacacaccaccacgcccagauaauauuuguaauuuuuguggaggcgggcuucuccauguuccccaggcugguuuugaucuccugggcucaaguggucugcccaccucagcccccuaaagugcuagaauuauaagcaugaacuaccgccccuggcuuccaagauucuuuuuaaaugucuguuuugccuuuaaaauuguacuguauuuuugucugcauuuuagauuugugccuaaaauuugaaaugauuggaucauuuuuucccuuuugauucaacuuuauucgaacauauugaccauucaucuaagcgauuaacauuugagugucugcugcaugccaaauauugugcuuggcauguaugugguuuuccuacuaacaagaaacauguuuguaaagaauaguauguaauauauacguaauaauucuaaaauagagguuuacacugucauuaauauuaacgcagagaaagauuuuccucugauggcucuccauugcuuuuccaaguugacauuuguuaccuuggcagauucaucagaguuuggauuaagggauacccuuuagauaaucccauuuaugaaucuguucuaaaggcacccaugugugauaccugaaucaaucuuaugugaucauauaacaauuuguccuucacauggacaaaucacuuuaacaacguaugacuuuguaacacuaugcagcaagauauacaauugugugcuccuucccagaagauguuacaguauauuggcagcaagggaagagaacaugaaauguguacaaauucccacccugucuuugugaauaaauuucucugaagaaaguaauaaaagguaucagaacaucuccccauucccucaaggucagucaguaccacuggcuaaggcucagcccccaaagaucuaguaaaaugauucaauucuggagcccaggacagcuaggaccuacuuuuaugaagaggguagcaacaguacagguaauaacaguauauuguugguuccuuuuuuauggacuuaaaaagauaguggaaacccauuuguucaguauauuucucuuggcaaauugaaauuuccauuuguuugcaauaaucuucuagcacaggguagagagguauauuaguccguuuucaugcugcugauaaagacauacccaagacuggacaauuuacaaaggaaagagguuuaaugcacucgcaguuccacguggcuggggaagccucacaaucauggcagaaagcaaggaggagcaagucacaucuuggaugacagcaggcaaagagaguuugugcaggggaacuccucuguuuaaaaccaucagaucucgugagacuuguucacuauugugagaacagcaugagaaagacucacccccaugauucaguuaccucccacuggcucccucccaugacaugugggaauugugggaguuacaauucaagaugagauuugguuggggacacagccaaaccuuucaagaaguaugucugauuuugauggaucuugaaacagucugaccuuaagucuuguagguuuaaaaaccugaugaugucagcagcccacuaaguauuggcucaucagaaugaaaucugaacaagaugcauuugaugacucagauuucuuaauacauugaggaaagagaguuugaugcauccuucuuacagaaggaaccagaguagaugaaguauucuacuuucaacuugagaggacccagaacauucaacauauguuggcuaagacuccuugucccuggaauuauauucauguauauucaguugaaucuuucaguccucagagcaagucuuuuuuuuuuuuuuuuuuugguccucagucucaagaggaccaaaaaauuuauuuuaugaaaauauuuccugccauaucuguaucuguuccauuucucccuuuuaaccagggauuauaccucaggacauuuugagauaaauuuguaauuuguuuuguuuuguuuuguuuuccucuaaaggcuaacaguguccauaaugcuaagaaggugaugcuggacaaacaguauaauuacuugagcccccaaaaucuuccauccugcccccacugcagucaucacacacauacaaaaaagccacaguaauauauauucccuaauucuuuuuuucuuuuuugagacugggucuuacucuguugcccagaguggagugcaguggcaugaucucagcucacugcagcuucaaccucccaggcucaagugaugcucccacuuccaccucccgaguagcuggaacuacaagaaugugccaccacacccagcuaauuuuuaaaaauuuuuuguagagauggggucuugcuauauauccaggcuggucucgaacuccugggcucaagugaucuuccagccuuggccucccaaaguccugggauuacaggugugagucauacccagccuguauuccuaauuuuuuuaaaaaggaaacuuuugcaacaguaauuuauugucauagggaaaauuuuuagcauuuguucaugcuauaaagucacuuuucacuuaaauuuaauuauauuaaauauuagcuuaucauguugaacauugguccagaguucuauaaugacaaaaagaaauaagauagaacaaggggggguggaauauuauuauuuacaugugcuuaucauauaaacauugucucaaauuagaauuuuucuacuaauagcagaaaucacaagggcaaagacuaagauuucaccaggugaacauuuaaaauguucuuguguuacaaauaaauaaaauauggaaacuaacauuuuccacuucauaguuggacuaaguguuguuaucuacuacaauacagcaggaaaaaaacauaagggauaccaaaaaauauuuuuaaaaagacauaaugguucauuaaaccauuaucaguuacugagucuuaccaguaaccaaagaaaugaaaaaauaaugauauuuuuuuggagggaggaaaagaauagggcuuaugaaaugggaaagcaaaacaaaacauuaauauacaauuuuuguaaggaugugaccaaauuuguucccuuacacucuaggauuauaaaauauuauaacgucucuggagaacaguuuggcaguauauuucaaaaaccuuaaaaguaugcgugccuucuaauucagcaauucuguuuuugagaauuuucacggaggaaguagauugccugcagaggcuuacuuacuuuugacaggggguaacggggcauaucauaaugucauuuauaauaauagaaagugguaagcaaucuaaaugucauuagggguuuggauaauugaaauauauaaaauacauaucauggaguacuaugucuucauuaaaaauaguuuuguagaagaauauaauggcauuaaaauguuuuauaagauauuaaaugaaaaaauucuggcuuccaaaccauauauauaguaugagcccaaguuuuguuuuuggguuuuucuaucaaugauuuguuaucugaaaaaaaaaaaaggauauauuuaucaauaaaugcaacagugacuucuguuaauauugugaaauagaaauguauauuucaguguucagagggaucacuguguuucacguugcuuuuugaaggguuuaaaagugauuuuuuuaaaaaauaacaaagcauaucuuucuauuuauguagauaucccugaucaaguuauaagaguuuucaaaguggaucagcaaaguugcuacauuaucaucaguaaagacaccacagcuaaagaaguaguuuuucaugcuguucaugaauuugguuugaccggugcauccgacacauauucucucugugaaguuucuguuacuccugagggugucauaaaacagagaagacuuccagaucaguucuccaaauuagcugauagaauucaacucaauggaaggugaauaagcuuauuaguggaugugcuuauuuguagaugugcuuuugaagauuuccuguuaaaacagcuauuguaaguagaaacauuaucauguuuuagugcuccuaaauucacuccagaagacgcuugauaaaauaucuugucacuccugcuaaaauaaacucuuagaaccacugauauaaucuaguuccuguuuuuuuauagaggaagcugaaugauacaaaucuucauauauaucugaaugacuguaucuacuaauuuauaaauuuguuuuuaauauggccaguauguacuuuggcaaaagaagccaugguuuucacaguucuuuuucuaaguaguuuuccuuuaaugaauaugcaggaaaauuuuaaaaauuuuaaaauguguucugaaaauuauuuaauaaacuagauuauuucuguaguacauuuguuccuuacucugguuuuuuuuuuuuuuuuugagauggagucucccucugucgcccaggcuggagugcaguggcgcgaucucagcucacugcaaccuccaccucccagguucaagcgguucuccugccucagccuucugaguagcugggacuacaggcacaugccaccaugccuggcgaauuuuuguauuuuuaguagagacgagguuucaccguguuggccaggcuggucucaaacuccuuaccucaagugaucugccugccucagccucccaaagugcuggcauuacgagugugagcuaccacacucaaccacucugagaauaaucuuuuugguaacccaguuucauauguagaacaagaucccuagaaagcuuacagugacugcaugccaugguugcugugaaaugagaaugaguuaacucuguuuugcuggcuguacauagugguuaagagcauagacccuggauucagauugcccacauucaaaucccagcucuggcuaugugaccuugagcaagucauauguagcuucucuaccugaauuuccucacccauaaaaugaggauaguaauaguagaauauaccucaugggaauguuguaaggauuaaaugaguuacuaaguauaccauaccuuauaauguuaaacauuauuauauauagcauaaugaguuucagcacuauuauuuauggcauugucuuaggcauaugaacagucuaaaagcagaaaaaagaguuucuugacaguaaaaaauagauggauagauggauacaaacuuaggcuuaaaucaaguuggauuauuagaaaagaacgaaguaaaagcaggugauacauuaccucguuuccuuaguaacaucccugcacaagauguuuccugucucuuacuuuuaagugcuguagaauuguugauuuaagagaagaaagcaaaauauaggucuuaaugugugguaacugauaagugccacuugcuggaaugagguuuuguauuuaacaagggagaaaccauuaguggaaguguuuccccuccucuguagauuucauuccucuugcuucacuuggaaauuuauuuaaaaaggaagugaguggaguaacuucugaauagagauuuuuaaccgucuugauucaggaauuuauuuugccuuaauuagaauucaugcuauucauaaacaaauauuuacauaguaccaauccucugucagauaaaacaguaagauaaaagcuuuacgagggcaaggccaguaccuaaaauaguaucugacagauaguuucauaaaauaauuaaguucaugacauaacaacauuauuuuuacucuuuaauagaugccaguugguagaauaagagacagacuucucaaaaaucuuuucauuuaaaauguuaacuuuucauuuuaucuguaaauuaauauuuuuggcuaaaaguuauuaacaguaaaaugauauuuuacaacgacaaaaaggaaaagugcucuuauuuaaucauauuuaugaauacauuuauuuaaaaaaauuuuuccauuuagguauuacuuaaaaaauaacauggaaacagaaaccuuauguucagaugaagaugcucaagaacuaguuaaggaaagccagcuauccaugcugcagcucaguaccauugagguggccacccagcugucaaugagggacuuugauuuguuucguaauauugaaccgacugaguacaucgaugaccuuuuuaaguuaaauuccaaaacaggaaauacucauuugaagagguuugaggacauuguaaaccaagagacauucuggguugccucagaaauuuuaacugaagcaaaucagcucaaacgaaugaagauuauuaagcauuuuauuaaaauugcacuucauugucgagaauguaagaacuucaauuccauguuugcaauaauaagguaaguugguacaaauagguacaaaugucuguaugguuuugucauuacaugcagcugauuuucuacuuagguauucaaugccuaugaaaagaaauguucaauuaauaugccuuuauugaaguguuguuagauuuaauguauuuuccauuuuggugguauuggcuuuuucuauuuuuguuucuuccaucuuucuuuuacuucuuuuuuguaaaugaaagugggugauugccuucuaauuuuucuuucucucccuucaucuccaaccccccgccuugagugauuauaucaucuuuggauaugugcccaguggcuggucuuuaucauuagacuucuguacugugcuuuuuuaaguaccugccucacuaugauuugacucugaaaaaucacaguaugguaucaguacuuugaccuaaaguugcuauuuugaaacaacaacauugauaauaauggcaaccauuugguaagcucuuccuguuugccaggcacuacaugagguucacuggaugugguguuccucaagcaaguuaggcuguuagaauaauaaaaauguuuugacauucauaagcccaggaaguguagauaauuacgugagcucucccacucccuucuucccacuuauuaugaaaaguuaauuguagguaauuuauuuucugaucuuuauuuagcacacuguagaucaacaaagggauucuucuuaaaacaaguuuaauuuuaaaagggagaggaguuguaguuagcuccauuuuuaaggccaugaugugcuuauaaaucgcagcauaauuccacuugaacuaauccuaccuauacacaucccccacagaauucauaaugauuuguuucuacuccucauguagauuaagauuaaaaaguagaaucuuuauagggacucuuuauucaugacccugucaugguaauaggaugugccuuuauuaaauuaaccagugucuacaacugaacugaacacucuaggaguauugaauagagauuaacagaguggucuuuagaaucagcugcaccuguauuugaauccugccucucccauauaguagcaaugugucaguggaaaacugaagauagguuuucuuaucuguaaaauaccaccuauaucacaguuuuuaaacagcuaagucuaaaacagaggaauaaagaugccacugauaaacacuuggaaggcuagaaauggaaccuguuuguaaaggaagcaucaaguaaagaauuugaaaauuacgggcucaguuuuagaguccacuaugaagaaaauugauugacacugagagaauagaucucuguauaaaaaagaggguagaaagaaagugguagaggucuaaaaaccauaccuuaguaugaugacucagugugaggguaaggaaaaagagucuagccaaagagauggaggaucaguacaagaaacagaguagcacaguuaugauagugucaucaaagccaaugaaagagagugauuugagagaagaugugauggacaguagcccaaagaagggaguggauaggaaagggcugagauuugguuaagaggcuuuguuugguuaaaagauuuguuuuguuacaaagaauauuuguucugcacauuuucauagcucauguaaagaucauugcuuuguuucuuuuguauucuuuuuaagauaauuguuuuguauucuuguacuucauguucagguagaucaaagaauauacucuuuucagcagagauggcaaaggugaaucauucuguucuggcuauaauuaacaacuuuuuauaauuauaaaauaauuuuaacuuuuugaauagacaugacauguacauggaaaaaauuuuaaagauaaagaguacacagcgaaaguaacuuugucucacccagucccuaauccacccaaauuccucuccccagagauacuguuaccuuuuuucauucaagaaauacucuauccauauagcaagcauauaaauauauauuuaaaaccaccuuggcuaauuuuuuuaauuuaucuuggagauuauuuaaaaucaguucuuauaaaguugucucauauuuuuuaaacaacuaugaaguacuccuuuguauuguggagugcacauuauggauauuucuaaauuuccagacuuuggcuauuuaaaacagugugugguguuuacuuuugccauguagaaauuuuuuuauuuuuauguagauguauuauuuuuuuuccugcuggaguuucugcauuuugugguuaguuaagaacaaagaauugccuagguuugaauccaguguuggcacuuguugucuaugugaacuaaguuuccucauuugucaaaugggaaauccugguaguuccuaccuaauaagguuaagaguauucaaugagcuaauacaaugagagcucuuagaacacccuagacaacauuuuuuauuaaucuugaauucauuuuuauguaaacagugagauaaagaaauauaucuuucuuuguuccaaaugacuucuucacccaacaucauuaaucaaucuuuuuuucuaaaauaugcaaugccaucuauuauguacugaaaucuaacacauauuuggguuuaugucugcacucauugcuucauugauuugucuauucauuuacuguuuuaguugcugaagugguaaaauagguuuuaaggucugauagggcuagucaaaccccuuaugacucucuucauacuuuucuuuggcuauuucuggcauguuuauuuguuucauaucaacuuuagaaucaauuuauguaguucuuuuaaaaaguuuuguugaugucugggcgcgguggcucacgccugugauccuggcacuuuggaggccaaugcagguggaucacaaguucaggaguucuagaccagccugaccaacauggugaaaccccaucucuacuaaaaauacaaaaaaauuagccagguaugguggcacaugcuuguaaucccagcuacucaggaggcugaggcaggagaaucacuugaacccaggagguggagguugcaguaagccaagaucaugccacugcacuccagccugggugacagagcaagacucugucucaaaaaagaaaagaaaaaguucuguugauguuuucauugagauuacauuaaauaccuagauuacuuuaguggacauuugauagcuuuguaacaauggcucuugccauccaagaacacuuauuccacuuguuucaguuuucuuuuauuuccucuguggaguuguuuuauuagucuguuuucacacugcuguauagaaauaccugagacuguguaauuuauaaagaaaagagguuuaauuaacucacaguuccccaugucuggggaggccuuaggaaacuuacuaucauaguggaaggcgaagggcaaacauggcgugucuuacauggcagcagagagagagagagugaggggggaagugccacacuuuuaaaccaucagaucucuugagaacucacugauuaucaugagaacagcguaggggaaaucugccuccaugacccagucaccucccacugcguccuuccccugacauguggggauuacaauuccacgugaaauuuggguggggacacagaaccaaaccauaucaguuuuuauagugguguucauguaaaucuugaacauuuguuugaauguuuaauaucuuuuauugcuguugugaaugggauccuuauauuaugaaugggauccuuaaguuuucuaaugguuucugccuaaguauucuaaugcauaugaauaucaguguuguaccuaguaccuuacugcauucuucaugcuucuaauaauuuucaguuaauauuuugggaguuuugaguuaaacaaucuaauuuucuucaacugaugauaacuuuacaucucucauuccauuuauuaauaacuauuucucuauuuugucuauuuucaucugcuggugcuucauauuaaaugauaccauugucccucaguaucuguggggcauucguuccauggcuccucacagauagcaaaauccucacauacucaaguccugcaguugacccugaggaacuuguggauacauaaagucagcauuagcagguuucacauccaaggaaacuguauuuuugauccacauuugguugugaauguggaacacucagauacggaggggugacugaauuuauugaaaaaaaucugcauauaaguggauccaugcagcaguauuccacgguagcaggaguuagccuuguaugugaauuguuuuauccuuuacuuuuucuuaguaaauggagauuguggcagcauuagggcugcuuacaacucagagugucucccuucucuccugucucaaacagauuuguaccaaaguguaucacugugugcuaugccaaauaaaggauuguuggcuuggcaugguggcucaugccuguaaucucagcacuuugggaagccaaggcaggcagauuacuugagcucaggaauucaagaccagccuggccaacauggugaaacccugucuguacuaaaaauauaaaaauuagccaggcauugugguacacaccuguaauuccuguaaucccagcuacucaggagguugaugcacaagaaucacuugacccugggaggcagagguugcagugagcugagaucgcaccaccgcacuccagccugggcaacagagcaagacugugucucaaauaaauaaauaaaauaaaggauuguuguuuuuaaccucagggcagaaagaguucugcuuuggagaacuguuugucagcuuucauugguaucuucagcugcagacauuauuugucaucagcuuugcuuacuccuguuugaccucgacuauuuuuugacaaccuuucuaguguguugaggaguuuguuaucuuaguuuugguggauaugaaauuuguauugguuacucauccuucuuacagugguuuggggaaauuucugagaagcaaaagggaacaaagauaccuaacuccaugccuuaaagucagaaaucaggagaacauuuuacagugguguugguaaaagucagauggcugagaaacaggauuugcugauaagaaaauugaggcauuguauauacacuauucauuuggcaaccuaccuaugugaugguacuguagagguaaaggauucauaaagacuugcagccuaacuggcaugaauuauguuuucaaguuagggaauaucugagccuauuuaaaauccuguggaagggagacauugaauaucuggaggcuuagugaacaggauuagaaccuaggaauauggauguauuggaaucagggaugugagugaacaaaaucgcaggaaaaaaaaggcuuccuaaggugcagaauuagcuccaguuauuauuuaacaguuguucucagcauuacuuaaaccgcuuuaaaauagguaaugucuccauaaaguuauuucuaaguaaaacaagcaacauugugaugcuugaaguuuuuuuuaauuuaaauguauauuuuauggaauuauucugucacuuaaaugaaacuguaaaauaaaugcuauguagguauagaacuauaggcaagcauuauaguuugaaagaaguucuuguaagaucagggagucucuuauuuauuuuuuucucaguuuuucucuuguuuauuucaauguguuaaaauaugucccugcuuauuuuuacuuuuauuagagaaaaugguguauaugcugaccugaguccaccccuuuccccaaguuucuuuuuaauguuucuauucucaucuuuggcaguggcuugaaccuggcaucuguagcaagacucagaggaacuugggaaaaguuaccaagcaaauacgagaaacaucuucaagaucuacaagacauuuuugauccaucuagaaacauggcaaaguauagaaauauucuuaguagucaaaguaugcagccuccaauuauuccacucuucccuguugucaagaaagauaugacauuucuacaugaagguaugaaaacauuauuuauugauguuuuaccacaugguuuaucuaaagucuaccugaauugauuuuuguguaugguauauuuccuauucuauuaauuugguaacuauacacuauuuuaccauuuuucuaguguugaauuagaugucauaccauacauauuuguuaauuaguuuaauauuuauuaguacuuuuuucugugucagauaaugcaaggaacuuagaccacuuaaauuccauuugcucagcuggacgcgguggcucacgccuguaaucccagaacuuuggaaggccuaggcagguggaucaugagguugggagaucaagaccauccuggcuaacauggugaaacccaucucuacuaaaaauaacaaaagauuagccgggggugguggcggccgccuguaguuccagcuacuugggaggcugaggcaggagaauggcaggagcccgggaggcggagcuuacagugagccuagauggcgccacugcacuccagccugggcgacagagcgagacucugucucaaaaauaaaaaacaauuccauuugcucaucuccugauuuucaugcaguuguugcugugcuuuuaacacaagauauuguugcuuaauaaagucaguauuuaaccuugccuguauauuuacuuuuguuguuguuacuacuauuuuuuauucauucuugcauuucagagcuuccguauugcugggcauaguuuuucggccuuauagaacacuguuuaguauucuccuuaagugcagguuugcuggugaugaauaucucuuaauuuuuguuuaucugaaaaugccuuuacuucauuuucagaggauuuuugguuggcagcuaucuucuucaaacacuuugaaaugacauuccauuguucugugccuuccacuguuaauguugagaaguuagcuuacaguuuuauuugcuguugcuuuaacuguaaucugccuuuguuugauacuggcuguuaagauuuuguuuuuucuuaauuucuuucuaguuuugcuuaauaugacuaagugugggguuuuguuuuuguuucuuauuccgauuggugucuguaggacaccuugaaaccuaugguuuuguacuuuucaucaguuugggaaaauucucaguaauuuuaucuuuuauucucucuccaacuaugucucauuucugguaaguucauuacugauguccuaauuccaguuauuauuuuuguuuguuuuacagcuuccuuuuucuuuuuuuaguuuaauguucuuuuccagaguucucauuguuuuuucuugucuuugaacauauucaacaucguuauuucaaagucugccucuaauaauuccauaaucuggauccccuuugggucuuaaucuguuuucuccuuuuuacucuuucauuucugucauguuauguuuucuccugaugugccugguuauuauugaaaagugagauuacagaaauaaucucgcuuuuugaaugauguuccauaucuccagagaggauuaaaguuugcuucuggcaggcaguuaggggugcuagaauuccaaaaucacuuuaauccguuuugauguaauuuaacaaaagacuuuuaucccagucuacauucaguuuauccuuggucucaggauauagcucuucagaguuucaaccaagcauuggagguuuacaaggacuuaaguugcuuuuccuuuuaccucaaaagacagggugucuguacucgguuuuucagcucauuaucccuuucugaaaucagauacaccuaggggcaagcacugggaaaugcaaaacuugcuucucugcauuuuuuuguacuuuuguccagcuuuucugaucucaccagaaguguuguucuaauuauguagucuuacugccucuucuuucauuaucacucaguuuucauaaggaaauguuacaggcuucagauauguuuuucugacauguuccuugaaauauguuuauauaacuugagaguauucgucaugauuacuuuguuuccagcuuguguugagacccugaacaauucauguguccaaucuauacgugcuguuuaccguauguuccucagucuugccuucagggccuuggacuuugacagaccucagggucuaccucgggggauaaauggggucaugcuauguuauagacaagugugaaaaaacaaugcuauaaacagguugcccuuuguuugggauuuuuguuuuguuuuguuuuuuuguggauuuuuuugaguugagaucucacucuguugcccaggcugaaguguaguggcacagucauggcucauugcagccucaaacuccugagcucaggcaauccuccugccucggccuuccaaagugcugggauuacaagugggagccauugugccccgagcccaugaaacugguuuuagaagccaugcacaguuuaucauuugacuuuauucauaaccaucacuccuauauggaacacaguuccuaguggcucauucccuaagagcaggguugaaccauguauggguauaccaguucuuaaaagcaaaauuggcacugugauaaagaagguccuucuuugugccccucaagauuaccagcuugacuuuugcuacuuuuauguagauaauuuaauuuugaacuuaaacauuuauuuucauucuauaggaaaugacuccaaaguagaugguuuaguaaacuuugagaaguuaagaaugauuuccaaggaaauccgccaaguuguucgaaugacuucugcuaacauggacccagcuaugauguuucgacagagguaggacauugaaauauguaaaaguguuagagugguaucaagggugauguaauaauuaaaauauuuaucauuuauugaucauauuuauucuaccaugugugcuguacaaagugcuuuauauguguccguuucauguaaucauuuaucauuaauaaccauaacagguaggugauauuagccuucguuauacauauuaagaaacugaaugaagcucagagcaguuuuuacauaauuugcaaauauuuguauguggauaguucuguauuauuguucuuuaaaacaucagcaggccgggcgcaguggcucacgccuguaaucccagcacuuugggaggccgaggcaggcggaucacaaggucaggagaucgagaccauccuagcuaacaaggugaaacccugucucuacuaaaaaaaaaaaaaaaaaucagcaaacaaauacaauaaaauugcugauauucaucuuguuuucaucucguuucuaagcuaauuuguaaaguauuagucuaugucuuuuauuuuuacugaauauuuuuaauguucuguuucuguuuaauucauacuucauuccuguaaaccauuuuucuuuuucucaaauuauacuguguuucauuuguauauaaguuuuuauuacauacaaaugaacagaauuuagaaagugcaaauuuaaucauacuuuacuaaaaaugaaaaauuuuauuguguucuguauuaaccugauauuuuaagaaugcuuuuuaagguucauuuuuaauguaauaacaaaggcuuccucagcuuacauaaaauugaaacaaaguauguuguuaaguauuccuaguaauuuuuuuuuuuuuuugagacggagucucgcucugucgcccaggcuggagugcagaggcgcaaucucggcucacugcaagcuccgccucccggguucacgccauucuccugccucagccuccugaguagcuggaacaacaggcgccugccacuacgcccggcuaauuuuuuguauuuuuaguagagacaagguuucaccguggucucgaucuccugaccucgugauccgcccgccucggccucccaaagugcugggauuauaggcgugagccaccgcgccuggccuauuccuaguaauuuuuauaauuuucaggguguaaauaagacauugugguuuuaauuuuugaucugauuuccuuuugggccuauguguauagcuucaguucacagggacauuaaaaaugaaaucauguacaggggccgacacaauuucuauggcuuaaaaaaauauacugugcuaaggaaacaaaaauacuugguauuagguuggugcaaaaguauuugugauuuuugccauuacuuuuacaccaacacaauauuuuaaaagccagaguuggaauuuucguaacccaauagaaccagugauacacuggguuuuuuuuuauuuguuuucuuuaaauuguuguuuagggaucuuuguuuuugagacagggucucucacucugguugcccaggccgaagugcagugguggugucuuggcucacugcagccucaaccucccggguucaggugauccucccaccucagccucccaaguaacuggggcuacaggugcaugccaccauguccagcuaauuuuuuuuuuuuuuuuccaguagagauaggguuucaccauguugcccaggcuggucuugaacuccuggacucaagcaauucacaugccucagccugccaaagugcugggauuacaggcgugagccacugcacccggccuaggugucuuuguuuuugcaaguaguugaucugaugguuucucugguuuagagauccacaaagcauggaaggaagggagagugugccagaucuccucuuuccugcacaucccacuucugcaccuugaaaaucacuacauguaaugaaugaugucauugcuuaacaguguggaagcagaaaauaguaagaacuagguaccaaagcaaagaaggguuuguuugguuuuuuguuguauguccuuguacaaugacccuaacacucucuauuggcuuauguggaccucuauuuacuuacacauguuaacauccugauuccugaagacaugaugaauuugugacccugccagaccaguuuauaauauacuaaguacuagccauacuucaguaaugagcaaaggagaaaaacugaugaggaaauuaauaaacauggcuguuuucuugggaauggccuggauugaauacaauaagguauugggggaaaauaaaaaacaucuuuuuuaaagauuggacugaauuuuuccugaaucaguuuugucagccagugcuaaaauguaauaccuuucuuuaagcaaacaauguccauuuuggugguguaugaguaucuaguuuggacaaaguaaccccuuuuaacaguaaucaauuugcagacuuaaaaaauagaaucuuuagucaaucaaacaggaauguaaagauauauaguauuaugaagauuuuaaugauauguuuuuucuuacauuuuaaguuggauuugcuggucaacauuucuuacaagacaucuugucagaaauuucugcacuuaaaaaugaaauuuuauguuuuuaugucccuuguaauuucauucugucacuuaaaugaguggcccaaaaaucuugccagcaagauguucagaaauucuauuccuuuaaggucuuuucccuuaaaaacuuugaauucaaaauuuauauuauaguaaguaaauguuuuuccuuaagcuucuuauuuauauaagcuuccugaugaauuagguauuuaaaauauaauuggucuaaagcauauuuuuauaaaguauuuuggagcuuuuuugaccuucaguauauacucaucuuacccuccugccuuccauuuaaagucauuuuacuguuaagcuguaauuuuuuccugauaaaauguuucuguucuuuucugucugcauaguuucucugacucucaacuguugucuuuuuucugugcuuuccuauucaaacacaugcuucaauguuuguggcucuugcuuacaggaagaagagguggcggagucugggguaaguguagagaugaacgcaacuggaaugaagguugugcgacucuuaacauauauugcauccuuuucauuaaugcacgcacauaaaauagcaugaauucuauuaacccugucagccuacauuccugacaaaugccuucugcuaacaaggugaaaguagugauagaacuagcuauuuuuccuuuauuuuuccacuauugaugcccuauaaguccuuuuuagauuuugauuuagcuaggucaguuagaugaugauaaugauagugaauauuuguugugugcuugcuaugugccauacauuguucuaagcacucuaaacgaauuaucuuacuuaauucuacuacuacccuauaaaggagauacuuuucuuuccauaguauggaugggaaagguugaguugccuaaaguuuuaguucauuaaugguggauccaaaacuagguagucuaguucuagaguucacaccacuuucuuuuauucaaaugccacauuuuauaaaaguaaauauaucauauaaauauauaaaaaugaaugaaagauguuugugaagguugcauuuuccaucaguuuucuaaaaagaggcagcccuuauccaagcuguacuauaaaauugaacuagaagaugauuuuauuuccucagacccacuaaugccacuuacuuguagcauugacugaauuuuauuugaaauuuuuaccagcuuuaauugaagauucccuuaucuuuaaaguugugauagaaucagcaacugacacuauuuguuauagaguuaggucucuacuucuacauagcuaagugucuauuuagaaucauagaauguuaaagaucuuauauaucaucuaucuaguccuuucauuuuuagaugaagaaagagaugacuuuuguggaugaagggauugcauaagaagaauuuuguuauuuuaagacuuguagugaaccaugaaguuagaagcuuuuauuacauguaagaagaauuuuuugugagccaccuucuuuauucgagucuugccucauuuguggucuuauuuucuguuaaugcuuggugaacuugacuuuccuucuauuuucuuucucccuucucuguguguuucccauguguuuucuucuggaucgcaaauuuaugucuuggucucuuuuggcucuucucacugaaaauagaaauugauaccuggcauuacuauuauaaagaagaauacuuggacaauaucuuuuagugggcauuggguguguuugaaugacuuauguuaacauguuucacguucauucagcuuuaggguuacacuguaugaugcuuacaaacauuagguauauuuauuuuauaucagcaauuuucuguuuucaaaguaguuuagaaaacauuuuaucgacguuuaucacaguguuuuuauuuguuagaauuuugugucuccuagauuugucaacaccuacuuuuuuauauuaacuaagauaaaaaucauuaaauauuuguguuaaaauuugcuccuaaauagcugcaacuugauuuuacugcauuucuuugaauucaagacaacgucaauuguuggacauauuguuauuuuaucuacuacuaaggaaaaucacugcaguauccuguuaccacugagaauuucuacuuuaugcuuauugaaggagcucuuauggacuuggcuauggauuuuuaucacagugugaaaacugaauuuuuaaaaaucaauauuuuuauucacauaaaaaggaaaauauaagcaaaguaaauugguuuagguuuuccuaaaauuucuuuauauucaaaauaugaaucuucugaaacguuuucuuuuagagucauuagcuucuggauuuuguuuuccagaacccuccuuccccauacaguauugcccucugugccauccaguguguugguaaugcaccauuucuuugaaaaaccacaaaagaaccaaaagcugcuggugcugggcucucaggcuagcuuuggaaauaauuagaauuaguuuucucuugucacuugcuuugggaauguucuugaacuugucagauuuacuacuuccuuauaaucauuuggucccuggagguuaaaagacuaauucacuaauggcuuuggauuuucuuucaagccauucugcaaguuuugaggucucugcagauguaaauaaugucuugucauaguuucugccuggccaauagcaauugaaaguugccauucaguguaagauauaccccuauuggaaagaucuuaaaaugugaaagaaaaaaaugccauaacacuuuuucaacuauauuucacuuaauuuacaaugaaagcauuaggauuuuagugucuauuuuaaaguagauauaugagcacuguggucuuuguauuuagaauacuuuuauauaaaaauggagcuuaauuuagaaaauccauagauaaccuuauuauuuuggaauggcaaaauaaaauaccaucuaaauaaaaauuauauaagaauuuuguauuuguuagccuuguuagaaaggacaaacaucauugcaguugcuguuuuccauugguucuagaugugcagucguuguaggauguuugccaaaaagaguagagucgggugaagcuguaguuuguuugaauugugguuauuuccacccagcuugcaauucugucacauucacaggcauuacaaaagugaugucccagauccucaguucuagaacccaaauauugccuaaccauuccauauuugagggaagcauugaguuuuuacugcauucugauguccgacuguauugaauugcauauaaaugcuguaaauuuucagcuaacguguuauugguaguucuguuugaguuuuggccaaaauaaugguuacuaguaaaauugguuaacaugcucacagugggccugcuauaaugguaguggcaauagcauguccaaagcagaacaacaagcaaaacuacuuuagaacccucauugcuaaagaacccugguucagagauucggcugaggauggacuugucgugguccagacucuugccauaucuucaaagcguggguggccuccaggaccagaggaaugcuuuuucuuguuacuguugugccauagguugcauaggcacaaacacaggccugauggaauaugccacucagggggccauuguuauccuauucuuuugaauucuguacuuugccaaauccuguucuuaauucagaacgucaccauaugugccaaauuacuuugcauuaaugcucuucaucuuuuaacucauuuacaucagcaugcaauagcauuaacagaacaaaaucuuuuaaucuucaaucugcuaugcuuaguucucaucucuauagccccuuauugugauuuucaucuucuuauaggucacugagucaaggaagcacaaauucaaacaugcuggauguucagggaggugcucacaaaaaaagggcacgccgcagcucucugcuuaaugccaagaagcuauaugaggaugcccaaauggcaaggaaggugaagcaguaucuuuccagucucgauguagagacagaugaggagaaguuccagaugaugucauuacagugggagccugcauaugguaccugugaguacaaguuuucauuuaugugacgcuaaagagcacaacaaaauaaaaacuuauuucucuagaauuauaccuaagucccaagaaaauuaacuuucacucacaaaagauugcuggcauaccuuaagcaucaugugauccaauuaaucacagacugaaucccauccauuccugauggcuacacuauccaaaaaauagagggauaaguagaucuuuaaaaagcuuuuuaauucuuuuaaaaacuggaucauuauagaggaggcuuucuguuugagaacauuuuuauauucaucccuaaagaguaaacauaaguggaauuuuuaccucuuuuuauuucauggauaauauuuaccaacuagaaaauauaagaaauuugauuaaaacaccagugauaauagguagcuuacaggugccaguaguaagguaaaacaaaaaaaaaucagacacauuccaauauuaguaaucucuagaaaaugugauggaaaagaucguguucucaauauggauuuuuuuuaauuaaauacaagcaagagaaugcauauauauuuggaucaaggaaauuaugaauucuaagagcagaaaucaaagauaaugaaauauauacuguuauaacaaaauaauuguacaucuuaaauuguagguuaaggccaggcguggugggucacaccuagaaaccuaggcaggaggaucacuugaggccagccuuggcaacucaaagagaccccaucucuacaaaaaaaaauuaaaauuauccaagugguagugcuagcaacuugggaggcugaggcaggcaggucacuugagcccaagaguuugaagcugcagugagcuaggaccaugccagugcucuccacccugggcaacaaagugagacucagucucucaaaaauaaauacgcgcgcacacacagacacacgcaguggguuaaauuuacaaagugagacucagucucuaaaaaauaaauacacacacacacacacacacacacagagagugaguuaaauuugcccauaaaaauugaaauagaauuuuauuucaaaguuccuaguugacaagggguaguagucaucauggauugacccuaagauugauaaaugauaugguauuugcauaguaauuuuuuaaaguaugucaaaagaaagaauagaaaacaggaaguggaaauagaaccaaauacugauuuuuaaaaauucaguuuugacaauuuuuaaauaaggguaaggagccuuuuaauaagugcuauaaucaaaacaauaucuugaaugcuucugcauauaagaaaagauuuggaguaugauggaaagaauaccuacgaaaggauagaggcagaauuugaguuucauuuauuacauuugaguaagguuuucuucaucuuuagucccuguuuucucaaauguaaaacuugggcaaggguugggaguacauuuuauuucugugauucuuuguacgucgaaguuauuaaauuuggaaaaagacauuuuuaaaagcuaacaguuauugagagcuuucuacauucuggcugccacauguuaaaugguacauguuaaagguaaaagcugaaagaguauauagaaccuuuaacauuuauucaugcuuuaaaguucaaagccauguacauauuuauuaaagcuuucuggcccugcuuugagucaucaucaaaguuauuuuuucccagguaauuugauguagacuuaaucaucuuaugguuaugaaacacaguuuauauacacccucauggcuuccucuucuuacacccaccccagacuugugucugucuuuucucauagcacuaaaugaugucccaugcuacauauuuaauaaaaugagaaaaucuuuaggccuuucuuucuuaaacuggauuugaacauuuaguuaaaugcauguuccuuuaauuugguuugagcaucuuuauaaugcauaauugauuuuuaaauguuuaaauagucacuauccgaagcccaaacaauaguugauuucugagcauuauagaauuugauucuucccaauuaauuagaauauaugugguuuuugucauucaucuguaaacuuauuuuugaaguagucucagguuuuuuucuuuguacuguagcaauuauuaaaauaagaugucauugauuagcauuuaccaaucaaugagagaaggaugaaaguauuucauggcucuaaccaaagaugauaaccucuuggauucaauuaguuggugagccauugcaauuuucucuuggggucccuguauuugaacuuucuaagacauucucugauucuuaucaccccaaauauugucuagucugucuuaauaaaagcauaauagcuauuauagcuguguugagacaguuuagacaucuauuuuugcuuuuaucuugauguuuaaaacaaauacuucaugaaguacugaggcugcaccugcauugaaaccacccuggauaaccuaaggauuaaaaguacucccugauggaagaaugucuuccccuuggacuauaguauugguuuuauaugaaggaggcagcuuuuauaaguaaggguucucaguuuuuuauucucacauucauauucagaaaaccuauggauuuauaaaagcacugucucugguuuucuuguguuacagcuguugagauaauuucacuuauuuauucaacaaauacccauuaagcaucuguuuucagucaguuacuggcacauaaggauguaauaacgaacaaaaugcauaguccuuacucucaaguagguuaaagccuaaugaaaggaacagagaagauaaagccuaaugagaguauaggacuggugagaggaaagguaagcaagucaagucaagggagcaggcugaugcuaaaucaugcagggucauauaggccuuguuuuaaggauuugggucuucauucuaaaagcaggggcaaguuaagguuugugcagaaggagaagggaaaugauaugaucaaauacucauuuuggcagagucacucuucuauucuaugaagaaugccuugaaggcaugcuagaauugauacagugagaaaaguauuucaguaguaaaggugagagaauguuaacuugacccucagcagagugaugauggagcuaauuaacauggauucaagaauuauuuagggcuggaugagguagcucacaccuguaaucacaccacuuuggguagcuggggcauguggaucaccugaggucaagaguucgagaccagccugggcaacguggugaaacuccaucucuacuaaaaauacaaaaauaggccaggcgcaguggcucacgccuguaaucccagcacuuugggaggcugagguggguggaucaccugaggucgggaguucgagaccagacugaccaacauggagaaaccccugucuacuaaaaauacagaauuagcuggguaugguggugcaugccuguaaucccagcuacucgggaggcugaggcaggagaaucacuugaacacuugaaccugggagccaagauugcaccauugcacuccagccugggcaacaaaagcaaagcucugucuuaaaaaaaacaaaaaaaaaagccagguuuuguggcaggugccuguaaucccagcuacucaggaggcugagagaguagacuccauugaaccugggagguggagguugcaguaagccaagauugcaccauugcacuucagcccgggcgacagagcgaaacuucaucucaaaaaauaaaaaauaaaaagauuuauuuaggagauaaaauuaacaacuuauucuacaauaguuuuagagauaacauuuuuuaucugacucaccaaacaauagagauaacaucuuauaguacuuaacugaaauuccugcuaagaaaaauuaaucuauuuuaucuuuugugcuaaaaauagaugguuuuaaaguaaccauuuauuauugccaguggugauaaccuugccuaaaaacgugcaguuacuuauuucuuacucucuccuguuagugaccaagaauuuaagugagaaaagaucagccaaaucaucugaaaugucuccagugccuaugaggucagcuggccaaacaacuaaagcccacuugcaucaaccccacagaguaagccaggugcuucaggugccagcuguuaauuugcaccccaucaggaagaagggacaaacaaaagacccugcacugagugaguauucaccauuaauauuacauccguuuaccugaaauuuccaggggaguuagagugaaaaauaauuacagauguucaggagauaagcuguuguagguuguguaauauaaucgucacuuuaugaaucaaaaauguugauuucauuuugccuauagauguuugcugacagcauacguguuuuaaaugccaacauugaauuuccuauaauacugaaaucugucgaucaauagaaaauuuacagcaauacauuuuggguaccaagggcuuacugcauucagagguguauuuaaugaaauauccaauacagaugcaaccuacaaaaacuguggaaaugaaguugcuuauuccaaaaaugacuauacguuguuuuuugucuuuaaagaccccuucugaaaacgugguugggaaacaagagaauauaacuuuuauaaaauauagaccacacuuuuuuuuucuguuaggccauauagucauuauucauauuacuuuuauuuguuguuuugacaguaucacuauuuuagccuuuuagaugagaaccuagauuagauuugguuccuagcaugauuacuuaggcuguacauuauauguaguauauguuuaguagaacuuuguucauuuaauuuguuauuguuugagauacaaaguugaauaagaaauucccccuccuugaccagauuuucagucuggugauguagacacucacacagguaacuucaauauaaugugucuucuucuuaugccagggguauaugcagaacauauaaaagaacaaaacaagagcuuuuaacuuagacagagguaagauagggcuucagaagaaggcuuuuuggaaauaacaucuaagcagccuaaaagauuggugacgaagaagauaauuaggcaaaaguuccagagaaguugcuucaggcugaggaaacagcuugguaugugcaagaaacuacaagcacuuugcugacgcugaguggaaauugcaugcaguguugacagacaauaauaauuaaagcugacacuuggagagcacuuacuggugccaggcaugguucaaauugugcuuuacuaauuuuauauaucagucuucauaguaaugccacaagauaagugguauuuuacccucauucuacaaaggaagcauagaggcuaaaggaaggcugacuggcuuuaaaucuuugccuuuaaccacuguacuaaacagcuuccaagaugcagagaaugaagacagguaugcugaaauuacaaugugccaugccaaaggaaaaaguuaacauugagaagccauugaagagauuugaacaagagaagguuacgguucaaauuauguuugagaaggacuguagugaggaucacagcaggacuggagauagagagcucagauggaaagcuggucuaacaguuaacuggaaguugcccagggccuggacuaguuugguggcuauggaaaugaagagagaauugggugcagaauuggugaaguugauaaauuuguugguaggagugagagagggacaaaguuagcucugguuuuuuuacuugaauaucaccacuugagaggaagcauuacuuauacuauguagcuuccuuucuuucuuuuuuuuuuuuuuuuuuuuuuuugagacagagucucccucugucgcccaggcuggagugcaguggugcgaucuuggcucacugaaaccuccguuucccagguucaagcaauucuuaugccucagccuccugaguagcugggauuacaggugcaugccaccacaccuggcuaguuuuuguauuuuuaguagagaugggguuucaccaugguggccaggcuggucucgaacuccugacuucaggugauccacccaccucagccucccaaagugcugggauuacaggcgugagccaccauaccuggccacuuacuuuauguuuuaagaacagugucuauagcucucugacauuucuuagagaagaugaauguaaaaacgucaauauauugaaagcauugcuaaguuugagguacacuaaacagaccagacauuggacaaggguaaugauaggacuguaaggaaucguuccacugugcugcauacuauuuuucuauacauucaugauuuuuucuguuguuuacuucucuccuguagugugaauuuagugcucuugaaaagggcuggacuggcagcccugcagccucuucccguauacccacagcacagaugcaccacagguagugacagugccaacauccccacacugccccugccacaugcgucgccccgacuuggagaggccaccucuagaggggagggaagaguuugaauccaugccuucuuuuugaagauuucaaaucacugugucaauugugggagguggggcauagcacucagacuguuaaauugauuucccuuauaccacaaagugcagacaaacuaauauaaucugguccaugcugaccagcugaauuugaaugaauaaccuagaggugagaaucucuguaugccauuacccagucauuuagucccuguuugucauuuacacauuucaguugacuacacuagccauugugcaucauaguguuaguuauguagugauuuaggcaacuauagacauuuuaauugugaaacgaugcuuauuugcaucuuugguuuuauuuuuagauacaaguuuaccucagaaaguuuuaggaacaacugaagaaauaagugguaagaagcauacagaagacacuauuucuguggcgucaucuuuacauucuaguccuccugcaucuccucaaggcuccccucacaaagguaagacaaaacauuucaaacuaguucuuguuaaacuaaacaauacuuuauagcacauauuuugcuuuucaaucuauagcaauaauuauaaaucauuaagaaaagcauaacuccuaaugcuuuuugaacuuugauguuuuguauugcauuauucagaugcuuuuuagauauuaugugucauguaacuaggacuccaguauucaaagugugguccuaaacuucaacagacagcaagcauggauaagaauaaaggcagaagccauaguuuuggugcaaauucuugguguuaucauuccaguuuccuauauuuggacauuucuaugaaguguuuacaaguaaaaguuucuguaagagauucuuuuuaggccaggcacaguggcucaugcuuauaauaccagcauuuugggaagcugaggcggguggaucacuugagcccaggaguuggagaccagccagggcaacaugaugagaccccaacucuacaaacaauuuaaaacuuaggcaugguggugugccuguagucccagcuacccgggagacugaggugagaggaucgcuugagccugggaggcagagguugcagugagcugugaucaugccacuguacuucaaccugggcaacacagcaagacccugucucaaaaaaaagaaagaaacuguuuuuaaccaacuauaagauuuaggaaaacaaaaauuaggaaaacaaauaugcuuuuccuuuuuuaguaacagaguauuaccuuuuuuaaaauuaggauuuaaaauaaccuguacucuuguggauuuuuuacuuauacagaaucucaugagguaaaaaacugaaauucuuguucauuuacguguuuucauaauucagacuggagcauuucuuuucuuggcuagccugggcagugugcagcagaugccauuucauguuagcugcacauguagcauucuaaauaugguguguauuucuuauauugacccuucacacucuguguguacccuggaaagaaaggggauuuaguccuggcaucuucuucacagauguaaaagaauuacauauuuaaauaaucacaccagaggaugguacauggucagagggaagacaagcuuauuauaauaauucuaacaggagagagaagcuuccagagcuugcuucagcuuccaggcucuaaguuucaucucacucugcagagcucuuucuuauuuuugccaccuauguggcaauuauguacagugaugucagaccugaguuugaaccgugauucuguccuccacuguagcuguguuacuacaaguaauuuauuuauacggucagguuuccucucuguaagaugggaaaaagaccaucuaggccaaagcaggcggaucgccugaggucaggaguucaacacuagccuggccaagauggugaaacccaucucuauuaaaaauacaaaaaaauuagccagggguaguggcacaugccuguagucccagcuacucaggaggccgaggcaggagaaucacuugaaccaaggaggcggagguugcagugagccaagaucaugcuauugcaccccaacuaguuugguggcuauggaaacgaagaaagaauuggaugcagaauuguugccuaaccugggugacaagagcaaaacuccaucucaaaaaaaaaagaggaaaagaaaaagaccaucuauuuuaacagccucuuaugugguuuaaaugaaauaauauuuauaaagccucaugugugguaaguguuuagugaauuggaaugucucuuuucuuucucugcggccaccucaggacaccauagcuccauuacucacuugcuuuuuucauccucacauagcugagacugguuagauuuuuuucauucagauuuuacuaaagaaagcuuaauaaaaaugaaacaggagauaaaaacaguuuguauaguagguguauuuauaaaacacagauuuugauccuguuguagcucauauguaauuuuguguggcacacagaccuaugucaucacuuuccuugucuguaugguccuauccaaugcgccccuuaccagaucuugcgauguaggauaagccgcagugccuccagucagacagaugguccaaaugaacaguauccauaugcuccuaaugcucguucaggaacaccuuuacacuccuuaccccuguuagaggcugcucagugguccaucccauuauagcugauuugguauuuuaugccugaaugugacuucuggaaagugguauuagaaacaggaauuccuccauugcucuuauucccaacaaaaucuacacucaacacucgaauagagaaguauuuucucccuuugugagaaaauuguagccaacaauugaacaccauguuuauagguuugugagcuucucguaguaauguuuagaauucuuagaagccugaagaaauucuucucuucaaaacuguuucagcuuguucuugcauguguacuaucaaaaccccaaccaaguaugauccuucuauuuuuguagacagguuuuugccaguaaccuaugauugaacaaaacugucauuaugcucagaguaaauuauuaggaucuguuccugguucuuauuaaacuuggagaucuguucuuuguuuucuuaugauuaagaaaauaaaccugucuucauguuuugcaugaggauaguuuaaacaagaacuuuaaaaaagaagucaaaagaccuuaaacauuaucuacccuaguguuuaagaaaagcacucuccaccuuggaucuacaacaggaucagaaaaugaacguuauaaauauaccuauuguauguacuauuuauaugucuuauuugguuuuuacuaagcuucuucauaguaaaaucuaccuuacaauucuagaccuacauaguuacuuuacagaaauaauucuaguuaccugauauuuuugucauauuuuuccuuaugauuuuaccagcuuggcuuccuuucaacaguuuuuuuguuuuuguuuuuguuuuuauuuuuaucaccagcuugugcugauaaagguaaucuuucuccugcauucugucuugcaauaacugauguguauauguuuuauauauaaguagauuuuuuuccaugcauuaaaaaauauguugcuagauuucaauuuuucagauauuaucaagauguuagaauuuuuaaauagugaaauauuauguaaacaaggcuaauugugauugaccaugucaggguuuuugcaucucucccuccaguuggcaguaucauaucugaucacagcagcaagaucaguggccagagcugccccggaauagguggggcuuacuugcaaaagaaaauccuucagauuaccaggagcacagccaaaagaacagacaguacugagaaggccacugaggagaauagagacaggacaaguugugagaacacaaccagaaaaagaaugacauccccguuuagaagacuuagggaaagaaugcuuucaagggagagacuagucaacagccaaaaagaggacacagaucacaaucaagcuacagaaagcugugagaaagugaaggauguuggaagcaacaucaaagaugagaaagggagugccaucuucaauucaaauagccaaggcaacaguaacacuuuaaacugcuucuauacgcgauucaagucuaaaaggaggaagacacucugaugaaguuccuuauuuaauuuuaguguuaaguuuguuuucaguuauuaauguauacauggcuuaaauuaaaccauuugucaaagcuuaggcagacaacuuaguaaaauacuauuuauaaacacuugaaaaugccucauuuguacauaaguuauuuuacugauguauugaguuaguaaauuuuauacucuuguuuucuguaguugacuuuauuuccuacuguuagcuggaucugugagugaaauauguagaggaggcuuuuuuaucuucuacuuuuuacguaucuuugauugggggagaagggacuagucuaacauagcaauaucagaaucaucugggaaacuuguuaaaaaaugcaauuacugugucccaccccagacuucauaaacuugaauugccagaaaugggaucuggaauguuuauuuuaauuggcuugccaggugguucuuaguauuauuauauuugagaaauacugaucaaauagacauaagaaugaaauuauuuuuuaaacaaugaagcaagauuauuguguagagcaaugacuuuuucuuuucaagaagaagguuuuuauuuauuuuuaauuuacuuauuacauccacuuucuugguccucuuaaaaauugacuaaucagcucauggacauugacaaauagcagugaucccaaguucagagauguaugauagacgucagaagacuggcuugucuuggcuuacccuguuccuguccacguaggccaaauauaaaucacacauuuucuaggccuuuuucucuuugaaauaguuaacgaaacgacuuaauaagauuacugugcaacaaauuauuccuuaaaugacuugaguuauaugugaauaacuccaagauccauaaacagagaaagacuuggaacuaaggauguugucauccucuuucugcaugaagaugaggcccugagaauuccaguaacauacccaaagccuguaauucuuccuaaugacauuucuagguauugguccaaaggucacauaucuacuaaacccuacuuuccucugugagcaagaagauauuuuuuacuucuuugagacccgucccuuguugggauuacuagggcauuuucuuuuucuuuuauuucuaaacaaaaauuugguuucuuccaguuaucaaaauagauuauuauguacauuagccauucuguugcagauuuguuuuuggguccuucaccucagugcgucccuagaauacagaagaacaucucucuaguugucugcugugcaguaagucacagaacaacauagaacauguagaugcuguuuuuuucuauaacacauuauuaaacauguauccacucagcuguuuaauauucugcaagguuggugaagaaaaaggaaacuaaguaugacacuaaguuuaaaccuaaaacaauuuaaaaaacugaaacaggcugggcaugguggcucauaccuguaaucccagcaauuugguaggcugaggcgggaggaucgcuugaggccaggaguugaagaccagccucggcaacauaaugagaccucauuucugcaaaaaguuuaaaaauaacugggugugguggugcagaccguagucccagcuacuuggggcugaggcaagaggaccacuugagcccaggaguucgaagcugcagugagcuaugaucgugccauugcacuauagccuggcaacagagcaggacccugugucuaaaaaauaaaaauaaucuaaaacagugacucucaacucaagacaagacuucuuaggugggauaugcagaauauaugggguaaguauauauaguuugauaaagcaaaaauguaguucuuucccuugaguccuggacucccaccccuacccuuacuucaagaugguauuugggauucagaucaggucaagaaauauucauauuaaucaaaggaaggagcguuggguuaaaaagaaguugagaaacccuaaagacauguacuuauuaauauuuguaaucuucuuauuuuauuaaaugauuauagcugugggagagccugagaaagauauaccuuuaaacuaguuuucugaguaacacuggacuuugacugucuuuuucuugaauguguaguuguauuggugugguguggauaguaggcaaaugguuauguaggggaauguguggagaaaauuggcaccauuauaucuacauagauggaaacuaaaauugcuucuacuuugucuucuguuauuuuugugggguuuuuuuuuuucauccuuuccccuacuacccccaccauauguucccuuuuuuuguaguuugaucagugcucuuuucuuguucagguuacacacuuauuccaucagcuaaaucugacaacuugucugacuccagccauagugagauuucuucacgguccagcaucgugagcaauuguucuguugacuccaugucugcagcucuacaggaugaacgguguuccucucaggcccuggcagucccugaauccacuggggcauuggaaaagacagagcacgcuucagggauaggagaucauagucaacauggcccuggguaagcaucauugucuguguucauaacacaaaacccaagccaaguggccacugcaaggagugcuccccaccuugaccuuggaccucccaugggguaauugcagaguuauccauaaaagaauaugugggccaagcacauauucucuauucugaauauguaaauaagcacuauguugaaagauguauggguguucauuuuuaaaguguuacuaaauucaaguaacuuuuuaucauuauguaucuuuccagucagaacucaaagugcaucugcuacuuauauaggggagauaauuuuugaaauucuggcuauagguuaaucaaaaagguuguguuuuggaaagugccucgagugcugugcacauuguagacagguugggagaguaggacuagcccuugaucucuguccucugaaaguguaauuuggggaguaagaauaaucaccuagcaaagguuaauuaaaaaaaaaaaucaacucuaaauuucuauuuagaaucaagcaacguggaaaucuuugagaaaguuuauucuaacugauaaauauugugaaaucuggucuacuuuaauaugaaaaauuuaagauaaauuauuaccacauuuauaaagauuucuaaacuaggaucucuacaccagaggucagcaaauguuuucuauaaaaguuacauaguaaacauuuuagacuucacaggccauaaggccucugucacaacuacucugcuauuacaccagaauagccauagacaacacauaaacaaauggcaugacugugucccaguaaaacuuuuuuuuuuuuuuaaggcggagucucgcucugugagacagagugucacucuuguugcccaggcuggagugcacuggcgcgaucucggcucacugcaagcuccgccuccuggguucacgcuguucuccugccucagccucccgaguagcugggacuacaggcgcccaccaccacgcccggcuaauuuuuuguauuuuuaguagagacaggguuucaccauguuagccaggauggucucgaucuccugaccucgugauccgcccgccucggccucccaaagugcugggauuacaggcgugagccaccacgcccagccaaaacuuuauuuacaaaaacgagcaaagagaccaccagauuuggcccugggcuguaguuugcuacccccugcacuauacuguaaaugagggguuuacaaacuuuuuuuugugaagggcuggguaguaaauauuuucgccucugcaaucuacauauagucucugucacaaauucuucugguuugguuuuguuuucuuuucuuuuuuaaccuuuuaaaagguuaaaaaacagaacuauucuuugcuccagaccauacaaaaauaggcuguuggcuaaauuuggcccaugagcuuuaguuuggggaccccugcuauaaauuauucauuucauggguaauuggggaaguugcuguuuacuuggcacuguacugggcuaaccucagagguacguugaaaaauaaaacaugauucuucaaguugggaacucuuaauucuguaugcauggacgcaguagucuaauauugugaugaccaaaaaugaauauguauacuuaaccuuauucauuucaacucucaucuuuacauuuucauuuaaaaucaguucaagaaaaauacuugccaggcauaccucugguccaucccagcugcuggggaggcugaggcgggaggaucacuugagcccaggaguuaaaagcugcagugcaucaugaucgugccuguaaauaaccacugcacucuggucugggcaacagagugacacccugucucgaaaaaaaaaaaaauaucuaacauuuuaaaauuuaaaaagaaaaauucuaaggaaauuuugcuaagcauuagaguuucuuuacugugucuucugaguguuaacuaaauacuuacaaggaauauagugaugaaugaugauaauauuguuuuccucacgauguuauuuggcaugaacacuugugguacgugcucuguaguuucucacaggcaauaauaacuugaaacagagagaagauaguuuuucuggcaagccuucuaauuguacguuaucuccaauuuuagguggacacucuugaagccaucucuaaucaaguguuuagcugucucaucgucugugagcaaugaagagauuucucaagagcauaucauuauagaagcagcugacaguggucguggaaguuggacuucguguucaagcagcucccaugacaacuuccaaagccuuccaaacccaaaaagcugggauuuuuugaacucuuacagacauacccauuuggaugaccccauugcugaaguugaacccacugacucugagcccuauuccuguucuaaaagcugcucuagaacuugugggcaguguaaaggaagccuagagagaaagaguuggaccuccuccaguucucugucugacacguaugaaccaaacuaugggacaguuaaacagagaguauuggagagcaccccagcugagucaucugaaggcuuggaccccaaggaugccacugacccaguuuauaaaacugucacuucaaguacagaaaagggcuugauugguaaguuguguuuuuguugucuguggcauuuagagauuaaguagucaaaaaauggcauugggauaucuuggcccuggauuuuaucgucgcaaaaauucauucucuaacaaccuuucuuuccuucacaaacaaacaaguuauuucccaaaaauucaugguuucucaaagacuuuggagcagcuauucaaccccauuaaaaugaaaagucugaugugaagguauuuaauuagagggacaaguuuguuugucuuuuguuuuuaaguucuuuuugguuuuauugaggaauaucaucgcauuagugugcaauaguaguaaagggauuauucucuuuaucaccucauaaauuguuuggaccacaauugguaugcauacgugguagaaacauugaaucugcuauugauuuuaggucguaacagugagagaaaaugcaaucaggaaguccagaacauuuuucaguauacucucuugguguacaucaugagugugccaacuccuguuugugaauuccauuccaagcuuucuuaguaaacuuuuuuuuuuaguauuuggccaucaaauacuuuuuaaaaauuucuuuccuaaacuauauaaauacguggauauaaaacugcuuuucuacuuauauggaaugacucuacuuugaauuaauaucauaaucaacuguuaaauuuaugcaacagucauggugucgcauuuaacuacuaaaaaugugaaggugaaaugugcugauuuuauaguuacuugucaaauugcauuauagguuggguuuuuagcucauucauuuuuuuccaacuuuuuuuuuuuuuuuugagauggacucuugcuguauugcccaggcuggagugcaguggcaugaccucggcucacugcaaccuucgccugccagguucaagcaauucuccucucucagccucccaaguagcugggauuacaggugccugccaccaugcccagcuaauuuuuuuauuuuuaguagagauggggcuucauguuggccaggcuggucucaaacuucucaccucaggugauccacccacuucggccuccaaagugcugggauuacaggcgugaaccaccgcaccuggccagaaguaaaguucuugaaggaauuaguuccuccguaccagcaaaguuaaaguuuauaugcuaggacugagaacuaaucugcccaggagugccagaaaacauugguucaugucucagagagaaggugaaacagcccuuaaacagauggcccaaaugucauuucuauguaaagucucccaguuuacagagaaucgguguguagggugaacuuuuaaauguuucugauaucuuuagggcuggugugacuucaggaguugucauguacuucugugauaugggggcugaauugcagaaggaagcuugucaucagugucaucuccuucaacucucucguucuauuuaauguuuacaggacuuaauauaguuguuuauguauuuuaaaaagagguuuguuuauuaaacuuuuaaaaaauguuuuugaucugccaucauucaaguuuauucauuuugucuauuuuuaaguuguauuuugucauuguaauaaguuuguggggugguuucuuuuuuuuuccauuucuuuuucauuaacauuuucauugcuuauuuuucaugccaguguacugugucaccucacccaagaaggacgauagguauagggagccaccucccacuccuccaggauauuuggggauuucuuuagcggaccuaaaggaaggaccccacacacaccuaaaaccuccagauuauaguguggcagugcagaggucaaagaugaugcauaacagccucucuagacugccaccagcuucucucaguagcaaccucguggccuguguuccaucgaagauuguaacucagccucagaggcauaauuugcagccauuccauccuaaacuaggagaugugacugaugcagauagcgaagcagaugguauguugacaagcucucuuaaaggcucuuaaaugaauugcugaacacauuaaauggucuuuacuuugguauuuuaugguaauuaguaauuguuucuuuaaaugccuugaaucucuguuaaaaaguaagaaguuccugccggcagggugcaguggcucacaccuguaaucccagcacuuugggaggcugaggcgggcgaaucaccugaggucgggaguuccugaccagccuguccaacauggagaaaccccgucucuacuaaaaaaauacaaaaucagccaggcauuauggcgcaugccuguaaucccagcuacucgggaggcugaggcaggagaauugcuugaaccugggaggcagagauugcagugagccaagaucgcaccauugcacuccagccuggacaacaagaacaaaacucugucuccaaaaaaaaaaaaaaaguuccuaaauauaguaugggggaguguuuugguuuuguuuuauuuuucaagauagggucuaacucuguugcccaagcuuagagugcaguggcacaauaaugacucacuacagccucagacuccugggcucaagcaguccucccaacucagccucccaaguagcugggacuacaggugcacaccagcaugccuggcucauuguuaaauuuuuccuuuguagagacagggucucacuauauugaccaggcugguuuugaacuccuggccugaagcaguccucccaccccagccuccgaaaguguugggauuauaggugugagccaccacacccagccaaugguguggguuguuuguuuguugagacaaggucuugcugugucacucaggcuggagugcaguggcaugaucguggcucacugcagccucaacuuccuggucucagguaauucucccuccucagccucccaaguaggugggacuacaggcacacaccaccacacccagcuaauuuuuuguauuugagacagcauuuuaccauguugcccaggcuggucuugaacuccuggacucaagcaaucugccagccucagucucccacaaaguugggguuaugggugugagccacuguaccccgcacugaugguguauuuuuuaaaugaaaugggcaagcugccuauuucugugugccuaguacccuguggcucaaauggaauauucuuaucuuugaugaaacaguggcucaaucuaaugggauacuuuuaacauuaauggaauuguauuuuaccuuaaugcauggaaacuugaaacuguguuucaaaugccaaauuaucugaaaugauucuauugauauaguuccuuuuauuagcaaaagucuugacugacuuuguaccugugccaauaguuugagaaaugauuguuuuauugaaaauaaaugaaaauuuaugcuuuuaaacaagaguaauaaaaugauuaaaaaccaugaaauuccaguuuauugucaaccuucaaugugaucagaaaucauagguauuauuauaauaaaaucugggccucgaugcaauguuugagaggauuucuuuguugacauugauuuucuaaauagauaacuagauuauuaggaucucauuaauaugcugaucugccaguuaauuauauauuuuuuauuuucagaaaaugaacaaguuucagcagucuagccuuuggaugaccuauuugaaaaccacugaaagucguggaggaaugggcaagaaccaccucaugauucugcaggccauugcuaacgaacagcucauugcuacaaccaguccagagguuuuauucccucuacuccgagcaaugaaauagaccugaguuaugcuuccuuucauuuaauuucugcagauaaauaguuuccugagcaauggaugcuaugccuggauaccagucuccacuuugcacgccggaacugccuugggaccacaguuacagaaaaaauguaaacucagagugauccuuguguauauugcuauagauuuuucuuuaacaagcuauuuuaaagauaauggcauuauuauuuccaagccauagcuugggcugaaggacaaauugaaauugucugccaauaccaaggauauucuuguauauuugaaaaauaacuuauuauuugaauuguugugguuuuguuuguauuugagagcucuuguuagcugauauucauguuugaggucauaaaauugucucuggucugaccaaacagaagucaucuuuacagaggugauaugcuugaucuacacagagaugugacuugaucuguagcaccaaugcaauguaggucucaguuugagagaaauaggaagcccuuugcaguugagguguuaggaaccugcuggucaugguguggaaggccaaaugaagcugccacaggguuucuugucaguccuuugggaaaugggagggaguaguuuggggaggagggugggaacccuaauuuccacagaaugaaauuuugauguuaaaugacauguauacaaauucuuccuuaagugaaaguuaugcugcaucgaauuguaacugaaaguauagauccaacaaauagagacuggguucuagagaguucuggucuauagaaacccaaaacuaaaaucucucauaacucaaguauggaauacuuuuuuuaaagaaauucuuaucauggguguuguaauaaugaagacgaauuugacuuuaugcaguguucugcagcaugccucccccacaucucauagcaccagguugugucugaccugacauacccugcagcucucagcuggcugcaguaacauuuugugggagaaagaggagcuggaguuacagaaaugauugucucuugguucucaguuuuuagcccuugagaggacauacuuuuccagccucauggguauggcacucuuaauuaaaauuucagugacuguuuacuggaugaggcagauuuuucacauuuuugcaaauuaaauauauuuuauauauauuaaguuuaauuuuuucaguuuuuuuaauguaaaagcaagugaaauuuuaauaaacuucuguaauuaccaaaaaaaaaaaaaaaaaaaaagccaaagccauuaacgugcacuacccagaucaacuuggagccaaaagggguuuacuucugaauggcuguccguauguguccacauaggauuuaguugguuuguggccuccuuuauagaaauguguugucuuucccuagcugucucugcugucugucuuccugcauaucccccuucauuuuaaaaucaugaaucaguuguaagugguaaaugguaguaguucaucuuucccaucaacaugauugucucuuuauuuuaggaauaauagcauuucaaaaauuccugugguaaagaaacauuaaucugaaacuuaagccuuagaaauuaaucgcagguaugauagaaugaggcuuggugguuccauagcuuucuugguccuuugaaaugggaaauaaccugaaccaaaaauccuaguuugaaaguuacacuucagugauuuggccuauaaacagugguccuaugauuauacauuuuuuccuucacugauuugcauaauuuuguuuucauggccacagcaaaacaaugugaaauauauuuuugcuauacccacuuuuuuuaucaaauucagaugucuacucucaccauuuuauauucauuuccccagaaaaaugugcuguuuucauaaugucuuuauuuagcaggucuuucaaaccaaauggaagccuuaccugucuuuguccuuaauaguguaaauaucuugcacagaguguugaggccuaugguuuuggacuugcaccuuacagcugccuuuguuuuaucuaucuagcuuuaacugugaguguucagaucagcugaucacauugaucaggagccaaagccaaaugcuuuguaguuuguuauguauguaucccuuaaaaaaucaugagguuuugauuuuuauauuuuaacuaaggguacauuccugccuucucuuaguuugucauaugacuagaacaagagaagucuuaagcugcauuuacuccaauuccagaucuccauuuguuuuuguuuuauaaauuuauaaucuuaaugaagagacuagugcccucucuuccugccacaacucucaaucugccaagacuguugaagcaguuaacgcucagugcaaacuuuugccaaauaguaaguuucaacaaaauaucuuuauagugaaagauuuugagaauuaguaaauccaguacaugauuccauaaaagcuuauuaaaguuaauaauucuaauuuacuccaaaugauuacuuucaauaugaucuuuggggagaaaaagccuuuagugaauuuucuugagggugauaaaucacaucauugcgaucuauaucaccuccuugagaaucucucccaggcugaaaaugugaugguaaucauggguguuuuuaagaacaaaucuaauuuuuaucaaguguucuuuccucuacaaaaaaggaaggaggagaaaaagcuuccuuaaaacugauuauuuugauucaauuuuaaguuucuaaaaaaggugauauuaaaguauauguauuccuucagcauuaccuuaaaggcuagaaaaacgggauaaaucuucagaaaagugucaaaagugucacaguacauguucaaauuuaaacuugaauccugguucaucuuugacuuuuguugugcauuuuuaaugcuucuuuauuuuugauacacagaaugcaguugaacuugaucuuuuaaaauugagacauguaagcuaaucagcaaaagacagaaacaaaacugcacaucuguaauaaucagauagcaauucuacugcacaauucauugauuguaagguauccuguaacaagcaauguuugucuccuauuuuuugauaccucuuaaacuuaugucuuuuagaaagacagugccucuguaugcuuuuuguauuuuuacugaguguaaauauuuguuauauuuuugguuaagagaauguaaaaauaccauuuauuauuaucauaucuacuaauacauugguggaaucaauaaagaaucuacauuaa

SEQ ID NO: 192232 - RNA, 130681 nt, Homo sapiens
uuaaaggaaaggccaaccaggauugaaagaaaacauuuauugaaucaaaaucaauacuuucuuuuuaguaucuacaagccaacacagaacucauuuuauucaagaaugaacacaauguacaaaaaaaguaugcuuauauuauaaaaauaugucaauuuuaucuucugggugcuuagcagaagucauuuuaaacaaaaucaaggcaaacuuguucucuauaaugagucugcuauaauuuaacaacaaagugaaagcuaauguacuuacgaaguauuuuuaaaggcccacugauaaugcugcacuggaaaugcuaaacccaauguuaacuaaagucaacauuuccgcucuacgcuuacuggcaccacuucaugccuacaucaugggaaaguaccucuuuuacagaaugcagaucacugcuaacaauccacaugacuaagucuucaguuucccuugcuuaacauuuguuagcauauauuucagcaaagauuaacaguauaaugaauguugaguaguaaaauccuauuuaauucgcuucaauuuaaaaaugagauaugcugcuauggggaacaaaugaccucuugagauuuacaacccccuuuauaaaagugggaaagcugccucccuaaaaaaaauuauguccaagguuaauaccguaucuuuuuuuguaguuuucuuauuucuugauuuuauuggcaccucccaggcacuuuggcaugugcuccuguauaaaguguaguuacugugccuguagaguuaguggcagcugcagaguaguuauaggcugacaaguccacuuuuggcuuaccauggagaucugcuccaacacaugcuggucguuggagcagcaaaaaaaaaaaaaaaaaaaaaaaaaacagcgauuuggaaaaagacuaaaaucaugagucagggaaaaggaucacggcuucccguacuauuguuccaggaguuauaugacaaguagaaaaauuguacuaauuuaaagagucagucaaaauagaaguagacuaaauagcaugagugcugauaaugccaagaaaauccaaucucucuucuaaagagcuugcacacagcacauagcaaugucccuggccaagaaacugaccgugccuggcugagcagaaugacaacaguacucaggcaaauuccacaaugcaacauccacuuggugaaucagugacaauggaugaauucaacuuacuuuagaaguuguuauuaaacaaacugcaaaaugucuacuccgaagaugcaaauguuuuuccuuggcagauccucucugugcuugggauugacacaaaggcucaaaacugcaaaauacaaagaucaaguaaucuggugccccgcuguacuggguaaauuaaauuuuaaaaaguggaggagaaaugcuuucacauuuuaccuacauaaaccuaauguuuguucaguugccuguuuugcaagaaucuuggacuaagguaaaugaaggcagaagauaaagugaucccuguuccuuuauuccaaguuaaaguuuuuaauuaagccccauuuguuauaugaaauguuaauccuaccaaauguaguuagauaggcuugaauuggacauaggauuuaaacaaacauuuuaaugagaacacaaaccacugacucuggcuuaacaccacacucuaacagaaaagaagaaaccuuuacagaaauauuugaaauauacaaaauucgugcaaggacaaacauauuuuagaaccugagcaaaggcuucguacagguuguuuucacuggcaauaauucagccaggucgguauguauguugcucuuggcaacugauguggccccuaaaauaauauguagagcacagaaaggccagugacucuggaggucugcaguuaguaguacaggccagaaguucaagaaacugcuacuggaaacaacuggauaccauaacauuaaaaagaaguaaaaauaaaagaaugagugcacaaagaaacgaacagcuaauuaauaagaugaagaugcucaggauuggacuggaggagaguaugaccgcaacacucagauacauaaccacaccuguaaccacaccuguuuacaaccacagguccuugcucucaaaauaaauauauugaacauuuacaacagaaugaaugccuuaugaaugcaagcuuuucuuuuauugcaauucuaaucaaucaaucaaacagaccaaaaggucauacuucuaaaauaagcuacaaguaaucuuuuucuaugaaaaugaugugacuuggugccacagcuaaacuuuaucuaauagcagcaucaucagcccauggcagcaaagaaauguuaauuucuggcaucccaugggcucuuaccgaagcaacaacuucauaaagcaugcagauaucuauucugcugaaguuucaaacaaacaaacaaauaaaaaugaucauugugcuugugggucucauaccuuccaaaauauacauaaaugauggcaaauuaacaaauaauagcagguccuugcuuuccaauaaaaucguaaggcagggggucggcagugaaaagaaaaauguuuaaaauagaaaaaaaaaacugcaaaaugguguuagcauucacaaaaaagaucaugcgaagaucagauccauacugauuaaacauugaaaauucagugacaauccaaagaacucuguccaugaguccaaaggcaugcaugccagcugaaggaaaugcaggauucgucugacaguaucuucuucagagcagaacaguaacaucucacuggaauaaucacgacaggguggacaaggugccaucacacuucuuuuuuguaauucaaaauaaaagcaaucacaggacaaaaaaaaauuacagaauaguggacagagaaaauauagaaauucacaauaacccuauaaaacaaaaaaaaacuugaaauuauuucuacauuuucaggguuuauccuuuuucaaaguagucuuuuuaauuaauuugaaaaguuuauaaacaaugaagucuuaacuguaaaauuacuacccaagagauuaucuuuaguaucaguacuuuuuugagacagggucuugcucugucacccaggcuggagcgcaguggcgcauucucagcugacugcaaccccugccucccagguucaagcaauucucgugccucagccuccugaguagcugcgauuacaggcaugcgccaccaugcccagcuaauuuuuguauuuuuaguagagaugggguuucaccauguuggccaggcuagucuccaauuccuggccucaggugaucagcccaccuaggccucccaaagugcugggauuacaggugugagccaccaugcucggccucaauacucaaaauaaugauuucacucuuguuuaaaggacacauaagaagcaucuugucaucagaauccuccccaaccagauguuuuaaaguauuuaaaguucuuaauaaggaaaagaaccuaaaacuuacauuccaagugcagaaacuacacuuagcugaguaauuuugccuuucccaauaaguucaccauuaaaaaauuauauauauauacauauauuuacuauuauuggccuggccaugucuggccgucagguccagaccccagcucugaguacucacuggagaaaggaccagggcuaucccgccuucguauccacgagcugcaucuggacauuggcaggcauuccaccuccauaaccucccuuggacugcauuugguucugaauggagcuaaccuaaaacaagacaaaaauacaacaaaacaaaauggaagucaggaaguagguccggugcaacuaaguaauucuuuucccagaauuuuauuugggcugcuuuuuucagaaggguacuuuuauagacaaaaauuuuuuuauagacaaacaauuuucuaguuauaaggacaaacagggaggcuagcaacugaaacauuuuuugcaaaaaccccuauuuucucuauuuccaaauuacaaaagucaguuuuguaauucacaaggcacuugguaacauuugaaaaauggucaaaaauauauagaucaacuccacuuucuuuuuuuuuaagacagucucgcucuguugcccaggcuggagugcacuggcgucaucucagcucacugcaaccuccaccucccagguucaaaugauucuccugccucagccucccuaguagcugggauuacaggcacacaucaccacacucagcuaauuuuucuauuuuuagguuucaccauguuggccaggcuggucuugaacuccugaccucaagugauccgacugcuucggccucccaaagugcugcgauuacaggcaugagccaccgcacccggccgaucaacuccacuuuguuucucaaccucaaguaucuuaauuuacagauaucucacauauauaaucaccucaauuacuuaguaaagaaucaaaaccaagaaaauaagcaugaauaaaauuggaccaaccaaagauaaaucuuaaaagucugugucaaaaaauguaccauguuaauauagccugauaaaaaagaaucaaagaauccaaagacagauauagucccaguuuauuuauuaauauuguaacuggguaaacuauuuauccucucugaguaucaggcuucuuaucuguaaaaggguuaagaugguaaucucucccgaccacauugcagggcuguuuccugauagagugcaagauauaugaaaauugggauauuuucuuuuugcugaaacaaaggcacauaaagucauuugcaaacugugaaguacuuuuagcauaucauuauuauuccagucuuaguucauauaaauuagaagcagucuggaagcagagaauuggagagucaggcuagacugcuagaagaaggaacacaagcaauaugauuuuggaggugauggccuaacuaguggagagagagcacuagcaauguggucgaguauuuauuucauggaaucagcucaaagggcccugcacacuuccacaauuuggaaggaaccggggcaucaucuauuuaucagucaccugcuuaucaaauacuuacugagcaccuacuguaacauaaggcaugaagggugaggugcuuuccacuggugauucugagucaauauauuuaaaguaagacuugucuaacucauuuuuugaguaagucagguuucaauauauacuguaaaagaacauaauggcaaaacagaaaaugcauagcuuauuuagaucaagagagucuuaaugagaaaauguguuuugcucuuaaauggggacauuuuuacuaaccuggaaauuuacuuacauggaacaucuuauucguaugacaucacauuauaagguauugcuauaauagucagauuaauaaaaugacuaccuucagguaagaguguaagaagaaaucuauauuuuuguuuguuuguuuuuuaaacauaaacuugcucaguuaaugcagugugaagaggcuagggccugucauaugauaccaguucaaauucgucaucuuccccuuuaugguaacuaacauuaaguuauguggcacaaaccugauaccaaguaauuuuccacuuaacauggcauguuagcuuuuauagauauuuuaggccuggcuuaaaaaacaucuuuaugaccagguacaguggcucacagcuguaaucccaacacuaugggaguucgaaguaggcagauaacuugagcccaggaguuugagaccagccuggaaaacauagcgaaaccccaucucuacaaaaaaaauacaaaaacuagcugggcaugguggugcaggccuguagucccagcuacugggggaggcugaggcaggaugaucgauugagccuaggcggucaaggcugcaguaagcacuccagccugggcaacagaaugagacucugcaucaaaaaagcccaaaaccaaccaaacacaaaaucuuuguuuguuuuuacauugugcauucaauaaugccaagcagauucuaagaaaaaaaaaguauuuuucuccaaaagucaauucuucaauuuaaaagauuugguuuaucuuaaguaaccuuuauuaaguaacuuuaauaaguaaucuuucaguguugagacaauguauuauugugacugugaauauacaauauuuuaacgcaagguuguauuacugaacggguaacggaaaucuuuucuggaaagaggguaguagaaaagagucuuuuacacuaaguaaagguagaagaauaauauauuuagaagaaaaaagaaauuacaagucaucuaaccauucaauaauauaguuuaggcaagccuguuucauaugcgucaagccacauuccuaauacuagcugcucaguucuuuuauuugaauaaacagcaugucuauuuaugguuucuucuuauuuauuauugcauugcauaggagaacauaauuuuucucacagagucaggcucaucaaaucaguacuaucaaugauacuuucaagaaaaguuacucagccaggcgugguggcucauggcuguaaucccaacacuuugggaggccgagguggguggaucaccggagguccggaguuugagaccagccucgccaacauggugaaaccccgcucuacuaaaaauacaaaaaauuagccaggcaugguggcaggagccuguaaucccaguuacucaggaggcugagacaggauugcuugaaccuaggaggcagacguugcagugagcugagauugcaccacugcacuccagccugggugacagagcgagacucugucucaaaaaaaaaaguuacuaauugaacaacaccauuccuagcagcaagaacacagugcucugugacagugggauggaugcugaauauugcuuuagagauagcaaacucaaauacgaaauaacuauagaacacauuugggaagcacauuuagcucuaaagggcugaaauacuucauaaaaaguccacuucaguagcagagaaggcugccuggagacagcaagguagaaacucuaccacagcuaaagucccaucucaauccugcaucuaagauuaagaggcaggugugcaagcccugcaaaguacaguccuaaaguucuaccuaaacuaugagaagcaaaaaaauaguaagccaaugacagguuuuucauucaaggaggaaucuuaaaggaaauuccgaaauguacauaagauuuuaaaugccacgaacuaaaauuuaauuccuccuauacgguuggauuuauuuuuuuaagaugggguuucacucugucacccaggcuggaguucagaggcaugaucucagcucacugcaaccuccccccucccagguucaagcaguccuccccgcucagccucccaaacagcuggaaccacaggugcacauuacuucacucagcuaauuuuuuuguauuuuugguagagacaggguuucacuacauugcucaggcuggucuugaaauccugagcucagaugauccaccugccucagccucccaaaguacugggauuacaggcgugagccaccgugccuggccuuauaguuggauuuuuuaaaaaucugagguggcagagacaacaucuguugaugagagagaaauuaaaauucaucauauauaacaaauuugaaacuacccauucucuuuauuauaguaaccauauuaauaaaaguaauagggccucauuuagucuuuucacucuauguugaugcaggaaacaaaacuacugacuguuuugacagcaacaugauaccucuugcauuuccacaaagcagucaagugaaacaaaguacuuuuccuacggauuuaaaacaaacaagcuguuuccuuuccggcaagguucaaaugucauuccuuugcuuaccuaguaacugcagugacaaacgucguugcuguauccaggauacccaucuaccuauuuuuaaagucccuguuaagucuuuuguuaaugcugucuaguaaguugguauacaguggaucauaauuuuauguuuauaaaauccuuucugguuuugaacacuuuagggaucauuuauacuuguuuacuuuaggcauggggaaaagagucagucuguugaaacucaguggccugcuuuaaggcaaaugugaggaacaacucugauaagaacccgcauuuggugcugcuucuauuauaaugcauucugguuuucucuucaacaaaaauuaaggacuaaaaggucagcugaguagaucuaaagccuauucugaaacucacugaaaccucuauuaaaagacagcgaauaaaucuuauuucugguucuucacauccuacuggcaaaugugacaaauuuuuacugccuugcccuaaagggauaugugaaaauucuaauccuaugcuuagugcaugagaacuuagaguaaauaaaucaccaacauucuaauauuaccagguaaagaugaauaguuuauaacaggggucccaaaaccagaaguggccuguuaggaaccgggcugcacaacaggaggugagcagcugcaagugagcaucaccgccugagcucugccuccugucacaucagugauggcaugggauucucauaggagcacaaacccuauugcgaacugcacaugcaaggauuugguuguggacuccuuaugagaaucuaaugccugaugaacugugguagaacaguuucaucccaaaaccauuucccccauggaaaaacugucuuccacgaaacuggucccuggugccaaaaagguuggagaccacugguuuauaaaguaaagcaauaaaaaugugugcaaaaggcaacuaacugaacuuaaaagaacaaaaagagauuauuauuaaaaaggcugauauccaagucucuuuggugggagcaagagaaucaauaggauauuaaccuccauucugaacucaaauccuuucaaguuucaaaguauuuauucgggacaaaggcagcuaugaagaguugcguacaagaaacagaaacaaauaccuaauccaggaaauucaaagagauuaauuuuucaucaguaguuugcuucucucuucuaugcucauauuauguauuuacauucacuguacacaaauucauuuagcauaaugcuauuaaaaaugcuugugccugucacacagguuucauaugacuaugccccaaugcccuaccugcaugucccaccaacauacuuacugaauucauuccacugaacaggucuccugauccaacaugagcuguaugcacaaaguuugugggcucuccaaucauacuucugucaauccgccgucgccuuuucuaaaauauggggaacaaauguguugagaaagugaucuuaugagcaacuuauucugauggauuuuuauacuaugacuguuuaauaaauuugccaagaacacaaaaaugccuagcucuuagacugccacaauuacuucuuaugaugaaauccccaagacaaauauaugcacaaaaaugauuaguaaagcaaaauaacagguuauuauuuagagcuuaauagauuauuuggucuagcuuuggucauccacauauuuaauaacugcuuaaguuuuauucuuuuuaaaaaacgagacaaauguaaaauuacccucagucacuauuauuguuggcaaagaacacagugguuugaauacacugucugauuuuaaacauuacuuucuggcuuucaucauuaacagauguauuauauuuugaugguuauuauucagauuauacccaauuaccuuucuaugcuaaaaugaaucugucauuucagcuggaggggguggaggugggagggugagagggugacagauuugguccuaguccauucacucuucucuggucuguucuagcugggaacuaaaccuguugacuaacuaggcugggucuuacucacucuucuuaauuuuuuuuuuuuuuuuuuuuuugagauggagucuugcuauguuacccaggcuggucuuuuaacugggcucaagcaauccucgcaccucagcucccaaguagcugggauuacaggcacgcaccacuacgccuggcugacucuuccuaauuuuugaaaagcacuucucauggggugcugagccccauuuuccaguaacuuuagccaccagcuggugucccuguucugaccaauaugcucaucuaccccuuagagauauuuccugacuguacugcuguguuucacugauuaucuaagaguuuuccagauaugaagauuaucuuagaucuguccuguuuuccaugaucccuuagauaugauaauguuauugggagagaccacuggccacguuggguuaguguccuacuauggggcucugcuuaucccaguuuacugucaauaguauacuucuccugaaauugcagcuucccucaaaaccaagcagaguuacaaacuugcuggauuagcugccuuugaacauaacacuuuuauguccuuaucuacugaaacgcuggcaugauccugauaaacccuaaaauuuuaucacgagagucccauaugacagcuccucagggugaaaacaugacuuucuacaaaaccacaaaaguggcgagcccaugcauauauuuuagaaguccauauacauuguuuuacuguccucucguuuauauugucauagauagaaacaacaaccacaaaaaacccugacgcuuuuccuuugaaauauuuauguuauucauccuuagaauucagcaaugacauuagaccaucuccaaguuuguuggguuuuccuuccaguaauucugcguggcacacgguuaucugaacacagguuuucuguaucuuagaaaaguuuuauucuguuaguuccuugauaauugcuccauguguucauuuugcuauuucuggaguuccugccuauguggacauuugaacaugugugugucuauaaucuuccaaguuucuuauauuuucauccuuuauuucucuuuauaauuucacugcauugaaaaguaacucugcuuuauccucuucagagguccaagcuagauaguaaauauuauaaccuugcaggccaaauacaaucuccacuguagcuuugacucaacucugcuauuguagcaugaaagcagcugcagagcacaugaaauuaaaugaguauagcuguguuaugguaaaaauuuauuuacaaaaacaggugacaggcuagauuuagccuguaaaaguaguagucugcugaccccagcucuagauuuuuucaguaguagccacauaauuucauuuuuuccauuaugguuauuuuucagaggcuguuaugacaugucauugcaacauuuuuuaaucucugaaaaaguuguauuauuauaguuuuucacucuuuucccuaaaaacacuuaacuauauaaauuauaagucuauaacacuagggaacaaagaacucucauuucuuuauuugaacaacuuuaguuuuacuucaagccuuuuuuugaaaguugguaagaaacugucugucuuuuggggcccuguuccacagaaucauaaaacuugcagguuaaaaugguaucauaaagucaaaagaggcuuuugucuauguguuuuaauuuuucuauuuccuagcacaaugcacugguuuccugcuaucuuuuucucgcauacugcucccucugaugaucuuagaggugccucauacaaagacucccugccccuaauggcagacuugacacccacaaccauccuuugaucuggagugcugcaugccagcaaugcacuggucuuuuccucuguuccccaucuuuuucacagacucaguuugucuauuuccaaccaccccauucaacauacuucucuucauacuauuuuuguuuggaaugauaaagcauaauucuaugaauuagccuuaaacaaugcuaacuuaucuuuuuuaggaauaaaguagggaaaaaagauguuaacaguuuugugccuuuuucucuucuuaauaauauauuauuacauuuccacuaaauuuccuuauuaggaagcuauuugggcagguccagaaauguaaucuuuaccaucacaggauacgaauuuucucagcaugugggcaggacaaauuauugggauuucuuccccagugagccacuuaacugacagguagagagggaagcuucuagguucuugucacaguuccacaggacaguggcaucugcaggacaccagacucuuccccaggcguuugcaguaaacaugucaagauaacugcuucugauaugcagagagagccacuuggcucucucaagcaggggaggaggugguaccagagaauacuuccugguaccuacuuccagaccacuaggaggagucuugaucaacccuuguccugugaaccugcagaagcaacuccuaacaguucucauucugcaucauuuccuccagaaggguguguuuagagcuugccaaaaggcuccacuuggucuauaccuccauauuaagugauuuauucuguugaguuacugcaggacuguguugggggagaacagaaaccauagugugcucaggccaccacccaucucacccaaaaagaaugaauagauaugcuugugaaagaaggguauuaacacauacucacaaacaauaauucagcaaacaugauuacugagaauauucaaaagcugauaacaaaacuaguucccaagaagcuacucugacacugaaaagcaaaggaugggaagacuucagcuuacuucuaucauacuguguuauuagauaacuaauauauaugaaugugaaaauaauagugaguauuuuucagcuugaacuauacugagcugggagucacaccuuaguauuggaagguuucuucauggcaucuaaucuaacaguuugugagauaugaaagaagcuuucaguccuucgcuccccaaggcugagggaacucagcuguccagaaacugaaaggagcaacuguguugugcgagcauaguaaagguaaacaccuaagaugaaaauaguaagauaagcaagaaccagaucacauagaguuuguaaaggacugaagugugugauccucccaagaacaaugggaaauaauugaaaguguuuuaaagcagaggaauaacaugauuaaauagcuugagaagacuauuccacaauagcuauagguggaaaacauguuagaagaggucaaaauaaguuauuaauguuggugaaaagggauuauguggauucaacuaauaacacagauagaaguggauagauucaagaaguagucaguggauaaaaucaacagcauuugggccggaugugguggcucacgccuguaaucccagcacuuugggaggccgaggcggguggaucaccugaggucaagaguucgagaccagccuggccaacacagugaaaccccgucucuaccaaaaauacaaaaauuagccaggcgugguagcaggugccuuaaucccagcuacuugggaggcagagacaggagaaucguuugaacccaggaggcggagguugcagugagccgagaucgagccauugcacucaggccugggggacaagagcgagacuucucucaaaaaaacaaaaaaaaaaacaaaaaaaaacagcacuugguugcaggcuggauuugguaacagugagagggaggaguuaagaaauaugcacagacuucagauuucagcagagagugugcaauucacuggguucugagagaauccaaacuggagauaagagacugagaaucaccagcauuaacaaagccaaguuaaugagauuuccuagacaaacuaaauuucugugguugggcagagaagaagccaucaaagaaggccaaaaagaaacagccugaaagucaguaggaaaaucagcaguguguacaagugucaagagggagcagagcugaaagguggugagaggucaauuaaagacaaauacgugcaauggauucagcaauaucaagucaaugggcaccuuagugagugcuaugucaguggaguaauaggaggagaagacacgcugcaggggacugaggugggucuaagaaguggaaaauggagaaagagaacagagacaacucuggagaaaagucuggccuucuggacaggaagaagacaggucaguggcugaaaggagaaaaggagaugagaacagauugaauuuuuccccuguaagauggcagagaauucauuaugcucaauuucuaaugggaaagauccaguaaaagagguacagaaaaagaaggaaaaagaaaauggauugucaaccuuacaagguuccugagaaggcaggaaagguggaucuagacacagguggaaguguucuuuacacucuuuccuacaacacucuaucaaaaaccuggauuuaaauauaaauaaauauucuaaacuauaaaaaugcaguauuuuaaggcacaauguggacauuuaaagaauggcacacuuguuugggguacuguauaauagucacggguggcugggcauggugacucaugccuauaaucccagcacuucaggaggcugaggcagguggaucacuugaggucaggaguucaagaccagccuggccaacauggcgaaacccugucuccacuaaaaauacaaaaauuaggccauaagaaugaucaaauggacuuggggcucuggaagagugggaggggggcaaggguuuuauaaaagacuacaaauauggugcaguguacacugcucgggugaugaguacaccaaaauccacaaaucaccacuaaagaacuuacucauguaaccaaacaccaccuguagccccaauaacuauggaaaauuaaauauuuucuuuaagaaaaaaaaauuagcugggcaugguggcaggcaccuguaaucccagcuacuugagaggcugaggcagaagaaucacuugaaccuggggugggggguuggcggggagagguugcagugagccgagaucacaccacugcacuccagccugggugccagagugagacucuguuucaaaagaaaaaaaaagaauagucaugggcaaacaaggggaauuccagagucagaccuccgcaaagaaaaacaggaaauggugcacucugcucugauacguauuaacaguugucguuagcagagucaccguguuuccuggaaacaaauucuuuauaggaaacuuuguuaagaccgucaaccaucugaauaauccuugcauccuuaaaauauuaacuuuuauucugcauaaggugaaggacuagagacccaaaugaacugcuauguuaguguggaggggacauuaggcaaaaugucucuucccauaacuuuuuacauaauuacaucauaauuauuaaagauaaugaacuaaacaauuuggaguauauccaaggaggcgagaagcagguuaauuucaaaggauuugcuacugugagaaccuuauuugcauccuuaucuaaacaauauguauauaaccauacuauaucuaccucccucacauuucuggcauauggaucaacuguagcuucuagaaaacaguaauuacaucaucacuuaaaaguuaaaacuuucccaaagacuauucucugggcagcuuagugugcaaacacaugucacugagaagcaaaugaaggccaggucccaucagguuagcagaaggccuacaguaagaguaaaagaugguacagccugagguaguucuagaagcagauacagagugaauaaagaaaaugaaaauacuugccaucugggacagugaaaaaagcuggaacuuucaggguauaaaauagcaaucauuuaugcaaauguggccaaaguaaaugaaagguugaaagcuaugcugacucaacuuuaugaccuagagaaagucaguugaguuguguaacuaaaucccuaaaucuaugaauuaaaucuaacaagcccacuauuuccaaauugugucuuggggcaucccagcaaaacccaggggugccaggguuuucuauuugagggaaacacagugaggcucaauguguguuugacacugagugaacuaccagcuucagauaauuuguaacuucaacauuagaacauacauucuuuuuaacagcauaucuuugugaagcugaguuuucagugguuacugugaaaaaaacccaagcacuaugcaaaagucaguauggaacuagaaaagaagguggugguguucagucugauuccacaguuugagaaguuguauaaucccaacaggcacaaacacaccauaaguauguaacugguuauuuaagaauuaaauaaaaauauuuuucaauuuauaucuuauuuuuuaaaggcaaauaaguuguugggacauaaaucuuuacuaaguuguuuguaccaaauuaguuaauaaacaagucuguacgguauuucucuuggccuagaggcaccaugaaaaaaauuacagaaccguuaagagaaguuugggaaccucugaaauaagcuacauuaguuuuuugaaauauugacaguguaauuaggaaccaggcauuucuaaaacaaguggguauuuuuuuucuaugaugccagugacagugauucccugggugcgugagcugcuuccaaguuaaucaaucuaguucacaguauggaaaaaaaggcuaacaaaaguuguaauaauauaaaaaauggauuugacauuuuuugaugaaaaugaucuuccuaguggauauucauugacacaaaaaaugaaaauaccuuuuaugguaguaaugucaacaaacuauaugaaacacccuugccccaagucucucccuacucauucuuugagacccagcucaaacauaaacauuccgaguugaggcuguuggauauuuccuguucugaacauucacagcacauggcucauauucaauuauaguacuuaaaacauuguauuguaacuuacuugcuuacaguuugauuuuccuacacuacuaagaguucuguaacaguagcugugccugacacacaguagacaauaaaugacuguugaaugaauaaaaggcuuuuuuaaagaaacaaugucagcucaguucucuaaaaauuguuugucuuaucuaauauuaucgccaaauauuucucaagaaccuauuauauuuggaagauguaaacaauguaaugccaauucuaaugaagucuacauuucugcauaaaaaauacuuaucugcugauuuaauuuucucucuuucauagaaaugcugugugcucuagagagguuuuaacugguaacacuguuuuaguuuuuauauuggguagaaccuguaaagcagugguucucaagcuacaguguacaucagaaucccuggaagguuuguuaaaauacagguuucugagcucuagucacagaagauuuucagauugagcaaguuuggaguggagcuucaauuugcauaucuaacaagauuccaagugauauugauggcuuaaugguuaauagaaaacacuggcucuaaagauuaacagcugaaugacuauuauuaaaaagucaggccaggcgugguggcucacgccuguaagccuagcacuuugggaggcugaggcgggcggacugccugagcucaggaguucgagaccagccugggcaacauggcgaaacaccaucucuacaaaaauacaaaaaauuagccaggugugguggcacaccccuguagucccaacuacucgagaggcugagacacaauaaucguuugaacccgggaggcagacguugcagugagucaagaucacaucacuccagccugggcaacagagagagacucugucucaaaaaaaaaaaaaaaaauuacauauagucaaauaauaauagaugcuggugaggcugcagagaaaagggaacacuuauauacugcuggugggaauguaaauuaguuuagccauuguggaaagcaguauggcaauuucucaaagaagugaaaaacagaaguaucauuugacccaggacccccuuacugaguauauacccaaaguaauauaaaucauucuaccauaaagacacauguacacauauguucaucacagcacuauucacaaucgcaaagucauggcaucaaccuaaaugcccaucagugguagacuggauaaagaaaacgugguacauauacaccauggaauaccacacaaccauaaaaaagaacuagaccauguccuuuggagcaacauggauggagcuggaggccaucauccuaagcagacuaacacaggaacauaauaccacauguucucacuuguaagugggagcuacauugaguacacauggucacaaagaaggcaacaacagauaccaggacccaucugagaguagagggugggaggagggagaggaucaaaaaacgaccuaaugguuacuaugccuauuaccugggugaugaaauuaucuguacagcagguaaucugugacucaguuuaccuauauaauaaaccuacacauguacccccugaaccucaaagguaaauuaaaaaauaaagauuaacagcugaauauuuaaaaaguaaaaguggguaauaaagaguacuuauaagauaccaggcacaguuccaagaacuuuaaagccaugaacucauuugcuaguaccuucuauagcaguauaugacauuuuaccuucccuucaaaucugggauccucuggcaaacucucacuucuugucucagccacugcucagaaguccucauuuguucaccuuuguacucucuauugaauaaagguuuuuuguuuuuuuuuuugagacaagagucauucgucacccagguuggagugcgguggugcaaucucagcucacugcaaccuccgccuccuggguucaagcgauucucgugucucagccucccgaguagcuggaauuacaggcaugcaccaccaugcccaucuaauuuuuuguauuuuuaguaaagauggguuucaccauguuggucaggcuggucucgaacuccugaccucaacuaauccacccaccuuggccuccuaaagugcugagauuacaggcaugagccaccaugccuggccaagaugggagucuuaacaguguccagguccuggauauucauguuaaagaagcugaauucagccuucccaugggugguaaucugaguugauaaaacugccuguggaagucuaguuucuaagaauaugacaaaaaaaucucuaauauguuaagggacaaaugaaagagaaacaagguuuuagauacugcagagacuggaaaaauaucugcucuucaauaacugaauagccuacuuuggauuccaaauucucauacuuaggucaaaacuugagaaaauaauaaacuucuucuauacaugaacuuguacuguaucuucuacggugggaaaaauaauucuacuugucuggcuucuagagcuuagcucacucacuggaaugccagcaguggcccucaggugacagagcuuauauaaggagcucucuccagaggagaugagagucacaccauagaucaccacagagaaaccaaaaccagcuaguauuauaagcagagaauuaucuaagucaaaguacagaaaggaaagauauuuuguguuggaaauauucauaaauaaauaggugaguugcugguaaugcauuuacaauucaaucuuaaguguggugcugucgguaucuguccuuuaggguuuaguagguaacuaaccuuuuccuacucaguauguauuuugcagcuuuugacagaugagaaguuugcaggagacccccaaauguuuuuaaaaagaaucucuaagcaaaucuauagugaccuuuucaagggccaaauugcuaaaagcaaaauugaaggaacuaguuguucucaucucucagugagaaaccugaagugaaaacaguuuuuuucuccuucuauuuaaaauuaguaucugguuuaagucacauauuccaaguaugaaaacugaagcacaaaauagguuaaaaaaaaaaaaaaaaaggaggggagaaacuaaucugaacuagcuuucaaguauuaaugauauuguuaauaucauugguguuaaaaacuuuucacuagaaauuucugucacuauggguccaucugggauuguuucuauacacuguauguauacaauguacaauguaccuaggaagauauuacuugccaaagucccacagcuaacuaaaaucagaucugggagucuuccuuguccacuguuguuuccuucacaucacugugugaacaacuguguuucaaagcaagucauauaauuccccccaaacauuuacuauauaaaauugaaauacaaaaaucaaguguuuauauuaacucuaugugaagaguguuuacaauugagccaaguacuguacuauaauuaauuuuucuuacaccacacuuugcacuggaauugcuucuggcuugcuuagcuuaaaaaaaaaaauucugucacaaauuuuacacacaaugucugcuuaacuuuuuuuuuuuuuuuuuuuuuugagacagucucacucuguugcccaggcuggagugcaguggcacgaucucgccucccugcaaccucugccacccggguucaggugauucuccugccucagccucccaaguagcugggauuacaggcaccugcaaccgcacccagcuaauuuuaguagaaaugggguuucaccgucuuggccaggcuggucuugaacucaccucgugauccaccugccuuggccucccaaaguuguuugcuuaccuuuuaaugaaacuaucauuaauuguucuaauacccuccauaaguaucucgugguauaaccgauuaaauagcuaagugacuuguccagauagucugaaauuucacucaguaguauggguucuuuuucauucaaccaagagacuacuguuuuuuguuuuguuuuguuuuguaguucagggaaauuuuccccuaguauuacuuugauaauuuacuagggaaauuuuccuguaguauuacuuugauaauuuauuauccuccaaugccuuuuguccucuuuuuuguaacuuuaggcagauuuuguacuuccuggguugaucaucuaacuuucuuaauuuucccuucuacuuuacauuucuuuauauuuuucuuuuacuugcuggaagaaugaacuacaucuuccagccuucucaugcacuacuuuauuucagcuaucauauuauuuccaagcaucguuucuuguuaucgauuuguuccuucucucucucgcuuccuuuguaggcauguuguucuuguuuagugaauccagugucuuaucaucugagaccuauucauguuuucuguuuuguuuuuuaguucuuuccuauugccuguaucaucuauuucuuccgaguucuuuuauucaguucauuccuuuuagcuuuucuguugucuaaugaacacaggccauccaaacgaggcuuagugugcacgggucauguucaacuguaaauucaaugaacagugaucagauggugagcucacuuuuugcuuggggaaaccacaauugcagguuaucagcaggucccuucugugauggcaguaggcucucuagaaaaggaccugcugaaguccagacagaagaguucgaaucuagcugcaggcauucuaagaugaaggcaggugaagaaugcuggcuggcuggcuugcuuaucaguaucccccucuguacgcaguuaggcaguggcucacucagcuaaauagguucccacucuaccaucccaucuauuuuuuuauuauaucugauccacgguucucucuccucuucacucucuuuuucuuuguagguuuuaucuuuuuguuauuuaaacuccuuuaaugucuugugaaguaggguuucaggaaagaagaaaauauacauauaaacccaguccaacauccucucuuauguugagauaacuauaucucucuuugugguaacuaacgucaaaucaaaugagaacaaaauauugcugguaagagaccagcucuuuaagguuugauggucauguucauuucaaaaagaaauguacuugaauauaaccaauggggauaaaagcaaaauuuuaaaagcccauuacuuaaaaugagagcaaauugcaauuuaucaacucaacauccauaauaagagcauucacuuaugccaugcacucugcuaagcacuuuacauaaauuaucuuaauauauuuuaauucacuaccuaucuugaauccuaugagacaggugucauuauucucauuugcagggauucaauuaaucugcccaaggucaaacaguaaauaaauaaguaccagcucuggaauucaaauccggaucugucugacauuuuuuuuuuuuuugagacagaguuucacucugucacccaggcaggagugcaguggcgugaucucggcucacugcaaccuccgccucccagguucaagcaauucugccucagugccucccgaguagcugggacuacaggugcgugccaccacacccagcuaauuuuuuuuuauuuuuaguagagacgggguuucacuguguuagccaggauggucuuuaucuccugacgucgugauccacccaccucagccucccaaagugcugggauuacaggcgugagccaccaccgcgcccagccuuucugaccaacucuaauagagaaccagcccucacaugaaaaggggaaaaacuuguuugguuuuuaagaaccuuggaguucuuaaaaauaugaucacuuccuauagcuaaguacuccugaaagcacauuugccuuagguuucuuaaaaauuuuaucugucauaagguaggccaaaaaaauggcauugaguaauaucuuuuuuugcuuaauguagaggagauucuguuuacuuaucccaaaugauccacagacagcuaacacuaucaccaguaucuuaaugacuuuugaauauaugcauaaguacauaacagguacaugcauaaguauuuguucauguuaagaucccaaugaagacaucacccaacuguuacccagguagacacugcaagaacaaauaaaaccaaaaccaaaacaaaacaaacagugauggggaauaagggggggaaacgaauaaauuaaaaugauagacauguuucucauuaaguuaauauauaugaaagcauuugaacuaagucuguaaaaauggcagauaauaauuaacacuugguagcaagaaacgcuuucugaaauacugaaacacugcuuguuucacuguaacuuaucaccuagugcuguaucugcauagucucacaauucaacuuuauauccaacauggguguucauuucuauuuggauaaaauuuacugaaauauacuagaaagaaaacuggucuuaaaaugcaaaaggcucugccacuaauucacugaucuuaacuuaguuuacuaauuaacuucuuauuauaguuuuccaaauccgcaugcacgcaugcccacaugcauuugacuacguuugccuaugaugucucuaagaucuaaaauuaagauuggaugaaaauuauuuucauuucacaaaagaaaacaaaaucacauauaaaacaaacaauaucccaucugcuaaaacaagaauguaagcauaacaccuuuucaagaaacuauaagaaaguucaauagacaaaaguagauggaacauaaauaccagaaauaucuaagaaccagaagaauuuuuacuaugugcaaaggugauaagagaucagaccaaacuuuaggguaccccgagaacugagaacugaccuagaauuugucuugcaugagaacugcuaauaaaauauaucuguaauauuuccuacucaauaugaacaaguuugagaggaugaaaacugaaugguuuauaccaucuguuuacaucacagaugaacagauucuuaaaaagugcuucuaaaacuguucaauauauuauaaacaucauaaauaccagccccagauaguuauuaaaauaccauuauauuauuaaaucccagauaauuacuuaaguucuaacuucccuuuagucacagauacauaucagcaaaaacauuuuauuuuucuacaacaaugcacuaccuagucucacccuacuacugauuugaaaaauaaugcaauuuugaguuccuuaccaguauuccuuucuuuccuauuuguauacaucaaggccacgugagaaucagaacccaauccucacuaacucuagacagacaaaggcuuaauccucuucauucuuguugugucuaggcuuauaaaccccaaaagucaguuuaaaaaaaaaauucaugcuauugguguuuuagaagcaacucuuuggccauuuuaaucauuagccaccucaugaaaagauggagauuugcacaucauuuacacaauaacagaauuuguaauuaaaggcuauguuuucuaaauaaacauaauuucacagauauagucagaugacuuucaaacaacuaaagaaauguuugaccaggcuaagucgcucaugccuguaaucccagcacuuugggaggcugaggcaggaagaucacuuguggccagaagccugagaccagccugggcaacaaagcaagacccugucucugcuggggagaaaaaaaaaaaaaagguaaaauaaauguuucaguauucacacugaaugaaagaaaucuuccaguuaagaggaacacauagugacuccacuuaacguugccuauuagaugaggcaagaugauauuuuccaaugggcauauagaaaaaaaaauaauugaugcucauuugccauauuuauuuuaaaaauuauuuaaccauaaguuucuuuucucuuuuguucauaaauuuuuucgcugaguuucuuuucuuuuccuuuacaugguaauuauuuuugucauaacaacaauaauaaaauaauuuuucugaacuccagagcuccaugcucugacuacuaugaucaauggucuacaacauggaaugugcucacccaaagggggcacauaaaaugaucuguuggaaugugggaggaaaauacuagaccuucucuuuauuuuucaucucuuuuaaaaaacuaagcccuccuaguaagucauauauaggcugacauggauguauguuggcuacugacuacacuuguuucuguaagaguuacuagaaacagaauaagcagaaagcacugaauuaaauuagugcuuaaccauacuugaaauuaaacauaaaaacaaagauguugucuuauaaagucacuuuaaucugcuucaguuuaucuaaaugugucuuuuucuguacucugaaauaauuagucuuacacuguaauagaaauggaauaugcugaugacaaaggguguggaaguguggaacugggguuacuacuucaauaaaucucuaauuugugcauaauccugaagcucacaaccuauuaauaagucagaguuacuguucacucucauauuaaaaugcaaaacaauacaaggcuaaccuucaaaaaacuguuacuacauucuucccccaaugauaaaaauuuugaagucugaaaauaccacguguugaagaggauauggcacaauggaacacucaaacagcuggugggaauguaagaugguaacaucaagucuaaaagaauuugcuuuugcuugguaaagguaacuuccucagcuguuagacccaguaaugucacuccuagguauauacccuagaaaaacuugggcacauguuaccaggcuacacauacacaaaugcacaaaagagcauugugcauaauagucgcguacuagguuuaucaaaagaacuguaauggaaaaaucuauuaugguacagccaaacaagaaaacauuaaagaaaaaugaacauaaaaauuagcuaucugcaucaauaugaaucaaucuuauaaauauaccauuggaugaaagaagaaaacgcaaaagauuacaaccaguaaugacuccauuuaaaguuaaaacaggcaaacuaaauuauacuguuuagggauacauacauagaugguaaaaucguaaaacacaacaaggaagugauuaccauaaaaaucaggacagcaguuccuccagguguuggaacaggcacguguguaauuggaaaggacacaaggaggcuucuggggugcuggcaauguccuauuucuuaacgaguaauaugugcuucauaauauauuuguuucauaacuuuuauacuguacauuuauauguaaaauaaauccuuucaaauuauuaauuuuugguauuauaaugguauugugguuauguuaaauaagaguccuuaucuuuuagggauacugaaauauuuauggacaaaaugauauaaugucucagauuuggcuucaaaauaauagagcaaaggauaaaguggauggaaugaggugaagauuagacaagaauuaaaguuguugaagcugagagauggguacacagggcucauuauacuacugucuacuucugaauauguuuaaaaauauaaguuuuaaaaagcuuuuauggaaauagcuuaaaaauaaagauacaccaguuucacaaaugggaauuauauucaauacaggucuaauccaaaucccaacaggccuuauggaaaaccugacaaacuaauuuuaaaacugaucuguaauagucaaggacuaagacuggccaaaacacgacaaaaggugaacaaagacaaagggaucugcccucccagauaucaaaacaguauuaaugcaaacucuagaagacauuguguaucaucguguauuggcaccaggaugaacaaauggucaaacagaaucuagagucugacucaugcauguagggaagccugauaauguacacugcauaccaguggggaggggaaagacuucuuuuuuuuuuuuuuuuuuuuugagauggagucucacucuauugcccaggcuggagugcaguggcgcaaucucggcucauugcaagcuccgccucccagguucacgccauucuccugccucagccuccugaguagcugggaccacaggcguccgccaccacgcccagcuauuuuuuuguauuuuuaguagagacaggguuucaccguguuagccaggacagucucgaucuccugaccucgugaucaacccuccucggccucccaaagugcugggauuacaggugugagccaccgugccuguccaggaaagacuucuuaugaagucgcugugggacagaggguuccccacauggaaaauaaauauaauuaaaucccuucuccaaaaauccacagaaucaacuccaggcuucuaaaaggcaaaauuauuccacuuuuauagggaaauuugggugaauuauccuuaugaaugagagguaagaaaaaauucuuaagcacaaaaauauaagccaaaaaagguacuuuguuaaaucacacauaaccaacaaagaauuuguauucagaacguaagagggaagucuaugaauaaauaagaaauuuuaaaaauguacaaaagacaugaacaggcaugucuuucacacaagaggaaaccauaccgagcaacaagcacaugaagaagugcuucgcuuaaccucacuagcaaucggaaaagaacaauaccaugaaaucccaccuuacccaucagacugacaaaaauuaaaaagugaaaaaacaagcauuaaugaagauguugugaaagugaaacuauaccacauuaaugugggagcaguuaucccuuugcaaaauaauuuggcacuaucuugugaaacugaucaugcccacaccccacaauucaguauuuccacuuuuagauauauaugcuacagaaacaaguauacucaaagucauguauauacugagauauguacaagaauuuacagcaguuuguaacagaaaaaaaacuuaaaacuagaaacuacucaaauguccaccaacagaucaucuguauuggguaggagcuuauaucuguuuguuguugugcaucauuacaugauauauauacacacacauauauauaucauuacaugauauauauauacacacauauguauaugauauacacacacacacauauauauuugauuguauauuuugaccuguuauauauauaagcauauaaaauuauauauauauauaaaaaauuuguuuuuugaaacaggguuucacucuguugcccaggcuggagugcagggaugcgauccuggcucacuacagcuucaaccucccagcucaagcaauccuccuaccucagccucccgaguagcugggccuacaggcacacacuaccacacacagcuaauuuuuaaaauuuuuuguagagacaagguccuacuauguuacaccccaggcugaucucgaacuccuaggcucuagcaaugcucccgccucagccucccaaaguguugggauuauaggugcaagucacugcaccuggccuguuuuauaauuuuuguaccaaauauauuacaguuugaaagaagauuuaauuuuucuuuuaaagauuauuacuuuugcugaugucacauuuuaaguaacuaaaaauugcaacaaccacaugguuuacaaagaaauggcuugcuucaucuugagguauguaguaaaaaaaacaaaaaaacaaacaaaaaaaacccuccaaucugaacugaauaaagaucaacuccauucucaaccgaaaaacauuaaagcaaaauuucuucucugacauuuacaaacuuauaaaagcauuauaauuucaaaacauaaauagcuuucuacugccuucuuaucccuuuuccccaucuugaacucacgccgaaugcuauggacacuagcuuaccaacaguuccuaauugguuaagggcacagacaacaguacuggaacaccagaaccugucuguuccacaguuuugaaaagagccuuucuaguuuguuuucaaguacauauagacaaauucaaacuaucuccacaguuauauuaaaggagcugaagagguacaauauacagugaauaccauccacuacauuacaaagugacuaucuacaagaaaauagcaauagucaguccuaaggcaggggagguaguuccaguauacuagucuuuagaauuucuagguuuaguaguacaguuaaaacauuugaaucagucuucuaugauguuuuucuaaaacguaggguuuucauuucucaacugauaaggcuaauauucuucucuuuauuuuuuaacagaaucucgcucugucuccaggcuggagugcaguggcgcaaucuccacucacugcaagcuccgcuucccggguucacaccauucuccugccucagccucccgaguagcugggacuacaggcacccgccaccacacccggcuaauuuuuuguauuuuuaguagagacgggguuucaccacauuagccaggauggucucgaucuucugaccucgugauccgcccgccuuggccucccaaagugcuggggauacaggugugagccaccacgccaggcccugauaaggcuaauuuucuucuuuuauuaaguaaauccauuuaguuuaagcauuuugagaugacuaugguuuuauaaugugaugugugaaauuaaaucaggaacaugcacauuuguguuuucagaagaaggaaaaaaauugacacuuuuacuauacucauaccuaauuuaggguauaaaaugugguuccugaaaauggaaguucuauacaaaucugugccauacgagguuauuauugcauaguagcuauggagauccaucauauuugaccaaucacuuuucuguuuuacauaaauccccucauggagugcccucagcuagaguucccucuagccaccuuucaugggaauuguugguucauccucugaggcugcaguaguaacuuugauguuuucuuuuuuuuuuuugagacagagucucacucuguggcccaguccaggcuggagugcaguggcacgaucucggcucacugcaacccucgccucccagucucaaacaauucuccugccucagccucccgaguagcugggauuacaggcaugcgacaccacgcccagcuauuuuuuguauuuuuaguagagacaggguuucaccauguuggccaggcuggucucgaacuccugaccucagguaaucagcccgccucggccucccaaagugcugggauuacaggcauaagccacugcaccuggccuaacuuugauguuuucuaaaaugucuaaggucuuauagcaauccuuagcugucuaacugauccauccccacuccguuuccucaaccacuucccuugaaguaaccuugaaccaucuaaacacugagcacacugcacuuccucuguuucacuguggcaacuccagcaccaucacuugcacauauccucaugcccccacccugacuauuauagguuaaaacuauacaucagaacaacaacaaauggcagaaagaaaagccacaaagggaauaagcaaccuuauugcagagcauauuccauacucaacuccagacagcugaggaggcuaaaugugcaugaaggagugaaguggcucacugggcuacagugugcaguaugguuugucagugcucucugucugagcauacaguaagucaaaccacuagaaaaaauagguauguucuuccacauacuuuggcuuuuugcucuaaaccauucaaugauuuccuauuucacaaagaauaaaaaccagucuuuucaugaccuggaagaccaaacaugaacuggcccuugguuaccucuuagaccucauucccaccacuggccccaugccucacagccacucugccuucucugauguuccacucacacacccaaccuugcacuuacuacucacucuaagugcuuugccccaaguauuuguguauuuuacucccuuaaacuugugccuauacagcacuuaaucugagaggccuucccugaacacacuauuuaaauucauauccccauuucuccaacgucauccucuuuuuucuugcuuucuuuuuccacggugcacuuaucaccaccugauaccauacauacuuauuuguacaguaaauauguccuccacuaaagugagacaagaugaugguagagaugacaucuguuguauucacuguuaucucaccacuaccuggcucauuguagaaauaccagaguguuauuguuacaaauguacuguaagugcguacauguccaaaauaacacauuccaaggccaggugugguggcucaugccugcaauucccagcacuuuggaaggcugaggcaggaggaucauuugaggucaggaguucgacaucugccuggccaacaaggugaaacuccaucucuacuaaaauauaaaaauuaaccgggugugguggcacaugccuguagucccagcuacucgggaggcugaggcaggagaauugucugaaccuaggaggcggagguugcagugagccaagaucgcaccacugcacuccagcuugggagacacagcgagacuccuucucaaaaaaaaaaaaaaaaaagaguaagagaaaaaaaaaaggccgggcgcgguggcucacagcuauaaucccagcacuuugggaggucgaggaggguggaucacuugaggucaggaguucgagaccagccuggcuaacauggagaaaccccaucucuacugaaacuacaaaaauuagcugggcaugguggagggugccuguaauuccagcuacucaggacgcugaggcaggagaauugcuuaaacccgggaggcagagguugcagugagccaagaucgcaccauugcacuccagccuaggcgacaagagcaaaacuccgucucaaaacaaacaaaaacaaauuaacacauuccagauacaagcagcauuacaaaaaaucagugcuaugugggaaaccauuagaugggaaggcaaauaauaugaauagaaaaguggcuuuuuuuuuuuuuucuguaaaucaggguuccuuguuuuuuaaagcuaccuuagaagcugaccaguauucugaugcucaauaaguuggugaagaauucacuauaguucugucaacagcuaauaaaucuuuuuuuuuuuuuagauagagucuugcccugucgccaggcuggagcacagcggcgcaaucucagcucacugcaaccuccaccuugcggguucaagcaguucuccugccucagccuccggaguagcuaggacuucaggcacauaacaucacaccggcuaauuuuuuuuuuuaguagagacaggguuucaccauguugcucaggcuggucucgaacuccugagcucaggcaaucccccugccuuggccucucaaagugcuaggauuacagguguuagccacugcgcccagcccuaacaaaucuuuuuaaaaaauuaaauugcagggcagcaaccauccaguuaaaaaucuacaaccuuagcuauaucuagcaacagcaacuacagcauuacuaaguuacuaaguuuuggaauaccacggcucaaaacauuggggcucuauuauacccugcauuguacuauauuaaaaugaaggaguaggaggagaaaaaugauuauucuacuauacucagaaaaauacauucuauuuucuucccaauauuggguuguuccuuuuucacacauggaaugugcaaaagcagggggugauagggaacaagugggagagucggcaugcagcacuuuauuucaguaaauauuuuagaaaacuuuagcagaugaucaagcagcuuuaagauaaggcagucuugauauuguuuagaauaccaaggauaugucuuuguauaauguaaagaaacaaaaauuauuagugauucuuuacaucuguuuccugaugccaacaagcaagcuauuccuccauuauggugaccacaaagccccauuaaguuuuauguaauuuuucucaggaaucaaaaagguaagaaaucagauguccauggaauuuuuauggaauacuucacauaaguauguauucauuaaacaauaacaaacaacuaacauauguaaauguuguacugauacgggagugcugggaagggaagaguguggucccuuuaaaugauaugggagugggaacagggaagugcuggguagagaaaggcagguccauggcuagggcuccacccccacggacaaacauaggugaggacaggcacuccugcuuuugggcccaaauguugcauuuuccaagaccacccuggcccgccgugcccccauccugggccuauaaaaacccaagacccuagcaggcagacacauagacagccaaacgucgagaggagcacaucagcggaagaagacacaagcgguuagacggugaaaagacgucgagggaacacgccugcacaagagcacaccaacagacaccagcaugccagcaggccaucaacuggcuggaugaggcggaguuuggccggggcaguuaaaggagagcuggggccaccuagcagcccaacuccaggggaaaaccaucuccauucuggcucccucaucgacagagagcuacuuccacucaauaaaacuuugcacuccuucuccaagcccacgugugauccaauucuucuagcacaccaaagcaagaacccaggauacagaaagccuucugucccugugacaagguagagggucuaacugagcugguuaacacaaggcaaacuaaaaaagcacccuguaacacacgccuucuggcacuucagcuauaaagauucaucccuagacauugucguggggucagaaccccacagcuccccgucuguaugcuccccuagagguuugagcagcagggcacugaagaagcgagccacacccccaucgcauggcuucuagggggacaagggaacuuuucccguuucaguaugagagaaacucaaguugcaaauccucuguguagcagaaaauguauuucugaugucucauaacuccagaggcuuaugcuccugccauuuaaauaccuaaucugugucuuccuauuuuagcuauuggugaguauacauuuaucauauauugaagagaauucacuuuauuauauacccuuuauuauauaucacgucacugcacuccagccugggcaacagaaugagacuccaucucaaaaaaauaaauaaauaaauaaaauaaaauaaauucaaugcaauccaaaaaaaaaaacaaacaaacaaacucuaagauuuacauauguauuaugaaauaucucaaacaagaaaaaaaauaaagaaaaauauaauaagaaaacauguaaccacaauccagcuuuuaaaaaagacaucaccaauagaguuagaaaagaagagcuaagaaaaaauuuccccuaugacacagcaaaacauauuaaguaaguagagcaauuaaaacaauaugguagggcacaguggcucaugccuguaaucccagcacuuugggaggccgaggcaggugaaucacuugagauugggaguuacguguacaauuauauuuuuaaaauuuaguccuuauuuuuccucuuacguuguuacaaauauaaauaaaauaucaauucauuuguucagccagccaacaaucaaucauguauaccuacacucuccaagauauuauauuugauccugaagauaccaaguuaacauggugaagacccauaaauaauucaaaauguugugggagagacuguagaauaguuauuuacuaugcaaaagguuccaugcuauaauagaaaaaugaacuaaagagcugugggaauacagaugaguauuaucucauucaggggaaagcuggggcaauuuuuauguaaguaacauuuuauuuaggcaccuuaaaaaaugaaaaggaggccaggugcaguggcucacgccuguaaucccagcauuuugggaggcagaggcggguggaucaccugaggucaggaguucgagaccagccugaccaacauggugaaacccugucucuacuaaaaguacaaaauuagccaggcgugguggcacaugccuauaaucccagcuacucaagaggcugaggcaggagaaucacuugaacccaggaggcggaaguugcagugagccgagaucacgccauugcacuccagccugggcaauaagagugaaacuccgucuuaauaaaaaacagaauuuggaggcuggagggcaggauuuugguagagguaacaauaugugcauauauuagagggcacaaaaacaaggcauauaccaagaagucagucaagaccacugacaagcuauaugacuuugggcaaaaaacugaaccuguuucaacugaaaaauaaagacaaugauaucuuccucagaggguugcucugaggaaaaugagaugguaagcugagaggaauaugauggcaauauggcugucacaucuuccacccacugacuuccaaggcugauuuaucuguuuuaccucagguuacuaucuccuuuuucucucacuauuccuccagaagcuauuugacagaagaacaccuccucucagucauguacgaugaauggucuaggagaguucuugacauacaguauuuacuuuaaaaacauuauuucuuuuuaaacauauguucggaguuccacugaacuauucucugugguauucucuacaacugcuuugcaauuacugcuaggaucccaauccucaguuugagaaccaguggaaaguuuaauaagcaccccaccugauguguccacauacuucauacuuacaggcugaggcuguucugcaauacagcaguugaaacacaaccagaauucacucaugcuuacaguccacaguaaaugagcaccaaugaagguuccaaaucucaacucgggaaguuccaaaaauacgcuccucaauacgaugauguccagugaugccaagaugaaauuuuauuauuucaccguguuuuuguuccuggaagucaaguaucuuacacagucgauuuaauaaagaaaaauuuggauuguuuccuuucuuugcuucugguucuacagagacuccuuucugaaccacgacgaagguauaaaaauuguugucuugacccagggacuauaacagauagucuagggaaaaaaaagaaaaaguaaaaaaaaguuaaacuuuacuuauccuugaaagcuuuuauuucuuaaaauaaauauuaccaaaaaaaguaaacacugaaaaaaaaucaagauuuuaacaaacugauauugauucaacaaauuauuuuuugagcaacuuuuuaagugucaaguucuagguguaguaguaaaagcagacagaaaucuuugccuucguggggcauccuauuuuaugauuauaaaaguauggauuauuuuaaugaguuaauuuuuaaaaaucacuaauuagaacauuaugacugccacauacaaguuucuaauuccaagaagaaauaaugaucaccauuuucauauagguuucuucaguugaguccuuuauucucacagacaacucagacaguaauugacacagcaaugaauucuaaggagauaaucaagcaggugcaguucaucaaaaaccauaaacaaacuuauuaccuuauccacuggaauuagagcuguacaugaaaaauggguagagguuaaguuggcuuucuucugugaaucgagcuauuagaucccuaccacucccaccacuccuaccaucauuacuagaacgcauguuagucaaaauacucuacaucccacuguggcaaaccaagcugagucuaucagaauccuugucaggcaauguucuaucugcaguuggacaaagaguuaaaccuauuuuuuauuucugacugccaagcuguugacuuuaaggauguccuuagucaauaauauccuauaccucauguggaagaugguuuugagguaauaaugcugacaagcagcggcaaaagagaagugggaagucaagaugacaucaaucucugauucuaggcaucccuaagaucaguuucaccugugcaccagacguuugguuuuguaaggcaacauaucucccucuuuagccugaaguuaugaugaaguggguuuauaucacuugcagacuacuacaauagucaaguuaagauguccaauagacaguuugauauauaaaucugaagccaaggagaaguuuugcaaucaucagauuaugacuaaagcaaugaaugaucucuaggcaaaacgguaucaugacaagcaaagugugcucaacagaguccucugaguaagaacagcauuuaaaucauagguagaaaaagagaagucuacuaaggagguuuggguguuaccagaauuagaagaggaaaauccguuaaauguggugucacuggagccuguuucaaggagaaaguggguggcaguauuaacugccacugagauaggaaagacugaggacuauuccuuagacugugcagcaaacacaguguggcgcuggcaacagcaguuucaguaaaguaguguggguagacaucagauuacaggagguuaagugagugaaaggaaagcagcagagucaacaaguguagacaauguuugcaagaaaaauggauauaaaguuuaaaaaguagagugguagaaugaagaaaaugagccuuccuugaaaugaaaagaucaaagacuaaagauguaucaauuugacuguguucaaagagauguuaacauuuuugucccaaauggcgaaauauaaaucacuuauuuguaaauucuggaaagagaccucacacauuuauaagcuuugccaacuauagaucaguaacaaccacauuacaggaucacagaguccugaacauuaagugaaauuaaauuccucccuuuugcuuuuuccaaagccacgacucuaaaccuggaaagacagaagugacggugauuuuuguagcuguacagauaaagauguaauguaaaguuaaggcacacacccucagugucacaaaucuggguaguauaacaaggcaugaauucaggacccugauucuacaguccagaggacaaguccucuaacauacaggaaaauaacauguuaagauuuaagcauacauccaaggaauaucaaaagaaagaaaaguuuacauuuuugccauuaauuaaaauucagaaccuggaauguuuauuuaagcagagaugaacauuccuuaucuuacccaaacucuaaaucaaggaaguggcagucuuuggccaaugaauuggguaaauacugugaaguuuuauaagcucaaagaauaguaucacuuauuuccuccauccaauccucuuagcaggaauauaagagaaaaggcuuaaauauacagucucaugaacauuauuucagugcugcuauuuaauaaguuuaauuucacccuggaucaaaaaucuugcccauuaagaagccuuugugaaauuaaaaaaaaaauuuuuuuucagauagggucucacuguguugcccaggcuggaaugcaguggcaugaucacagaucacugcagccuugacuuucugagcucaggugauccuccugccuuagccucccaaguagcugggacuacagaugugugcugccacacuuugcuaauuuuuuauuuuguguagagacagggucucacuguuuugcccaggcugagcucaaacugcugagcucacacuucagccucccaaagugcuggcauuauagacaugagccaccgcaccuggccuaaaguacaauaacuucuauugcuacauauuuccauuuagauaauggaucugcuaaaauauauuuucaaaccaagaagauguuugcaauuccauggauuuuuauuuaaguaaauauauggaucuuaaaauguuucagacaugcuuuggaaugugauaucaauacaucuucuaucuucuugcuuuucuaaacaaauuuccuuuuuuuagaacagguuucuaaaguauauauauguaaaacauauuuacauauaaacaccuucaaggaaguauugaauucuucacaagaaacuucaacacugccacuaauaacuauacuaauaguuacuuucacuucuugagcugaaagcugcuuaaaacaugaccauuuuaaaaaccuauacuuuuugaaaucuuuagauaacagaaggagagucauuuuacaauaacaucaacauauaaacuuggcuuuaaauacagcucagcaaauuccacacauaacuaaggggucagacuggucuacagcacaagagaguauuuuaacaaccucauagauucauaagacauaagauuuuagaaagggaagggacuuuuaaagagaacaucauggaacuuggucauuaaauagcuuauccaaggcgacuuagcuagugagcuuccuuaaauuugcuuacaaaugagacugacaugaguagaaaagugcaauaguauucuguacucaaaauauuauccacuaucaguuccccuccuccuuuuugccaccuaaaucaaaugcuacagauaccagccuccuaccugcaugaaguuuugcugcugacaacuuaaugaaguuaaacuccaacauccuacccgcaauuuaauacaaaugcuuuuuaggucaacuuccaaagaaaaauaauaauguuuugaugugaaaaacuagacaguggggcaugucagguaacuagguuuuuuuuuuuaaucuaaaauaucuuaacucaguucagguauuaaguacgcucaguuugugugaaacuuaaaaaauucagaauuuggacuuugaaauaaaagaucugugacaguuauagcacuaauuuuuuagaaauguuaguucaggcaagugacaagcucuaucacucuguucccucccucccucucucccucucuucucucucuucucuuucucucucucuuucuuuuuuuugagacagaguuucagcucuguugcccaggcugcaguggaguggagcaauccuggcucacugcagccuugaccucucggguucaaaugauccucccaccucagccuccgaaguagcugggacuacagguacaugccaccacauuuggcuaacuuuugaacuuuuuauagagacagggucucacuauguugcccaggcuuacccucaguuuucuuaguuauaaaaugaaauacugcauugccauuucacaggucugaaaugaggauuaaguuagcuaauauauaugaaaguacaguauauauuauaaagagcauacagguugaauaucccuuuuccuaaaugcuugggaccagaaguaauguagauuucagauuuucuuguaguuugaaauacuugcuuuauacuuauccuacugaacacccuaaaucugaaaaauuugaaauccaaaaugcuccagugaacauuuccuuggaccaugucaguauucaaaaaauucuggcugggcacaguggcucacaccuguagucccaacauuuggcgcagcugaagcaugaggauugugugaagccaagaguucgagacuagccuaggcaacauagcaagaccucaucucuacaaaacaauuuaauuuaauuuaaauuuuaaauuuuuuuuuacguuuuggacuuuggagcauuucagauuucagauuuuuggauuuggaugcucaccuuguauugauauaagaugcuuuuuuguuacgagaauuaaaauggcaaaauagcauuauucugcuauagcaaaaacagguaauuugcugcaaacuuugaagaaacagccuaaaaucuaucuagaaaaaaaugaagaaaaugaaaaaaggugaauuaugguuuuacacaaaacaaaaugaaugacagcuucaggcaacacagaugauucucacauggcgagauaagaaacaugacacaauauacaugcaaugauuucugugaauuucaaaaacaauuuaaacuauuuuguuuagagaugcauacauacauauaaaauuaaagcaaggaaacuuauaauuaaagucaggagaaugguuaccucuaggccugagggcaaggauuacaaauaggaagaggugcuuaugggcuccuggaaugcugacaguguuccacuucuugaccugggugguagcuacacagguauuugcuuuauaauuauuuguuaaauaauacauguauccacuaugcaauuuuauuuuauuuuauuuuuuuugagacagggucuugcuuugcugcccaggcuagagugcagugucgcaaucucagcucaccgcaaccucugccucccagacucaaaccauccuacccuuaaucuuccaaguagcugggacuacgggugugugccaucauguccaguuaauuuuuaaauuuuuuguagagacaaggucucacuauguugcccaggcuggucucaaacuccugggcucaaguaaucugccugccuccuucucccaaaaugcugggauuagaggcaugagccacaaugccuggccacuaugcaauuuguauguauuuuuaaacgauaauuuuuuuuuuuuuuagacagaguuuugcucugucaccgaggccagagugcaguggcacaaucucagcucacugcaacuucagccucccagguucaaacaauucucaugccucagccuccugaguacaugcugugacuauaggcgcccaccaccacgcccagcuaauuuuuguauuuuuuuuaguagagaugggguuucaccauguuggcuaggcuggucucaaacgccugaccucaagugauccgcuggccucggccucccuaaaugcugggauuacgggcaugagccaccaugcccagccuuaaaugacaaaaauuuaaaugaaaugucaauuuaaaaaguaggccgggcaugauggcucagaccuguaauccuagcacuuugggaggcuaaagugggaggauuacaugaggccaggaguucaagaccagcauggccaaugcagcagaaccccaucccuacuaaaaauacaaaaauuagcugggcaugguggcaugcaccuguaaucccagcuacucagguggcugaggcacaagacuugcuugaccuaaggagguggagauugcagugagcugggaucauaccacugcacuccagcccgggcaacagaacaagaccgugucuccaaaaaaaaaaaaaaauuauuaauaaauacugggccaggcuuguugauucacgccuguaaucccagcauucugggaugcugaggcacaaggauugcuugagaccaggaguucgagaccaaccuagacaacaugacagaauuccguaacuacaaaaacauuuuaaaaauuagcugggugugguggcaagcacuugugguaucagcuacuuggaaggcugaguuuggaggaucacuagagcccaggaagucgaggcugcaguacaccaagacgcgccacugcaguaaagccugggcaccagagugagacccugucucaaaaaaaaacuaacaaugagcaguugauaauaaugaauugaggaagaucagaaguggaaaugcaaaacacagaauuaaguacgagugaacacccuugcuagaaacuuuggaagaacugguaaaauuacuggggaagggggucugaaguuccaucagaugccaaagagguuucugucagaaaugcaaacauuaaucaaugaccaaauauaaauaucaauaaaccuuauucauagcuguagcagcacuaaauccgucucaaacuagcugaaacaguugauacucacgugugguacaacaccguuuugaaaaaaauuaacuuauuuuaagaugaucuuucaaacuauguauuuaucacacagcuacuucucugugguuaaucgaaguccaaaccauuguucccugaacucaguuauaaaagacugagguagggaugcacauauaauuaucaaaauaugaggguuaauuuuuuccuuauauuuaaaaugacugauuacagauuagacuuuccuauaguuucauguaaauauaauuauacagcaugcacucuuuuucacaucuggcuucuuucauucagcauguuuuuaagauuuaccuauguugucucuauuaguaaauuauuuuuuauugcuaaguagauuuccauuauauggauauuauacaaucuguuuacccacccaucuuuugauggauauuaauguuuuuccagcuuuuuggcuauuaaaaauaaagcuguuauauacuaaguaugauuuuaacuuuauuaagaaacuacccaccaguuuucuaaaccaguuuuaccacuuugcauugagaguuccaguuauuccuuauccuaccaacucuuuguacuaucaaucuuuuuaauucuagucauccuaguggguguacaguaguaucuugcugugguuuaaauuugcacuuuucugauaacuggugauauuaagucuuuucaugugcuucuuggccauucauguauuuucuuuggguaaauauguuccaaccuuuugcccauuuuuaaauucagucaucuuacuauguucuucauauauucuaggucaauccuuucuccaauauaugcauagugaauauuuuguccuggucuuugucuaccgaacaacaucuuucgaagaguuaaaguuuuuaacuuugauaaugucuuaugcauaaguuuuaucucuuaugauuugugcuuuuuggguucuaaaaauucuuucacauaucccaaaguugcaaagauaaucuguuucuuuuucuagacuuuuuagcuuuuauuuuuauaccuauaaucuguuuuuaauuaaauuuuaguuuuugacaguauaaaggcuauuuuuuaaaaaaauauggauauccaguuguucuagcucauuugcugaagauauccuuuucuuaucagauuaauuuagcaccuuuauugaaaaucagggcugaggccgggcacgguggcucacgccuguaaucccaacacuuugggaggccaaggcgggcggaucacaaggucaggagaucgagaccauccuggcuaacauggugaaaccccgucucugcuaaaaauacaaaaaauuugcugggcgugguggcaggcaccuguagucccagcuacuccagaggcugaggcaagagaauggcgugaacccgggaggcaaagcuugcagugagccaagaucaugccacugcacuccagccugggcaacagagcgagacuccgucucaggaaaaaaaaaaggaaaaucagggcugagcuuggugguucacgccuauaaucucagcacucugggagaccaaggaggguggauugcuggagcucaggaguucaagaccagccugggcaacugggcagcaaagucccgucucuacaaaaacuacaaaaauuagcugggcaugguugcacacaccuguagucccaguuacuuggaggggcugaggcaggaggaucacuugagccugggagguugaggcugcagugagccaugacuguaacacuguacuccagccugagcgacagagugagacccucucuaaaaauaaaauaaaauaaaauaaaauaauugaguaacauucagucuacuucuaagcugauuauuguauugcacuugucuauuugucaauccaaugccaguaccauuauaauaagacuuagaagcaagguagucauuugucuuccaauuauacucuuuuucaaaauugcuuuuaguuuucuagguccuuugcauuuucauacauauuuuagaaucagcuuguuaauuucuacccaaaaaaaagccuccugugauucugauugggacugcauuuauucuaagaauuauauauuuauacguaagucaaauuauauauacauauauauauacacacacacacacacacacacacacacacaaaauaaauuuuguuguaucacuuuuaacuuuguuuauaccguucauaucagggcguuaaagccuuauguagucaaaugucaauuuucauaacagauuagugguuuuaucuuacuuaagaaacauuucuuuaucucaggauuaugaaucaaucaucccauuauaguucuguuaaguuuuacuucuguaauucaauuuugacauuaauauuuuguagggugugauuagguaauauuucacaguuuacucaggcuuuuucuuuuuuuuuguauuuuuauaaauuuaauaauauaugaaaaucauuaugaauuauaccacagaaacugccaaggaauuuaauuguauacaugagcgaguaggaaggcuauuuuaaucuuuuuuuaaaaaugucuaaauuauacguuucuuguugaaauguuuaaaauuaccaaauuauugcucauuugcuacauagaaggaaauguaucuuaggucaaguugauuuaccacaaggcccuuguacacauuaaacaaauauauuugauuuuuuuaaauauaucuacuuuaaacucaauuacucuguaaucuaugauguugacauuaaucaggauauucuacaaauaauuuauguucuccuuauucuugauuaguucuaaaucaaguuuuuuguuuucacaaauucuauuuauuauacaaguuucauuaaacauuuagaaaaaagcaaaaagauuaagaaaaucacccauuaacccuaccuuccuagaauaauaguauauuaaauuuuuuauuuguccuuuugugcacauaccuuaaaaauaacugcauaugcauuugaauuauuccuaauuuuaucuccugcucuauuuaacacuauguacauuuuucccuuagucuucauauucauuauuuuaauaccugcauaaaauuuccaucaugugacuucauuacaauggguuguucccaauggauuuugccuacuuuggaucaugcucaaaacacauacucauauacaguugacccuugaacgacauggcaguuaggggcaccaauucccugcacagucgaaaaccaauauauaacuguugauucucgaaaaguuuaaguacuaacagcaugcuguugacuagaaauuuuuauuauuauuauacuuuaaguacuaguguacaugagcacaacgugcagguuucuuacauauguauacaugugccauguuggugugcugcacucguuaacucaucauuuacauuagguauaucuccuaaugcuaucccuucucccuccccccaccccacaacaggccccagugugugauguuccccuguguccaaguguucucauuguucaauucccaccuaugagugagaacaugcggugucugguuuucuguccuugcgauaguuuguucagaaugaugguuuccagcuucauccaugucgcuacaaaggauaugaacucauccuuuuuuauggcugcaaaguuagauuagaucccauuugucaauuuuggcuuuuguugccauugcuuuugguguuuuagucaugaaguccuugcccaugccuauguccugaaugguauuaccuagguuuucuucuaggguuuuuaugguuuuaggucuaacauuuaagucuuuaauccaucuugaauuaauuuuuguauaggguguagggaagggauccaguuucagcuuucuacauguggcuagccaguuuucccagcaccauuuauuaaacagggaauccuuuccccauuucuuguuuuugucagguuucucaaagaucagauggguguagaugugugguauuauuuccgggggcucuucuauuccauuggucuauaucuuuguuuugguaccaguaccaugcuguuuugguuacuguagccuuguaguauaguuugaagucagauagugugaugccuccaccuuuguucuuuuggcuuaggauugacuaggcaaugcaggcucuuuuucgguuccauaugaacuuuaaaguaguuuuuuccaauucugugaagaaagucauugguagauugauggggauggcauugaaucuauacauuaccuugggcaguacggccauuuucaugauauugauuccuccuauccaugagcauggaauguucuuccauuuguuuguauccccuuuuauuucauugagcaaugguuuguaguucuccuugaagagguccuucacauuccuuguaaguuggauuccuagguauuuuauucucuuuguaccaagugugaaugggaguucacucaugauuuggcucucugucuguuauugauguauaagaaugcuugugauuuuugcacauugauuuuguaucgugagacauugcugaaguugcuuaucagcuuaaggagauuuugggcugagaugaugggguuuucuagauauacaaucaugucaucugcaaacagggacaauuugacuuccucuuuuccuaauugaaugcccuuuauucccuucuccugccugauugcccuugccagaacuuccaacacuauguugaauaggaguguugagagaggacaucccugucuugugccaguuuucaaagggaaugcuuccaguuuuugcccauucaguaugauacuggcugugggugugucauagauaacucuuauuauuuugagauacgucccaucaauaccuaguuuguuaaguuuuuagcaugaagcguuguugaauuuugucaaaggccuuuucugcaucuauugagauaaucauguuuuugucuuugguucuguuuauaugauggauuacguuuauugauuugcauauguugaaccagccuugcaucccagggauaaagcccacuugaucgugguacauaagcuuuuugaggugcugcuggauuugguuugccaguauuuuauugaggauuuuugcauugauguucaucagggauauuggucuaaaauucucuuuuuuuguugugucucugccaggcuuuaguaucaggaugauguugaccucauaaaaugaauuggggaagauucccucuuuuucuauugauuggaguaguuucagaaggaaugguaccagcuccucuuuguaccucugguagaauucggcugugaaucuaugugguccuggacuuuuuuugguugguaggcuauugauuauugccucaauuucagagccuguuauuggucuauucagggauucaacuucuuccugguuuagucuugggagaguguaugugucgaguaauuuauccauuucuucuagauuuucuaguuuauuugcauagagguguuuauaguauuuucugaugguagucuguauuucugugggauggguggugagauccccuuuaucauuuuuuauugcaucuauuugauucuucucucuuuucuucuuuauuagucuugcuagcggucuaucaauuuuguugaucuuuucaaaaacaccaacuccuggauucauugauuuuuugaaggcuuuuuugugucucuaucuccuucaguucagcucugaucuuaguuauuucuugccuucuucuagcuuuugaauguguuugcucuugcuucucuaguucuuuuaauugugauguuagggugucaauuuuagaucuuuccugcuuucucuugugggcauuuagugcuauaaauuucccucuacacacugcuuuaaaugugucccggagauuuguugugucuuuguucucgcugguuucaaagaacaucuuuauuucugccuucauuucauuauuuacccacuagucauucaggagcagguuguucaguuuccauguaguugagugauuuugagugaguuucuuaauccugaguucuaguuugauugcacuguggucugagagacaguuuguuauaauuucuguucuuuuacauuugcugaggagugcuuuacuuccaacuauguggucaguuuuggaguaagugugauguggugcugagaagaauguauauucuguugauuugggguggagaguucuguagaugucuauuagguuggcuuggugcagagcugaguucaauuccuggauauccuugucaacuuucugucucauugaucugucuaaugcugacagucggguguuaaagucugccauuauuauugugugggaaucuaagucucuuuguaggucucuaaggacuugcuuuaugaaucuggguacuccuguauuagaugcacauauauuuaggacaguuagcucuuuuuguugaauugaucccuuuaccauuacgcaaugaccuucuuugucucuuuugaucuuuguugguuuaaagucuguuuuaucagagacuaggauugcaaccccuccuuuuuuuuguuuuccauuugcuugguagaucuuccuccaucccuuuauuuugagccuaugugugucucugcacuugagaugggucuccugaauacagcacacugacgggucuugacucuuuauccaauuugccagucugugucuuuuaauuggaacauuuagcccauuuacauuuaagguaaacauuuuuaugugugaauucgauccugucauuaugauguuagcugguuauuuugcucguuaguugaugcaguuucuuccuagcauugauagucuuuauaauuuggcauguuuuugcaguggcuggugguaccaguugcuccuuuccauguugagugcuuccuucaggagcucuuguaagggaggccugguggugacaaaaucucucagcauuugcuugucuguaaaggauuuuauuucuccuucacuuaugaagcuuaguuuggcuggauaugaaauucuggguugaaaauucuuuucuuuaagaauguugaauauuggcccccacucucuucuggcuuauagaguuucugccaagagaucugcuguuagucugaugggcuucccuuuguggguaacccgaccuuucucucuggcugcccuuaacauuuuuuccuucauuucaaccuuggugaaucugacaauuaugugucuuggagaugcucuucuugaggaguaucuuuguggcauucucuguauuuccugaauuugaauguuggccugccuugcuagguuggggaaguucuccugaauaauacccugcagaguguuuuccagcuugguuccauucuccccgucacuuucagguacaccaaucagauguagauuuggucuuuucacauagacccauauuucuuggaggcuuuguucauuucuuuuuacccuuuuuucucuaaacuucucacuucauuucauucauuugaucuucaaucacugauacccuuucuucuacuugauaaaaucagcuacugaagcuugugcaugagucacguaguucuugugccaugguuuucagcuccaucaggucauguaaggacuucucuacacuguuuuucuaguuagccauucgucucaucuuuuuucaagguuuuuagcuucuuugcgauagguucgaacauucuccuuuagcucggagaaguuuauuauuaccgaucaucugaagccuucuucucucaacuugccaaagucauucucuguccagcuuuguuccguugcuggcaaggaguugcauuccuuuggaagagaagaggugcucugauuuuuagaauuuucagauuuucugcucuaguuucuccccauauuugugguuuuaucuaccuuuggucuuugauauggugacguacagaugggguuuugguguggauguccuuucuguuuguuaguuuuccuucuaacagucaggacccucagcugcaggucuguuggaguuugcuggagguccacuccagaucguuugccugguuaucaccagcagaggcugcagaacagcaaauauugcauaauggcaaauguugcugucugauccuucuucuggaagcuuugucucagaggggcaccuggcuguaugaggugucagucagccccuacugggaugugucucccaguuaggcuacucgggggucagggacccacuugaggaggcauucuguccauucucagaucugaaacuccgugcugggagaaccacuacucucuucagagcugucagacagggacguuuaagugugcagaaguuucugcugccuuuuguucagcuaugcccugcccccauagguggagucuacagaggcaggcaggccuccuugagcuguggugggcuccacccaguucgagcuuccuggccgcucuuuuuaccuacucaagccucaacaaugguggaugccacucccccagccuugcugccaccuugcaguucgaucucagacugcuguucuagcagugagcgaggcuccgugggcaugggacccucuuagucaggcgcaggauauaaucuccuggugugccuuuugcuaaggcuguuggaaagcgcaguauuagggugggagugucccaauuuuccagguaccaucugucacggcuucccuuugcuaggaaagggaauuccccgauccccugcgcuucccaggugaggcgaugccccgcccugcuccgugggcugcacccacugucugacaagccccagugagaugaacccgguaccucaguuggaaaugcagaaaucacccuucuucugcgucgcucaugcugggagcugcagacuggagcuguuccuacucagccaucuugacaucaaccuacucaggcuuuuucuaacaucuuccuuuucccacuuaaaucugaaguauuuaacauaaaaaauguauccauuauuaugguaggggacauaagagagaauauuauauuggcucaaacaugaaagagugugcaauauaaagaggaaaguaaaauauguugaaaacuacucuuccauucuuuaauauccacauuucuucucccacuuguguaagaguaacugccauguucaucuuucccucucuuuaauaaucuuccucuuucuccucccacucuucuucuuuauuucucucucugccucuuccaucucucucucucuuuuuuuuuuuuuugagacagaguuuagcucuuguugcccaggcuggaaugcaauggugcgaucucagcucaccacaaccuccgccuccuggguuccagcaauucuccugccucagccuuccugaguagcuaggauuauaggcaugcaccaccacaccuggcuaauuuuguauuuuuaguagagaugggguuucuccauguuggucaggcuggucuugaacuccugaccucaggagauccgccugcccuggccucccacggugcuggaauuacaggcaugagccaccgugccugggccuuuuccaucucuuuauccauauucccuaaacucuuccuuagcucccuagaguuagaaauaaugaugcugugacacaaacacagcagguuuucaguguauuauagaugauggacugaaauguguauuuucauucugacuucucucuugagucuacuagacauuuauauccaccugcuaauaagcaucucuugcagucuccuggcaccucaaaccaauauaggcaaacuuguauauacugucuuuuuccucccaucuauuucuauguuacucuucucggugggugggaccauuauacacuguuuaucaagcaaugcauacuaaaauucuguccuacuacguacaguuuucugaauaaaaccauccuguaaaaugccuucuuacauuuaagcaaaucuuuacuguuauucaaaauaauaugagcacauagacuuuuuaaaaaucagugaauauacacauuggaaagcugaaguggguggaucaccugaggucaggaguuuaagaccagccuggccaacacaaugaaaccccguuccuacuaaaaauacaaacauucgccagguguggcggcacaugccuguagucccagcuacuugggaagcugaggcacaagaaucacuugaacccaguaggcggagguugcagugagccaagauugugccacugcacuccaaccugaguaauagagcgagaaucuaucucaaaaaaaaaauaaaaaagaaucaaugaauaauaaaagacuauuaaccaggugcaguggcucacaccugcaaucccagcacuuugggaggcugaggcgggcaaaucacaaggucaggaguucaagaccagccuggccaauauggugaaaucccaucucuacuaaaaauacaaaaaguuagcugggcauaguggcgggcgccuguaucccagcuacucgggaggcagaggcaggagaaucacuugaaccugagaggcggagguugcagugggcugagaucggcgccacugcacuccagcccagugacaaagugagacccuaucuuaaaaaaaaaaaaaaaaaaagacuauuaaaaauggcaaaucucugaccugugccucuccaucucuuagugggaacuguuuuuaacuuaccaagcugcuucuucugguauuuaccuuuuuuuuuuuuuuuugagaaggagucuuacucugucaccaggcuggagugcaguggcacaaucucaacucacugcaaccuccacccccccaguucaagugauuauccugccucagccucccgaguagcugggauuacaggcaugcaccacgacacccagcuaauuuuuguauuuuugguagagaugggguaucaccauguuggccaggauggucucgaucuccugaccuccugaucugcccaccucagccucccaaagggcugggauuacaggcaugagccaccgugcccagcgugguauuaacuuuuauaauuguaaguaagaugcccauugcuacuucucaaauuaucaauuuuuagacuacuugguauaauuagcuaucuuuuuuuuuuuuuauugagacaagagucuugcucuguugcccaggcuggaguucaguggaacaaucucagcucacugcaaccuccaccuccuggguucaaacgauucuccuaccucagccguccuaucuuuucuuaaauaaucuuuuguuuucucugaauaacugcuaagcuuuuuuaauugcuuaguuuuuuuauguaccuauaucagaucuguaaaacaccuguaauuuccaaauaccugaacauauuaauagauguacugauucaaauauucuuuugguuucuuccuagccucuugcuucaauccuaacugcucuaaguugguauguucuguuucugugaaucaugucuuccucuucucauccuucucacuuauguuguaaaaucauacacauacuccccuggcuuccuaagaagugggacacagaaugaaaauguuuuaauuccuuacauuugauauuugauugaucguuuaguugaauauagaauaccaagacaaaaaucuuucccucaggauuuuaaagacacuauuucaguaucugcuaacuuccaggguugugagaagucugaugacauuccaauuuuccuuccuuugugugugauguauuucccuucuagaagaguuaaacauuuuuuuccuuaacucuuggaauucucaaaugccacagagauguuacuugguuugguccuuuuucaucauuguacuggggucugaaugaccucuuucaaacuggaaaauguuguccaggaaaauaauaguaccuauaccaugggacuauugugaaaauuaaacaaaacacuuaguauacaguaaguacacaaugaugcugaugauuaauauuuuuccaaauuugccaauugauuugauuauugcuucuugccucucaauccuuccuuugaaguucaacuuccuucuucagaaaguacauacucaggccacgcauggugguucgugccuguaauaccagcacuuugggaggcuacggcaggcagaucacuugagaucaggaguucgagaccagccuggccaacauggucaaacccgacucuacuaaaaagacaaaaauuaaccagacauggugguacaugccuguaauuccagcuauuugggaggcugaggcacaagaaucgcuugcaccuggaggcugcaauggacuaagaucaugccacugcacuccagccuggaugacagagugacacucugucuuggaaaaaaaaaaaaagauacucaaacaauuuuucaguaauaugugcucuuuaaugguuaacugagaaggugguaagcuucucaguuguuugucuaagacugcaguuuuuaauuguaauuuuggaauaauuucaaacuuacagccgaguuacuaauacagaacagaaaucucccauguauccuucacccagauacgcuguuaaaagaauaucuauacaguaguucccucuuaaccaugaaagauaaugcuccaaggcccucaguguaugccugaaaccauaaauauuaccaaacucuacauaaauuauguuucugccuacacauuaaccgacggguagcauauagaguagauacacugcacaaagggaugauacauguuccagaugagacacagcaugacgguucaaaauuucaucaugcuacucaaaauggcugcaauuuaagaguuaugaauuauuucuaaaaauuuccauuuaauauuuuuggaccacaguuggccaaaaacugaaaccaaagaaagcaaaaccacgaauaaaaugggacuacuguauuuuuuccuuuauucuugcacgacaguuuagcgaaguauagaauucuugguugacagugcuuuuccuucaguucuuugcagaagaccucuauuguugcugaugaaaaguagacuaucaaucuaauucuuggucauuugaauacaaaauucuuuuuuugugauagguguuuugaagauugucuucguacuuggcucugauuucacagaaucucuaguuucagauucauuuuuauauauuuaggacuuuuaccuguuucuauucugcuauuuaacccaccuauuaauuuucuccaugacucuuuuaguucaaugaucauaauuuucucucucuuuuuuuuuuuuuugagauggggucuugcucugucauucaggcuagagugcagugguacaaucuuggcucacugcaaccuccaccuccuggguucaagcaauucuccugccucagccucacaaguagcugggacuacaacaggcgcccaccaccacgcccaguuaauuuuuguauuuuuaguagagaugggguuccacuauguuggccaggcuggucucaaacuccugaccugagaugaucugcccgccuuagccucccaaaguccugggauuacagguaugagcaaccgcgcuuggccaaaugauaauuuucauuuuaauaaguucuauuuggcucuuuuacaaauugaccuacuauagugucuuagucguuuauuuagacauuuuaaauagauauguuuuucugauuauucuguuaagucaauucauaaucuucuaauuacccuuuuugucugacucucucucauguuggacuguuuccuuaucauuaucuuaccauagaaacuguuuuuccugugcaaguccaggucucucuguuugaaaaagcauucuuuuuuuuuuuuuuuuuuuuuuuuuucagacagagucucacucugucaccacgcuggagugcaguggugcgaucucagcucacugcaaccuccaccuccuggguucaggcaauucuccugccucagucugccgaguagcugagaccacagacgugcaccacuacgcccagcuaauuuauuucuauuuuuaguagagacgggguuucaccauguuggccaguauggucucgaucuucugaccucaugauccacccgccucggucucccaaagugcuggguuuacaggugugagccaccacgcccggccugaacaagcauucuuaaagagcaguucacauuugcuacugcuucgaaauucacaaggucaggcucacaaguugcaguguacauuuuaauuuaauuccuuggcuugagauuccuguaccacauggauauuauauguucauacugcacacugguauguagguacauauuuggaucggcaguaugguguacugguuuagaacguaagacucugaaacuacacagccuaaguuugaauucuggaucccuccgcucaguaucucuaggaucuugggcaaguuacuuaaucuuuguauguucuaguuugcugcucuacaaaauggagcuuaugguaguauuuucucaaagauuuaugugaggauuaaaugaguaaacauauauugcuuagaaaaugaagucucaacaacucuacaacuucauuugccaacaggauggggcucuaccucauuucuaucacaguugcagagauucuuuaaugaauaccuaucaugguaguagacaggcauucugcucaaaacucugaacugccuacgaaacacuagccgccuagauucccaucuaucaggccauuauauuucuagugaggcuauauaaacaaaacaauacaaaacuagaguugggaccgccauguagacuugaggaacugauggcauucaucauggcuaucacuccagcuaucacugaugacaugcuacgaaggguuugggaugaaucagaccacaggacugccaugugcugguguuaacaagaggugccuacuggccaguacaaaaauaacugugguugucuuuuacaaacugguggugauuacuuguucauauauaacacaguuacuaaauaauaacuuuuuaaaaaauguucaugaaggggguggagccaagauggccaaauaggaacagcuccagucugcaacucccagcgugagcgacgcagaagaugggugauuucugcauuuccaacugagauaccggguucaucucacuggggagugccggacagugggugcagcgcacugugcgugagcggaagcagggcgaggcaucgccucaccccggaagugcaaggggucagggaauucccuuuccuagucaaagaaaagggugacagacagcaccuggaaaaucggguaacucccacccuaaugcugugcuuuuccaacgggcuucacaaacggcacaccaggagauuauaucccacacauggcucagaggguccuacccucacggagccucgcucauugcuagcacagcagucugagaucaaacugcaaaguagcagcgaggcugggggaggggugcccgccauugcucaggcuugaguagguaaacaaagcagccuggaagcucgaacuggguggagcccaccacagcucaagaaggccugccugccucuguagacuccaccucugggggcagggcacagacaaacaaaagacagcaauaaccucugcagacuuaaaugucucugucugacagcuuugaagagaguagugguuuucccagcaugcagcuucaaaucugagaacgggcagacugccuccucaaguaggucccugacccacgagcagccuaacugggaggcaccccccaguaggggcagacuugacaccucauguggccggguacuccucugagacaaaacuuccagacgaacgaucaggcagcagcauuugcgguucaauaauauccgcuguucugcagccaccgcuggugauacccaggcaaacagggucuggaguggaccuccaguaaacuccaaaagaccugcaguugaggguccugacuguuagaaggaaaacuaacaaacagaaaggacauccacaccaaaaacccaucuguacgucaccaucaucaaagaccaaaaguagauaaaaccacaaagaugcggaaaaaacagagcagaaaaaccggaaacgcuaaaaaucagaccgccucuccuccuccaaaggaacgcagcuccucaccagcaacggaacaaagcuggacagagaaugacugacgagcugacagaggaaggcuucagaagaucaaacuacucugugcuaacggaggaaguucgaacgaauggcaaggaaguuaaaaacuuugaaaaaaauuagaugaauggauaacuacaauaaucaacucagagaagucguuaaaggaccugauggagcugaaaaccacagcacaaggacuaugugacgaaugcacaagccucaguaaccgaugcgaucaacuggaagaaaggguaucagugauggaagaugaaaugaaugaaaugaagcuugaggagaaguuuagagaaaaaagaauaaaaagaaacgaacaaagccuccaagaaauaugggacuaugugaaaagaccaaauauacgucucaaugguguaccugaaagugacggggagaauggaaccaaguuggaaaacacuaugcaggauauuauccaggagaacuuccccaaucuagcaaggcaagccaacauucaaauucaggaaauacagagaacaccacaaagauacuccucgagaagagcaacuccaagacacguaauugucagauucaucaaaguugaaaugaaggaaaaaauguuaagggcagccagagagaaagguuggguuacccgcaaagggaagcccaucagacuaacagcagaucucucggcagaaacucuauaagccagaagagagugggggacaauauucaacauucuuaaagaauuaagaauuuucaacucagcauuucauauccagccaaacuaagcuucauaagugaaggagaaauaaaauccuuuacagacaagcaaaugcugagagauuuugucaccaccaggccugcccuaaaagagcuccugaaggaagcacuaaacauggaaaggaacaacugguaccagccacugcaaaaacaugccaaauuguaaagaucaucaaggcuaggaagaaacugcaucaacuaacgagcaaaauaaccagcuaacaucauaacgacaggaucaaacucacacguaacaauacuaaccuuaaauguaaaugggcuaaaugcuccaauuaaaaggcacagacuggcaaauuggauaaagagucaagacccgucagugugcuguauucaggagacccaucucaugugcagagaaacacacaggcucaaaauaaagggauggaggaagaucuaccaagcaaauggaaaacaaaaaaaggcagggguugcaaucuuagucucugauaaaacagacuuuaaaccagcaaagaucaaaagagacaaagaaggucauuacauaaugguaaagggaucaauucaacaagaagagcuaacuauccuaaauacaugugcauccaauacaggagcacccagauucauaaagcaaguccuuaagugaccuacaaagagacuuagauucccacacgauaauaacgggagacuuuaacauccuacugucaacauuagacagaucaaugagacagaaaguuaacaaggauauccaggaauugaacucagcucugcaccaagccgaccuaauagacaucuacagaacucuccaccccaaaucaacagaauauacauucuucucagcaccacaccacaccuauuccaaaauugaccacauacuuggaaguaaagcacuccucagcaaauggaaaagaacagaaaucauaacaaacugucucucagaccacagugcaaucaaacuagaacucaggauuaagaaacucacucaaaaucacucaacuacauggaaacugaacaaccuguuccugaauaacuacuggguacauaaugaaaugaaggcagaaauaaagguguucuuugaaaccaacaagaacaaagacacaacauaccagaaucucugggacacauucaaagcaguguguagagggaaauuuauagcacuaaaugcccacaagagaaagcaggaaagaucuaaaauugacacccuaacaucacaauuaaaagaacuagagaagcaagagcaaacacauucaaaagcuagaagaaggcaagaaauaacuaagaucagagcagaacugaaggaaacaaagacacaaaaaagccuucaaaaaaucaaugaauccaggaguugguguuuuugaaaagaucaacaaaauugauagaccgcuagcaagacuaauaaagaagaaaagagagaagaaucaaauagacccaauaaaaaaugauaaaggggauaucaccacccaucccacagaaauacaaacuaccaucagagaauacuauaaacaccucuacgcaaauaaacuagaaaaucuagaagaaauggauaaauuccuugacacauacacucucccaagacuaaaccaggaagaaguugaaucucugaauagaacaauaacaggaucugaaauugaggcaacaauuaauagccuaccaaccaaaaaaaguccaggaccacauagauucacagccaaauucuaccagagguacaaggaggaacuguuaccauuccuucugaaacuauuccaaucaauagaaaaagagggaauccucccuaacucauuuuagggaggccagcaucauccugauaccaaagccgggcagagacacaaccaaaaaagagaauuuuagaccaauauccuugaugaacauugaugcaaaaauucucaauaaaauacuggcaaaccaaauccagcaacacaucaaaaagcuuaucaaccaugaucaagugggcuuccucccugggaugcaaggcugguucaacauaugcaaaucaauaaacguaauccagcauacaaaaagaaccaaagacaaaaaccacaugauuaucucaacagaugcagaaaagaccuuugacaaaauucaacaacccuucaugcuaaaaacucucaauaaauuagguguugaugggacauaucucaaaauaauaagagcuaucuaugacaaacccacagccaauaucauacugaauggauaaaaacuggaagcauucccuuugaaaacuggcacaagacagggaugcccucucucaacacuccuauucaacauaguguuggaaguucuggcaagggcaaucaggcaggagaagggaauaaaggguauucaaucaggaaaagaggaagucaaauugucccuguuugcagaugacaugauuguauaucuagaaaaccccaucaucucagcccaaaaucuccuuaagcugauaagcaacuucagcaaagucucacgauacaaaaucaaugugcaaaaaucacaagcauucuuauacaucaauaacagacagagagccaaaucaugagugaacacccauucacaauugcuucaaagagaauaaaauaccuaggaauccaacuuacaagggaugugaaggaccucuucaaggagaacuacaaaccauugcucaaugaaauaaaagaggauacaaacaaauggaagaacauuccaugcucauggguaggaaaaaucaguaucaugaaaauggccauacugcccaagguaauauauagauucaaugccauccccaucaaucuaccaaugccuuucuucacagaauuggaaaaaacuacuuucaaguucauauggaaccaaaagagagccugcaucgccaagucaauccuaagccaaaagaacaaagcuggaggcaucaugcuaccugacuucaaacuauacuacaaggcuacaguaaccaaacagcaugguacugguaccaaaacagagauauagaccaauggaacagagcagagcccucagaaauaaugccgcacaucuacaacucucugaucuuugacaaaccugacaaaaagaagaaauggggaaaggauucccuauuuaauaaauggugcuggcaaaacuggcuacccauacguagaaagcugaaacugaaucccuuccuuacaccuuauacaaaaauuaauucaagauggauuaaagacuuacagguuagaccuaaaaccauaaaaacccuagaagaaaaccuaggcaauaccauucagguauaggcacgggcaaggacuucaugucuaaaacaccaaaagcaauggcaacaaaagccaaaauugauaaaugggaucuaauuaaacuaaagagcuucugcacagcaaaagaaaccaccaucagagugaacaggcaaccuacagaaugggagaaaauuuuugcaaccuacucaucugacacagggcuaauauccagaaucuacaaugaagucaaacaaauuuacaagaaaaaaacaaacaaccccaucaaaaagugggcaaaggauaugaacagacacuuuucaaaagaagacauuuaugcagccaaaaaacacaugaaaaaaugcucaucaucacuggccaucagaaaaaugcaaaucaaaaccacaaugacauaccaucucacaccaguuagaauggugaucauuaaaaagucaggaaacaacaggugcuggagaggauguggagaaauaggaacacuuuuacacuguuggugggacuguaaacuaguucaaccauuguggaaguugguguggcaauuccucagggaucuagaacuagaaauaccauuugauccagccaucccauuacuggguauauacccaaaggauuauaaaucaugcugcuauaaaggcacaugcacauguauguuuauuguggcacuauucacaauagcaaagacuuggaaccaagccaaauguccaacaaugauagacuggauuaagaaaauguggcacauauacaccguggaauacuaugcagccauaaaacaggaggaguucauguccuuuguagggacauggaugaagcuggaaaccaucauucucagcaaacuaucgcaaggacaaaaaaccaaacaccgcauguucucacucauaggugggaauugaacaaugagaacacauggacacaggaaggggaacaucacacaccggggacuguuguggaguggggggaguggggagggauagcauuaggagauauaccuaaugcuaaauuauaaguuaaugggugcagcacaccaacacagcacauguauacauauguaacaaacuugcacguugugcacauguacccuaaaacuuaaaguauaacaauaaaaaauaaauaaauaaauguucaagguuuuuguauaacccuguacagucagaaucgugaacaauauuggagaaaaauguuuuuaaaugugguauuugaaaugaucuuuauuuucauacucaaaaaagagccuguaauaauagaaagcuuugauaaugauguuaugauguggaagauuucauaaacagaaaauacuaaccaguugucaaagaacaugaacuauuucuccuuucugguccauaaaccuacacaaaucacagugggucaaauaagagauucaguauucuuggauucucuguucuuuuuguauguucuacauuuuaaaaaaucacagauagaaaauuucccuagauuauaaagaaaaguccaacuagauuauaaagccaugauguggaaaaaaaauugaauguuaaucauauauuucacuauauacuuugacaaauauaaucucauuuaauuuuuguaauccuaagcgguauuauccuuacuuuggaaaugaugaacccacagcucagacacaguaauuuaagacagagcauuuucucucuauucuuuuuuaagaauauagggaaauguuaguuuaaucuauuucaauguuauuuuaaauuauaauuauguugauucuuauaagcauuauugagguagaaugugaauuaacauucucuguugcauuugacuugguaacuugucucaguauuuacaaauaaauacuuaauacauuaauuccaacauaaaaaauauauaguacguagaauuuccgugaauuugacauuggcaaaaccuguguucaaaauagauuucacaacugauuagauaagugacauucaauagccucucugaaucaaaguuuucauuuaugagaauuauaccaacuuuccaggauugcucuaaagcaggauuucucaaccucagugcuacugacauuuucauuuagauaauuuuauuuuuuuugagagagggucucgcucuguuacccaggcugcagggcaauggugcaaucacggcucccugcagccucgaccuccugggcucaaacaauucucucgccucagccucuagaguagcuaugacuacaggcaugcaccaccaagccaagcuacuuaaauuuuuuuuuuuuuuuuuuuuguaaaggcagggucuauauguuucccaggcuagucucgaacuccuggacucaagugcuccucuugcuuuggcuucccaaagugcugggauuacuggaauuacaggaaugagccacugcacccagcccagauaguacuuucuugcaggcacuguccugugcauugugggauauuuagcagcauccuuggccucuauccacuagacacgaacaguaccccuuuccaccuguugugacaaccaaaaaugucuccagacacugccaaaugccccuggagagugauucccccaguugggaaccacugucauggggaaaaauauuauuauaaaagugaacugaaaaagaaguacaugauaucccucuacuacagggaauccccuucagaugggagggauaaggaaaagauucccuaagaagccaagaacuaaugacauucuccuaaaagcaacaaucaggaacagaaaaaaaaacucuaauaaccuugugugguauuaguuauucuugguuauuccuccaaauuccucuacauuaaauucaggugaccuuaguaagacuuguuugacuacagaacaaggcuuggaucuuagaacgucauaaaaagcuuuauagcuucugcucagauuccaacuacccuaaaaccgucaugcuggaaagaccauggcgcagacauaggcccaacugagcuuagccuuccagccuuccuagccaaaucaccggacguguaaauaaagcugcuuagaauccuccaguccugcccaccuauuagcugaauaccauuagcugaugaugcuacauuuaagagaagaauugccaagacuugcccaaauuccugaccuucaugauugagagauauaauagaauaauuguugguuaagccacugaauuuugagguaguuuguuauacagugauagauaacuggagcgcuucuucuuuuuuuuuuuuuuuuuuuuuuuuuuuuuuuuuuuuuuuuuuugagauggaguuucacucuuguugcccaggcuggagggcaauggcacaaucucagcucacuacaaccucugccucccgaguucaagcaauucuccugccucagccucccaaguagcugggauuacaggggcccaccaccaugcccaguuaauuuuuguauuuuuaguagagaugggguuucaccaugugggccagguuggucuugaacuccugaccucaggggauccgcccaccuaggccucccacagugcuaggauuacaggugugagcuaccgcgcccagccuggaacucuuaauucuuaugauuauuuucauauagcuuguguauauuuuguaugccuauacucuucaauuaaagauuuuuaugugcuucgaggaaaucuuguuuaacuaucuuucuuggaucaaaugaagucauccaauucuuaccaagaggaacaacugucauggacuucuggucccuuccaacaaaaucaaccguagggaagaaaaaaacagaaguaaaucuggauuccaagaacaauaauggcagcaacaacaaaagggaacaaaaacugcuggugauaccaaaagcuguacuuaacuuuucugaaaggaaacugguaaccuggagccugaagcaaagggaagcagagguaggacuuaaaagagagauaugcuaaaagcucuuuaagauuuugccuuucccucccccuugauugccccuuagccacagaaauuggcagcaacagccuagaugucuuugucagcaguuuaaaaucaggguggcacagaagccuuagagaggaaagcucaggaaagcagacacagacuaauaagccauccucuuggcauucacucuucccgccccucucugugcccccaccuuguacaaggggcaggggagcuacagggcugguagugaguuauaaucuaaggagauaaccucuuuccaguauccaguauuauuuauuuauaugaguguaaaaacaaaucccaaucagaauuugccugaugcaguagcagccaacagaacuugacagcacuucaauggugccagguggcggcuauuugaccugggucccaaguccuuccuuuccuuaaacucaccuggacauaaauucccuaacagauauuauuagacuaagugacuaauaccccgcaagggacacagacaaauagacacaucuauaacauaaacuacugugaaagaaggaugacucacuaaacaacuuaugccaucugaagcaguauuacuggaaugaaugauccaagaaugugucccuagaaagucaauggaagauauaaguauaugaagccaaaacaggaaaccaugaaaaaggaucaaguagaaauacugaauauguaaaacagacaauauccagguaacagaguuccagaaagagggagggaaaugaaacauuucuagggaagaauaaacauuucaagaaauaauaacuucccagaauuaaagauaaaagaagugaagaauguaaagccucaaacagccaaauaacagaagagcccauuccuagaaaauuuaagauuaucaaagaaaaaaaucucaaaggcuggaaaaaaaagaacacaguaaugccaaaaguaaaagaauaagauuaauauuagauaucacaaaaagugacacuggacacaggaugggguaguguaaauccacaauccuuuauccauaauccuugcagcagggguuuuuucagaauucagaauugcuaugguuugaauguaucccccaaaaaaacaugcauuggaaaccaaauccccaaaagauuaaugcugucaucauauuuaagacuaugugccccauuucaauggguucauuauaaaaaggggaguucuaucuucucacucauguucucucucucccuucugccuucugccacagcaacauguuggcccguugaucuuggacuucccagccucccaaaccaugagccaauacacuucugguucauuauaaauuacccagucugugguaucuuguuauagcagcacaaaacagaccaaaacaaugauuuuucagaguauauaaagauaauaugguguuuguauguauaucacauauuauguaacauccacaacagcaucuaaggcacuaacccauaauuuaacucauuaauaucuugaagcaaaaucuauaaacauuaacacuaaaugagaugaauaaaauccguaaguagccucauaccaguuugguuuguguguuguagucaaauaaauuaugaaaaacccuuugauuauuugguuuuagaauaccaggaaagggacucuugaccuguauuuuaaaaguuuugaauuaaaguaacuuuaaacuuagaauuuuacauccaaaacaucauuccaauaugauguuaagacaaaaauauuuucaacauacaaagccucagagggucacauaaagcccacuaacugcacauuuggaagaauacucaaaagaaaaagaaauauaggagguacuccaagagauaaagaaagcacuccaagagauaaagaaaguaaaaguagucaaaugccuuaguagccauaaaaagugaucuaaaauaccagcaauauacucacuggggauggggagucaggagacacauuaaaagaacguaugagaaugcuagaguaucugucauauuuaggggaagaaaaagccauuuuaaaaguaagaaauauacagaaguaaacugaggaaugggucuaaagggcaaucaucauaagaacaaaaauagaaaaaauuucaacuuacccaaugaaaagcaggaauggaguuagucaaaagggaaagggaugaaaauuaaacccaauuagaacaguaauuacaauaauguaaaugaguugaacuugccaauuuaaagacaaauuaguauaaaacauuuuuuaugccagguuaaaaaaugacagagcaauaugaguaauacuuaagaaaggauaaaccaaacaaauaugaaccacaacaaagcuaacauagcaaucuuaauaaaauuuaaggcaggccaaccauggucucaugccuguauuccagcacuuugggaggccaaggcagaaugauugaguccaggaguucaagaccagccuagccaacauaggcagauucugucucccuaaaaaaauaaacauaauaaaaaauaaauauaacaaaauuuaagguaaaaaauaucaagaaggacaaagugagauauuacauauuuauaaaaauaguagaacaaaaccacauaaucaucaugaacacauccacaucaaacaaagucucaauauaugucagaaacaacuguagaaaauggagggagaaaaagcuaaaaucaauugcaguuggaaauauuaacacucaacugaucaaaaacaguauaagcagauauauugaagauccaagcaauaaaaucagagaauacauauuauuugcauaagcacauagcauauacacagauaggucauauaauagcccaaaaagcauggcccaaaacacaagaucaauaaccauacacauugcauuaucuuacaauaaugggauaaaacuagaaauuaaugacaaaaagaugguuuuaaaaaucucauuuggucacgaggucaggagaucgagaccauccuggcuaacacagugaaaccccgucucuauuaaaaauacaaaaaauuagcaggcgcaguggcaggcgcccuuagucccagcuacucuggaggcugaggcaggagaauggugugaacccgggaggcagagcuugcagugagcugagauugcgccacugcacuccagccugggggacagagcgagacuccgucucaaaaaaaaaaaaaaaaucucguuuguaaacuaaauauauuacuaacucagauuaaaacguaaaaacauuaagaaaauuuuaaaauacucagacguuaacaguaaugaaaauucaagacuacccucuaacuggaucaauuuuugcugacuuggucacuccugaaccaauuauugugaccaaaguaauggcaugagccaacagguuccuugaaccaagacuaggauuaggcugauuugcuuaaaccaaugggaaucuacaaauacaauagaagaagcaguauguagugaaagggaaaucugauuaucauauuaggaagaggaaagaagagauauauggaauaguagggaggcaacauugcugacagaacuuuaauuccaguucagccaccauucucuaagguuaauuacugaucauauaacaugagaugggaccucaguuuccuuggguaaaaaaugaacaugauauuuaagagucccuuuagcucuaggaguuugcaacuacaucagcuguuuuguucaggcuaaaauagagccuggcacauauuauaccauuugcuaugaguguacagaaugaauaggaaguuuaccacacucaauuuugagagauucuuaggacuacuacuucaaaaaaaaaaaaaaccacuuaauggaucuccaauagauaaaugggaaaaggacgcaaauuuuaaaauccacaaaggggaagcugguaagcugcuuuuaaaauauuccaaguuucuaauuuaaaaagugaaaaauuaaaaaauucaacuaccauuucauaucuauucaaauauucaauguugauaaagaagcagagaaacuagcaacugcauacacacuauaguagcuguguagauugguagugcuuuuagaaaguauucaaaauuuucacauuuaaugcaucauuaucacuucuggaaauccaaaaguaauccugacuaguccaaaagaaagcaaaauaccuauacacacaaaaauguuuucuugcaauauuucuuauuauaagagggaaaacuccaacacaaccuaaacacguaacaaccagguaauaauuaaauuaugguuagauaauagauuauguagccauugucacaguauucagagaauauauuuaacaaauuuuauuauuuaagggcaucuaaagaguccaguaacuaugagaaauuuacauuaaaacugauaugagcauuugauuuuuaaaguuuaaaaccuaaaaccuuguuucuaaacuuuaucugacaaauuucguaccccauguuuugaaaacgucuggacuucaccaagagugggccaagaacaauuacauuuuggauauaauucacagaaauauuaacuuccaagaguaucugggguauuuuuuuauacuaaaggagaagauaauauagcuacucuuauugaaugugcagcuuaugagcuuuuggacuuuuuaaaaaaaauguguggaaaaaugucaguaucuaccaugccaaagaaaguauuggucuuauuuuuacuacaugcuuuauauuuuuauguuucauuagcucagucccacaugagaccagugccugcccugauuucuggaaugcugccccaauucuuuucuccuaggccuuguugccaggguugcagcugcacaacuaauucuuauuaaaauguaagucuuugaaaugcaggucuacggaaagggauauaaaggauuucauuaucuuuucucaaaacucacaaugaggauuaaacucccacccuucccaagccauaccacuacuugugcccuucucuaccaagucacacaccaaauauaaugaagacagcagcucacccuuaaauauccaaauaaaaacagccaugaaggagagagcugcacaguaaugaaccuucaggucuggcaaaaguuauuaaaaaaugacuucuaauacucauaauguagucacaggcuacagcuggauauucauacagugaugugauuuuagaaauaauacuucuaaagaauaaauacuuggaagaaaaaauagguacucugcaauaacaauuucagaauaauuucagaaacuucaagucagaaaaacaagaacugcaaguaauuuacucaaaauguaaaauacuuuauaagcuauuaauuuuguuguagaacacucacaccccuaaaauuuucuugaaaaagcaggaaaaaauuuaaagacaauuuacauuccuuuccauuuuuuacuagaaucucauguacuuuugucucuggauaaaauucuuaacaacugaucuugcucuugaacaauuuaugauuaaauucaucuugugagaaaaguuaacacacaacugucaagaccauaaagauaaaccuauuuucaauuaaaaguaaacaaacagaucaaauccucucauguaaaguaaaaugacacagaguuuuucauuaaaacacauuauuuuagauguugguacacuacuggaauucuaacaugcagaaccuuagaauuuuaacugugucagagaaaagaauuaagguuagcaaaauuaccuaggguuaaguacacauauccuagucuguucccuaggugacucacauuuaaauacaaaaaaaaaaaaaaaaaaaaaaaaaaccagagagagagagguacaaucccuugaggaucucauuauaaaacaugcacuucaaguuacagaaacaaagcacauucagauacaauucuaaaaaguggcuacuaguuguauuuuuuaguaauaaaacugaaaucauuaacuuaaauguacuucauaacuucauaagcuuuuuaaauauagaagaaauauauaauuaaaauacuuguuaaaaauauagauugggggucgggcacaguggcucaugccuguaaucccaacacuugaaugccaagguggaaggauugcucgagcccaggaguuugagaugacacugggcaacauagagagacacugucucuacuaaaaaaaaaaaaaaagccaggugugguggcacaugccuguggucccagcuaccuggagggcuaauguggaaggacugcuucagcccagaagguugagggugcagugagucacgauuguccauuauacucgagccugggcaacagagugaaagccugucucaaaagaaagaagaaaaaaaaauauuugggaucaccucacaccccuuaggauggcuacuaugaaagaaaacaaaacaaaacaaaaaccacacacagaaaauaaaugcugacauggaugugaagaggaaaucuuugugcacuguuggugauaccguaaaauggugcaacugcuauagagaacacauuaugacagguccccaaaauauuaaaaacagaaauacuaucuacuucugggauauauuuggaaaaacugaaggcagagcccugaagacauauuugcccacccacauucauacuagccaagagguagcacaacagccaagagguagaagcaacccaaauguccaccaacagaagaacagauaaacaaacauacaauggaauauuaucgagccuuaaaaaggaagggcaguggcacaugccuguacuuccagcuacuuacaagacugaugccagaguacuacuugagcccacgacuucaaguccagccugggcaauaaagcaagaucuaaucucuuuuaaaaauaaaaaauaaaaauaaaaaggaaggaaauccugucaugcuauaaaauggaugagccuuacgaacacuauacuaagugaaauaagccagucacaaaaacauaaauacuguaugauuccauuuacaugaggaaucuaaaguagucaaauucauagaaucauaaaguauguggguacugggggauggcaauagggagaaaugaaaauuuguuaucuaauggguacagaguuucaguuuugcaaagugaaaaaguucuagagauuggcugcacagcaaugugaacauacuuaacacuacucaacuguacacucagaaauggauaagaugauaaauuuuaugugucuuuuaccacuacuauaaaaaaaauuuuuuucugccaggcgugguggcucaugccuguaaucccagcacuuugggagcccgaggcaggugaaucacgaggucaggagaucgagaccauccuggcuaacacggugaaaccccgucucuacuaaaaauacaaaaaauuagccaggcgugguggcgggugccuguagucccagcuacuugggaggcugagguaggagaauggcaugaacccgggaggcggagcuugcagugagccgacaucgcgucaccgcacuccagccugggcgacacagcgagacuccgucucaaaacaaaaaacaaaacaaaaaaaacauuucuaauguagauugggggugaccucacccuuggagauucuaacaaauugaaaaagaugaaaauuaggugaaucccuuuuuuccuuuuacccaguacgacgcuugaugauuuuggcgggggggaagauagaauuaaguuucccaccauuauccuacccacccaguugucuucccucaauacagccccuaauauuagcuucuuguguagccuuucacagauacuuuaugaauauaccagcauauauguauauucuuuuuugaaauauuuuuauguagcauuauacaucacgggcaccuuuuucacuuaacacuuuaucuuagaaaucaggcaauaucaguaccauuuuaaagagaugagaucuauguuacccaggcuggauuugaacuccugaguucaaacaauccuucccuaucagccucccaaauaacuaggacuaucagcaugugccacuacacccagcuaauaucaguaacuuuuaaaaaacugccucuuuuaaguuuuaaaggcugcauuuguaucauacugauauaggucaucuuucacagacggaaguugaguuguuucuaauacuucacuauuacaguacugcaaaaacuaacccuguauauucacacaagugagaauacgaugaacuaaacccaaaagcuacagaauuuaaccauaagauaaauuccaagaagugaaacugauguauuaaagagcauguacauuuaaauguucaguaggcauuuuaaauuuggcagauguuuuccaaucuccuaaaggaaugugccaacuuauacucccucuaauaaggcauuagaauaccuacauuucuuucaaaacacguuuucuaagaaggcuucccuaacuccaagaauauaaagaggaaaaauucauuuucuuccucugaagauaaggaucugauuuuuucugauggcuacccagcuauaauauugccagaaagaaaaaaaauaauuuucuccacugauccgauacgugcuuucaucauauucuaaauuuccauaugaauuugggacucuuuuuauucuguaccacugaucuaucuaccagaauuauaauguauuaauugcuguaauuuuagaauacauuuuuuuuugagacagagucucgcucugucgcccaggcuggagugcaguggcgcaaucucagcucacugcauccuccgccuccggguucaagugauucuccugccucagccucccaaguagcugagauuacaagcaugcgccaccaugccuggcuaauuuuuguauuuuuagcagauaugggguuucaccauguugaccaggcuggucucaaacuccugaccucaaaugauccacccuccucggccucccaaagugcugggauuacaggcauaagccacugccacccggccagaauacauuuuuaauaucuagaagaacuaauucuuuuuuuuuuuuaaucuuauuuacuuauuuuuugagacagagucucgcucugucacgcaggcuggaguacaguggcacaaucucagcucaaugcaaccuccaccucccagauucaagcuauucuccugccucagccuccugaguagcugggauuacaggcaugcaccaccacgccugacuuaauuuuuuuuuuucuauuuuuaguagagacaggguuucauuauguuggccaggcuggucucaaaccccuaaccucaagugauccaccugccuuggccucccaaaguguucggguuacagguguuagccaccacgcccagccuaguuccuuuuuuaaauguucuuuuuuuuuuuuuuuuuuuuuuuuuuucuuuaagacggagucuugcucugucccccaggcuggagugcaguggcgcgaucuccgcucacugcaacuucugccucccggguucacgccauucuucugccuuggccucccgaguagcuggaacuacaggcacccgccaccacgcccagcuaauuuuuuguauuuuuaguagagacgggguuucacugcuuuagccaggauggucucaaucuccugaccucgugauccgccugccucggccucccaaagugcugggauuacaggcgugagccaccgugccuggccuaaaugcucauucuuuuaaagaauuuuucuggauaaucuuccuuauuuuuuuccuuauaaauuuuagauucaacuaaucuuuaaaaauccuuuuaaaaauuuuaucgggauguuacagacuggaagagaacaauauuuuucagauacugaauuacgauggucaguuucuaaguauucuuuuggguccugggugauucugcuauaagagaucuacuuuuugagaaacaauacugcaugucaaaggaaagaguaguggugcuugcuaaggggcaaaggaagccaguauacagagugcaagcucugucuauggggguacaacagccuaacuauauuagauaucaauauaaauuuauccuuguugagaagaccaagaaaauuucuucacagaggcagaaacuauacuccaaacuacuuucuauggcccuaggguaagaaaacaacugcagcugaaguaagugguuucgaauuccauuccauacaagaacucaaaauuaguggugaacuacaggcuuggaaaaccagaaugaagugaggcacugaggguggggggaaaagucauaucgaccuuucuccuaccuuacacccccaacucaucccagcacuuugggaggcuaaagcagguggaucauuugaggucuggaguucgaaaccagccuggucaacauggugaaaccccgucucuacuaaaaauacaaaaaaacuuggccaggagugguggcgggcaccuguaaucccggcuacucaggaggcugaagcaggagaaucgcuugaacccuggaggcggagguugcaaugagccgagauugugccacugcacuccagccggugcaacagagugagacucugucucaaaaagaaaaaagaaaaaaaagaaugcauuaucugccaaccugcacaucugugucagaggcauccuuaccuaacucacaauucaaguuuuauuaagucccuugaguucucauuaugcagauguauaauugaggguugagaaagauguaucagcuagaaaguuuucacaaaaauguaagacaaaauccaaagccaauuggauuaaacaugaaauuuaguggcucaugcaacuguaagucuagagguacagcagcuucagggaaggguugauccagcagcucaaauggaguaacuagggcauggcuuuucucugcucuacucacucaguguuggcuucuuaaucaacuaaauuuccuuucauggucaaaagauagcugccaggaauucaauaacuauguuuucagguugaaauucauaaaaauaagugccuucaucucagcauuccuagcaaauauccuaagauucacucugcuugaucuagcuuaaggugcaugccugccaugacugucuuagguaggaaacauguuccauuccuacaaaauauauaugaaauacagcacauuaaaguugaccuuaaugauuuaaauuuccuguauuacuaaauaaugguacuacugcauuuaaauugauggguaaagugcaucauacaacuuucucuaucuucuuaaaaaguuauucuccugguugggcaugguggcucacaccuucaguucccgcacuuugggaggccaacgcagguagaccucuugagcccaggaguucaagaccagccuggacaacauggugaaacccugucucuacaaaaaauauaaauuggcugggcaugguggugcacaccuguagucccagcuacuugggaggcugagacaggaggaucgcuugagcccaggaggcagagguuccuggcaucuugggcucaaacacauaggccuaggcaaagagccaagaucacacuccagccugggcaacagagugagacccugucucaaaaaaagaaguaggaaaaaaagguauucucccagauuuucaucagaaucgaucaagaaaaaaaaaaagugaauucuucccugaauguaaaucucuuuuugaaggauucaaaauauacuaccagauuaccugguaaaaucauaacacagguuuuaucuuuuuccuuuuaccauaacugaaaguaacaccacagauuuucaagaagaaaaagagguucucauuccauacuuuuucaagauuauaauaacaagauuuaaaagaaaagauagaaagaaacauuuauaucuagagccaggucaaaaaaaaaaaaugauuuguuucacagagcuuuaaaacauaagcaacuagaucauccauccuauggcccaagaucccucuuacuacaucaccgccaaacuucccuccaccucccccaaaacacacaguccuaagaacagaguggggaugcacacuuuagggaaucuuucugugaaugugcauuccaaagccaaauacaaauuauuccugaauuaugcuucuuacuauugacgucccucauuccuauaauuaucacagaaaauagaaggcaaacuauucuguuuuuauaaugaagaagaaagugaaauuccauuuauuagauugaaagccaauacucaaacauaaaggagagaaccugguucugacgguaaaguuggacaaaaacaaaaggcaacauugucuggaguagaacuaaccacuugaacauguguuacauacuggaagucuuaaagaaaaaacaaacuucacucauaauccuagagggaagcaguguggguaaagaaaaggaugugaauuuaaaaaaaaaaaucucuguaauuauuagauucuacggauugguuuuucaaauacuuaucaaguaauucaguuaagcaaacauguauugaugacaucauuaagaaguauuagagucagauacaauaggaauauaaacauaccccuugacuucauaaagcuuguaaggggcuacaaagaacaugaucaaguagaaaugugugcgacacuaaaaaacauggcuuugaguaaucaaaaaaggaagaaaccaaauaaaucuagauaauuucuauagcaaauaacaggaaaucucaaggcaaaacugcuuaaacaauaagaaaauucagauagagaggcuauaggcaugguaaauggaacucuaguucuacuuuucuccaguucccuugguucucccuccuucacauaaggcaccaccuucaggcuacuaaaaagauggcuccagcacuuccacacaucacaucuacguaauaucagcucugcggagaagagggaccaucuauuuucuuccuuuucacaaaagcaagaaagauuuccccaaaagccucuugcagaugucccuuuugucucucauuggacaaaacuguuucucauguccauuccuaaaacaaucacucccaaagagaaugagaccuaccacaacuaagauuaaaauggaugcugguaacuaucaugaccaucauuucagcgcuggcugaauauuucaaauacaguauuucaggccucggacugaagaacaaauaauagagaaaaaugccuaggcaaaggaaaggaugugccuaacuggaagaagcaagccaaacucugaaaucagacauuaaacaugauguuagggauaaagaauucccuuaaacugcacugcuguccuccucuguaauauaaaaauuaaugucagcaaaugcuaagaauguagaaguagucauccucuuuuuauggaaaggguuuagguuauuuaauuaucaguggagauuaucagacuuaccacuccucagcaauggaguaacacauucagcuacuucuggguuaagaacauuccauauuaugcauacagaugaccgcagauucacugucaguaguuauuccuugcagauuucuucucauuuggguuccagguuucacucaaaaauucacacacucaaaucuggcccuaucugcaaaugaaagcaugcaauuaggaggcaaaaagcuacagagagcaauucccccucccccaucuauaauuaacugauccauauaaagacugaacucaaacacuaggcucacuaagcaccauguuuaaccuaagcaaccugcauuucaacaccauaacgugcuuauuauacacaguuaacacacuuuucccaccauauaaauuuauuguugcuuccacauuauaucuacccaccgggcagaauccagcagacagauaccuuugguggacccacacuagguuggucugcaugguuaaaggauaacugccuacauuuauaaaucaggacuuuacaugaaaauccagauuuuggaccucucuugaaaaaucagaauaucuggcaauacuggccccacauucccauauggaaacaaucuucuggagcugauuagcagcuaacuaacccuguggaugggacucugcaguucuccacagaagucgccacucuccuuuauguuacaaccuggcucacaauuacuugucuguacccugcagacaucugagcuugcaaacucugcuacguauuucuaauagcucccagggaacauuuuaguauugucacagccaagcauguuucucugccuugaggauauaauauagcauaaggggauaacaaacauggacuuaagagucagaagcugaaguucaaauucugcaaaugacuagcugugugaccucaggucuguuuuuaaccuaagauauaguucaucuaaaagcguccaaauaaaccuauaagccuuaacacaguagacaaaacacgccuaaaaucuaacguguccaaccugaauugacaauacuagauacacugcuuccucagucuucgucaucucaacaaaucacaccauaauccauauauuccgcucaagccacaaacauaaagucccacauacucuuccuugucucccaaagccaucaccaaggcaacuggcucuuccuccaaaacacauaacuugaacagauucuuagaauuccagucauaaaaacaaacagcaauucauccuucauaaucaauuacuuugcugaaauugccuauaaauuuaacaccuuaaauaaugguagcuugaagugucaagguuccauauuaugaagaauacugguacuucauuaaaggaaaaaugaauuucauuaaaggaaaaaugaaaaccauugggguugcuuaaucucauuccuggcaagacauugauauuaauuuuauaaacuuacacauuucuucaacucuaaacugacagugaacuaagaggcuaugcuaacucugauaacgaaauuaggaaaaccaagacuacuauuaauagaauaaauaagucuaggaagguugcaggaucaauacucaaaaaccaagauuaauacucaaaaaucaauucuauuucuauagaacacuuguacaaagaauaaucagaagccaggcacgguggcucauauguauaaucccagcacucugggaggccagggugggaugauugcuugaggccaggauuuuaagaccagccugggaaacacagggagacccugucucaacaacaacaaaaaaaauguuuuaaguuaaccaggcaugguggagcaugccuguaguccuagcuacucaggaggcuguggugggaggauuacuugagcccaagaguucgagguuacagugagcuaugauugugccacugaacuccaaccccggcaacagagccagauccugucuccaaaaaaaaaaaaaaaggacaaucauuuaaaaaauaauuucauuuguaguguaaaaguaugaauuaugaagaaauuaucaaauuaugugcaaaaacaaauagagaauaauauuauguucauagaucaaugaagucaaugauguuaacaugucaauucuccccaauuugaucaauauagucaacacaauucuaauaagaaucccagcugaccuuuuuguagaauaaacuggcauguuuauucuaaaauccuacaguuuagucgggcaugguggugcacaccuguaaucccagcuacucggaaggccgaggcaggaggaucgcuugaacccaggagacagagguugcagugagccaagaucaugccacugcacuacggccagggugacagagugagacucugccucaaaauaaauaaaauaaauuaauuaaauaaaaucauauggaaauggcaaagagcuagaucaaucaaaacggcuuuuaaaaagggcaaaaauuuuggaagccuuauacaaccagaauucaagguuuauuauaaagcuacaaaaacacuguacuaguaggcagagagacuuaacaggucaauaaaacaaaacugagaguccagaaauacaacuacacacauguagucaacuuauuuuccauaaggguacaaaggcaauccagcagagaaaggauagcuuucucaacaaaugaagcuggaacaacugaauauucauaccgcaugccaaaauuaacucaaaaucaaucacagaccuaaagguaaaaccauaaaacuuccauaaaaucuuuguggccuuaucuugggcaaagauuaguaaacuaaaacacaaaagcacaauccacuuaaaaaagacaaaguaauaauuucauucaaauacuaauuucugcuauuugcaagacacuguuaacagaaugaaagauaagccucagaaauaaaaggcauccaaacagaaaaggaagaagagaggggccaggcgcgguggcucaugccuguaaucccagcacuuugggaggccgaggcaggcagaucacgaggucaggagauggagaccauccuggcuaacauggcaaaaccccgccuccacuaaaaauacaaaaaaucagccgggcgucguggcaggcaccuguagucccagcuacaagggaggcugaggcagcagaauggugugaacccgggaggcagagcuuucagugagccaagaucacgccacugcacuacagccugggugacagagcaagacuccgucuaaaaaaaaaaaagaaaagaaaagaaaaagaaaagggaggaggagccaagauggccgaauaggaacagcucccgucuacagaucccagcgugagcgacacagaagacgggugauuucugcauuuccaucugagguacuggguucaucucacuagggagagccagaucgugggcgcaggucagugggugcgcacaccguuugcaagccaaaguagggcgaggcauugccucacucgggaagugcaaggggucagggaguucccuuuccuagucaaagaaaggggugacggacggcaccuggaaaaucgggucacucccacccaaauacugugcuuuuccgaggggcuuaaaaaacagcgcaccacgagauuauaucccgcgccuggcucggaggguccuacgcccacggaguaucgcugauugcuagcacagcagacugagaucaaacugcaaggcagcagccaggcugggggaggggcacccaccauugcccaggcuugcuuagguaaacaaagcagccuggaagcucaaacuggguggagcccaccacagcucaaggaggccugccugccucuguaggcuccaccucuuggggcagggcacagacaaacaaaaagcaguaaccucugcagacuuaaaugucccugucugacagcuuugaagagagcacuggcacucccagcacgcagcuggagaccugagaacgggcagacugccuccucaagugggucccugaccccuaacccccgagaagccuaacugggaggcaccccccagcaggggcacacugacaccucacacagcaagguacuccaacagaccggcagcugaggguccugucuguuagaaggaaaacuaacaaacaaaaaggacauccacaccaaaaacccaucuguacaucaccaucaucaaagaccaaaaguagauaaaaccacaaagauggggaaaaaacagaacggaaaaacuggaaacucuaaaaagcagagcgccucuccuccuccaaaggaaugcaguuccucaccagcaacagaacaaagcuggacagggaaugacuuugacgagcugagugaagaaggcuucagacgaucaaauuacucugagcuacuggaggacauucaaaccaaaggcaaagaaguugaaaacuuugaaaaaaaauuuagaagaauguauaacuagaauaaccaauacagagaagugcuuaaaggagcugauggagcugaaaaccaaagcucaagaacuacgggaagaaugcagaagccucaggagccgaugugaucaacuggaagaaaggguaucagcgauggaagaugagaugaaugaaaugaagugagaagggaaguucagagaaaaaagaauaaaaagaaacgagcaaagucuucaagaaauaugggacuaugugaaaagaccaaaucuacgucugauugguauaccugaaagugauggggagaauggaaccaaguuggaaaacacucugcaggauauuauccaggagaacuuccccaaucuagcaaggcaggccaacguucagauucaggaaauacagagaacgccacaaagauacuccuugagaagagcaacuccaagacacauaauugucagauucaccaaaguugaaaucaaggaaaaaauauuaagggcagccagagagaaaagucggguuacccacaaagggaagcccaucagacuaacagcggaucucucggcagaaacccuacaagccagaagagagugugggccaauauucaacauucuuaaagaaaagaauuuucaacccagaauugcauauccagccaaacuaagcuucauaagugaaggagaaauaaaauccuuuacagacaagcaaaugcugagagauuuuugucaccaccaggccugcccuaaaagagcuccugaaggaagcacuaaacauggaaaggaaaaacugguaccagccgcugcaaaaucaugccaaaauguaaagaccauccagacuaggaagaaacugcaucaacuaacgagcaaaauaaccagcuaacaucauaaugacaggaucaaauucacacauaacaauauuaacuuuaaauguaaauggacuaaaugcuccaauuaaaagacagacuggcaaauuggauaaagagucaagacccaucagugugcuguauucaggaaacccaucucacgugcagagacacacauacgcucaaaauaaaaggauggaggaagcucuaccaaacaaauggaaaacaaaaaaaggcagggguugcaauccuagucucugauaaaacagacuuuaaaccaucaaaaaucaaaagagacaaggccauuacauaaugguaaagggaucaauucaacaagaagagcuaacuauccuaaauauauaugcacccaauacaggagcacccagauucauaaagcaaguccugagugaccuacaaagagacuuagacucccacacauuaauaaugggagauuuuaacaccccacugucaacauuagacagaucaaugagacagaaagucaacaaggauauccaggaauugaacucagcucugcaccaagcagaccuaauagacaucuacagaacucuccaccccaaaucaacagaauauacauuuuuuucagcaccacaccacaccuauuccaaaauggaccacauacuaggaaguaaagcucuccucagcaaauguaaaagaacagaaauuauaacaaacuaucucucagaccacagugcaaucaaacuagaacucaggauuaagaaucucacucaaaaccgcucaacuacauggaaacugaacaaccugcuccugaaugacuacuggguacauaacaaaaugaaggcagaaauaaagauguucuuugaaaccaacgagaacaaagacacaacauaccagaaucucugggacacauucaaagcaguguguagaaggaaauuuauagcacuaaaugcccacaacagaaagcaggaaagauccaaaauugacacccuaacaucacaauuaaaagaacuagacaagcaagagcaaacacauucaaaagcuagaagaaggcaagaaauaacuaagaucagagcagaacugaaggaaauagagacacaaaaaacccuucaaaaaauuaaugaauccaggagcugguuuuuugaaaggaucaacaaaauugauagaccgcuagcaagacuaauaaagaaaaaaagagagaagaaucaaauagacccaauaaaaaaugauaauggggauaucaccaccgaucccacagaaauacaaacuaccaucagagaauacuacaaacaccucuacgcaaauaaacuagaaaaucuagaagaaauggauaaauuccuggacacauacacucucccaagacuaaaccaggaagaaguugaaucucugaauagaccaauaacaggagcugaaauuguggcaauaaucaauagcuuaccaaacaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauucugauaccaacgccgcgcagagacacaaccaaaaaagagaauuuuagaccaauauccuugaugaauauugaugcaaaaauccucaauaaaauacuggcaaaacgaauccagcagcacaucaaaaagcuuauccaccaugaucaagugggcuucaucccugggaugcaaggcugguucaauauacgcaaaucaauaaauguaauccagcauauaaagagagccaaagacaaaaaccacaugauuaucucaauagaugcagaaaaggccuuugacaaaauucaauaacacuucuugcuaaaaacucucaauaaauuagguauugaugggauguauuucaaaagaauaagagcuaucuaugacaaacccacagccaauaucauacugaaugggcaaaaacuggaagcauucccuuugaaaacuggcacaagacagggaugcccucucucaccacuccuauucaacauaguguuggaaguucuggccagggcaauuaggcaggagaaggaaauaaaggguauucaauuaggaaaagaggaagucaaauugucccuguuugcagaugacaugauuguauagcuagaaaaccccaucaucucagcccaaaaucucccuaagcugauaagcaacuucaacaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacacuccaugcucauggguaggaagaaucaauaucgugaaaauggccauacugcccaagguaauuuacagauucaaugccauccccaucaagcuaccaaugccuuucuucacagaauuggaaaaaacuacuuucaaguucauauggaaccaaaaaagagccugcaucaccaagucaauccuaagccaaaagaacaaagcuggaggcaucacacuaccugacuucaaacuauacuacaaggcuacaguaaccaaaacagcaugguacugguaccaaaacagagauauagaucaauggaacacaacagagcccucagaaauaacgccgcauaucuacaacuaucugaucuuugacaaaccugagaaaaacaagcaauggggaaaggauucccuauuuaauaaauggugcugggaaaacuggcuagccuuauguagaaagcugaaacuggaucccuuccuuacaccuuauacaaaaaucaauucaagauggauuaaagacuuaaacguuugaccucuaauuaaacuaaagagcuucugcacagcaaaagaaacuaccaucagagugaacaggcaaccuacacaaugggagaaaauuuucgcaaccuacucaucugacaaagggcuaauauccagaaucuacagggaacucaaacaaauuuacaagcaaaaaacaaacaaccccaucaaaaagugggcgaaggauaugagcagacacuuuucaaaagaagacauucaugcagccaaaagacacaugaaaaaaugcucaucaucacuggccaucagagaaaugcaaaucaaaaccacaaugacauaccaucucacaccaguuagaaugguaaucauuaaaaagucaggaaacaacaggugcuggagaggauguggagaaauaggaacacuuuuacacuguuggugggacuguaaacuaguucaaccauuguggaagucaguguggcaauuccucagggaucuagaacuagaaauaccauuugacccagccgucccauuacuggguauauacccaaaggauuauaaaucaugcugcuauaaagacacaugcacacguauguuuacugcggcauuauucacaauagcaaagacuuggaaccaagccaaauguccaacaaugauagacuggauuaagaaaauguggcacauauacaccacggaauacuaugcagccauaaaaaaugaugaguucauguccuuuguagggacauggaugaaauuggaaaccaucauucucaguaaacuaucgcaagaacaaaaaaccaaacaccgcauauucucacucauaggugggaacugaacaaugagaucacauggacacaggaaggggaacaucacacucuggggacuguugucggguggggggaggggggagggauagcacuggaagauauaccuaaugcuagaugacgaguuagugggugcagcauaccagcauggcacauguauacauauguaacuaaccugcacaaugugcacauguacccuaaaacuuaaaguauaauaauaauaaaaaaauuaaaaaaaaaggaagaagagaaauuguaucuguuugcugaugacaugaucuuauguguagaaaacccuaaagccuccaccaaaaaacuguuagaacugauaaacgaaguaaaguugcaggguacaaaaucaacagacaaaaaucaguagcauuucuuuacacuaacaacuaauaaucuggaaaaaaaauuaagaaaucaauucuauucacaauagccuccaaaaaguauauauauuuaggauuaaauuuaaccaaggaggugaaagaucuguaggcugaaaacuauaaaacacugaugaaagaaacuguagacaauacaaauaaauauaaugguaucccauguucagggauuggaaucuuuaauguuguuaaaaugccuacaauacccaaagcaauuuacagauucaaugcaaucucuaucaaaauuccaaugcuguuuuucacagaaauagaaaaaauaauccuaaaauucauauaaaaccacaaaagacgucaaacagacaaagcaaucuugagcaaaacaaagcuggaggcaucacacuaccuagcuucaaaaucuacuacaaacuauaguaaucaauacagaacauacuggcauaaaaacggaaauacugaccaacagaacaggauagaaagcccagaaauaaaccuacaaauuauggucaacuggcuuucaacaaaguuaccaagaacacaaaacagagaaaggacagucucuucaauacagcagucuccccuuaucugugagggauacguuccaagacccccugcagauaggaacccuagauauacuauguuuauucaaucugauaaacuagacagcuauuaagugacuaaugagcagguagcauauacagcauggauaugcuggacaaaggaugauuucccaggcaggacaaggcaggacggcacaagauuucaucacacuacucaggaugacacauaauuuaaaacguaagaauuguuuauuuuguggaauuuuccauacacuauuuucagaucaugguugaccaagauuaacucaaacugcagaaugcaaaaccacagauaaggugaaacuacuguaaauggugcuaggaaaacuggauauccacaaggaaaagaauaaaaguggaccauuaucucacaccauacacaaaaaucaacucagaauggauuaaaaacuuaaauguaagaccugaaacugucaaacuacuagaagaaaacauaggaaaauaguuacaugacauuggucugagcaauuuuuaguuuuuuuagauauaaccccaaauauacaggcaacaaaggcaaaaauaaaacaggacugcaucaacuaaaaagcuucugcacagcaaaggaaacaauuaauggauugaagagacaauccacagauugagagaaaauauuuaaaaaccauuuaucugauaaagggcuaauauccaaaauauauaaggaacucaaacugaauagcaagaaaacaacuuaaucaaaaaacgggcaaaggacccaacagacauuucucaaaagaagacaauaaacagaugaaucucagcaaaucacaagcagccaagcuucagccaaucacaagcugccaacugaucagaccauguucaaauaaggcaaaggaggaacuguuaacuaaucaaucuauauacguacuugcuucucuuuucugucuauacuuacugcccagguugcacagcagagcucucugaaccuuuucugguucugagugcugcccaauucauguaccauucuuugcucaaauaaauucugccacauuuacauugucuaaaguuuuucuuuuaacauagagacaaaaacuggaaacaauucaucaacuggagaauggauaaaccugugguauacacuacucucaauaaaaaagaaugauuuuauacacccaucaacauggauuaaucucaaaauaauuaugcugagucaaagaagccacacaaagaguauauacuguauaauuuauacaaaauucuagaaaauagaaacuaaucucuagugguggaaaagcagaucagcuaaucuccuaggaaugugggugggugggcaaaaggagggccuacaaagggcugagaagaaacuuuugggguauauuuccaguaucuucagugugguuaugauuucacaggaauauacacaugccaaaauuuaucaagcugaacacuugaaauauaugcauuuaauuuuauguuuaaauauuaauaacugguagcaagccugguuaaaaugaaaagcaagauccuuuuaaugcauuaaauuugaaaauuauggccacaaucuuucucuucagaaaauagcucuuccaaaaguauaucucaaugcuaaggaucagaaacacgauuacuaaucacaaagaaagcauaugccaaaaacaguacucuaacuaaccuaguauaauauaauuuggcaugggaaaaaggaaaugugguggauuucaacauuguuaauucaauuauaguccagaguaccucaguccuccauuaaauuugguagaaauuagauuuaaaauacugucauuucauuguugaccaaaaagacauuuuacuauaaucauucaaugagugucauguggauaccguuacuaaaauggacuucauauucugcuuagaauucaugaaaaagucaugaaaacagauccaaucuaacugcuaagcacugguaugccuuggugcuuuuuguaucauauuaaaugccaccucuaucccuaucuaccugucauuuauacugaagagacggagaaaaaugaauuauuuccuuagcuaaauuuaaccauuaaguuuuauuuuaggccggguacagugucucaugccuguaaugccagcacuuugggaggccagggcgggaggauuguuugggcccaggaguucaagacaagccugggcaauguagagagaccccauuucuacaaaaaauacaaaauuuaaaaauuaaaaauaauaauaaauuagccuggcaugguggugcaugccuguggucccagcuacuuggaaggcugaggugcaaggauuccuugggccgggaaggucaagguugcagugagcugugaucaugccacugcacuccagccugggcaagagagcaagacugucccaaaaaaaaaaaagaaaauuauuuuagacagaagccaaaguguacacuccaucucuaugcagagauuucuagucuccaagauaaucagucucaguuccaucauauugcuaugaagacaagaaugcauuuuuaaagaaauuaaguuauccaugcugugucuaaauacuuuuagggcagucacaaagaaaaauuaugcuaguuuugcaucaucccaaauggcacaacuccaaugaaugaguacaggcuguauguucuaccuauuaguacaucuuucuguugucacugcugccuaaaaguggaauguccugccuuaggguaucuguuaucagaggucaggauguuaggaucaugauucaaaaguccuacugauagaugauuuagacaaacuuuauuuaagauuccuuccaaaccucagaucuucuuauaaguuaaaaauaaaaucgauuuuuaagugcccaauccacuacaauucaaaagucuuaaauuucagcugauaaacuacaagaagccaaaggcauaggucuuccaguaacauuuugaguacuuuccacuuuuccucaagaaacaguagcuuaaauuaucaggccuugacccuauuaaaucacucugacauugaaugaaaaauaaguacuuaaauauaugucccauuuuuaugcaugaucauuuaaugucaaauaccaauuccuuucuucuucucaaagaaauacagaucugucagggacaaauauagaccuguaagaaaucuaguucaauuuccucacuuuacaggcccagaaagguaaagaaacuugacuuaaaaucacuuaauuaguacaaugucuauuagcacugcaauaaaucacugucauuuauuuccucugugaauacacuguaaagaaaugcauauaaucauucacuuaaacaguuuaagugaaaagucaucugggcaauaauguagccaguggcgacacuaagacucaacacauuuuuguuugauucuugcuauuauuugcuggugcuguuaacauuccaagaccauaaaaguguaagauguaguugaguuacagaaguggguacaggugaggguagguguaaaugaggcaaaaacguuaaaggggaaagaagcuauuucuaauugcuggaauuucagaaucugcuugucuuaaaaaaaaaaaaaagagucaugaggcaacaaaaacggacuacuccugguaagucauaaugauacaaccacuuuguaaauaauuucgcaacuuucuuauaaagguauauauacauuuaccaugcuccccaacaaacccacuccuaagagaaaugaaaacauguccagacaaagaauauggcugaaggaggcaguauagaauagcaguuaagaaaagaggugcugguuggacacgguggcucaggccuguaaucccagaacuucgggaggcugagguggguggaucacuugaggucaggaguucaagaccagcccggccaacauggugaaacccccgucucuauuaaaaacacaaaaauuaggcugggcacgguggcucacaccuguaauccuggcacuuugggaggccgaggcaggcggaucacccgaggucgggaguucgugaccagccucaccaacauggagaaacccuguuucuacuaaaaauacaaaaauagccaggcgugguggugcaugccuauaaucccagcuacuggggaggcugaggcaggagaaucucuugaacccgggaggcggagguugcagugagcugacaucgcaccauugcacuccagccugggcaacaaaagcaaaacuccgucucaaaaaaaaaaagcaaccaaaacuuagccgggcaguaguggcgcgugccuguaaucccagcuacuuaggaggcugaggcaggagaaucgcuugagccggggaggcagagguugcagugagccaagaucucgucaccgcauugcagucugggcaagagaguaagacccugucucaaaaacaaaauaaaauaaaauaagauaaaaaaagaaaaaggaggugcugcuaucaaacugucuucaggguuugaaaucuggcucugccacuuacuaaguguacugauuucagacagguuauuccccucucuccaugccucaaaaaauagggguaucagaaagggaagggggcuuaauauuaugaugauacauuaugcuagcaauuagcaagucagaguuguuuuuuagucagaggacuuuuaacuuuuuuaauuuuuuuuuuuuuuugagacggagucuugcucugucucccaaacuagagugcaguggcgugaucuuggcucacugcaaccuccaucucccagguucaagugauucuccugccucagccucccgaguagcuggaauuacaggcacgcgccaccacgcccggcuaauuuuuauauuuuuaguagagacaggguaucaccauguugaucaggcuggucucgaacuccugaccucgugaucugccugccucggccucccaaagugcugggauuacagacaugagccaccgcacccagcccuuuuaaaauuuuuuaauugaaauauaauucuacauauuuaugggguacauagugauguuucaguaaauaaaauguauaguggucgggguaauuggcauacccaccauuucaaacauuuaucauuucuuuguguugggaacauucaauaauucuccuuuuagcuauuugaagcuauauguuauuaacuauagucauccucccgggccauagaacacuagaacguauuccuccuaucuaguuguaauuuuguguccuuuaaccccaucucuccucucuccuucuucccccuacccuugccagucucagaggacauuuuaaaacacauauacacacccacagcaacgguaguguacaauacaguauuuaagaguuuauguguauuuuguguauggucaaauaaauauaguuuccaauucugacugccacagagaauuguugggagguuaccucccugagauuugguuucacuaacuauaaaacgaagacaaugccaccucagagaauuauuguaagaauguaguaagauguauaaaguguuuacuuauuacaaugcuugacauaucauagcuaaaaaacggaaacuauuuuauuaugcaauaugcacauuauaacuagaaugaccauucauccuucuuugcuugugauagucacaauuuaugccaauuuuuaaacauaauuuuuuuuuuuuuuuuuugagacggagucucgcucugucacccaggcuggagugcaguggcgcgaucucggcucacagcaagcuccaccucccagguucacgccauucuccugccucagccucccgaggagcugggacuacaggcacccgccaccacgccuggcuaauuuuuuguauuuuuaguagagacagguuucaauguguaagccaggauggucucaaucuccugaccucaugauccgcccgccucggccucccaaagugcugggauuacaggcgugagccacugcgccaggccuacaacauaauuauuaauggccauucucuaucuugauauguuccaguuucgaugauaaauuauauggucacccuaauuuauaacuaaaauacugucaagauuuuuccuuuauuuaguucuuuguucucuuauucccuuuuuagugacauuuucucuuucuuauccaacucacugucccccuuuuccaaccucucucuugcucucacuuguucucacuccccuuauccaggugcuuggcaaccucaaugcugcaaguccagguucugugguccuaaacuccucaguaauggcauguuuuucaaaucuuauuuuucucaaauucccauccauccuuucacugaauuccagaauaaaagcuagugacccuaaaaacacuaccacgaucaccaacaaugggauuaauauucuaguucucuaaggauaacaacacuuuaacaggaaacuccaagagagacaacaccuuaagccaaaguagagaaacuaacagcauaaaugucagauacugugacaggcuggguaggauagaccauuugagaacuuuacucuucgaaucaaauaauuuagguggguuucuacuaaauaccuauaucagaacagcccugauucccuccuuuuugcugguucucagacaauccagucaaaauaccaaaggcucaaaaacuaacauuacauuaauaguucuuaaggguuuuguccuaugcccucaucuuucacucuacaaaugcuccccuagguuauuucaaucacuccccugaguucgauuagcaucaaugcugaucgccaaaucuacauuuccagcccacagcugucuccagcccaaagcucuccagccuaguugucuuuuaauuuagccucacacccagcugcauguagugcagcuccacaggaugugcuaccucugcuucaaacuuuacugaacccugcuucuuaacucaacucugcuucuuucuuaccauuacccaccccaauccuauucaauuuauuuucauuaaauucccucucaucuacccaguuuacgaagccagaaacaagcauguuauccuuaacuuuugccuuuccaucucaucccccacagccaaacggccauguucuauuuguccaaucuguuucuccccaacacuaagucaccaguagaguucuaggcaccaccaucaucucucaacgaauaccauaauagcugcuaacugaccccugguaaccacucuuagucccuccaauuuguuccccauuuuggcuagaaugauacuucuaaaaugaaugucugaucauguuauuccugacguaaaacccccuuuaaugacuauuauccucaggaaagucuccucguaugacuucucagggccuuuaccauuugguccccacauuucucuucaaccucauuuacuaccucuuccauuugauaccccaugacugugccauccaaccauucucaauuucuuucuguugccuacaggacaucacacuuacuguucacuucuuucugucuggcauacucuucagaacuugauauggcuaucauuuccuucaggaaucauuccccaaucccccaagucuauucaggcccucuuccaauauaccuuguaccuuccuuucagggcauuuauauuacagagguuauuaauccuggcugcaccuccaaauaaugggagaaacuuagucccagaauuucagauucagaaauguggcaaaauggcauucaauucugggugucagauuuagcuuagcaaaaagcacaaggggaagauaugacagccuucaaagauuuguaggucuuagcauagcaugggaaagaggaagccaacuuguuaugggguaccaaagauggugguaacaaagccacuaugcagaaguuucaggaaggcaauuuuugguuuaaaaaaaagaaagaacuaucuacaagucuaacugcccccaaaaagauacugggaugccuagaaaguggugaauucacagucacuagagguuaaguaucagggacccuaaaagaauuccuauauuugugacgucauacuaaauaauauccacaguucaaaucaauucuaagauucuaugguaccuaaauucauaaaauauuuuaaagaugccgggcgcgguggcucaugccuguaauccgagcacauugggaggccaaggcggguggaucaccugagaucggaucaccugaguucgggaguucaagaccagacucaccaacauggagaaaccccaucucuacuuaaaaaaaaaauaaaaauuagccaggcaugguggugccugccuguaaucccaacuacucaggaggcugaggcaggagaaccgcuugaacccaggaggcagagguugcgcugagccgagauuuuuccauugcacuccagccugggcaacaagaguaaaacucaaaaaaaaaaaaaaauuuaaagaugacuagacagcagcugaaugaaagcacauuacucuaacccacucuaacaggaagcauaacuuccuaaaaaauuagauuuaacugccuauuuuacaaauaacucagugaaacuacucauaaaaauagcuaaauacauuacguuuucguguauuaacuuuuuaaagaaaaaaaugaaaaacugucauuaagauuggaaauagggagagucuccuaguuuuuauuugacccugugugaaaagccaaaagaaaccaagaugcugauuugucgaucgauuauuucucaaaggguaaaaugacaucaaaaaggcuuuuuuaggaugugguaacuuuuauaauuuuuauaauuuuuaauuuuuauuuacuuauuuauuuauuuauuuuugaaauggagucuugcucugucacccaggcuggagugcaguggcacaaucuugacucacugcaagcuccgccucccggguucacgccauucuccugccucagccucccaaguagcugggacuacaggcacccgccaccacgcccagcuaguuuuuuuguauuuuuaguagagacgagguuucaucauguuagccaggauggucucgaucuccugaccucgugauccacccgccucggccucccaaagugcugggauuacaggggugagccaccgcacccggccaggaugcaguaacuuuuaaaaagacuuuguacacuaacaaauauuuguuuucucauguauacaugagaaagagggaaagaugagaaagaguuaaagguuucuuaacgccuuauguaauuauaacaguuauggguacaagaaaaacaauggagaagaauggaacuaaauaacagccucauucucucugcugucauauuuuauuguaucuucaggucaaagugaucuggaaagaagccauuuuugcacgagaaagaacaaaaaugcaaaaaaaaaaaaaaaagaauauaaaguauuuaaucugaagucauccuuuuccuaugacuuuuauaaaaagcacaaaaaaugucuaaauuaguuacugucaucuuuaacucacuacuauuuauaucuccauacuuuuauuuuacaacuuagagaaaacauucuacuuucaucaaaauuuuaguuuuaauaaauaugcugcaaucuuagguuggaguuauuaagagagguggaguggucuuuucuccccacaaggaaaucuuuuauaauaaucuucaauaaaaaaaagaaagaaagaaagaaaaagaacuugcaaaacauuauguuuccauacaacuuuacaaaacacauuuucauauaugaaagacuacuauagagaagcaacauaaucaaacuguaaagccucuguuauggguugaauuugcccacuccucucccaaaaagauauguugaaauccuaacccccccaguaccucugaaugugaccuuacguugcagauguuacuaguuaaaaugagaucauacuggaguagagugggccccuaauccaauaugauuguuguccuuuuaagaagccaacaguaugaaaacagagacacagaaggagaaggccaugugaugacaaaggcaagagacuggaguaaagcagcugcaagccaacgacugccagcaaaccaucugaagcuaagguaaagcaagaaagguuuccccuccagguuucauggggaacacagcgcuguugacacccugauuuuggacuucuaaccuucagaacugugagacaacacauuucuguugucuuaagccaccuaguuugugauaccuuguuguggcaaacccaggaaaugaauacagccuccauuugaugaggagagcaaaaaaagucacacaaaucuaaguguuauaaucauguucacuauaauccauuacccaaucaaaacaggauuuuggccuugcuucaguguggucacugucuacauggucuccagcucaucaaaacggaauccacguuucuauuaaauaucccacuuauucaguaucuaggcuagacaguuaucuaggccaccaaguuuaauaaaagugugucuguuuucccauguguuacaggacagucguguucguauuuuauauuguacauauuuugaccagauaguacauacccauaguaaaacuggauaaaaagaaauguguuggccgggugcgguggcucacgccuguaaucccagcacuuugggaggcugaggcaggcagaucaugaggucaggaggucgagaccacccuggcuaacacggugaaacaccaucucuacuaaacaaaauacaaaaacuuagccgggcacgguggcgggcgccuguagucccagcuacuugggaggcugaggcaggagaauggcgugaacccgggagguggagcuugcagugagccgagaucgugccacugcacuccagccugggugacagagcaagacucugucucaaaaaaaaaaaaaaaaguguuucacccucacucuucuguccacaaaucauccuguuccccgcuccagagagaaacauuauuacuaguuuauucuauguuuuuccaguaagauuccaugcauuuauaaaaauacuauauauacuuauguaugugacgcauuuaaaugguagcauacucuacacauucugaaccuuuuguuaaccacuucacaugugucuuggagaccauucuguauauguagaacuuguuuuucauuugcaguacaauauuccauuauauggaugcaccauaauauauuuaaccaauccucuacagauagacauuaaggucacugccaauacuuaucuuuaucacgaugaugcuguaauagcuaucuuuuuuuguuguuuugguuuuuuguuuugguuugguuuuuuuuuuuucaaagucucaaucugucacccaggcuggagugcaauggcaucaacucagcuuacugcaaccuccaccuccuggguucaagugauucucaugccucagucucccaaguagcuaggauuacaggugcccaccuccaugccuauuuuuuuuuuuugagacuuagucucacucugccacccagaauggagcgcaguggcaugaucucggcucacugcaaccuccgccucccagguucaagcgauuguccugcuucagccucccgaguagcugggacuacaggugcaugccaucacgccuggcuaauuuuuuguauuucuaguauagacaggguuucaccauguuagccaggauggucuugaucuccugaccucaugacccgcccaccucggccucccaaagugcugggacuacaggugugaaccacugcacccagccuaauuuuucuauuuuuaguagagacggaguucugccauguuggccaggcuggucucgaacuccugaccucaagugaucugcccgccucagccucccaaagggcuggaauuacaggcgugagccaccacgcccggccauguacuggcuuuuuauuauccuuucacugaacucuuucuuugccauccuauuuauaacugcaaucuccuguucccuacccuaguagucaccaucucccucccaugcuuuauuuuuccucauaguacuuuuuuaaguuaucuggcauucuauauauuucacucauuuguugcuugucuacaucaacuagaauguagggcuccauaaacacaagaacuuuugucucuuucauucgaaacuaaaucccuaguaucugagugucuggcaaauagcuagugcgcaguauuuauucaauaauugaaugguuuuauuugaucccagaaaagggacaacauaccuuuccuucaaggcaaaguaagucacaguucccaaacugaugaguaauuuguccucuuuaucuuguauuaauuuucuauauuaugucaaauaaaauuauuauauuuuugugugauccagauuuggaucacagaguauaucagauuggauauacucugugaagccaggaauucccaauuuaauucagccuauccgcuuaaagauaauguuuucuggucuuucucaauauugugcguacuuuucaaacaguguauacuugacucugcauccuuguauguaguggcccuccugcauugacaauaucauuaacacacaauuucuucuaccagcuguacauuuucaccagaagaguggcucagugugacauuacuuccaguaaauacaggggguccugaaaugccaacuagcuuaucuuaaagcagccaauacauaucgaauuugucccaguugccuuuauaaggaguuaagacacgcaguaaguugcgucacucuauggcagagcgaucagucuguauuucagucaggaccuggcacaccagggccuaaaaguaaaaugacuguugacaaacuguucauugggaaggggagaagguaauacuuuacagaaaaauaaagaacauaagaaaaguaaguucuuacuugucuuagccuguucaggcugcuauaacaaaauaccauaaacuagguagccuauacacaaugaaaauuuguuucucauaguuguggaagcugggaaguccaagaucaaggcacugguggauucagagucuggugagggcccacuuuuuuuuuuuuuuuuuuugagacggaguuuugcucucgucacccaggcuagagugcaguggccugaucuccacucacugcaaccuccgccucccggguucaagcgauucuccugccucagccgccccgguaaccgggauuacaggcacccgccaccacguccagcuaauuuuuguauuuuuaguagaaacaggguuucaccauguugggcaggcuaguccugaacuccugaccucaggugaucugccugccuuggccucccaaagugcugggauuacagacgugagccaccgugcccggcugagggcccacuuucucuuagacgguaccuucucacuguaucuucacaugguagaaggguagagcuaacucucuggggucucuuuuacaagagcacuaaucccauucaugagggccuaaucaucucucaaaggccucaccuccuauuaccaucacguugcggguuagaauuucaacauaugaauuugagggguggggaagagagacgcaaauauucagaucagagcauuauucauuuuuagauuauuaaaaucugacaaaugugcaaguaguauuaucaaaauaucucuaucuguucauucauucaacauucaaaugaacaacuauguucuuuugcuguauuauaguuuguuucuguuuuuuuuuuuuuuuuuuuuuuuuuuuugagacagggucucgcacugucacccaggcugagugggugcaaucucagcucacugcagccucaaucuccugugcucaagcgauccucccaccucaggcucccaaggagcugggacuacagguguaugccaccaugccaggcugauuuuuauuuuauuauuauuuuuauuuuuuugguagagaugggguuuugccauauuucucagacuggucuugaacuaucacuugagaucugccaaccucagccucccaaagugcugggauuacaggcacaagccaccacacccagcccuaacuguguacuuuuaaauuaccaaguuuuuuguuuuuuguuuuuuuuuuuuuuuugagauggagucucacucugucacccgggcuggagugcagucucggcucacugcaaccuccgcuuccuggguugaagcaauucuccugccucagccucccaaguggcugggauuacaggcaugugccaccauaccaggcuaauuuuuguauuuuuaguagagauggguuuucaccauguuggccaggcuagucucuaacuccugacuucaggugauccacccgccucagccucccaaagugcugggauuacagaugugagccacuguguccagcugggaagauauuauuauuaucuuuuuuuuuuuuuuuuuuuuuuuuuggugagacagagucuuacucugucaccaggcuggagugcagugguacaaucucggaucacugcaaccuccgccucccaggcucaagcgauucuccugccucagccucccgaguaguugagacaacaggcaugcgccaccaugccuagcuaauuuuuuauuuaguagagaugggguuucaccauguuagccaggauggucucaaucucuugaccucgugauccguccaccucugccucccaaugugcugggauuacaggugugagccaccacacccagccaaagauacucauuuuuaagaugcuuaauaaucaagaguuaauuccaagagaacauaacagacugguuuccuaacuaauuucuccccacuucuacauauguacaaccuugucuauuaugaagugccaaauaaacccuuaacuuaccaaagaaaccaucagaaaggcugaugagucccgggugguguuuguuauaucaguauuuuugaaggguuauuuguauuuaaagagcagagggaaaagguaauauaaaacuugcaagauuacuuagauguaaauggcagucuugaucuuacauguauuuugaaaacuauuucuaaagaagaauucauauuuuuaaaaaaguuauggcuauaaaacaauaauuuggagauuuacuucuuuaaugagaaaaaggagcaugcuggacucuauaauauuauauuuagucuuuuaauguaccaaacugaguucaagggaaggagaaaaaaaagaguaacuaaacaaaauaaagaucaaagugaaaacaaauccuucaaaaacguaguuuucaauuccgaguggauaguaaaauaaacuggugagcuucuaaagcaauauuaaugccaaagccccacaucagacaaauuaaucaauuccuaggagugguucccaggaaccuguguuuuguuaaggguaccaccagacuauuuuaguguacugccaggguagggaaccaccauucugaauaaguccuuuuuuaaaaaaaaaaucauauacauaaauucauggaccauaauaauucaccuucauuauauaaacauuuuauaagugauuaagauaugacaauuugacauggcuaaccaaauagcauuaagaaauaauuaaaaaacaacaacuacagaccacagaacaaucuuacuuacaaaucaggcacacuuauaaauauuucucuauaaggcuucuugugaaagcccuccccauacccaagaguuuuuauauugaccgauguuuucuccuaguauuuuuaagguuuuccuuuuuuaucuugaacucugggaaaaaucaagaauuuaccuugguauggaguaaaagacaaagauacaguuuucuuuuuuucuaauuuuuauauuuuggcaaucacuuccaugagguucuaauuacuauguucgcuggccuguaaaguacuauaaaaacuacgcugguuucaucauaaaagucaguuauggccaggcaugguggcucaugccuauaauccuaccacucugggaggacgaggugugcagaucacuugagcccaggaguuugagaucagccugggcaacauggccaaaucccgucucuacuaaaaauacaaaaauuaaccagccagccuggugccagccuguagucucugcuacucaggagucugagaugggaggaucauuugagcccugggagguggaggcugccauugaccccgcgccacugcacuccagccugggcgacagagccauacccugucucaaaaaaaaaaaaaacaaaaaaaaaaaaagaaagaaaaaagaagcagccaguuauacaguuucucaaaacuuucaagguaaaauuaaaaagugaaauaauuuacuucaaaagauaaauacacgauaccaauuaaggcagaagauaagcuguucccuuaacucaagaguccucaacccaguauaagguuugauacuuuccaggggguacacaggucuagacaauuuuaaggaaaucaauuuucagaucaccaacugccuuuugugcucuucuaaaauugacguauccaagcacgauuccuugucucuuccaucuuuccuuucacaauagcucuucuauguuauaaaagaaagucaaggccagacacaguagcucacaccuauaaucguagcacuuugggagguggaggcaggaggaucacuuuaggccaggaggugaagaccagccugggcaacauagugagacccugucucuacaaaaguaaaauaaaauaauuagccaagaaugguggcacgcaccugugauccuagcuacucaaaaggcugaggcaaaaggacuacuugagcccaggaguuugaggcugcaguagugaguuaugacugugccacucuacuacagcuuaggugacagagcgagucccuguuucuaagaaggaaaaaaaaaaagucauuucucuuauucaucucaaguuuuaacauguuccuuaccucaagaaaucuccaaugcaccaaaaggacaauugggagagacuggggaaaagucucaugugagcaaaacaagaaauacugaaagaaaugaugccuuaugcuacaaacucuuuuuuuuuuuuuugagacagagucucgcucugucacccaggcuggagugcaguggugcgaucucagcucacugcaagcucugccuccuggguucaugccauucuccugccucagccuccagaguagcugggacuacaggcgcgugccaccacgcccagcuaauuuuuuguauuuuuuaguagagacaggguuucaccauguucgccaggauggucucgaucuccugaccucgugauucacccgccucggccucccaaagugcugggauuacaggcgugagccacugcacccggccuaugcuacaaacucuugacaugacuccuugcuuuaucaaccugucuuagaaguagaaagugaaagucacugagugcagguaccgauguguuucuuagaauuaaaaauaaaaccacuucugaugagaaaacauacuccauuuggcugguuugacuaugaggaccagcaauuagauuuuauagcaguacuucccauuaaagugaauaaccaaaaucacuuuaaggucaagaucuuagucaauacauuauguaaaaacauauacaacagacaauacaccagaaacuaaaucuuuugcaaccuuuuaaacuuaugaugaaaaacauuaaugucagcucuaaaauguauuaagcaguuuuuacaaaaaaaauguauagaauacaggagccaaaacauuuaacaauuacccuaacuugcugacacagaauacuauuaauaaauaauacugaucaaagaaaaguaaucaauuugaaaagugguggggguagaaggaacaacaacaacccuuaaauuucagugccugaaaaugucuauaccaaagccucauuccuugcuccuccaaaguagucaauagcaucucuaaagcaguuaaguuuccagguccuugccaaaguagucaguagguaucucuaaagcaguuaaguuuccaggucaaccuaacuuucuguugcaagcaacaaaugguaccagaagcuaaaaaucccuaauuugcucucaaauacuuagugaagaaucuaccaggcccaguggcucaaaccuauauucccagcuaucucagauacugaggcagaaggaucaucugaagccagggguuuggggcuguagugagguaugacugcaccacugcacuucagccuggaccauagagugaggcucucucuaaaaaaaaaggaaucgaaauuacaguauuuggaaguuauuuagcauauggcuuuuuaaugagacacucaccauacugaaacuacucaauaggcugauauuucaugaaacuugggagguagaaauaucuucagauaaaaaaauuacacuuaaguaucuucuagcauucucaaaacuuuauuuuaucaggaacuaaaaaguguaacaucuugauuccacauuauaagaggaaaaguugcauuuacuaguucacauacuauuuuuaaacauuaccacaauuuuuuuuuuuuuugaggcagggucucccucugucacccaggcuggaguguagugggaugaucaugacccacuguagccucaaccuccggggcuuaagcaauccuucuaaguagcugggaccaccaugccaagcuaauuuauuuauuuacuuuuuugauagagauagagucucacuauuuugcccaggccggucucaaacuccugggcucaugcgauccaccugccuccguuucucaaagugcugggauuaugggugugagccaccacgcccggccacuucucccauuuuugacaaaauaauaaauggagguaaaauaaucaaauaauaaaagaaaaaaaauuacauauuaauucaauucuauaaaagcccaacuauuagggaaaaaaguauggagacuuuuacaucuauuggcaauauuuuaccuauucaauccaaagagaaacacacuacaaagaaaauuucgguaggauauggugcuucacaccuguaauuccaacacuuugggaggccgaagagggcggaucacuggaaccuaguaguucgagaccagccugggcaacauggcggagccccaucucuacaaaaaaaugcaaaaaaaaagaaaaaaaagcugggcaugguggcacacaccuauagucccaccgacuugggaggcugaggugggagaaucaccugaccgcaggaaguugaggcugcagugagacaugaucgugccacugcacucgccugggcaucagagugagauccugucucaaaaaaaaaaaagaaaaagaaaaaaaauucuacaaacauccauuuacuuccaaugaaacacuacaacugacacauuaugaaaauagaacaucaaugguucagauuaaaagaaaagaaaaauuucugaacaaaucaaaucuaaguugaauauuguuaaccuuaccaccuuuaaaauacagcugacccaaggccgggcgaggugacucacgccuguaaucccagcacuuugggaggccaaggcggguggauuaccugaggucaggaguuugagaccagcauggccaacauggugaaacccagucucuacuaaaaauacaaaaauuagcugggcaugguggcgggccccuauaaucccagcuacuugggagacugaggcacgagaaucgcuugaacccaggaggcagagguugcagucagccaagauugcgccacugcacuccagccugggcgacagagcaaaacuccaucuaaaaaaauaaaauagaauaaaauaguaaauaaaauacaguugacccaugaacuacacagggauuauggucccggcaaccugucagccccucacuccaucaaaaaucugcaaguaacuuuugacucccaaaaguuaauagccuacugcugaccaggagccuuacauuaacagaaacaguccauuaacauguaucuaguauauguauuauauauuguauuauuacaauaaauuaagcuagagaaaagaaaauguuaagaaaaucauaaagaagagaaaauauaauuacuauucauuaaguggaguagaucaucauaaagucuucauccuuaucaucuucaaguugaguagacugaagagaaggaggaaaaggagggguuggucucgcugucucagggguggcagaggcuaaagaaagccuacauguaaguggaauugcacgguucaaacccauguuguucaagggucaacuguacgcugaguauaaagccuuauuaccuaguaaacagaggcuucugaaggcuagucaugaaauaguuggcauucauucccucucaccacucccuauacgugccuucuuguacgucaagggcaggaaugcuuuauuuaaaaaaaaaaaaaaaaaaaaaaacuggccaggugcauuugcucaugccuauaaucccagcauuuugagaggccaaggcaggaggaucacuuaagcccaggaguucaagaccagacugggcaauacagugagaucccaucuccacaaaaaacaauuuuuuuaauuagcuggguguggugaugagcaccuauagucccagcuacuaaggaggaccucuugagccggggaggacugcuugggcccaggaggauugcuugagcccaggagguugaggcugcagugagccaagaucaugucacugcacuccagcaugggugacacagugagacccuguccccccaaccaaaaaaaaaaaaaaaaagcuacauuucccagacuuuccuuuacaguuaguauuggaaaugcaaacaagguucugcuaguuagacagccucuuaugagauuuguaaagcagaagugauaauggaagcuaucuuucuguugcugauuuaaguggugagcaaugacacaaagaagguuuagaaacaauugugauagccuaacucuacucaccagauauaaaggcaacuggaagaagcugugguaccagauucaguguuccuaugacuacuuaccaguuuguuuccugaccucucagucacagcuaugggcuuauguucuugaauauauuaaucuagugauaacccucugauuccagcucuuccagaccaugcaaugauuuuguaaguaccaaauugccuaccauaagauaucuuucugccuaaaaauccuagaauagaguuuguuucuugcaaggagcucugaaagaaacaauacuguucauuaugcuuaaaauaugcauugccuguauuuuuccucucccucauuucagaagucaaauacacaagaauuauucuacacugcuauuauaaauugaaaugcuuagguccaugugaaaaauuaaaaguucucuuagccauagucagaaauuauuuuauuuauaauauaugcuaaucaugaaucaauauagaauauuaacacuccuuacacugaugauccugcuuuucuuggcugaauaaauuuauaucaguaacauacaaagauacagcuacuguugguuuuacgguuuuggguuuuauuuuggggcggggggagcaacagggucucacucugucacccaggcuggagcacaacccgagcucacuacagccucaaccuuccaggcuccagagaucuuccugucucagccuccugaguugcugggacaaagguguauaccaccucaccaggcaauuuuuuuuuuuuuucagagacaggguuuuuuuauguuguccaagcuggucucaaacuccagggcucaagcaauccucccaccuuguccucccaaagugcugggauuacaggaaugagccacugugccuggucuggguuuuguuuuuuuagagauagggucucauuauguuguccaggcuagacucaaguccuuuggcucaagcaauccucucaccucagccucccauguagcugggacuaaagcgcacaccaccauaggcaaccucuauuaucauuuaaaaaaacuauucuuuuacuuugauuauaaaaggaauauaugaucauuguaaaaaguguggaaaauauagaaacauuuuuaaauugggggcugggcccaguagcuuacaucuguaaucacagugcuuuaggaggcuaaggcacaggauugcuugagcccaggaguucacaaccaaccugggcaacagagcaagacccuaucucuaccaaaaaaaauuuuuaaauuagcugggcaugaugacaugugccuguaguccuaacuacucaggaggcugaggugcgaggcuuacuugagcccuggaguucgagguuacaccaaguaugaucacacuacugcacuccauccugggcaacagaggagacuaagaaaauuaaaaauaaagaaauuaauaaccaucccccaaaaccagguacacugaacaguuguacacguacaauuuuguauccuacuuuagcacucuaacaauuguuuuccuuugaaauccuuuacaaugaauuacuaauaaaagauauaugcagauguaccuaauuuaacgacucuuuuuuguuaaaaauuaagguaauuuucaauuuuuuaaaauuauaacuaaugcuucacugaauacuuuuggauaaaaagcuuucugaaggauaaauguguuauauccaugcaaugggacauuauucagccauuaaaaggaaugaaguacugauacauaccacaacauggauaaaccuugaacauauuaugcuaagugaaagaagccaauuacaaaaggccacauauuuccuacacggcugauggaaacguaaaacuaugcagccacuuuagaaaacagacuagcaguucugcaaaauauuaaacacagaguuaccauacaacccagcaacucuacuccuagguauauauacccaagauaaauuaaaacaaauccaugcaaaaacuuguacaugaauguucauauuuauagcagcauuauucauaacugaaaugugcaaacaacccaacguccauucacugauaaauggacaaauaaaauacuguauaagcauucaacagaauaauauucagccauaaaagagaaugaugggccuggcgcaguggcucacaccuguaaucccagcacuuuggcaggccgagaugggcggaucaccugaggucgggaguucaagaccagccugaacaacauggagaaaccucgucuccauuaaaaauacaaaauuagccaggcaugguggcacaggccugcaaucccaguuacuugggaggcugaggcaggagaaucacuugaacccaggaggcagagguugcagugggccgagaucacaccacugcacuccagccuggauaacaagagcgaaacuccaucucaaaaaaaaaaaagagaaugauguacugauacaugcuauaugaauaaaucuugaaacauuaugcuaaaugaaaaaagccagacacaaaaggucacauaucgcaugauuccacuuacauuaaauguccaaagaggcaaaucuagaaagagaaaauauguaaacggcuaucagaggauguggggagggaagaacagaaaugacuacucauuuuguuuuggggugaugaaaauauaaaauuaguagcaacgguuguacaacacugacuuauguaaaaaaggugauuuuggccaggcgcaguggcucaugccuguaaucccagcacuuugggaggccaaggcgggcagaucaccugaggucaggaguucgagaccagccugaacaacauggagaaaccccaucucuacuaaaaauacaaaauuagccaggcaugguggcacaugccuguaaucccaucuacucgggaggcugaggcaggagaaucgcuugaacccgggagguggaggcugcggugagccgagacugcaccacugcacuccagccugggcaacaagagugaaccuccaucuuaaaaaaaaaaaaaaagggccaggugcaguggcucacacuuguaaucccaggacuuugggaggccaaggcaggcgcaucacgaggucaggagaucaagaccauccuggcuaauauggugaaaccccgucucuacuaaaaauacaaaaacauuagccaggcaugguggcgggcaccuguagucccagcuacucgggaggcugaggcaggagaauggcaugaacccgggaggcggagcuugcagugagccgagaucgcgccacugcacuccagccuaggugacagagcaagauuccaucucaauaauaauaauuuuaaaaaggugauuuuuuaugugaauuaucucaauuagggugucauuaaggaaggaaaauaaccuccucuccccccaaagaagaaaaaaaaagguuacuuccuuagaauaaucucucagaaguggaaauacacacaaauaugccaaagcgcuuuugaaacagguuccagauuuauacuaccuccaacaacauauuuaguaccugugucaucacuguacucaggucugaacaagcaccauuccuuaaaccuuaaaucugauaagagaaacuugcuauuguuuauuacuuuaaaaaugaacacuuucuccccauaucuuaaucauaaacuuuucaaauggucaguucuuagccuuuaaaagugacuucucuauguauauaacacaaauguuucgauuucucaggaaauguagaaauggacuuucuuacaauuuuggucagcaauaauuaacucauccuaacucaguucuauuucagcuuuuaaccuuaaaacuuuccuuuaagucacauauuuuuaaaacaguccgaaaaacuacucuccuccuuagacagggaaauuaaaauuucccugaaagaucacuaccuggguuauacauguuucuaguuuccugauggcacuuaacuuucaagugaaauguccaaguggcucccaagacauuuuaaaacgauaugguauuguugaaaggaaauuaaacauuuauuaacaucuuauucuacaagccaaaugcuuuaugugcauuacuucauuuaauccuaacaaauguauuacucucacuuaacugaaaaggaaaaugaaaaucaccaacgguaagaacuugccacgcagcaaauaugcagcaaaguuagagaucaaaucgaggugugucuaaauuucaaaguccauauucuuucugccacuuuacaaugcuuuccaagcuaaaugacuauggaaaaucaggcaagacuuugaauacuuguucugccacuuacugugugacuaauuucuaaacuucuucagaguagaguuuacaaaaacaaggucacuguucacaaaauaaaucuuaaaagaggaggcuaaaaauucacugugagaugaaacuuucuuuaaauacuauuuuuucaacagcaaaauguauggaauaauucuaaacacuuuucuagaauuuguuucaagauucacuuuaccuuccaacagaggcacuugcauauccacucacaaacauguaauguagauaaaaaacacuucuuuaggggcugucaagucucuucuguagaccacaaaugcaucauuucucaguagaaaaggccacaucaacuacauugcucuuuacucuucuuuaccacaugagaaauguuuucagcaacauauacaccauucaggaaguagcacaaggggguaagagaaaaagcuacugaagagaaaaagacuggaggagcuugugagcaagcagugauacaacacagaaaggacgagguuaagaacaauaaaaaugaaggcaagacaucagcggucuacucuaccccagguaauggauaucacugugaucaaggaaaaauccuuaaaggaucuuugauuugcuuuuacaauugcuauuuaacgacccaaacaaccacuugacaaauuuggaacuggugauuuccaaagaaugcaauauaccaauauauaugagcaauucuuccacaaggauuuuucacauucauaaaacaaaaaucaaaggaaacauuaacauaagaauucuuacaugcuaaaauuuuuccaagaacuauuucacuccucauucucacacauaaaaaggguagcaauaucuaauaaaauugucauacuacagauagaugaaggccuucaauaaaacacaguuuucuuccaaaauuauuuuacuauuaaaggaucagucggacuuggacagacuaaaaaauauaaacuuaucuacaggcucauauuuuacccuagggcuauuauuaaaauaauucugcuguacauagaauccugaaugguuuucaucagcuaguauaaaacaaucaggcuauugugcaaugguaagagggcucuuaagaaaaaaauuacugcugaaaguaauucuuuucuccaguugacuuaccacauucuacucucuauaaacaccauuguuuuuaaucacaacuuuaccuacagcuuuauccucgucaaacagaauuuucacuuuccaauaugacccuuucaaacugaaguaauaaaaaguaauacuuuuaugauaauauucguuaaagugaaaugucagagucuauguaagauuuugugaaaaaacauauauucauauugagguaucuggaaggauguucaucaaaacaugaccacugacuaguuauuauauuuuagggugguaggauuaaaacuuuuuccuuagcuuguauauacuuucugauguucuacauuaaauacaguuugugugugugcauaaaagagaauaauuucaguuaaaggguaagaaauguagaccccauauuuuaauucaguagcaccaguucaaauccaguuauucagaauuaacaaagcaacuguugcucaaaaaaugccaauaaacucccgagccaacuaaguucaauuuuucuuugagacagggucuugcucugucauccaggcuggagugcaguggugugagcucagcucacugaagccuugacauccuaggcucaagcaaccucccaccucagcccccaaggagcuggggucauaaacacacucaugcccagcuaauuuuuguauuuuuuauagagauaggguuucacccuguugccugggcugaucucgaacuccuguacucaagcaaucgcccaccucagccucccaaagugccgggauuacaagcgugagccaaccacugugcccagucucagaguucaauuuuuaaacaauaauuuuucuccagucagaaaaugcugccuguaacuuugugucucuuuaaagaacugggggagaagguagagggagaguguggaaaacggacuggaauguccaggugaccacaggaaagguaacaggaaaaaacuugagaaaacaagacaacaccauuucauugauuuguaaaagaaaucacagaguagaagaaaguaaauuaucagagaaaguaagcaagcacuuaaaggguaauaaguaaaagcagaaaaaaaaguuaaaaaaaauugaacucaggaguauuuauguaaauuauucugaaagggggggggggagggcugagaaaaugcuauauaacaaacugaaucaguucugcuuucuugaccagaaaaguaacgccuuucaauaaucuuauuuagcauaagcaguaaaaccaagaacacucugucagaggaucugaagaucuuuugugccugcuuuggaaugaacuauuagauacacaguuaaacaauauacaaacauauaaauagcacauuuuaugcaauaaaugaaucuagaaguaaucaucagauguaaagagaacauaacuuugaaaaagaagguaaaagcacugauauaacuccacugaccaccauaaagaaauuucuuuaaaccaaaauaaguaauucuacuagacuaaaccauaagaaauugccaauauucaccaggugugguggcuuacgccuguaaucccagagcuuugggagaucgaggcaugcgcaucacuugagguugggaguucaagaccagucuggccaacaugaugaaacccuguuucuacuaaaaauacaaaaauuagucgggcgugguggugcacaccuguagucucaccuacucgggaggcugaggcaggagaaucacuugaaccuaggaggcagagguugcagugagccaagaccaagccacugcacucuagccugggcaacaaacagacucugucuuuaaaaaaaaaaaagaagggaggggagaagagaggagaggggagaggagaggggaggggagggggaggggaggggaggggggaggggaggggagaggaaaggaaaggaacugccaauauucaagcauuuuuuuugucuauaaaaacaacaauuucauauggucccacugccaguggucugcugauaaauauuugaccaccucuuugagaaaagggccccugauuuguagcuucugcagucugccaugcuguaaaugucccaccauggccaguuucaagcuacuaacaugaugucacacauggagcuggagagagaggcacaaucagcuaaccaguuccagcacaacacuggcuccacuuaacuacucugaucuaagaaucaucacaacaguuccuaaauuuucucauccuuuucuaaaacaggcuuuuaucggaauaauccaguuucuuuucuagguuaggagaaauaggcuuuugacauuuuaaauuauuaauacacuaaaaucacucacaaggaagaauaggccaggcgcaguggcacacaucuguaaucccagcacuuugggaggcccaggcgggaucucccaaauguggaucacauucucaacuagccuagccaacaaggagaaaccccaucucuacuaaaaauaaaaaauuggcuagcgugguggcacacaccuggaaucccagcuacuuggguggcugaggcacaagaauugauaggaccaaaggcugcagugaguccugaucaugccacugaacuccagccugggagacagagcaagacuccauuucaaaaaaaaaguggggggaauagaugaaauugguaccuggcuuuauccucucaacacuuuuuuuuacugaacaccuuuuggugccaguauuguuucgggcauuguagacagcaaggaauaagacaaaggaagucccuacugucauaaaaauuaauuuuaaaaaacacauaauuucaaggacucacaaauggcaugaagaaauuaaaacagugauggggaggaccuauuuuuaacugaguggugaggaagcaggaggugauauuuaagcugagauuggaaagguaaagggccaggcuaaaaaacaucugggaaaacaccauuucaaacaaaggaaacaaccaguguaaaagcucuaagccaaggccaagaauggcauguuugagaaacugaacagacuaacuuggccagaguguagugagcaaaggugagauaauaggcuguuagggccaaauuauguacagacuguugaguuuguauuuucugggugaguacaguuuauaucuuauucugaauggguugagaaacaacuucacauaguaguuugauaaauguacugaauggaauaaaugaaggcauaaugucaugcauuauuuuaaugaccccuuaugagacuggggucacaccuauuaauuguauucaguuuucucaauaugaccacuuugauuacuuaauaaucuaaacagaacauuaugaaguuaaaguaggauggcgggcaucaaacuaugaauacagcugaaauaaacugagugguaggacuacacaccagcucagaaacaaggaucucauuaauccaagaugguuaugugugaaaugcuaacauaugaauucaacuaggucaaugucaaauucuaaugaaaacuaccuagucuauaaaauagauuauuucaaaauuguaaagaaacacuucuagugugucauccaacaugaugauuuuauuugguauguaaacaggcuuuuuaaaaauuauaauggucgccaagugcgguggcucacgccuguaaucccagcaguuugggaggccgaggugggcggaucaucugaggucaggaguucaagaccagccuggccaacauggugaaaccccaccucuacuaaaaauacaaaaaaaaauaaaaaaauuagcugggcaugauggugcaugccuguaaucccagcuacuagggaggcugaagcaggagaauugcuugaagccaggaggcagagauugcagugaaccaaaauugcaccacuacauucccaccugggugacagagcaagucuccaucucaaaaaaaaaaaaaaaaauucuaauggucauguuuauaugagagucuaaauuguaucugcauauuacaaaaacuguaaagauauauauacacacccacacacacauuguggcgauaugaaagucccacaauacaagucaauaaagacauaaauuauugcauauuauacaaaaaugggaaaauguuuacacugguuuaucgagaauaauuuauacuugcacacaaacauuaucucuuuaauucaccaacuucuaagccaccuauuuuaacaacuuaucuaaaagauuuuuuuuuuuuuugaaacagggucucauucugucacccaggguagacugcaguggugagaucucggcucacugcagccucaaccuucuaggcucaagcaauccgcccaccucagccuccugaguaggagggacuauggguguacaggccuggcuaauuuuucuauuuuuuuuuuuuuuuuguagaugggguuucgccucguugcccagacuggucucgaacuccugagcucaagcaauccacucaccucagccucccaaagugcugggacuacagacuuagccuaucgcaccuggccaagauuuuuuucuuaaucaaccaacagcaaaugagaucuacagcucaggaaaaaaaaaaaaaaucuugucuugacauaaugaaauaccagaacuucacaagucauuaauuucuuuugcacuuucauuucccaacuaucaguaaaauugcaguuuuaguauguacaagcauuuuuaggaacacaaauauguauaugcauuuaauaaauacuacucaauagaguuguguacauuauuguagcugcuaguuuaccauggaaauauaauaaauauacgcuuuuuuuuuugaaaggagaguaacuaggcaguacaguacuaagaggacaggcauacuaauaacuuuuuguagacuaaaaaaaaucccucccuaaaacugugagacuucuauuugagcuuucaaaaaaaaaugcacaggauaccaucgagcuaucucaguaacaguaacugccuuucuuuaacaaaagaaguuuagcaaaaacuagcaagaaaagaaaagaaaagaaaagaaaaauaaugaaguuuuggcacccaaucucauuugagccuacaucccugauaaaaagaaaauuauacggccaggugcaguggcucacaccuguaaucccagcacuuuggaaggcccagguggguggaucacuugaggucaggaguuugagaccagccuggccaauauggugaaaccuggucccuacuaaaaacaaaauuagccuggccuggugguggacuccuguaaucccagcuacuugggaggcugaggcacaagaauugcuugaauccgggagacggaguuugcagugagccgagaucacaccaccgcacucuagccugggcuaaagagcgagacucagucucaaaaaaaaaaaaaaaagauuacaauauaguccaaauugaagggucuaaguccauguaaaucaccaacacucagaauugaagaaacaucacuuuaaaaaaaaauagcgcaagcccaaaauagguuuuuuuaaggugcugucacccuacuaccaaaucagguuuuccuuuucuuuauuccaucaguuuaucuccuuuccuuuccuaccuccucugucccuuaccauuuuacuguguauuuucacuuuacauacacaaaaauugauuugaaacuuacuucauacucuugcaucuaaauuuguuucuacuuaauucuuacaggacuacaugguuuuaggugaaauucaaauacuuuuaguuauagaaacauucauauaagcuguaaccaaagacaugagugacaagauuaacagucauucauucaggaaauguugaguccccauuaugugcucuccacuguucugaauacuggggauucugcagugaauaaaacgaagcucuauuccuacuagcacuaaagcaacacuaugcuuggcaaguucaagaccucagggaggucuauauguggccagaguggaagaagccaaggagaaacugguaagacaugaaaucagacaagcaggacguacagacgaugaagggucaagacuucuugaauacuuagguauuaaguauucugguuuuuauaaacgauauggaaagccacuaaggguuugaacacaggaguaaaauaaucagacuuucauuuucaaaagaucgcccuuguugcugguuugagaacagaaaacagcagaagcagcauguagagacuacuaaaauaauacaugcaagagacgaugguugcuuacagagguggcagcagaugaagagagcaaauugugguuacauuuauucuuauggcaguuuuuaagauagauaagggacauguuuucaugcuaauuauuugaaucacaugugggaguaugagaaagaagagagucaagaaugucuacuagguuuuuggccaaagaaacugaaagauggaguugacauuuaauaggaugaggaagacgggaauggggacaauuacugggguggaggggugauggagaagagggaggacaaggaguucaguugugacauuaaaucugggaugccuauuagaaaucuacuuaaaaaugcggaguacgcaaauggauacagaagucuggagguaggaaacagauccagacuaaagauaacauuuuuaguuugaaauauauaauucuaggcugggcgcaguagcucacgccuguagucccagcacuuuggggggcccaggcaggcagaucacuugagcccaagaccagccugggcaacaugaugaaaacccaucucuauaaaaauacaaaaaacuagccggaugugguggcacauaccuguggucccagcuacuuggaagacuaagguaggaggaucaccugagcccgggaggucaaggccacagugagcuaagaucacgccacuguacuccagccuggaggaugagcaaggcccugccucaagaaaaaaaaacuuuuuuuuuuuuuuuugagacggagucucugucgccaggcuggagugcaguggugcgaucuuggcucacugcaagcuccgccuccuggguucacaccauucuccugccucagccucccuagucgcugggacuacaagcaccagccgccacgccuggcuaauuuuuuuuuguauuuuuaguagagacgggguuucaccauguuagccaggauggucucgaucuccugaccucgugaucugccugccucagccucccaaagugcugggauuacaggcaugagccaccgcgccuggccaagaaaaaguuuuuuaauuaaaaaaaaaaauaaggcugggcgcaguggcucaugccuauaaucccagcacuuugggaggccaagcugggcagaucacuugaagucaagaguuugagaccagccuggccaucauggugaaacccaaucucuacuaaaaauacaaaaauaagccgggcguggugaugggcgccuguagucccagguacucgggaggcugagacaggagaaucacuugaacccaggaggcggagguugcagugagccaagaucacgccacugcacuccagccugggcaacagagcaagacucuaucucaaaaaaaaaaaaaaauuauaaaaaaauguaaaauauauauauauguauauaauucuagcuagacagaaugagaucacaggggacuaaaacuaaauauaaauauagaagaggucuaaacauaugucccugaaacacugccucauuuuuuagaaguuggggcaaugaaaaggaaccaacaaaagaaacugaaaacaggcaguaauaugccagaaacaaagggaagauuucaaacaugauguuaucaaccacaucaaaugcugcuauugcuucuacauccacugagauuaggcuugagaacuagggaauuuaccaccaacaaagucacucaauaaucucaaaaagagcuguuaugguagaaugaaagagaaaaaaagcagauuguaguggauccaaacaagacagggagcgcggaugacaacaaauauuuaccuuuuuggagaggaguaacuaaaggaagauguggcauuuggaaagguguuuuuuuaaagaugggagauauuucaauacaucuauaugcugauagggauaauccaguagaaauggggaaaugaugcagcucauuagaaugcaggagaaugagaugaauacugaagcaaugcaauguccuuaaaaggagaaaggagcacgaguggagaccaugaugacagaauaguaggaaaggcaaaguauggguaaagauacaaggagacguauaaaaguuuuauucugaucgcuuucauuuuuaacauacaggaaacaaggucaugagcugaaaaugaagaggaaaaaagggaggcuagagguuugacgagagguauuaaaaguaaucuguggugauuaaaucaggaaacguacuaggauuacagaaggauuaggccaggugcaguggcucacgcuuguaaucucaguauuuugggaggcuaaggcagguggaucacuugaggucaggagugagaguucgagaccagccuguccaacguggugaaacccugucucuauuaaaaaaaaauacaaaaaucagccgggcauggugaugggcgccuguaauuccagcuacucgggaggcugaggcaggagaaucacuugaaccugggaggcagaaguugcagugagccaagaucgcgccacugcacucuagccugagugacacagugagacuccaucucaaaaagcgaaaacaaaacaaaacaaaacaaaaacaaccagcaacacaaagggcccuccuuaggucaguggucaugaauuuaaagggagagccaggucagcuuggguguguuuuccucaaagcaugcucaacuucccagauguaugcuggaacagauggagaacuggacacaaaggguguggggguaaggguuuggccaggugaauuacaacagaagaaugccgcaagggaguugaauguguaugaaaaggcaaaauuauaauaguggaccacaaauuuaaggcaggguaaauacuccagugaggacauggaaggagguggucuugggacagcaaagaggugauggcagcaauggauuacagaucgcagacauacagaaguacuguugaagaaacguuuacagccaucccucgguauccaugggugauugguuccaggaacccugccccacccuggcccaaauccccagaugcugaagucccuuacauacauaaaauggcacaguauuugcauauaaccuaggcacauccaccuguauacuuuaaaucaucucuagacuauguauaccuaauaaaauauaaaugccauguauaauuguuauacuguagcuuuuuacccuuuuuguucuguuuuuucuuuuuaaauacuuuuuauccuuggcuggcuaaauccucagaugugaaaucugaugauuuggagggucuacugcauuuuauggaaggaguuggaaagacaggaugcugagaccccaguggaauuaaugaaauugugucuaugaaauauccucaauaaagcaugggcaguucugguuaaaauguuauagaacuaccuuaaagacuaaagaaaaaucucacccugggcaaagugaaccugcaagauaaaggaaacuggaaggcuaaauuggagcuggagaacuguaucacaggaauuauagcuggagcuuccuagacauagaauccucaaccacuuccagcacuccugaagaaagagucagcuuugcacaaccucgccaacucagaaggcaaaaaugccagaucacaaucagauaagccacaauaaaacuauaccuucccccaccuuccccccuauaucuuuucucuguaauccuaagcugcauccugaagugguaggaauaccauacugaagaagaccuggcaaaguaaaaagagaagccaacuaaguacgacucuuccuccaaaacaagcuucuagguucaaagcaguuuugagccaaagaaaaguucugaaaucuacaagaguuugaacacuacuauacuguaccuuuuaaugacuaaaauaaaacuauuauugacaagugaccagaagacuuuuuguuaccuaaaagugacuuaaaaagcuaucugaucacgcuaaaagcucaucuagaagcagagaaagacuuagucuacagggagaguuuugaaggcacagugaaaguuguauuuugcuuaaaccuuaccaaguuccacccauuaaaccuuucaguuccacagauacccauaaauucccucuauauauacgguguaaaacauacacaauguugaauguacucaaaauucauuuuugcuuuacuaaacaaaaagugaaaguuuuauuaagucaaaugaaacaaaaauaauuuuauguuguuguuuuuauuuuuuuauuuuuuucuuugagacggagucucacucuuucgcccaggcuggagugcaauggcgugaucucagcucacugcaagcucugccucccggguccaugccauucuccugccucagccucccuaguaucugggacuacaggugccugccaccacgcccggauaauuuuuuguaucuuuuaguagagaugggguuucaccguguuagccaggauggucuugaucuccugaccucaugaucugcccgccucagccucccaaagugcugggauuacaggcaugugccaccaugcccggccaguuguuuuuuuuuguuuguuuuuuuguuuuuuugagauacucuugcuccaucgcccaggcuggaguagaguggugccaucccagcucacugcaaccucugccuccuggguucaaguaauucuccugccucagacucccaaguggcugggauuacaggccugagccaccgcgcccggcuaacucuuguauuuuuaguagagaugggguuucaccauguuggccagguuggucucaaauucccgaacucagaugauccacccaccucggccucccaaagugcuaggauuacaggcgugagccagggcacccugccuguuuuguuuuuuuugagauggagucucgcucuguugcccaggcaggagugcaguggcgcaaucucggcucacugcagccucugucucccggguucacaugauucuccugccucagccucccaaguagcugggauuacaggcaugugccaccaugcuuggcuaauuuuuguauuuuuaguaaagacaagguuucauaggccaggcuggucucgaacuccugaccuuaggugauccacccaccucagccacccaaagugcugggauuacaggaaugagccaccacgcccggccaauaauuuuauguuuuaguacaagauaaaaaaauucgaucauacagauuaaauaugaaaucacagcaugaguuucuaaguggguaagcaagaaaacagauauaucagggcucauaauuuaguuauuucaaagguaccuagauuuaauaugaaauuaaccuaauacuuucuaggaaaaagagggaguauguuuuaccauaaucuauuugacuaaaauacauuaacagguauuuuacagugucaggauuaagacaacuuauuaccaagucuucuuggcauuucaauucaggaacucccuuuggaugagggcccaaagcagucucagcuaaauccugcacuacucauuauuuguuaguauuauagaaagauacaaguauacuuaagcuuugaaccaagguagcaggaugcauaaaacuaauaauuuaaaagcuaaauuccucgccuggcacgguggcucacgcuuguaauaccagcacuuuggaaggccaaggugggcggaucacgaggucaagcgaucgagaccauccuggccaacaaggugaaaccccggcucuacuaaaaauacaaaaauuagccaggcaugguggcacacgccuguagucccugcuacucgagaggcugagggaggacaguugcuugaacucaggaggcagagguugcaguaagccgagaugggaccacugcacuccagccuggcgacagacucugucucaaaaaaaaaaaaaaaaaaaaagcaauccgggugugguggcucaugcuuccaaucucagcacuuugggaggcuaaggcaggcagaucaccugaagucgggaguucgagaccagccucaccaacauggagaaaccccgucucuacuaaaaauacaaaauuagccgagcaugguggugcaugccuguaaucccagcuacucgggaggcugaggcaggagaauuguuugaaccggggagguggagguugcagugagccaagauuguaccauuucacuccacccugggcaacaagagugaaacuccgucucagaaaaaaaaaaagaaaaguuaaauuccaaguuuucccagguaguaugaaaaacauaagaaaaaaaugcccucaccuaacuagcaaguaaauauuaagaauaagcuugaccgggcacgguggcucacgccuguaauccuagcacuuugggaggccaagguggguggaucaccugaggucaagaguuugagaucagccugaugaccauggagaaacccugucuuuacuaaaaauauagaaauuagucaggcaugguggcagacaccuguaaucccagcuacucaggaggcugaggcaggagaaucacuugaacccaggagacagagguugcagugagccgagauugcgccauugcacuccagccugggggcaaagcaagacuccgucucaaaaaaaaaaaaaaaaaaaaaaaaaaagaauaagcauguacauguacuucucucaaguuccucucaagacgacacaggaaaacuauaaugucccccugagacugacuaaaacauuacuaacauuaaauauucaauaaaauguuaaaauauuuuucaugaaaauugagaauaagaacaauacagcagaucaaaaccaacacgcauuuuuaauuuugacaaaaaucuuauaaaaccuuaacaaacuaucccagacucauuuuaaagcagaugaggaaccuaaauaaacccuuucauaauuuuaaaaaagacaacugggacuuuaaaacauaacagcaaccuaucccagaaaauaaugugagaaauuaguuaugaaguauuuaaauaaacuuuuuuaaauuaaaacucucaugaucuacacaggcaaauaugagcacagcugcaauaugccauguuaguaucauuauuaaucacuuuauuaaucacaucugaggaaaaagaaaugcuuucuaaaucauucuaaaaggucuuacaaaaaaaugaacuacccucuccccaacagacacacauacccugaugaagaaaacaccaacauuucaaauauuccagcaauuauaacacaagauaauccugaaauuuauuuagccucaaaacauuaugaacuacuccaaggaaggaacaauacuuugaaaacacuaguauuuuuaagguacaaaaaaaaaaauuauggccuggcgugguggcucacgccuguaaucccagcacuuugggaggccaaggagggcagaucacgaggucaagagaccgagaccaucauggauggccaacacggugaaacccugucucuacuaaaaauacaaaaauuagccgggugugguggcacacaccuguagucccagcuacuugggaggcugaggcaggagaauugcuugaaccagggagguggagguugcagugagccgagaucgcgccacugcacuccagccuggcaacagagcaagacuccguuucaaaaaaaaaaaaaaaaaauuaugaguucugauuucuuggaaaaauauauuuuaacgcagcugcugauugucaagaauucugaugaugugcuuauccgaaaaaaaaaaaaaaaaaaaaaagccaaacacuuuuacuuaacacaucacaccuuauuuacuuguucuuuaucaucacuauuaccauuuacaaguagguuugucaucaacaccagacuaucagugguacauugucagguaacuucuuccgagaaauacacauuuaaagaaaaaguaucacaauucucuaucacuaaaauuugaagaauuacuuuccuuauuuuuucuagaaacaacaauaaaaagcuaacagcacacuuugggaggccgaggcgggcagaucacuugagaccaggaguucgagaccagccuggccaacacagagaaaccccgucucuuuuugaaaauacaaaaaauagggcauaguggcgcaugucuguaaucccagcuacaugggaggcugaggcaugagaauagcucgagccccaaaggcggagguugcaguaagccgagaucacaccgcugcacucuagccugggugacagagcgagacuucgucucgaaaaaaaaaaaaaaaagaaaaaaaaaagcuaauagccgguaaguccaaaaucugaaacuucuauuugaauguaaacauuaucuuuaacaauguauuaaguauuauaagcauuaacagucaaaacagcccacuuaaauacaaaaaagcuaacuauaaaaaaauuaauaucuacauuauuucauaauaaucaagacagacuuuggaucacauuagucuggauuccugaaauaaauaaaauauuacugcuuuuuaaacauauauaaauagauuaaaauaggcaacgcaaccuuauguucagaauaaaugcaaaacuacaaaucucauccuuuuaaauuaguaguuuuaucacaguugcaauacuaaaagauaaguccacauauggaaccacaaauuauuacuaauaauccuucccuuuuuagcacuaucaaguuuauaugcauuuauuuguaaguggugaacacaaggacaaaauaaaauuccugaaaugaagcuuuauuuuaaaacauuucuuauagaaaaggaaucuacuguuuaucucuggggauuuuuaaaaacagaaaauguuauuacaaagauuauuuacagaaaacaggaccagaaguacauuacccuucaauacacuguaccaaagucuccuaauagggaccagggagauaauaaaaacacuagcuuauuaaaugucuuccucccuucauuuuaaaauguagacagauucuauuaaacugacaauauaaaagcuuaacccaauaauuuuagcuguacaaaguuacuuauuaaccuuuaaaggcuguuaugaauuuacacuuccugcaguucaccugccaucuuucccaacugaaauagccacuagggguuuaagacagucaccacuugcgacaucaauaauaaggaaauaacuuugcauucaaguuuaagaaaaggauaauugcggauuuugccugugcccauaaacaggugcuuaaugaauaucuguugaguaaauggugacauuuuauuauauuagugcaacauuagcuuuucccccccuaaauuuagaguucucccuugcucaaaaagcagcaagaccauaccacagucccuucucaaaaacacauaaacuccuuuauucauaaugaaacagaaagcuggguuucaaaauacaaucccacucccucuuuaucuucuccauuauuuuuaaagauuagaaauaaggccuguuuuuaagaaacagaaaauguauaccaacuucucucaaaccaaaagagaaaauccaaauuugauauauauuuucuauguucauaauauugagaguaagaacggacuguucaucaacaguauguuaugugggacaaaaacuaaaaaacguauaucaaaaauacauacuguuugccgacauucuuuccuuaaucauaaucaaggaguaugugccuaaauuuuacuagaugugagauaagcuuugucugauauuucaagauucauucauucaacaaauacuuuacugagcacguacuauaagccaggcccuucaacgaaacauuuagauuuuguaaacugcacaucaccccccaaaauuccccuaaaaaagcuuaucauuuaaaauaauugcaagcuaaagaggaauccccaauguuguuucuuacacauagugaagucagcggaucggggcgcuuuuucagcuguuaaugcggcaucaaggagccgcuaccuaccacacccguugccuaaaaucgcaacuuaaagcugcaagcacuggguaaaacaaccuguaagaguagcucagcucccgcgacgagguagccaagggcuuucaagcccggggcccggggcgaaccgcggcaggacccgcggacugaacgcgucgggcgccucaggcgaagagucggagcuccggagccaggugucuuugcuccccgaaacccucaccuagagaccccgggcccuccccgcccgccccucgcaccacccucccgacuuccagacgugaaaaguuggggggagggggggggucugccuuuccauuuuacaucaggcggucaguuggcugccucagcuguccgccugccgugaauucugaacugagcguguaaccauuccucagaggaaacagaagaaaaaccaaaggcaggguccuagggcaugaggaccucgcccaaaccugaaauggaagacgcaggcucagcccacagcccgcagcgcgcggcuggcaaggccgggccgcgcucaccccagagcccucagggacgaggguucggggcuucgggaccccgcccaagggaccgagagggcgaggcguggcggccgacgcgcgacuggggcuggcauugcacucaccgucgccuuugucucagccgcccgcuccggccgcagccccucucagcgccggcuccgcggcuccugccgccccaacgccugcagcugcgcuccccagcgcgcucgcagcuuccuggcucccccuccccgcccaggcucgcgcgcggguugggcggagc

SEQ ID NO: 192233 - RNA, 130681 nt, Homo sapiens
gcuccgcccaacccgcgcgcgagccugggcggggagggggagccaggaagcugcgagcgcgcuggggagcgcagcugcaggcguuggggcggcaggagccgcggagccggcgcugagaggggcugcggccggagcgggcggcugagacaaaggcgacggugagugcaaugccagccccagucgcgcgucggccgccacgccucgcccucucggucccuugggcggggucccgaagccccgaacccucgucccugagggcucuggggugagcgcggcccggccuugccagccgcgcgcugcgggcugugggcugagccugcgucuuccauuucagguuugggcgagguccucaugcccuaggacccugccuuugguuuuucuucuguuuccucugaggaaugguuacacgcucaguucagaauucacggcaggcggacagcugaggcagccaacugaccgccugauguaaaauggaaaggcagacccccccccuccccccaacuuuucacgucuggaagucgggaggguggugcgaggggcgggcggggagggcccggggucucuaggugaggguuucggggagcaaagacaccuggcuccggagcuccgacucuucgccugaggcgcccgacgcguucaguccgcggguccugccgcgguucgccccgggccccgggcuugaaagcccuuggcuaccucgucgcgggagcugagcuacucuuacagguuguuuuacccagugcuugcagcuuuaaguugcgauuuuaggcaacgggugugguagguagcggcuccuugaugccgcauuaacagcugaaaaagcgccccgauccgcugacuucacuauguguaagaaacaacauuggggauuccucuuuagcuugcaauuauuuuaaaugauaagcuuuuuuaggggaauuuuggggggugaugugcaguuuacaaaaucuaaauguuucguugaagggccuggcuuauaguacgugcucaguaaaguauuuguugaaugaaugaaucuugaaauaucagacaaagcuuaucucacaucuaguaaaauuuaggcacauacuccuugauuaugauuaaggaaagaaugucggcaaacaguauguauuuuugauauacguuuuuuaguuuuugucccacauaacauacuguugaugaacaguccguucuuacucucaauauuaugaacauagaaaauauauaucaaauuuggauuuucucuuuugguuugagagaaguugguauacauuuucuguuucuuaaaaacaggccuuauuucuaaucuuuaaaaauaauggagaagauaaagagggagugggauuguauuuugaaacccagcuuucuguuucauuaugaauaaaggaguuuauguguuuuugagaagggacugugguauggucuugcugcuuuuugagcaagggagaacucuaaauuuagggggggaaaagcuaauguugcacuaauauaauaaaaugucaccauuuacucaacagauauucauuaagcaccuguuuaugggcacaggcaaaauccgcaauuauccuuuucuuaaacuugaaugcaaaguuauuuccuuauuauugaugucgcaaguggugacugucuuaaaccccuaguggcuauuucaguugggaaagauggcaggugaacugcaggaaguguaaauucauaacagccuuuaaagguuaauaaguaacuuuguacagcuaaaauuauuggguuaagcuuuuauauugucaguuuaauagaaucugucuacauuuuaaaaugaagggaggaagacauuuaauaagcuaguguuuuuauuaucucccuggucccuauuaggagacuuugguacaguguauugaaggguaauguacuucugguccuguuuucuguaaauaaucuuuguaauaacauuuucuguuuuuaaaaauccccagagauaaacaguagauuccuuuucuauaagaaauguuuuaaaauaaagcuucauuucaggaauuuuauuuuguccuuguguucaccacuuacaaauaaaugcauauaaacuugauagugcuaaaaagggaaggauuauuaguaauaauuugugguuccauauguggacuuaucuuuuaguauugcaacugugauaaaacuacuaauuuaaaaggaugagauuuguaguuuugcauuuauucugaacauaagguugcguugccuauuuuaaucuauuuauauauguuuaaaaagcaguaauauuuuauuuauuucaggaauccagacuaaugugauccaaagucugucuugauuauuaugaaauaauguagauauuaauuuuuuuauaguuagcuuuuuuguauuuaagugggcuguuuugacuguuaaugcuuauaauacuuaauacauuguuaaagauaauguuuacauucaaauagaaguuucagauuuuggacuuaccggcuauuagcuuuuuuuuuucuuuuuuuuuuuuuuuucgagacgaagucucgcucugucacccaggcuagagugcagcggugugaucucggcuuacugcaaccuccgccuuuggggcucgagcuauucucaugccucagccucccauguagcugggauuacagacaugcgccacuaugcccuauuuuuuguauuuucaaaaagagacgggguuucucuguguuggccaggcuggucucgaacuccuggucucaagugaucugcccgccucggccucccaaagugugcuguuagcuuuuuauuguuguuucuagaaaaaauaaggaaaguaauucuucaaauuuuagugauagagaauugugauacuuuuucuuuaaauguguauuucucggaagaaguuaccugacaauguaccacugauagucugguguugaugacaaaccuacuuguaaaugguaauagugaugauaaagaacaaguaaauaaggugugauguguuaaguaaaaguguuuggcuuuuuuuuuuuuuuuuuuuuuucggauaagcacaucaucagaauucuugacaaucagcagcugcguuaaaauauauuuuuccaagaaaucagaacucauaauuuuuuuuuuuuuuuuuugaaacggagucuugcucuguugccaggcuggagugcaguggcgcgaucucggcucacugcaaccuccaccucccugguucaagcaauucuccugccucagccucccaaguagcugggacuacaggugugugccaccacacccggcuaauuuuuguauuuuuaguagagacaggguuucaccguguuggccauccaugauggucucggucucuugaccucgugaucugcccuccuuggccucccaaagugcugggauuacaggcgugagccaccacgccaggccauaauuuuuuuuuuuguaccuuaaaaauacuaguguuuucaaaguauuguuccuuccuuggaguaguucauaauguuuugaggcuaaauaaauuucaggauuaucuuguguuauaauugcuggaauauuugaaauguugguguuuucuucaucaggguaugugugucuguuggggagaggguaguucauuuuuuuguaagaccuuuuagaaugauuuagaaagcauuucuuuuuccucagaugugauuaauaaagugauuaauaaugauacuaacauggcauauugcagcugugcucauauuugccuguguagaucaugagaguuuuaauuuaaaaaaguuuauuuaaauacuucauaacuaauuucucacauuauuuucugggauagguugcuguuauguuuuaaagucccaguugucuuuuuuaaaauuaugaaaggguuuauuuagguuccucaucugcuuuaaaaugagucugggauaguuuguuaagguuuuauaagauuuuugucaaaauuaaaaaugcguguugguuuugaucugcuguauuguucuuauucucaauuuucaugaaaaauauuuuaacauuuuauugaauauuuaauguuaguaauguuuuagucagucucagggggacauuauaguuuuccugugucgucuugagaggaacuugagagaaguacauguacaugcuuauucuuuuuuuuuuuuuuuuuuuuuuuuuuugagacggagucuugcuuugcccccaggcuggagugcaauggcgcaaucucggcucacugcaaccucugucuccuggguucaagugauucuccugccucagccuccugaguagcugggauuacaggugucugccaccaugccugacuaauuucuauauuuuuaguaaagacaggguuucuccauggucaucaggcugaucucaaacucuugaccucaggugauccacccaccuuggccucccaaagugcuaggauuacaggcgugagccaccgugcccggucaagcuuauucuuaauauuuacuugcuaguuaggugagggcauuuuuuucuuauguuuuucauacuaccugggaaaacuuggaauuuaacuuuucuuuuuuuuuuucugagacggaguuucacucuuguugcccaggguggagugaaaugguacaaucuuggcucacugcaaccuccaccuccccgguucaaacaauucuccugccucagccucccgaguagcugggauuacaggcaugcaccaccaugcucggcuaauuuuguauuuuuaguagagacgggguuucuccauguuggugaggcuggucucgaacucccgacuucaggugaucugccugccuuagccucccaaagugcugagauuggaagcaugagccaccacacccggauugcuuuuuuuuuuuuuuuuuuuuugagacagagucugucgccaggcuggagugcaguggucccaucucggcuuacugcaaccucugccuccugaguucaagcaacuguccucccucagccucucgaguagcagggacuacaggcgugugccaccaugccuggcuaauuuuuguauuuuuaguagagccgggguuucaccuuguuggccaggauggucucgaucgcuugaccucgugauccgcccaccuuggccuuccaaagugcugguauuacaagcgugagccaccgugccaggcgaggaauuuagcuuuuaaauuauuaguuuuaugcauccugcuaccuugguucaaagcuuaaguauacuuguaucuuucuauaauacuaacaaauaaugaguagugcaggauuuagcugagacugcuuugggcccucauccaaagggaguuccugaauugaaaugccaagaagacuugguaauaaguugucuuaauccugacacuguaaaauaccuguuaauguauuuuagucaaauagauuaugguaaaacauacucccucuuuuuccuagaaaguauuagguuaauuucauauuaaaucuagguaccuuugaaauaacuaaauuaugagcccugauauaucuguuuucuugcuuacccacuuagaaacucaugcugugauuucauauuuaaucuguaugaucgaauuuuuuuaucuuguacuaaaacauaaaauuauuggccgggcgugguggcucauuccuguaaucccagcacuuuggguggcugagguggguggaucaccuaaggucaggaguucgagaccagccuggccuaugaaaccuugucuuuacuaaaaauacaaaaauuagccaagcaugguggcacaugccuguaaucccagcuacuugggaggcugaggcaggagaaucaugugaacccgggagacagaggcugcagugagccgagauugcgccacugcacuccugccugggcaacagagcgagacuccaucucaaaaaaaacaaaacaggcagggugcccuggcucacgccuguaauccuagcacuuugggaggccgagguggguggaucaucugaguucgggaauuugagaccaaccuggccaacauggugaaaccccaucucuacuaaaaauacaagaguuagccgggcgcgguggcucaggccuguaaucccagccacuugggagucugaggcaggagaauuacuugaacccaggaggcagagguugcagugagcugggauggcaccacucuacuccagccugggcgauggagcaagaguaucucaaaaaaacaaaaaaacaaacaaaaaaaaacaacuggccgggcaugguggcacaugccuguaaucccagcacuuugggaggcugaggcgggcagaucaugaggucaggagaucaagaccauccuggcuaacacggugaaaccccaucucuacuaaaagauacaaaaaauuauccgggcgugguggcaggcaccuguagucccagauacuagggaggcugaggcaggagaauggcauggacccgggaggcagagcuugcagugagcugagaucacgccauugcacuccagccugggcgaaagagugagacuccgucucaaagaaaaaaauaaaaaaauaaaaacaacaacauaaaauuauuuuuguuucauuugacuuaauaaaacuuucacuuuuuguuuaguaaagcaaaaaugaauuuugaguacauucaacauuguguauguuuuacaccguauauauagagggaauuuauggguaucuguggaacugaaagguuuaauggguggaacuugguaagguuuaagcaaaauacaacuuucacugugccuucaaaacucucccuguagacuaagucuuucucugcuucuagaugagcuuuuagcgugaucagauagcuuuuuaagucacuuuuagguaacaaaaagucuucuggucacuugucaauaauaguuuuauuuuagucauuaaaagguacaguauaguaguguucaaacucuuguagauuucagaacuuuucuuuggcucaaaacugcuuugaaccuagaagcuuguuuuggaggaagagucguacuuaguuggcuucucuuuuuacuuugccaggucuucuucaguaugguauuccuaccacuucaggaugcagcuuaggauuacagagaaaagauauaggggggaaggugggggaagguauaguuuuauuguggcuuaucugauugugaucuggcauuuuugccuucugaguuggcgagguugugcaaagcugacucuuucuucaggagugcuggaagugguugaggauucuaugucuaggaagcuccagcuauaauuccugugauacaguucuccagcuccaauuuagccuuccaguuuccuuuaucuugcagguucacuuugcccagggugagauuuuucuuuagucuuuaagguaguucuauaacauuuuaaccagaacugcccaugcuuuauugaggauauuucauagacacaauuucauuaauuccacuggggucucagcauccugucuuuccaacuccuuccauaaaaugcaguagacccuccaaaucaucagauuucacaucugaggauuuagccagccaaggauaaaaaguauuuaaaaagaaaaaacagaacaaaaaggguaaaaagcuacaguauaacaauuauacauggcauuuauauuuuauuagguauacauagucuagagaugauuuaaaguauacagguggaugugccuagguuauaugcaaauacugugccauuuuauguauguaagggacuucagcaucuggggauuugggccaggguggggcaggguuccuggaaccaaucacccauggauaccgagggauggcuguaaacguuucuucaacaguacuucuguaugucugcgaucuguaauccauugcugccaucaccucuuugcugucccaagaccaccuccuuccauguccucacuggaguauuuacccugccuuaaauuugugguccacuauuauaauuuugccuuuucauacacauucaacucccuugcggcauucuucuguuguaauucaccuggccaaacccuuacccccacacccuuuguguccaguucuccaucuguuccagcauacaucugggaaguugagcaugcuuugaggaaaacacacccaagcugaccuggcucucccuuuaaauucaugaccacugaccuaaggagggcccuuuguguugcugguuguuuuuguuuuguuuuguuuuguuuucgcuuuuugagauggagucucacugugucacucaggcuagagugcaguggcgcgaucuuggcucacugcaacuucugccucccagguucaagugauucuccugccucagccucccgaguagcuggaauuacaggcgcccaucaccaugcccggcugauuuuuguauuuuuuuuuaauagagacaggguuucaccacguuggacaggcuggucucgaacucucacuccugaccucaagugauccaccugccuuagccucccaaaauacugagauuacaagcgugagccacugcaccuggccuaauccuucuguaauccuaguacguuuccugauuuaaucaccacagauuacuuuuaauaccucucgucaaaccucuagccucccuuuuuuccucuucauuuucagcucaugaccuuguuuccuguauguuaaaaaugaaagcgaucagaauaaaacuuuuauacgucuccuuguaucuuuacccauacuuugccuuuccuacuauucugucaucauggucuccacucgugcuccuuucuccuuuuaaggacauugcauugcuucaguauucaucucauucuccugcauucuaaugagcugcaucauuuccccauuucuacuggauuaucccuaucagcauauagauguauugaaauaucucccaucuuuaaaaaaacaccuuuccaaaugccacaucuuccuuuaguuacuccucuccaaaaagguaaauauuuguugucauccgcgcucccugucuuguuuggauccacuacaaucugcuuuuuuucucuuucauucuaccauaacagcucuuuuugagauuauugagugacuuuguuggugguaaauucccuaguucucaagccuaaucucaguggauguagaagcaauagcagcauuugaugugguugauaacaucauguuugaaaucuucccuuuguuucuggcauauuacugccuguuuucaguuucuuuuguugguuccuuuucauugccccaacuucuaaaaaaugaggcaguguuucagggacauauguuuagaccucuucuauauuuauauuuaguuuuaguccccugugaucucauucugucuagcuagaauuauauacauauauauauauuuuacauuuuuuuauaauuuuuuuuuuuuuuugagauagagucuugcucuguugcccaggcuggagugcaguggcgugaucuuggcucacugcaaccuccgccuccuggguucaagugauucuccugucucagccucccgaguaccugggacuacaggcgcccaucaccacgcccggcuuauuuuuguauuuuuaguagagauuggguuucaccaugauggccaggcuggucucaaacucuugacuucaagugaucugcccagcuuggccucccaaagugcugggauuauaggcaugagccacugcgcccagccuuauuuuuuuuuuuaauuaaaaaacuuuuucuuggccaggcgcgguggcucaugccuguaaucccagcacuuugggaggcugaggcaggcagaucacgaggucaggagaucgagaccauccuggcuaacauggugaaaccccgucucuacuaaaaauacaaaaaaaaauuagccaggcguggcggcuggugcuuguagucccagcgacuagggaggcugaggcaggagaauggugugaacccaggaggcggagcuugcagugagccaagaucgcaccacugcacuccagccuggcgacagagacuccgucucaaaaaaaaaaaaaaaaguuuuuuuuucuugaggcagggccuugcucauccuccaggcuggaguacaguggcgugaucuuagcucacuguggccuugaccucccgggcucaggugauccuccuaccuuagucuuccaaguagcugggaccacagguaugugccaccacauccggcuaguuuuuuguauuuuuauagagauggguuuucaucauguugcccaggcuggucuugggcucaagugaucugccugccugggccccccaaagugcugggacuacaggcgugagcuacugcgcccagccuagaauuauauauuucaaacuaaaaauguuaucuuuagucuggaucuguuuccuaccuccagacuucuguauccauuugcguacuccgcauuuuuaaguagauuucuaauaggcaucccagauuuaaugucacaacugaacuccuuguccucccucuucuccaucaccccuccaccccaguaauuguccccauucccgucuuccucauccuauuaaaugucaacuccaucuuucaguuucuuuggccaaaaaccuaguagacauucuugacucucuucuuucucauacucccacaugugauucaaauaauuagcaugaaaacaugucccuuaucuaucuuaaaaacugccauaagaauaaauguaaccacaauuugcucucuucaucugcugccaccucuguaagcaaccaucgucucuugcauguauuauuuuaguagucucuacaugcugcuucugcuguuuucuguucucaaaccagcaacaagggcgaucuuuugaaaaugaaagucugauuauuuuacuccuguguucaaacccuuaguggcuuuccauaucguuuauaaaaaccagaauacuuaauaccuaaguauucaagaagucuugacccuucaucgucuguacguccugcuugucugauuucaugucuuaccaguuucuccuuggcuucuuccacucuggccacauauagaccucccugaggucuugaacuugccaagcauaguguugcuuuagugcuaguaggaauagagcuucguuuuauucacugcagaauccccaguauucagaacaguggagagcacauaauggggacucaacauuuccugaaugaaugacuguuaaucuugucacucaugucuuugguuacagcuuauaugaauguuucuauaacuaaaaguauuugaauuucaccuaaaaccauguaguccuguaagaauuaaguagaaacaaauuuagaugcaagaguaugaaguaaguuucaaaucaauuuuuguguauguaaagugaaaauacacaguaaaaugguaagggacagaggagguaggaaaggaaaggagauaaacugauggaauaaagaaaaggaaaaccugauuugguaguagggugacagcaccuuaaaaaaaccuauuuugggcuugcgcuauuuuuuuuuaaagugauguuucuucaauucugaguguuggugauuuacauggacuuagacccuucaauuuggacuauauuguaaucuuuuuuuuuuuuuuuugagacugagucucgcucuuuagcccaggcuagagugcgguggugugaucucggcucacugcaaacuccgucucccggauucaagcaauucuugugccucagccucccaaguagcugggauuacaggaguccaccaccaggccaggcuaauuuuguuuuuaguagggaccagguuucaccauauuggccaggcuggucucaaacuccugaccucaagugauccacccaccugggccuuccaaagugcugggauuacaggugugagccacugcaccuggccguauaauuuucuuuuuaucagggauguaggcucaaaugagauugggugccaaaacuucauuauuuuucuuuucuuuucuuuucuuuucuugcuaguuuuugcuaaacuucuuuuguuaaagaaaggcaguuacuguuacugagauagcucgaugguauccugugcauuuuuuuuugaaagcucaaauagaagucucacaguuuuagggagggauuuuuuuuagucuacaaaaaguuauuaguaugccuguccucuuaguacuguacugccuaguuacucuccuuucaaaaaaaaaagcguauauuuauuauauuuccaugguaaacuagcagcuacaauaauguacacaacucuauugaguaguauuuauuaaaugcauauacauauuuguguuccuaaaaaugcuuguacauacuaaaacugcaauuuuacugauaguugggaaaugaaagugcaaaagaaauuaaugacuugugaaguucugguauuucauuaugucaagacaagauuuuuuuuuuuuuuccugagcuguagaucucauuugcuguugguugauuaagaaaaaaaucuuggccaggugcgauaggcuaagucuguagucccagcacuuugggaggcugaggugaguggauugcuugagcucaggaguucgagaccagucugggcaacgaggcgaaaccccaucuacaaaaaaaaaaaaaaaauagaaaaauuagccaggccuguacacccauagucccuccuacucaggaggcugaggugggcggauugcuugagccuagaagguugaggcugcagugagccgagaucucaccacugcagucuacccugggugacagaaugagacccuguuucaaaaaaaaaaaaaaucuuuuagauaaguuguuaaaauagguggcuuagaaguuggugaauuaaagagauaauguuugugugcaaguauaaauuauucucgauaaaccaguguaaacauuuucccauuuuuguauaauaugcaauaauuuaugucuuuauugacuuguauugugggacuuucauaucgccacaauguguguguggguguguauauauaucuuuacaguuuuuguaauaugcagauacaauuuagacucucauauaaacaugaccauuagaauuuuuuuuuuuuuuuuugagauggagacuugcucugucacccaggugggaauguaguggugcaauuuugguucacugcaaucucugccuccuggcuucaagcaauucuccugcuucagccucccuaguagcugggauuacaggcaugcaccaucaugcccagcuaauuuuuuuauuuuuuuuuguauuuuuaguagaggugggguuucaccauguuggccaggcuggucuugaacuccugaccucagaugauccgcccaccucggccucccaaacugcugggauuacaggcgugagccaccgcacuuggcgaccauuauaauuuuuaaaaagccuguuuacauaccaaauaaaaucaucauguuggaugacacacuagaaguguuucuuuacaauuuugaaauaaucuauuuuauagacuagguaguuuucauuagaauuugacauugaccuaguugaauucauauguuagcauuucacacauaaccaucuuggauuaaugagauccuuguuucugagcugguguguaguccuaccacucaguuuauuucagcuguauucauaguuugaugcccgccauccuacuuuaacuucauaauguucuguuuagauuauuaaguaaucaaaguggucauauugagaaaacugaauacaauuaauaggugugaccccagucucauaaggggucauuaaaauaaugcaugacauuaugccuucauuuauuccauucaguacauuuaucaaacuacuaugugaaguuguuucucaacccauucagaauaagauauaaacuguacucacccagaaaauacaaacucaacagucuguacauaauuuggcccuaacagccuauuaucucaccuuugcucacuacacucuggccaaguuagucuguucaguuucucaaacaugccauucuuggccuuggcuuagagcuuuuacacugguuguuuccuuuguuugaaaugguguuuucccagauguuuuuuagccuggcccuuuaccuuuccaaucucagcuuaaauaucaccuccugcuuccucaccacucaguuaaaaauagguccuccccaucacuguuuuaauuucuucaugccauuugugaguccuugaaauuauguguuuuuuaaaauuaauuuuuaugacaguagggacuuccuuugucuuauuccuugcugucuacaaugcccgaaacaauacuggcaccaaaagguguucaguaaaaaaaaguguugagaggauaaagccagguaccaauuucaucuauuccccccacuuuuuuuuugaaauggagucuugcucugucucccaggcuggaguucaguggcaugaucaggacucacugcagccuuugguccuaucaauucuugugccucagccacccaaguagcugggauuccaggugugugccaccacgcuagccaauuuuuuauuuuuaguagagaugggguuucuccuuguuggcuaggcuaguugagaaugugauccacauuugggagaucccgccugggccucccaaagugcugggauuacagaugugugccacugcgccuggccuauucuuccuugugagugauuuuaguguauuaauaauuuaaaaugucaaaagccuauuucuccuaaccuagaaaagaaacuggauuauuccgauaaaagccuguuuuagaaaaggaugagaaaauuuaggaacuguugugaugauucuuagaucagaguaguuaaguggagccaguguugugcuggaacugguuagcugauugugccucucucuccagcuccaugugugacaucauguuaguagcuugaaacuggccauggugggacauuuacagcauggcagacugcagaagcuacaaaucaggggcccuuuucucaaagagguggucaaauauuuaucagcagaccacuggcagugggaccauaugaaauuguuguuuuuauagacaaaaaaaaugcuugaauauuggcaguuccuuuccuuuccucuccccuccccuccccccuccccuccccucccccuccccuccccucuccucuccccucuccucucuucuccccucccuucuuuuuuuuuuuuaaagacagagucuguuuguugcccaggcuagagugcaguggcuuggucuuggcucacugcaaccucugccuccuagguucaagugauucuccugccucagccucccgaguaggugagacuacaggugugcaccaccacgcccgacuaauuuuuguauuuuuaguagaaacaggguuucaucauguuggccagacuggucuugaacucccaaccucaagugaugcgcaugccucgaucucccaaagcucugggauuacaggcguaagccaccacaccuggugaauauuggcaauuucuuaugguuuagucuaguagaauuacuuauuuugguuuaaagaaauuucuuuaugguggucaguggaguuauaucagugcuuuuaccuucuuuuucaaaguuauguucucuuuacaucugaugauuacuucuagauucauuuauugcauaaaaugugcuauuuauauguuuguauauuguuuaacuguguaucuaauaguucauuccaaagcaggcacaaaagaucuucagauccucugacagaguguucuugguuuuacugcuuaugcuaaauaagauuauugaaaggcguuacuuuucuggucaagaaagcagaacugauucaguuuguuauauagcauuuucucagcccucccccccccccuuucagaauaauuuacauaaauacuccugaguucaauuuuuuuuaacuuuuuuuucugcuuuuacuuauuacccuuuaagugcuugcuuacuuucucugauaauuuacuuucuucuacucugugauuucuuuuacaaaucaaugaaaugguguugucuuguuuucucaaguuuuuuccuguuaccuuuccuguggucaccuggacauuccaguccguuuuccacacucucccucuaccuucucccccaguucuuuaaagagacacaaaguuacaggcagcauuuucugacuggagaaaaauuauuguuuaaaaauugaacucugagacugggcacagugguuggcucacgcuuguaaucccggcacuuugggaggcugaggugggcgauugcuugaguacaggaguucgagaucagcccaggcaacagggugaaacccuaucucuauaaaaaauacaaaaauuagcugggcaugaguguguuuaugaccccagcuccuugggggcugaggugggagguugcuugagccuaggaugucaaggcuucagugagcugagcucacaccacugcacuccagccuggaugacagagcaagacccugucucaaagaaaaauugaacuuaguuggcucgggaguuuauuggcauuuuuugagcaacaguugcuuuguuaauucugaauaacuggauuugaacuggugcuacugaauuaaaauauggggucuacauuucuuacccuuuaacugaaauuauucucuuuuaugcacacacacaaacuguauuuaauguagaacaucagaaaguauauacaagcuaaggaaaaaguuuuaauccuaccacccuaaaauauaauaacuagucaguggucauguuuugaugaacauccuuccagauaccucaauaugaauauauguuuuuucacaaaaucuuacauagacucugacauuucacuuuaacgaauauuaucauaaaaguauuacuuuuuauuacuucaguuugaaagggucauauuggaaagugaaaauucuguuugacgaggauaaagcuguagguaaaguugugauuaaaaacaaugguguuuauagagaguagaaugugguaagucaacuggagaaaagaauuacuuucagcaguaauuuuuuucuuaagagcccucuuaccauugcacaauagccugauuguuuuauacuagcugaugaaaaccauucaggauucuauguacagcagaauuauuuuaauaauagcccuaggguaaaauaugagccuguagauaaguuuauauuuuuuagucuguccaaguccgacugauccuuuaauaguaaaauaauuuuggaagaaaacuguguuuuauugaaggccuucaucuaucuguaguaugacaauuuuauuagauauugcuacccuuuuuaugugugagaaugaggagugaaauaguucuuggaaaaauuuuagcauguaagaauucuuauguuaauguuuccuuugauuuuuguuuuaugaaugugaaaaauccuuguggaagaauugcucauauauauugguauauugcauucuuuggaaaucaccaguuccaaauuugucaagugguuguuugggucguuaaauagcaauuguaaaagcaaaucaaagauccuuuaaggauuuuuccuugaucacagugauauccauuaccugggguagaguagaccgcugaugucuugccuucauuuuuauuguucuuaaccucguccuuucuguguuguaucacugcuugcucacaagcuccuccagucuuuuucucuucaguagcuuuuucucuuacccccuugugcuacuuccugaaugguguauauguugcugaaaacauuucucaugugguaaagaagaguaaagagcaauguaguugauguggccuuuucuacugagaaaugaugcauuuguggucuacagaagagacuugacagccccuaaagaaguguuuuuuaucuacauuacauguuugugaguggauaugcaagugccucuguuggaagguaaagugaaucuugaaacaaauucuagaaaaguguuuagaauuauuccauacauuuugcuguugaaaaaauaguauuuaaagaaaguuucaucucacagugaauuuuuagccuccucuuuuaagauuuauuuugugaacagugaccuuguuuuuguaaacucuacucugaagaaguuuagaaauuagucacacaguaaguggcagaacaaguauucaaagucuugccugauuuuccauagucauuuagcuuggaaagcauuguaaaguggcagaaagaauauggacuuugaaauuuagacacaccucgauuugaucucuaacuuugcugcauauuugcugcguggcaaguucuuaccguuggugauuuucauuuuccuuuucaguuaagugagaguaauacauuuguuaggauuaaaugaaguaaugcacauaaagcauuuggcuuguagaauaagauguuaauaaauguuuaauuuccuuucaacaauaccauaucguuuuaaaaugucuugggagccacuuggacauuucacuugaaaguuaagugccaucaggaaacuagaaacauguauaacccagguagugaucuuucagggaaauuuuaauuucccugucuaaggaggagaguaguuuuucggacuguuuuaaaaauaugugacuuaaaggaaaguuuuaagguuaaaagcugaaauagaacugaguuaggaugaguuaauuauugcugaccaaaauuguaagaaaguccauuucuacauuuccugagaaaucgaaacauuuguguuauauacauagagaagucacuuuuaaaggcuaagaacugaccauuugaaaaguuuaugauuaagauauggggagaaaguguucauuuuuaaaguaauaaacaauagcaaguuucucuuaucagauuuaagguuuaaggaauggugcuuguucagaccugaguacagugaugacacagguacuaaauauguuguuggagguaguauaaaucuggaaccuguuucaaaagcgcuuuggcauauuuguguguauuuccacuucugagagauuauucuaaggaaguaaccuuuuuuuuucuucuuuggggggagaggagguuauuuuccuuccuuaaugacacccuaauugagauaauucacauaaaaaaucaccuuuuuaaaauuauuauuauugagauggaaucuugcucugucaccuaggcuggagugcaguggcgcgaucucggcucacugcaagcuccgccucccggguucaugccauucuccugccucagccucccgaguagcugggacuacaggugcccgccaccaugccuggcuaauguuuuuguauuuuuaguagagacgggguuucaccauauuagccaggauggucuugaucuccugaccucgugaugcgccugccuuggccucccaaaguccugggauuacaagugugagccacugcaccuggcccuuuuuuuuuuuuuuuaagauggagguucacucuuguugcccaggcuggagugcaguggugcagucucggcucaccgcagccuccaccucccggguucaagcgauucuccugccucagccucccgaguagaugggauuacaggcaugugccaccaugccuggcuaauuuuguauuuuuaguagagaugggguuucuccauguuguucaggcuggucucgaacuccugaccucaggugaucugcccgccuuggccucccaaagugcugggauuacaggcaugagccacugcgccuggccaaaaucaccuuuuuuacauaagucaguguuguacaaccguugcuacuaauuuuauauuuucaucaccccaaaacaaaaugaguagucauuucuguucuucccuccccacauccucugauagccguuuacauauuuucucuuucuagauuugccucuuuggacauuuaauguaaguggaaucaugcgauaugugaccuuuugugucuggcuuuuuucauuuagcauaauguuucaagauuuauucauauagcauguaucaguacaucauucucuuuuuuuuuuuugagauggaguuucgcucuuguuauccaggcuggagugcaguggugugaucucggcccacugcaaccucugccuccuggguucaagugauucuccugccucagccucccaaguaacugggauugcaggccugugccaccaugccuggcuaauuuuguauuuuuaauggagacgagguuucuccauguuguucaggcuggucuugaacucccgaccucaggugauccgcccaucucggccugccaaagugcugggauuacaggugugagccacugcgccaggcccaucauucucuuuuauggcugaauauuauucuguugaaugcuuauacaguauuuuauuuguccauuuaucagugaauggacguuggguuguuugcacauuucaguuaugaauaaugcugcuauaaauaugaacauucauguacaaguuuuugcauggauuuguuuuaauuuaucuuggguauauauaccuaggaguagaguugcuggguuguaugguaacucuguguuuaauauuuugcagaacugcuagucuguuuucuaaaguggcugcauaguuuuacguuuccaucagccguguaggaaauauguggccuuuuguaauuggcuucuuucacuuagcauaauauguucaagguuuauccauguugugguauguaucaguacuucauuccuuuuaauggcugaauaaugucccauugcauggauauaacacauuuauccuucagaaagcuuuuuauccaaaaguauucagugaagcauuaguuauaauuuuaaaaaauugaaaauuaccuuaauuuuuaacaaaaaagagucguuaaauuagguacaucugcauauaucuuuuauuaguaauucauuguaaaggauuucaaaggaaaacaauuguuagagugcuaaaguaggauacaaaauuguacguguacaacuguucaguguaccugguuuugggggaugguuauuaauuucuuuauuuuuaauuuucuuagucuccucuguugcccaggauggagugcaguagugugaucauacuugguguaaccucgaacuccagggcucaaguaagccucgcaccucagccuccugaguaguuaggacuacaggcacaugucaucaugcccagcuaauuuaaaaauuuuuuuugguagagauagggucuugcucuguugcccagguugguugugaacuccugggcucaagcaauccugugccuuagccuccuaaagcacugugauuacagauguaagcuacugggcccagcccccaauuuaaaaauguuucuauauuuuccacacuuuuuacaaugaucauauauuccuuuuauaaucaaaguaaaagaauaguuuuuuuaaaugauaauagagguugccuaugguggugugcgcuuuagucccagcuacaugggaggcugaggugagaggauugcuugagccaaaggacuugagucuagccuggacaacauaaugagacccuaucucuaaaaaaacaaaacccagaccaggcacaguggcucauuccuguaaucccagcacuuugggaggacaaggugggaggauugcuugagcccuggaguuugagaccagcuuggacaacauaaaaaaacccugucucugaaaaaaaaaaaaaauugccuggugaggugguauacaccuuugucccagcaacucaggaggcugagacaggaagaucucuggagccuggaagguugaggcuguagugagcucggguugugcuccagccugggugacagagugagacccuguugcuccccccgccccaaaauaaaacccaaaaccguaaaaccaacaguagcuguaucuuuguauguuacugauauaaauuuauucagccaagaaaagcaggaucaucaguguaaggaguguuaauauucuauauugauucaugauuagcauauauuauaaauaaaauaauuucugacuauggcuaagagaacuuuuaauuuuucacauggaccuaagcauuucaauuuauaauagcaguguagaauaauucuuguguauuugacuucugaaaugagggagaggaaaaauacaggcaaugcauauuuuaagcauaaugaacaguauuguuucuuucagagcuccuugcaagaaacaaacucuauucuaggauuuuuaggcagaaagauaucuuaugguaggcaauuugguacuuacaaaaucauugcauggucuggaagagcuggaaucagaggguuaucacuagauuaauauauucaagaacauaagcccauagcugugacugagaggucaggaaacaaacugguaaguagucauaggaacacugaaucugguaccacagcuucuuccaguugccuuuauaucuggugaguagaguuaggcuaucacaauuguuucuaaaccuucuuugugucauugcucaccacuuaaaucagcaacagaaagauagcuuccauuaucacuucugcuuuacaaaucucauaagaggcugucuaacuagcagaaccuuguuugcauuuccaauacuaacuguaaaggaaagucugggaaauguagcuuuuuuuuuuuuuuuuugguuggggggacagggucucacugugucacccaugcuggagugcagugacaugaucuuggcucacugcagccucaaccuccugggcucaagcaauccuccugggcccaagcaguccuccccggcucaagagguccuccuuaguagcugggacuauaggugcucaucaccacacccagcuaauuaaaaaaauuguuuuuuguggagaugggaucucacuguauugcccagucuggucuugaacuccugggcuuaagugauccuccugccuuggccucucaaaaugcugggauuauaggcaugagcaaaugcaccuggccaguuuuuuuuuuuuuuuuuuuuuuuaaauaaagcauuccugcccuugacguacaagaaggcacguauagggaguggugagagggaaugaaugccaacuauuucaugacuagccuucagaagccucuguuuacuagguaauaaggcuuuauacucagcguacaguugacccuugaacaacauggguuugaaccgugcaauuccacuuacauguaggcuuucuuuagccucugccaccccugagacagcgagaccaaccccuccuuuuccuccuucucuucagucuacucaacuugaagaugauaaggaugaagacuuuaugaugaucuacuccacuuaaugaauaguaauuauauuuucucuucuuuaugauuuucuuaacauuuucuuuucucuagcuuaauuuauuguaauaauacaauauauaauacauauacuagauacauguuaauggacuguuucuguuaauguaaggcuccuggucagcaguaggcuauuaacuuuugggagucaaaaguuacuugcagauuuuugauggagugaggggcugacagguugccgggaccauaaucccuguguaguucaugggucaacuguauuuuauuuacuauuuuauucuauuuuauuuuuuuagauggaguuuugcucugucgcccaggcuggagugcaguggcgcaaucuuggcugacugcaaccucugccuccuggguucaagcgauucucgugccucagucucccaaguagcugggauuauaggggcccgccaccaugcccagcuaauuuuuguauuuuuaguagagacuggguuucaccauguuggccaugcuggucucaaacuccugaccucagguaauccacccgccuuggccucccaaagugcugggauuacaggcgugagucaccucgcccggccuugggucagcuguauuuuaaaggugguaagguuaacaauauucaacuuagauuugauuuguucagaaauuuuucuuuucuuuuaaucugaaccauugauguucuauuuucauaaugugucaguuguaguguuucauuggaaguaaauggauguuuguagaauuuuuuuucuuuuucuuuuuuuuuuuugagacaggaucucacucugaugcccaggcgagugcaguggcacgaucaugucucacugcagccucaacuuccugcggucaggugauucucccaccucagccucccaagucggugggacuauaggugugugccaccaugcccagcuuuuuuuucuuuuuuuuugcauuuuuuuguagagauggggcuccgccauguugcccaggcuggucucgaacuacuagguuccagugauccgcccucuucggccucccaaaguguuggaauuacaggugugaagcaccauauccuaccgaaauuuucuuuguaguguguuucucuuuggauugaauagguaaaauauugccaauagauguaaaagucuccauacuuuuuucccuaauaguugggcuuuuauagaauugaauuaauauguaauuuuuuuucuuuuauuauuugauuauuuuaccuccauuuauuauuuugucaaaaaugggagaaguggccgggcgugguggcucacacccauaaucccagcacuuugagaaacggaggcagguggaucgcaugagcccaggaguuugagaccggccugggcaaaauagugagacucuaucucuaucaaaaaaguaaauaaauaaauuagcuuggcaugguggucccagcuacuuagaaggauugcuuaagccccggagguugaggcuacagugggucaugaucaucccacuacacuccagccugggugacagagggagacccugccucaaaaaaaaaaaaaauugugguaauguuuaaaaauaguaugugaacuaguaaaugcaacuuuuccucuuauaauguggaaucaagauguuacacuuuuuaguuccugauaaaauaaaguuuugagaaugcuagaagauacuuaaguguaauuuuuuuaucugaagauauuucuaccucccaaguuucaugaaauaucagccuauugaguaguuucaguauggugagugucucauuaaaaagccauaugcuaaauaacuuccaaauacuguaauuucgauuccuuuuuuuuuagagagagccucacucuaugguccaggcugaagugcaguggugcagucauaccucacuacagccccaaaccccuggcuucagaugauccuucugccucaguaucugagauagcugggaauauagguuugagccacugggccugguagauucuucacuaaguauuugagagcaaauuagggauuuuuagcuucugguaccauuuguugcuugcaacagaaaguuagguugaccuggaaacuuaacugcuuuagagauaccuacugacuacuuuggcaaggaccuggaaacuuaacugcuuuagagaugcuauugacuacuuuggaggagcaaggaaugaggcuuugguauagacauuuucaggcacugaaauuuaaggguuguuguuguuccuucuacccccaccacuuuucaaauugauuacuuuucuuugaucaguauuauuuauuaauaguauucugugucagcaaguuaggguaauuguuaaauguuuuggcuccuguauucuauacauuuuuuuuguaaaaacugcuuaauacauuuuagagcugacauuaauguuuuucaucauaaguuuaaaagguugcaaaagauuuaguuucugguguauugucuguuguauauguuuuuacauaauguauugacuaagaucuugaccuuaaagugauuuugguuauucacuuuaaugggaaguacugcuauaaaaucuaauugcugguccucauagucaaaccagccaaauggaguauguuuucucaucagaagugguuuuauuuuuaauucuaagaaacacaucgguaccugcacucagugacuuucacuuucuacuucuaagacagguugauaaagcaaggagucaugucaagaguuuguagcauaggccgggugcaguggcucacgccuguaaucccagcacuuugggaggccgaggcgggugaaucacgaggucaggagaucgagaccauccuggcgaacauggugaaacccugucucuacuaaaaaauacaaaaaauuagcugggcgugguggcacgcgccuguagucccagcuacucuggaggcugaggcaggagaauggcaugaacccaggaggcagagcuugcagugagcugagaucgcaccacugcacuccagccugggugacagagcgagacucugucucaaaaaaaaaaaaaagaguuuguagcauaaggcaucauuucuuucaguauuucuuguuuugcucacaugagacuuuuccccagucucucccaauuguccuuuuggugcauuggagauuucuugagguaaggaacauguuaaaacuugagaugaauaagagaaaugacuuuuuuuuuuuccuucuuagaaacagggacucgcucugucaccuaagcuguaguagaguggcacagucauaacucacuacugcagccucaaacuccugggcucaaguaguccuuuugccucagccuuuugaguagcuaggaucacaggugcgugccaccauucuuggcuaauuauuuuauuuuacuuuuguagagacagggucucacuauguugcccaggcuggucuucaccuccuggccuaaagugauccuccugccuccaccucccaaagugcuacgauuauaggugugagcuacugugucuggccuugacuuucuuuuauaacauagaagagcuauugugaaaggaaagauggaagagacaaggaaucgugcuuggauacgucaauuuuagaagagcacaaaaggcaguuggugaucugaaaauugauuuccuuaaaauugucuagaccuguguacccccuggaaaguaucaaaccuuauacuggguugaggacucuugaguuaagggaacagcuuaucuucugccuuaauugguaucguguauuuaucuuuugaaguaaauuauuucacuuuuuaauuuuaccuugaaaguuuugagaaacuguauaacuggcugcuucuuuuuucuuucuuuuuuuuuuuuuguuuuuuuuuuuuuugagacaggguauggcucugucgcccaggcuggagugcaguggcgcggggucaauggcagccuccaccucccagggcucaaaugauccucccaucucagacuccugaguagcagagacuacaggcuggcaccaggcuggcugguuaauuuuuguauuuuuaguagagacgggauuuggccauguugcccaggcugaucucaaacuccugggcucaagugaucugcacaccucguccucccagagugguaggauuauaggcaugagccaccaugccuggccauaacugacuuuuaugaugaaaccagcguaguuuuuauaguacuuuacaggccagcgaacauaguaauuagaaccucauggaagugauugccaaaauauaaaaauuagaaaaaaagaaaacuguaucuuugucuuuuacuccauaccaagguaaauucuugauuuuucccagaguucaagauaaaaaaggaaaaccuuaaaaauacuaggagaaaacaucggucaauauaaaaacucuuggguauggggagggcuuucacaagaagccuuauagagaaauauuuauaagugugccugauuuguaaguaagauuguucuguggucuguaguuguuguuuuuuaauuauuucuuaaugcuauuugguuagccaugucaaauugucauaucuuaaucacuuauaaaauguuuauauaaugaaggugaauuauuaugguccaugaauuuauguauaugauuuuuuuuuuaaaaaaggacuuauucagaauggugguucccuacccuggcaguacacuaaaauagucuggugguacccuuaacaaaacacagguuccugggaaccacuccuaggaauugauuaauuugucugauguggggcuuuggcauuaauauugcuuuagaagcucaccaguuuauuuuacuauccacucggaauugaaaacuacguuuuugaaggauuuguuuucacuuugaucuuuauuuuguuuaguuacucuuuuuuuucuccuucccuugaacucaguuugguacauuaaaagacuaaauauaauauuauagaguccagcaugcuccuuuuucucauuaaagaaguaaaucuccaaauuauuguuuuauagccauaacuuuuuuaaaaauaugaauucuucuuuagaaauaguuuucaaaauacauguaagaucaagacugccauuuacaucuaaguaaucuugcaaguuuuauauuaccuuuucccucugcucuuuaaauacaaauaacccuucaaaaauacugauauaacaaacaccacccgggacucaucagccuuucugaugguuucuuugguaaguuaaggguuuauuuggcacuucauaauagacaagguuguacauauguagaaguggggagaaauuaguuaggaaaccagucuguuauguucucuuggaauuaacucuugauuauuaagcaucuuaaaaaugaguaucuuuggcugggugugguggcucacaccuguaaucccagcacauugggaggcagagguggacggaucacgaggucaagagauugagaccauccuggcuaacauggugaaaccccaucucuacuaaauaaaaaauuagcuaggcaugguggcgcaugccuguugucucaacuacucgggaggcugaggcaggagaaucgcuugagccugggaggcggagguugcagugauccgagauuguaccacugcacuccagccuggugacagaguaagacucugucucaccaaaaaaaaaaaaaaaaaaaaaaaaagauaauaauaauaucuucccagcuggacacaguggcucacaucuguaaucccagcacuuugggaggcugaggcggguggaucaccugaagucaggaguuagagacuagccuggccaacauggugaaaacccaucucuacuaaaaauacaaaaauuagccugguaugguggcacaugccuguaaucccagccacuugggaggcugaggcaggagaauugcuucaacccaggaagcggagguugcagugagccgagacugcacuccagcccgggugacagagugagacuccaucucaaaaaaaaaaaaaaaacaaaaaacaaaaaacuugguaauuuaaaaguacacaguuagggcugggugugguggcuugugccuguaaucccagcacuuugggaggcugagguuggcagaucucaagugauaguucaagaccagucugagaaauauggcaaaaccccaucucuaccaaaaaaauaaaaauaauaauaaaauaaaaaucagccuggcaugguggcauacaccuguagucccagcuccuugggagccugaggugggaggaucgcuugagcacaggagauugaggcugcagugagcugagauugcacccacucagccugggugacagugcgagacccugucucaaaaaaaaaaaaaaaaaaaaaaaaaaaacagaaacaaacuauaauacagcaaaagaacauaguuguucauuugaauguugaaugaaugaacagauagagauauuuugauaauacuacuugcacauuugucagauuuuaauaaucuaaaaaugaauaaugcucugaucugaauauuugcgucucucuuccccaccccucaaauucauauguugaaauucuaacccgcaacgugaugguaauaggaggugaggccuuugagagaugauuaggcccucaugaaugggauuagugcucuuguaaaagagaccccagagaguuagcucuacccuucuaccaugugaagauacagugagaagguaccgucuaagagaaagugggcccucagccgggcacgguggcucacgucuguaaucccagcacuuugggaggccaaggcaggcagaucaccugaggucaggaguucaggacuagccugcccaacauggugaaacccuguuucuacuaaaaauacaaaaauuagcuggacgugguggcgggugccuguaaucccgguuaccggggcggcugaggcaggagaaucgcuugaacccgggaggcggagguugcagugaguggagaucaggccacugcacucuagccugggugacgagagcaaaacuccgucucaaaaaaaaaaaaaaaaaaagugggcccucaccagacucugaauccaccagugccuugaucuuggacuucccagcuuccacaacuaugagaaacaaauuuucauuguguauaggcuaccuaguuuaugguauuuuguuauagcagccugaacaggcuaagacaaguaagaacuuacuuuucuuauguucuuuauuuuucuguaaaguauuaccuucuccccuucccaaugaacaguuugucaacagucauuuuacuuuuaggcccuggugugccagguccugacugaaauacagacugaucgcucugccauagagugacgcaacuuacugcgugucuuaacuccuuauaaaggcaacugggacaaauucgauauguauuggcugcuuuaagauaagcuaguuggcauuucaggacccccuguauuuacuggaaguaaugucacacugagccacucuucuggugaaaauguacagcugguagaagaaauuguguguuaaugauauugucaaugcaggagggccacuacauacaaggaugcagagucaaguauacacuguuugaaaaguacgcacaauauugagaaagaccagaaaacauuaucuuuaagcggauaggcugaauuaaauugggaauuccuggcuucacagaguauauccaaucugauauacucugugauccaaaucuggaucacacaaaaauauaauaauuuuauuugacauaauauagaaaauuaauacaagauaaagaggacaaauuacucaucaguuugggaacugugacuuacuuugccuugaaggaaagguauguugucccuuuucugggaucaaauaaaaccauucaauuauugaauaaauacugcgcacuagcuauuugccagacacucagauacuagggauuuaguuucgaaugaaagagacaaaaguucuuguguuuauggagcccuacauucuaguugauguagacaagcaacaaaugagugaaauauauagaaugccagauaacuuaaaaaaguacuaugaggaaaaauaaagcaugggagggagauggugacuacuaggguagggaacaggagauugcaguuauaaauaggauggcaaagaaagaguucagugaaaggauaauaaaaagccaguacauggccgggcgugguggcucacgccuguaauuccagcccuuugggaggcugaggcgggcagaucacuugaggucaggaguucgagaccagccuggccaacauggcagaacuccgucucuacuaaaaauagaaaaauuaggcugggugcagugguucacaccuguagucccagcacuuugggaggccgaggugggcgggucaugaggucaggagaucaagaccauccuggcuaacauggugaaacccugucuauacuagaaauacaaaaaauuagccaggcgugauggcaugcaccuguagucccagcuacucgggaggcugaagcaggacaaucgcuugaaccugggaggcggagguugcagugagccgagaucaugccacugcgcuccauucuggguggcagagugagacuaagucucaaaaaaaaaaaauaggcauggaggugggcaccuguaauccuagcuacuugggagacugaggcaugagaaucacuugaacccaggagguggagguugcaguaagcugaguugaugccauugcacuccagccugggugacagauugagacuuugaaaaaaaaaaaaccaaaccaaaacaaaaaaccaaaacaacaaaaaaagauagcuauuacagcaucaucgugauaaagauaaguauuggcagugaccuuaaugucuaucuguagaggauugguuaaauauauuauggugcauccauauaauggaauauuguacugcaaaugaaaaacaaguucuacauauacagaauggucuccaagacacaugugaagugguuaacaaaagguucagaauguguagaguaugcuaccauuuaaaugcgucacauacauaaguauauauaguauuuuuauaaaugcauggaaucuuacuggaaaaacauagaauaaacuaguaauaauguuucucucuggagcggggaacaggaugauuuguggacagaagagugagggugaaacacuuuuuuuuuuuuuuuugagacagagucuugcucugucacccaggcuggagugcaguggcacgaucucggcucacugcaagcuccaccucccggguucacgccauucuccugccucagccucccaaguagcugggacuacaggcgcccgccaccgugcccggcuaaguuuuuguauuuuguuuaguagagaugguguuucaccguguuagccaggguggucucgaccuccugaccucaugaucugccugccucagccucccaaagugcugggauuacaggcgugagccaccgcacccggccaacacauuucuuuuuauccaguuuuacuauggguauguacuaucuggucaaaauauguacaauauaaaauacgaacacgacuguccuguaacacaugggaaaacagacacacuuuuauuaaacuugguggccuagauaacugucuagccuagauacugaauaagugggauauuuaauagaaacguggauuccguuuugaugagcuggagaccauguagacagugaccacacugaagcaaggccaaaauccuguuuugauuggguaauggauuauagugaacaugauuauaacacuuagauuugugugacuuuuuuugcucuccucaucaaauggaggcuguauucauuuccuggguuugccacaacaagguaucacaaacuagguggcuuaagacaacagaaauguguugucucacaguucugaagguuagaaguccaaaaucagggugucaacagcgcuguguuccccaugaaaccuggaggggaaaccuuucuugcuuuaccuuagcuucagaugguuugcuggcagucguuggcuugcagcugcuuuacuccagucucuugccuuugucaucacauggccuucuccuucugugucucuguuuucauacuguuggcuucuuaaaaggacaacaaucauauuggauuaggggcccacucuacuccaguaugaucucauuuuaacuaguaacaucugcaacguaaggucacauucagagguacuggggggguuaggauuucaacauaucuuuuugggagaggagugggcaaauucaacccauaacagaggcuuuacaguuugauuauguugcuucucuauaguagucuuucauauaugaaaauguguuuuguaaaguuguauggaaacauaauguuuugcaaguucuuuuucuuucuuucuuucuuuuuuuuauugaagauuauuauaaaagauuuccuuguggggagaaaagaccacuccaccucucuuaauaacuccaaccuaagauugcagcauauuuauuaaaacuaaaauuuugaugaaaguagaauguuuucucuaaguuguaaaauaaaaguauggagauauaaauaguagugaguuaaagaugacaguaacuaauuuagacauuuuuugugcuuuuuauaaaagucauaggaaaaggaugacuucagauuaaauacuuuauauucuuuuuuuuuuuuuuuugcauuuuuguucuuucucgugcaaaaauggcuucuuuccagaucacuuugaccugaagauacaauaaaauaugacagcagagagaaugaggcuguuauuuaguuccauucuucuccauuguuuuucuuguacccauaacuguuauaauuacauaaggcguuaagaaaccuuuaacucuuucucaucuuucccucuuucucauguauacaugagaaaacaaauauuuguuaguguacaaagucuuuuuaaaaguuacugcauccuggccgggugcgguggcucaccccuguaaucccagcacuuugggaggccgaggcggguggaucacgaggucaggagaucgagaccauccuggcuaacaugaugaaaccucgucucuacuaaaaauacaaaaaaacuagcugggcgugguggcgggugccuguagucccagcuacuugggaggcugaggcaggagaauggcgugaacccgggaggcggagcuugcagugagucaagauugugccacugcacuccagccugggugacagagcaagacuccauuucaaaaauaaauaaauaaauaaguaaauaaaaauuaaaaauuauaaaaauuauaaaaguuaccacauccuaaaaaagccuuuuugaugucauuuuacccuuugagaaauaaucgaucgacaaaucagcaucuugguuucuuuuggcuuuucacacagggucaaauaaaaacuaggagacucucccuauuuccaaucuuaaugacaguuuuucauuuuuuucuuuaaaaaguuaauacacgaaaacguaauguauuuagcuauuuuuaugaguaguuucacugaguuauuuguaaaauaggcaguuaaaucuaauuuuuuaggaaguuaugcuuccuguuagaguggguuagaguaaugugcuuucauucagcugcugucuagucaucuuuaaauuuuuuuuuuuuuuugaguuuuacucuuguugcccaggcuggagugcaauggaaaaaucucggcucagcgcaaccucugccuccuggguucaagcgguucuccugccucagccuccugaguaguugggauuacaggcaggcaccaccaugccuggcuaauuuuuauuuuuuuuuuaaguagagaugggguuucuccauguuggugagucuggucuugaacucccgaacucaggugauccgaucucaggugauccacccgccuuggccucccaaugugcucggauuacaggcaugagccaccgcgcccggcaucuuuaaaauauuuuaugaauuuagguaccauagaaucuuagaauugauuugaacuguggauauuauuuaguaugacgucacaaauauaggaauucuuuuagggucccugauacuuaaccucuagugacugugaauucaccacuuucuaggcaucccaguaucuuuuugggggcaguuagacuuguagauaguucuuucuuuuuuuuaaaccaaaaauugccuuccugaaacuucugcauaguggcuuuguuaccaccaucuuugguaccccauaacaaguuggcuuccucuuucccaugcuaugcuaagaccuacaaaucuuugaaggcugucauaucuuccccuugugcuuuuugcuaagcuaaaucugacacccagaauugaaugccauuuugccacauuucugaaucugaaauucugggacuaaguuucucccauuauuuggaggugcagccaggauuaauaaccucuguaauauaaaugcccugaaaggaagguacaagguauauuggaagagggccugaauagacuugggggauuggggaaugauuccugaaggaaaugauagccauaucaaguucugaagaguaugccagacagaaagaagugaacaguaagugugauguccuguaggcaacagaaagaaauugagaaugguuggauggcacagucaugggguaucaaauggaagagguaguaaaugagguugaagagaaauguggggaccaaaugguaaaggcccugagaagucauacgaggagacuuuccugaggauaauagucauuaaaggggguuuuacgucaggaauaacaugaucagacauucauuuuagaaguaucauucuagccaaaauggggaacaaauuggagggacuaagagugguuaccaggggucaguuagcagcuauuaugguauucguugagagaugaugguggugccuagaacucuacuggugacuuaguguuggggagaaacagauuggacaaauagaacauggccguuuggcugugggggaugagauggaaaggcaaaaguuaaggauaacaugcuuguuucuggcuucguaaacuggguagaugagagggaauuuaaugaaaauaaauugaauaggauugggguggguaaugguaagaaagaagcagaguugaguuaagaagcaggguucaguaaaguuugaagcagagguagcacauccuguggagcugcacuacaugcagcugggugugaggcuaaauuaaaagacaacuaggcuggagagcuuugggcuggagacagcugugggcuggaaauguagauuuggcgaucagcauugaugcuaaucgaacucaggggagugauugaaauaaccuaggggagcauuuguagagugaaagaugagggcauaggacaaaacccuuaagaacuauuaauguaauguuaguuuuugagccuuugguauuuugacuggauugucugagaaccagcaaaaaggagggaaucagggcuguucugauauagguauuuaguagaaacccaccuaaauuauuugauucgaagaguaaaguucucaaauggucuauccuacccagccugucacaguaucugacauuuaugcuguuaguuucucuacuuuggcuuaagguguugucucucuuggaguuuccuguuaaaguguuguuauccuuagagaacuagaauauuaaucccauuguuggugaucgugguaguguuuuuagggucacuagcuuuuauucuggaauucagugaaaggauggaugggaauuugagaaaaauaagauuugaaaaacaugccauuacugaggaguuuaggaccacagaaccuggacuugcagcauugagguugccaagcaccuggauaaggggagugagaacaagugagagcaagagagagguuggaaaagggggacagugaguuggauaagaaagagaaaaugucacuaaaaagggaauaagagaacaaagaacuaaauaaaggaaaaaucuugacaguauuuuaguuauaaauuagggugaccauauaauuuaucaucgaaacuggaacauaucaagauagagaauggccauuaauaauuauguuguaggccuggcgcaguggcucacgccuguaaucccagcacuuugggaggccgaggcgggcggaucaugaggucaggagauugagaccauccuggcuuacacauugaaaccugucucuacuaaaaauacaaaaaauuagccaggcgugguggcgggugccuguagucccagcuccucgggaggcugaggcaggagaauggcgugaaccugggagguggagcuugcugugagccgagaucgcgccacugcacuccagccugggugacagagcgagacuccgucucaaaaaaaaaaaaaaaaaauuauguuuaaaaauuggcauaaauugugacuaucacaagcaaagaaggaugaauggucauucuaguuauaaugugcauauugcauaauaaaauaguuuccguuuuuuagcuaugauaugucaagcauuguaauaaguaaacacuuuauacaucuuacuacauucuuacaauaauucucugagguggcauugucuucguuuuauaguuagugaaaccaaaucucagggagguaaccucccaacaauucucuguggcagucagaauuggaaacuauauuuauuugaccauacacaaaauacacauaaacucuuaaauacuguauuguacacuaccguugcuguggguguguauauguguuuuaaaauguccucugagacuggcaaggguagggggaagaaggagagaggagagaugggguuaaaggacacaaaauuacaacuagauaggaggaauacguucuaguguucuauggcccgggaggaugacuauaguuaauaacauauagcuucaaauagcuaaaaggagaauuauugaauguucccaacacaaagaaaugauaaauguuugaaaugguggguaugccaauuaccccgaccacuauacauuuuauuuacugaaacaucacuauguaccccauaaauauguagaauuauauuucaauuaaaaaauuuuaaaagggcugggugcgguggcucaugucuguaaucccagcacuuugggaggccgaggcaggcagaucacgaggucaggaguucgagaccagccugaucaacauggugauacccugucucuacuaaaaauauaaaaauuagccgggcgugguggcgcgugccuguaauuccagcuacucgggaggcugaggcaggagaaucacuugaaccugggagauggagguugcagugagccaagaucacgccacugcacucuaguuugggagacagagcaagacuccgucucaaaaaaaaaaaaaaauuaaaaaaguuaaaaguccucugacuaaaaaacaacucugacuugcuaauugcuagcauaauguaucaucauaauauuaagcccccuucccuuucugauaccccuauuuuuugaggcauggagagaggggaauaaccugucugaaaucaguacacuuaguaaguggcagagccagauuucaaacccugaagacaguuugauagcagcaccuccuuuuucuuuuuuuaucuuauuuuauuuuauuuuguuuuugagacagggucuuacucucuugcccagacugcaaugcggugacgagaucuuggcucacugcaaccucugccuccccggcucaagcgauucuccugccucagccuccuaaguagcugggauuacaggcacgcgccacuacugcccggcuaaguuuugguugcuuuuuuuuuuugagacggaguuuugcuuuuguugcccaggcuggagugcaauggugcgaugucagcucacugcaaccuccgccucccggguucaagagauucuccugccucagccuccccaguagcugggauuauaggcaugcaccaccacgccuggcuauuuuuguauuuuuaguagaaacaggguuucuccauguuggugaggcuggucacgaacucccgaccucgggugauccgccugccucggccucccaaagugccaggauuacaggugugagccaccgugcccagccuaauuuuuguguuuuuaauagagacggggguuucaccauguuggccgggcuggucuugaacuccugaccucaagugauccacccaccucagccucccgaaguucugggauuacaggccugagccaccguguccaaccagcaccucuuuucuuaacugcuauucuauacugccuccuucagccauauucuuugucuggacauguuuucauuucucuuaggaguggguuuguuggggagcaugguaaauguauauauaccuuuauaagaaaguugcgaaauuauuuacaaagugguuguaucauuaugacuuaccaggaguaguccguuuuuguugccucaugacucuuuuuuuuuuuuuuaagacaagcagauucugaaauuccagcaauuagaaauagcuucuuuccccuuuaacguuuuugccucauuuacaccuacccucaccuguacccacuucuguaacucaacuacaucuuacacuuuuauggucuuggaauguuaacagcaccagcaaauaauagcaagaaucaaacaaaaauguguugagucuuagugucgccacuggcuacauuauugcccagaugacuuuucacuuaaacuguuuaagugaaugauuauaugcauuucuuuacaguguauucacagaggaaauaaaugacagugauuuauugcagugcuaauagacauuguacuaauuaagugauuuuaagucaaguuucuuuaccuuucugggccuguaaagugaggaaauugaacuagauuucuuacaggucuauauuugucccugacagaucuguauuucuuugagaagaagaaaggaauugguauuugacauuaaaugaucaugcauaaaaaugggacauauauuuaaguacuuauuuuucauucaaugucagagugauuuaauagggucaaggccugauaauuuaagcuacuguuucuugaggaaaaguggaaaguacucaaaauguuacuggaagaccuaugccuuuggcuucuuguaguuuaucagcugaaauuuaagacuuuugaauuguaguggauugggcacuuaaaaaucgauuuuauuuuuaacuuauaagaagaucugagguuuggaaggaaucuuaaauaaaguuugucuaaaucaucuaucaguaggacuuuugaaucaugauccuaacauccugaccucugauaacagauacccuaaggcaggacauuccacuuuuaggcagcagugacaacagaaagauguacuaauagguagaacauacagccuguacucauucauuggaguugugccauuugggaugaugcaaaacuagcauaauuuuucuuugugacugcccuaaaaguauuuagacacagcauggauaacuuaauuucuuuaaaaaugcauucuugucuucauagcaauaugauggaacugagacugauuaucuuggagacuagaaaucucugcauagagauggaguguacacuuuggcuucugucuaaaauaauuuucuuuuuuuuuuuugggacagucuugcucucuugcccaggcuggagugcaguggcaugaucacagcucacugcaaccuugaccuucccggcccaaggaauccuugcaccucagccuuccaaguagcugggaccacaggcaugcaccaccaugccaggcuaauuuauuauuauuuuuaauuuuuaaauuuuguauuuuuuguagaaauggggucucucuacauugcccaggcuugucuugaacuccugggcccaaacaauccucccgcccuggccucccaaagugcuggcauuacaggcaugagacacuguacccggccuaaaauaaaacuuaaugguuaaauuuagcuaaggaaauaauucauuuuucuccgucucuucaguauaaaugacagguagauagggauagagguggcauuuaauaugauacaaaaagcaccaaggcauaccagugcuuagcaguuagauuggaucuguuuucaugacuuuuucaugaauucuaagcagaauaugaaguccauuuuaguaacgguauccacaugacacucauugaaugauuauaguaaaaugucuuuuuggucaacaaugaaaugacaguauuuuaaaucuaauuucuaccaaauuuaauggaggacugagguacucuggacuauaauugaauuaacaauguugaaauccaccacauuuccuuuuucccaugccaaauuauauuauacuagguuaguuagaguacuguuuuuggcauaugcuuucuuugugauuaguaaucguguuucugauccuuagcauugagauauacuuuuggaagagcuauuuucugaagagaaagauuguggccauaauuuucaaauuuaaugcauuaaaaggaucuugcuuuucauuuuaaccaggcuugcuaccaguuauuaauauuuaaacauaaaauuaaaugcauauauuucaaguguucagcuugauaaauuuuggcauguguauauuccugugaaaucauaaccacacugaagauacuggaaauauaccccaaaaguuucuucucagcccuuuguaggcccuccuuuugcccacccacccacauuccuaggagauuagcugaucugcuuuuccaccacuagagauuaguuucuauuuucuagaauuuuguauaaauuauacaguauauacucuuuguguggcuucuuugacucagcauaauuauuuugagauuaauccauguugauggguguauaaaaucauucuuuuuuauugagaguaguguauaccacagguuuauccauucuccaguugaugaauuguuuccaguuuuugucucuauguuaaaagaaaaacuuuagacaauguaaauguggcagaauuuauuugagcaaagaaugguacaugaauugggcagcacucagaaccagaaaagguucagagagcucugcugugcaaccugggcaguaaguauagacagaaaagagaagcaaguacguauauagauugauuaguuaacaguuccuccuuugccuuauuugaacauggucugaucaguuggcagcuugugauuggcugaagcuuggcugcuugugauuugcugagauucaucuguuuauugucuucuuuugagaaaugucuguuggguccuuugcccguuuuuugauuaaguuguuuucuugcuauucaguuugaguuccuuauauauuuuggauauuagcccuuuaucagauaaaugguuuuuaaauauuuucucucaaucuguggauugucucuucaauccauuaauuguuuccuuugcugugcagaagcuuuuuaguugaugcaguccuguuuuauuuuugccuuuguugccuguauauuugggguuauaucuaaaaaaacuaaaaauugcucagaccaaugucauguaacuauuuuccuauguuuucuucuaguaguuugacaguuucaggucuuacauuuaaguuuuuaauccauucugaguugauuuuuguguauggugugagauaaugguccacuuuuauucuuuuccuuguggauauccaguuuuccuagcaccauuuacaguaguuucaccuuaucugugguuuugcauucugcaguuugaguuaaucuuggucaaccaugaucugaaaauaguguauggaaaauuccacaaaauaaacaauucuuacguuuuaaauuaugugucauccugaguagugugaugaaaucuugugccguccugccuuguccugccugggaaaucauccuuuguccagcauauccaugcuguauaugcuaccugcucauuagucacuuaauagcugucuaguuuaucagauugaauaaacauaguauaucuaggguuccuaucugcagggggucuuggaacguaucccucacagauaaggggagacugcuguauugaagagacuguccuuucucuguuuuguguucuugguaacuuuguugaaagccaguugaccauaauuuguagguuuauuucugggcuuucuauccuguucuguuggucaguauuuccguuuuuaugccaguauguucuguauugauuacuauaguuuguaguagauuuugaagcuagguagugugaugccuccagcuuuguuuugcucaagauugcuuugucuguuugacgucuuuugugguuuuauaugaauuuuaggauuauuuuuucuauuucugugaaaaacagcauuggaauuuugauagagauugcauugaaucuguaaauugcuuuggguauuguaggcauuuuaacaacauuaaagauuccaaucccugaacaugggauaccauuauauuuauuuguauugucuacaguuucuuucaucaguguuuuauaguuuucagccuacagaucuuucaccuccuugguuaaauuuaauccuaaauauauauacuuuuuggaggcuauugugaauagaauugauuucuuaauuuuuuuuccagauuauuaguuguuaguguaaagaaaugcuacugauuuuugucuguugauuuuguacccugcaacuuuacuucguuuaucaguucuaacaguuuuuugguggaggcuuuaggguuuucuacacauaagaucaugucaucagcaaacagauacaauuucucuucuuccuuuuuuuuuaauuuuuuuauuauuauuauacuuuaaguuuuaggguacaugugcacauugugcagguuaguuacauauguauacaugugccaugcugguaugcugcacccacuaacucgucaucuagcauuagguauaucuuccagugcuaucccuccccccuccccccacccgacaacaguccccagagugugauguuccccuuccuguguccaugugaucucauuguucaguucccaccuaugagugagaauaugcgguguuugguuuuuuguucuugcgauaguuuacugagaaugaugguuuccaauuucauccaugucccuacaaaggacaugaacucaucauuuuuuauggcugcauaguauuccgugguguauaugugccacauuuucuuaauccagucuaucauuguuggacauuuggcuugguuccaagucuuugcuauugugaauaaugccgcaguaaacauacgugugcaugugucuuuauagcagcaugauuuauaauccuuuggguauauacccaguaaugggacggcugggucaaaugguauuucuaguucuagaucccugaggaauugccacacugacuuccacaaugguugaacuaguuuacagucccaccaacaguguaaaaguguuccuauuucuccacauccucuccagcaccuguuguuuccugacuuuuuaaugauuaccauucuaacuggugugagaugguaugucauugugguuuugauuugcauuucucugauggccagugaugaugagcauuuuuucaugugucuuuuggcugcaugaaugucuucuuuugaaaagugucugcucauauccuucgcccacuuuuugaugggguuguuuguuuuuugcuuguaaauuuguuugaguucccuguagauucuggauauuagcccuuugucagaugaguagguugcgaaaauuuucucccauuguguagguugccuguucacucugaugguaguuucuuuugcugugcagaagcucuuuaguuuaauuagaggucaaacguuuaagucuuuaauccaucuugaauugauuuuuguauaagguguaaggaagggauccaguuucagcuuucuacauaaggcuagccaguuuucccagcaccauuuauuaaauagggaauccuuuccccauugcuuguuuuucucagguuugucaaagaucagauaguuguagauaugcggcguuauuucugagggcucuguuguguuccauugaucuauaucucuguuuugguaccaguaccaugcuguuuugguuacuguagccuuguaguauaguuugaagucagguagugugaugccuccagcuuuguucuuuuggcuuaggauugacuuggugaugcaggcucuuuuuugguuccauaugaacuugaaaguaguuuuuuccaauucugugaagaaaggcauugguagcuugauggggauggcauugaaucuguaaauuaccuugggcaguauggccauuuucacgauauugauucuuccuacccaugagcauggaguguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuuguugaaguugcuuaucagcuuagggagauuuugggcugagaugaugggguuuucuagcuauacaaucaugucaucugcaaacagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauucuuuugaaauacaucccaucaauaccuaauuuauugagaguuuuuagcaagaaguguuauugaauuuugucaaaggccuuuucugcaucuauugagauaaucaugugguuuuugucuuuggcucucuuuauaugcuggauuacauuuauugauuugcguauauugaaccagccuugcaucccagggaugaagcccacuugaucaugguggauaagcuuuuugaugugcugcuggauucguuuugccaguauuuuauugaggauuuuugcaucaauauucaucaaggauauuggucuaaaauucucuuuuuugguugugucucugcgcggcguugguaucagaaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuuguuugguaagcuauugauuauugccacaauuucagcuccuguuauuggucuauucagagauucaacuucuuccugguuuagucuugggagaguguauguguccaggaauuuauccauuucuucuagauuuucuaguuuauuugcguagagguguuuguaguauucucugaugguaguuuguauuucugugggaucgguggugauauccccauuaucauuuuuuauugggucuauuugauucuucucucuuuuuuucuuuauuagucuugcuagcggucuaucaauuuuguugauccuuucaaaaaaccagcuccuggauucauuaauuuuuugaaggguuuuuugugucucuauuuccuucaguucugcucugaucuuaguuauuucuugccuucuucuagcuuuugaauguguuugcucuugcuugucuaguucuuuuaauugugauguuagggugucaauuuuggaucuuuccugcuuucuguugugggcauuuagugcuauaaauuuccuucuacacacugcuuugaaugugucccagagauucugguauguugugucuuuguucucguugguuucaaagaacaucuuuauuucugccuucauuuuguuauguacccaguagucauucaggagcagguuguucaguuuccauguaguugagcgguuuugagugagauucuuaauccugaguucuaguuugauugcacuguggucugagagauaguuuguuauaauuucuguucuuuuacauuugcugaggagagcuuuacuuccuaguaugugguccauuuuggaauaggugugguguggugcugaaaaaaauguauauucuguugauuugggguggagaguucuguagaugucuauuaggucugcuuggugcagagcugaguucaauuccuggauauccuuguugacuuucugucucauugaucugucuaauguugacagugggguguuaaaaucucccauuauuaaugugugggagucuaagucucuuuguaggucacucaggacuugcuuuaugaaucugggugcuccuguauugggugcauauauauuuaggauaguuagcucuucuuguugaauugaucccuuuaccauuauguaauggccuugucucuuuugauuuuugaugguuuaaagucuguuuuaucagagacuaggauugcaaccccugccuuuuuuuguuuuccauuuguuugguagagcuuccuccauccuuuuauuuugagcguaugugugucucugcacgugagauggguuuccugaauacagcacacugaugggucuugacucuuuauccaauuugccagucugucuuuuaauuggagcauuuaguccauuuacauuuaaaguuaauauuguuaugugugaauuugauccugucauuaugauguuagcugguuauuuugcucguuaguugaugcaguuucuuccuagucuggauggucuuuacauuuuggcaugauuuugcagcggcugguaccaguuuuuccuuuccauguuuagugcuuccuucaggagcucuuuuagggcaggccugguggugacaaaaaucucucagcauuugcuugucuguaaaggauuuuauuucuccuucacuuaugaagcuuaguuuggcuggauaugcaauucuggguugaaaauucuuuucuuuaagaauguugaauauuggcccacacucucuucuggcuuguaggguuucugccgagagauccgcuguuagucugaugggcuucccuuuguggguaacccgacuuuucucucuggcugcccuuaauauuuuuuccuugauuucaacuuuggugaaucugacaauuaugugucuuggaguugcucuucucaaggaguaucuuuguggcguucucuguauuuccugaaucugaacguuggccugccuugcuagauuggggaaguucuccuggauaauauccugcagaguguuuuccaacuugguuccauucuccccaucacuuucagguauaccaaucagacguagauuuggucuuuucacauagucccauauuucuugaagacuuugcucguuucuuuuuauucuuuuuucucugaacuucccuucucacuucauuucauucaucucaucuuccaucgcugauacccuuucuuccaguugaucacaucggcuccugaggcuucugcauucuucccguaguucuugagcuuugguuuucagcuccaucagcuccuuuaagcacuucucuguauugguuauucuaguuauacauucuucuaaauuuuuuuucaaaguuuucaacuucuuugccuuugguuugaauguccuccaguagcucagaguaauuugaucgucugaagccuucuucacucagcucgucaaagucauucccuguccagcuuuguucuguugcuggugaggaacugcauuccuuuggaggaggagaggcgcucugcuuuuuagaguuuccaguuuuuccguucuguuuuuuccccaucuuugugguuuuaucuacuuuuggucuuugaugauggugauguacagauggguuuuugguguggauguccuuuuuguuuguuaguuuuccuucuaacagacaggacccucagcugccggucuguuggaguaccuugcugugugaggugucagugugccccugcuggggggugccucccaguuaggcuucucggggguuaggggucagggacccacuugaggaggcagucugcccguucucaggucuccagcugcgugcugggagugccagugcucucuucaaagcugucagacagggacauuuaagucugcagagguuacugcuuuuuguuugucugugcccugccccaagagguggagccuacagaggcaggcaggccuccuugagcuguggugggcuccacccaguuugagcuuccaggcugcuuuguuuaccuaagcaagccugggcaauggugggugccccucccccagccuggcugcugccuugcaguuugaucucagucugcugugcuagcaaucagcgauacuccgugggcguaggacccuccgagccaggcgcgggauauaaucucguggugcgcuguuuuuuaagccccucggaaaagcacaguauuugggugggagugacccgauuuuccaggugccguccgucaccccuuucuuugacuaggaaagggaacucccugaccccuugcacuucccgagugaggcaaugccucgcccuacuuuggcuugcaaacggugugcgcacccacugaccugcgcccacgaucuggcucucccuagugagaugaacccaguaccucagauggaaaugcagaaaucacccgucuucugugucgcucacgcugggaucuguagacgggagcuguuccuauucggccaucuuggcuccuccucccuuuucuuuuucuuuucuuuucuuuuuuuuuuuuagacggagucuugcucugucacccaggcuguagugcaguggcgugaucuuggcucacugaaagcucugccucccggguucacaccauucugcugccucagccucccuuguagcugggacuacaggugccugccacgacgcccggcugauuuuuuguauuuuuaguggaggcgggguuuugccauguuagccaggauggucuccaucuccugaccucgugaucugccugccucggccucccaaagugcugggauuacaggcaugagccaccgcgccuggccccucucuucuuccuuuucuguuuggaugccuuuuauuucugaggcuuaucuuucauucuguuaacagugucuugcaaauagcagaaauuaguauuugaaugaaauuauuacuuugucuuuuuuaaguggauugugcuuuuguguuuuaguuuacuaaucuuugcccaagauaaggccacaaagauuuuauggaaguuuuaugguuuuaccuuuaggucugugauugauuuugaguuaauuuuggcaugcgguaugaauauucaguuguuccagcuucauuuguugagaaagcuauccuuucucugcuggauugccuuuguacccuuauggaaaauaaguugacuacauguguguaguuguauuucuggacucucaguuuuguuuuauugaccuguuaagucucucugccuacuaguacaguguuuuuguagcuuuauaauaaaccuugaauucugguuguauaaggcuuccaaaauuuuugcccuuuuuaaaagccguuuugauugaucuagcucuuugccauuuccauaugauuuuauuuaauuaauuuauuuuauuuauuuugaggcagagucucacucugucacccuggccguagugcaguggcaugaucuuggcucacugcaaccucugucuccuggguucaagcgauccuccugccucggccuuccgaguagcugggauuacaggugugcaccaccaugcccgacuaaacuguaggauuuuagaauaaacaugccaguuuauucuacaaaaaggucagcugggauucuuauuagaauuguguugacuauauugaucaaauuggggagaauugacauguuaacaucauugacuucauugaucuaugaacauaauauuauucucuauuuguuuuugcacauaauuugauaauuucuucauaauucauacuuuuacacuacaaaugaaauuauuuuuuaaaugauuguccuuuuuuuuuuuuuuuggagacaggaucuggcucuguugccgggguuggaguucaguggcacaaucauagcucacuguaaccucgaacucuugggcucaaguaauccucccaccacagccuccugaguagcuaggacuacaggcaugcuccaccaugccugguuaacuuaaaacauuuuuuuuguuguuguugagacagggucucccuguguuucccaggcuggucuuaaaauccuggccucaagcaaucaucccacccuggccucccagagugcugggauuauacauaugagccaccgugccuggcuucugauuauucuuuguacaaguguucuauagaaauagaauugauuuuugaguauuaaucuugguuuuugaguauugauccugcaaccuuccuagacuuauuuauucuauuaauaguagucuugguuuuccuaauuucguuaucagaguuagcauagccucuuaguucacugucaguuuagaguugaagaaauguguaaguuuauaaaauuaauaucaaugucuugccaggaaugagauuaagcaaccccaaugguuuucauuuuuccuuuaaugaaauucauuuuuccuuuaaugaaguaccaguauucuucauaauauggaaccuugacacuucaagcuaccauuauuuaagguguuaaauuuauaggcaauuucagcaaaguaauugauuaugaaggaugaauugcuguuuguuuuuaugacuggaauucuaagaaucuguucaaguuauguguuuuggaggaagagccaguugccuuggugauggcuuugggagacaaggaagaguaugugggacuuuauguuuguggcuugagcggaauauauggauuauggugugauuuguugagaugacgaagacugaggaagcaguguaucuaguauugucaauucagguuggacacguuagauuuuaggcguguuuugucuacuguguuaaggcuuauagguuuauuuggacgcuuuuagaugaacuauaucuuagguuaaaaacagaccugaggucacacagcuagucauuugcagaauuugaacuucagcuucugacucuuaaguccauguuuguuauccccuuaugcuauauuauauccucaaggcagagaaacaugcuuggcugugacaauacuaaaauguucccugggagcuauuagaaauacguagcagaguuugcaagcucagaugucugcaggguacagacaaguaauugugagccagguuguaacauaaaggagaguggcgacuucuguggagaacugcagagucccauccacaggguuaguuagcugcuaaucagcuccagaagauuguuuccauaugggaauguggggccaguauugccagauauucugauuuuucaagagagguccaaaaucuggauuuucauguaaaguccugauuuauaaauguaggcaguuauccuuuaaccaugcagaccaaccuaguguggguccaccaaagguaucugucugcuggauucugcccgguggguagauauaauguggaagcaacaauaaauuuauauggugggaaaaguguguuaacuguguauaauaagcacguuaugguguugaaaugcagguugcuuagguuaaacauggugcuuagugagccuaguguuugaguucagucuuuauauggaucaguuaauuauagaugggggagggggaauugcucucuguagcuuuuugccuccuaauugcaugcuuucauuugcagauagggccagauuugagugugugaauuuuugagugaaaccuggaacccaaaugagaagaaaucugcaaggaauaacuacugacagugaaucugcggucaucuguaugcauaauauggaauguucuuaacccagaaguagcugaauguguuacuccauugcugaggagugguaagucugauaaucuccacugauaauuaaauaaccuaaacccuuuccauaaaaagaggaugacuacuucuacauucuuagcauuugcugacauuaauuuuuauauuacagaggaggacagcagugcaguuuaagggaauucuuuaucccuaacaucauguuuaaugucugauuucagaguuuggcuugcuucuuccaguuaggcacauccuuuccuuugccuaggcauuuuucucuauuauuuguucuucaguccgaggccugaaauacuguauuugaaauauucagccagcgcugaaaugauggucaugauaguuaccagcauccauuuuaaucuuaguugugguaggucucauucucuuugggagugauuguuuuaggaauggacaugagaaacaguuuuguccaaugagagacaaaagggacaucugcaagaggcuuuuggggaaaucuuucuugcuuuugugaaaaggaagaaaauagauggucccucuucuccgcagagcugauauuacguagaugugauguguggaagugcuggagccaucuuuuuaguagccugaagguggugccuuaugugaaggagggagaaccaagggaacuggagaaaaguagaacuagaguuccauuuaccaugccuauagccucucuaucugaauuuucuuauuguuuaagcaguuuugccuugagauuuccuguuauuugcuauagaaauuaucuagauuuauuugguuucuuccuuuuuugauuacucaaagccauguuuuuuagugucgcacacauuucuacuugaucauguucuuuguagccccuuacaagcuuuaugaagucaagggguauguuuauauuccuauuguaucugacucuaauacuucuuaaugaugucaucaauacauguuugcuuaacugaauuacuugauaaguauuugaaaaaccaauccguagaaucuaauaauuacagagauuuuuuuuuuuaaauucacauccuuuucuuuacccacacugcuucccucuaggauuaugagugaaguuuguuuuuucuuuaagacuuccaguauguaacacauguucaagugguuaguucuacuccagacaauguugccuuuuguuuuuguccaacuuuaccgucagaaccagguucucuccuuuauguuugaguauuggcuuucaaucuaauaaauggaauuucacuuucuucuucauuauaaaaacagaauaguuugccuucuauuuucugugauaauuauaggaaugagggacgucaauaguaagaagcauaauucaggaauaauuuguauuuggcuuuggaaugcacauucacagaaagauucccuaaagugugcauccccacucuguucuuaggacuguguguuuugggggagguggagggaaguuuggcggugauguaguaagagggaucuugggccauaggauggaugaucuaguugcuuauguuuuaaagcucugugaaacaaaucauuuuuuuuuuuugaccuggcucuagauauaaauguuucuuucuaucuuuucuuuuaaaucuuguuauuauaaucuugaaaaaguauggaaugagaaccucuuuuucuucuugaaaaucugugguguuacuuucaguuaugguaaaaggaaaaagauaaaaccuguguuaugauuuuaccagguaaucugguaguauauuuugaauccuucaaaaagagauuuacauucagggaagaauucacuuuuuuuuuuucuugaucgauucugaugaaaaucugggagaauaccuuuuuuuccuacuucuuuuuuugagacagggucucacucuguugcccaggcuggagugugaucuuggcucuuugccuaggccuauguguuugagcccaagaugccaggaaccucugccuccugggcucaagcgauccuccugucucagccucccaaguagcugggacuacaggugugcaccaccaugcccagccaauuuauauuuuuuguagagacaggguuucaccauguuguccaggcuggucuugaacuccugggcucaagaggucuaccugcguuggccucccaaagugcgggaacugaaggugugagccaccaugcccaaccaggagaauaacuuuuuaagaagauagagaaaguuguaugaugcacuuuacccaucaauuuaaaugcaguaguaccauuauuuaguaauacaggaaauuuaaaucauuaaggucaacuuuaaugugcuguauuucauauauauuuuguaggaauggaacauguuuccuaccuaagacagucauggcaggcaugcaccuuaagcuagaucaagcagagugaaucuuaggauauuugcuaggaaugcugagaugaaggcacuuauuuuuaugaauuucaaccugaaaacauaguuauugaauuccuggcagcuaucuuuugaccaugaaaggaaauuuaguugauuaagaagccaacacugagugaguagagcagagaaaagccaugcccuaguuacuccauuugagcugcuggaucaacccuucccugaagcugcuguaccucuagacuuacaguugcaugagccacuaaauuucauguuuaauccaauuggcuuuggauuuugucuuacauuuuugugaaaacuuucuagcugauacaucuuucucaacccucaauuauacaucugcauaaugagaacucaagggacuuaauaaaacuugaauugugaguuagguaaggaugccucugacacagaugugcagguuggcagauaaugcauucuuuuuuuucuuuuuucuuuuugagacagagucucacucuguugcaccggcuggagugcaguggcacaaucucggcucauugcaaccuccgccuccaggguucaagcgauucuccugcuucagccuccugaguagccgggauuacaggugcccgccaccacuccuggccaaguuuuuuuguauuuuuaguagagacgggguuucaccauguugaccaggcugguuucgaacuccagaccucaaaugauccaccugcuuuagccucccaaagugcugggaugaguuggggguguaagguaggagaaaggucgauaugacuuuuccccccacccucagugccucacuucauucugguuuuccaagccuguaguucaccacuaauuuugaguucuuguauggaauggaauucgaaaccacuuacuucagcugcaguuguuuucuuacccuagggccauagaaaguaguuuggaguauaguuucugccucugugaagaaauuuucuuggucuucucaacaaggauaaauuuauauugauaucuaauauaguuaggcuguuguacccccauagacagagcuugcacucuguauacuggcuuccuuugccccuuagcaagcaccacuacucuuuccuuugacaugcaguauuguuucucaaaaaguagaucucuuauagcagaaucacccaggacccaaaagaauacuuagaaacugaccaucguaauucaguaucugaaaaauauuguucucuuccagucuguaacaucccgauaaaauuuuuaaaaggauuuuuaaagauuaguugaaucuaaaauuuauaaggaaaaaaauaaggaagauuauccagaaaaauucuuuaaaagaaugagcauuuaggccaggcacgguggcucacgccuguaaucccagcacuuugggaggccgaggcaggcggaucacgaggucaggagauugagaccauccuggcuaaagcagugaaaccccgucucuacuaaaaauacaaaaaauuagcugggcgugguggcgggugccuguaguuccagcuacucgggaggccaaggcagaagaauggcgugaacccgggaggcagaaguugcagugagcggagaucgcgccacugcacuccagccugggggacagagcaagacuccgucuuaaagaaaaaaaaaaaaaaaaaaaaaaaaaaagaacauuuaaaaaaggaacuaggcugggcgugguggcuaacaccuguaacccgaacacuuugggaggccaaggcagguggaucacuugagguuagggguuugagaccagccuggccaacauaaugaaacccugucucuacuaaaaauagaaaaaaaaaaauuaagucaggcgugguggugcaugccuguaaucccagcuacucaggaggcugaggcaggagaauagcuugaaucugggagguggagguugcauugagcugagauugugccacuguacuccagccugcgugacagagcgagacucugucucaaaaaauaaguaaauaagauuaaaaaaaaaaaagaauuaguucuucuagauauuaaaaauguauucuggccggguggcaguggcuuaugccuguaaucccagcacuuugggaggccgaggaggguggaucauuugaggucaggaguuugagaccagccuggucaacauggugaaaccccauaucugcuaaaaauacaaaaauuagccaggcaugguggcgcaugcuuguaaucucagcuacuugggaggcugaggcaggagaaucacuugaacccggaggcggaggaugcagugagcugagauugcgccacugcacuccagccugggcgacagagcgagacucugucucaaaaaaaaauguauucuaaaauuacagcaauuaauacauuauaauucugguagauagaucagugguacagaauaaaaagagucccaaauucauauggaaauuuagaauaugaugaaagcacguaucggaucaguggagaaaauuauuuuuuuucuuucuggcaauauuauagcuggguagccaucagaaaaaaucagauccuuaucuucagaggaagaaaaugaauuuuuccucuuuauauucuuggaguuagggaagccuucuuagaaaacguguuuugaaagaaauguagguauucuaaugccuuauuagagggaguauaaguuggcacauuccuuuaggagauuggaaaacaucugccaaauuuaaaaugccuacugaacauuuaaauguacaugcucuuuaauacaucaguuucacuucuuggaauuuaucuuaugguuaaauucuguagcuuuuggguuuaguucaucguauucucacuugugugaauauacaggguuaguuuuugcaguacuguaauagugaaguauuagaaacaacucaacuuccgucugugaaagaugaccuauaucaguaugauacaaaugcagccuuuaaaacuuaaaagaggcaguuuuuuaaaaguuacugauauuagcuggguguaguggcacaugcugauaguccuaguuauuugggaggcugauagggaaggauuguuugaacucaggaguucaaauccagccuggguaacauagaucucaucucuuuaaaaugguacugauauugccugauuucuaagauaaaguguuaagugaaaaaggugcccgugauguauaaugcuacauaaaaauauuucaaaaaagaauauacauauaugcugguauauucauaaaguaucugugaaaggcuacacaagaagcuaauauuaggggcuguauugagggaagacaacuggguggguaggauaauggugggaaacuuaauucuaucuucccccccgccaaaaucaucaagcgucguacuggguaaaaggaaaaaagggauucaccuaauuuucaucuuuuucaauuuguuagaaucuccaagggugaggucacccccaaucuacauuagaaauguuuuuuuuguuuuguuuuuuguuuugagacggagucucgcugugucgcccaggcuggagugcggugacgcgaugucggcucacugcaagcuccgccucccggguucaugccauucuccuaccucagccucccaaguagcugggacuacaggcacccgccaccacgccuggcuaauuuuuuguauuuuuaguagagacgggguuucaccguguuagccaggauggucucgaucuccugaccucgugauucaccugccucgggcucccaaagugcugggauuacaggcaugagccaccacgccuggcagaaaaaaauuuuuuuuauaguagugguaaaagacacauaaaauuuaucaucuuauccauuucugaguguacaguugaguaguguuaaguauguucacauugcugugcagccaaucucuagaacuuuuucacuuugcaaaacugaaacucuguacccauuagauaacaaauuuucauuucucccuauugccaucccccaguacccacauacuuuaugauucuaugaauuugacuacuuuagauuccucauguaaauggaaucauacaguauuuauguuuuugugacuggcuuauuucacuuaguauaguguucguaaggcucauccauuuuauagcaugacaggauuuccuuccuuuuuauuuuuauuuuuuauuuuuaaaagagauuagaucuugcuuuauugcccaggcuggacuugaagucgugggcucaaguaguacucuggcaucagucuuguaaguagcuggaaguacaggcaugugccacugcccuuccuuuuuaaggcucgauaauauuccauuguauguuuguuuaucuguucuucuguugguggacauuuggguugcuucuaccucuuggcuguugugcuaccucuuggcuaguaugaaugugggugggcaaauaugucuucagggcucugccuucaguuuuuccaaauauaucccagaaguagauaguauuucuguuuuuaauauuuuggggaccugucauaauguguucucuauagcaguugcaccauuuuacgguaucaccaacagugcacaaagauuuccucuucacauccaugucagcauuuauuuucugugugugguuuuuguuuuguuuuguuuucuuucauaguagccauccuaaggggugugaggugaucccaaauauuuuuuuuucuucuuucuuuugagacaggcuuucacucuguugcccaggcucgaguauaauggacaaucgugacucacugcacccucaaccuucugggcugaagcaguccuuccacauuagcccuccagguagcugggaccacaggcaugugccaccacaccuggcuuuuuuuuuuuuuuuaguagagacagugucucucuauguugcccagugucaucucaaacuccugggcucgagcaauccuuccaccuuggcauucaaguguugggauuacaggcaugagccacugugcccgacccccaaucuauauuuuuaacaaguauuuuaauuauauauuucuucuauauuuaaaaagcuuaugaaguuaugaaguacauuuaaguuaaugauuucaguuuuauuacuaaaaaauacaacuaguagccacuuuuuagaauuguaucugaaugugcuuuguuucuguaacuugaagugcauguuuuauaaugagauccucaagggauuguaccucucucucucugguuuuuuuuuuuuuuuuuuuuuuuuuuguauuuaaaugugagucaccuagggaacagacuaggauauguguacuuaacccuagguaauuuugcuaaccuuaauucuuuucucugacacaguuaaaauucuaagguucugcauguuagaauuccaguaguguaccaacaucuaaaauaauguguuuuaaugaaaaacucugugucauuuuacuuuacaugagaggauuugaucuguuuguuuacuuuuaauugaaaauagguuuaucuuuauggucuugacaguuguguguuaacuuuucucacaagaugaauuuaaucauaaauuguucaagagcaagaucaguuguuaagaauuuuauccagagacaaaaguacaugagauucuaguaaaaaauggaaaggaauguaaauugucuuuaaauuuuuuccugcuuuuucaagaaaauuuuaggggugugaguguucuacaacaaaauuaauagcuuauaaaguauuuuacauuuugaguaaauuacuugcaguucuuguuuuucugacuugaaguuucugaaauuauucugaaauuguuauugcagaguaccuauuuuuucuuccaaguauuuauucuuuagaaguauuauuucuaaaaucacaucacuguaugaauauccagcuguagccugugacuacauuaugaguauuagaagucauuuuuuaauaacuuuugccagaccugaagguucauuacugugcagcucucuccuucauggcuguuuuuauuuggauauuuaagggugagcugcugucuucauuauauuuggugugugacuugguagagaagggcacaaguagugguauggcuugggaagggugggaguuuaauccucauugugaguuuugagaaaagauaaugaaauccuuuauaucccuuuccguagaccugcauuucaaagacuuacauuuuaauaagaauuaguugugcagcugcaacccuggcaacaaggccuaggagaaaagaauuggggcagcauuccagaaaucagggcaggcacuggucucaugugggacugagcuaaugaaacauaaaaauauaaagcauguaguaaaaauaagaccaauacuuucuuuggcaugguagauacugacauuuuuccacacauuuuuuuuaaaaaguccaaaagcucauaagcugcacauucaauaagaguagcuauauuaucuucuccuuuaguauaaaaaaauaccccagauacucuuggaaguuaauauuucugugaauuauauccaaaauguaauuguucuuggcccacucuuggugaaguccagacguuuucaaaacaugggguacgaaauuugucagauaaaguuuagaaacaagguuuuagguuuuaaacuuuaaaaaucaaaugcucauaucaguuuuaauguaaauuucucauaguuacuggacucuuuagaugcccuuaaauaauaaaauuuguuaaauauauucucugaauacugugacaauggcuacauaaucuauuaucuaaccauaauuuaauuauuaccugguuguuacguguuuagguuguguuggaguuuucccucuuauaauaagaaauauugcaagaaaacauuuuuguguguauagguauuuugcuuucuuuuggacuagucaggauuacuuuuggauuuccagaagugauaaugaugcauuaaaugugaaaauuuugaauacuuucuaaaagcacuaccaaucuacacagcuacuauaguguguaugcaguugcuaguuucucugcuucuuuaucaacauugaauauuugaauagauaugaaaugguaguugaauuuuuuaauuuuucacuuuuuaaauuagaaacuuggaauauuuuaaaagcagcuuaccagcuuccccuuuguggauuuuaaaauuugcguccuuuucccauuuaucuauuggagauccauuaagugguuuuuuuuuuuuuugaaguaguaguccuaagaaucucucaaaauugagugugguaaacuuccuauucauucuguacacucauagcaaaugguauaauaugugccaggcucuauuuuagccugaacaaaacagcugauguaguugcaaacuccuagagcuaaagggacucuuaaauaucauguucauuuuuuacccaaggaaacugaggucccaucucauguuauaugaucaguaauuaaccuuagagaaugguggcugaacuggaauuaaaguucugucagcaauguugccucccuacuauuccauauaucucuucuuuccucuuccuaauaugauaaucagauuucccuuucacuacauacugcuucuucuauuguauuuguagauucccauugguuuaagcaaaucagccuaauccuagucuugguucaaggaaccuguuggcucaugccauuacuuuggucacaauaauugguucaggagugaccaagucagcaaaaauugauccaguuagaggguagucuugaauuuucauuacuguuaacgucugaguauuuuaaaauuuucuuaauguuuuuacguuuuaaucugaguuaguaauauauuuaguuuacaaacgagauuuuuuuuuuuuuuuugagacggagucucgcucugucccccaggcuggagugcaguggcgcaaucucagcucacugcaagcucugccucccggguucacaccauucuccugccucagccuccagaguagcugggacuaagggcgccugccacugcgccugcuaauuuuuuguauuuuuaauagagacgggguuucacuguguuagccaggauggucucgaucuccugaccucgugaccaaaugagauuuuuaaaaccaucuuuuugucauuaauuucuaguuuuaucccauuauuguaagauaaugcaauguguaugguuauugaucuuguguuuugggccaugcuuuuugggcuauuauaugaccuaucuguguauaugcuaugugcuuaugcaaauaauauguauucucugauuuuauugcuuggaucuucaauauaucugcuuauacuguuuuugaucaguugaguguuaauauuuccaacugcaauugauuuuagcuuuuucucccuccauuuucuacaguuguuucugacauauauugagacuuuguuugauguggauguguucaugaugauuaugugguuuuguucuacuauuuuuauaaauauguaauaucucacuuuguccuucuugauauuuuuuaccuuaaauuuuguuauauuuauuuuuuauuauguuuauuuuuuuagggagacagaaucugccuauguuggcuaggcuggucuugaacuccuggacucaaucauucugccuuggccucccaaagugcuggaauacaggcaugagaccaugguuggccugccuuaaauuuuauuaagauugcuauguuagcuuuguugugguucauauuuguuugguuuauccuuucuuaaguauuacucauauugcucugucauuuuuuaaccuggcauaaaaaauguuuuauacuaauuugucuuuaaauuggcaaguucaacucauuuacauuauuguaauuacuguucuaauuggguuuaauuuucaucccuuucccuuuugacuaacuccauuccugcuuuucauuggguaaguugaaauuuuuucuauuuuuguucuuaugaugauugcccuuuagacccauuccucaguuuacuucuguauauuucuuacuuuuaaaauggcuuuuucuuccccuaaauaugacagauacucuagcauucucauacguucuuuuaaugugucuccugacuccccauccccagugaguauauugcugguauuuuagaucacuuuuuauggcuacuaaggcauuugacuacuuuuacuuucuuuaucucuuggagugcuuucuuuaucucuuggaguaccuccuauauuucuuuuucuuuugaguauucuuccaaaugugcaguuagugggcuuuaugugacccucugaggcuuuguauguugaaaauauuuuugucuuaacaucauauuggaaugauguuuuggauguaaaauucuaaguuuaaaguuacuuuaauucaaaacuuuuaaaauacaggucaagagucccuuuccugguauucuaaaaccaaauaaucaaaggguuuuucauaauuuauuugacuacaacacacaaaccaaacugguaugaggcuacuuacggauuuuauucaucucauuuaguguuaauguuuauagauuuugcuucaagauauuaaugaguuaaauuauggguuagugccuuagaugcuguuguggauguuacauaauaugugauauacauacaaacaccauauuaucuuuauauacucugaaaaaucauuguuuuggucuguuuugugcugcuauaacaagauaccacagacuggguaauuuauaaugaaccagaaguguauuggcucaugguuugggaggcugggaaguccaagaucaacgggccaacauguugcuguggcagaaggcagaagggagagagagaacaugagugagaagauagaacuccccuuuuuauaaugaacccauugaaauggggcacauagucuuaaauaugaugacagcauuaaucuuuuggggauuugguuuccaaugcauguuuuuuugggggauacauucaaaccauagcaauucugaauucugaaaaaaccccugcugcaaggauuauggauaaaggauuguggauuuacacuaccccauccuguguccagugucacuuuuugugauaucuaauauuaaucuuauucuuuuacuuuuggcauuacuguguucuuuuuuuuccagccuuugagauuuuuuucuuugauaaucuuaaauuuucuaggaaugggcucuucuguuauuuggcuguuugaggcuuuacauucuucacuucuuuuaucuuuaauucugggaaguuauuauuucuugaaauguuuauucuucccuagaaauguuucauuucccucccucuuucuggaacucuguuaccuggauauugucuguuuuacauauucaguauuucuacuugauccuuuuucaugguuuccuguuuuggcuucauauacuuauaucuuccauugacuuucuagggacacauucuuggaucauucauuccaguaauacugcuucagauggcauaaguuguuuagugagucauccuucuuucacaguaguuuauguuauagaugugucuauuugucugugucccuugcgggguauuagucacuuagucuaauaauaucuguuagggaauuuauguccaggugaguuuaaggaaaggaaggacuugggacccaggucaaauagccgccaccuggcaccauugaagugcugucaaguucuguuggcugcuacugcaucaggcaaauucugauugggauuuguuuuuacacucauauaaauaaauaauacuggauacuggaaagagguuaucuccuuagauuauaacucacuaccagcccuguagcuccccugccccuuguacaaggugggggcacagagaggggcgggaagagugaaugccaagaggauggcuuauuagucugugucugcuuuccugagcuuuccucucuaaggcuucugugccacccugauuuuaaacugcugacaaagacaucuaggcuguugcugccaauuucuguggcuaaggggcaaucaagggggagggaaaggcaaaaucuuaaagagcuuuuagcauaucucucuuuuaaguccuaccucugcuucccuuugcuucaggcuccagguuaccaguuuccuuucagaaaaguuaaguacagcuuuugguaucaccagcaguuuuuguucccuuuuguuguugcugccauuauuguucuuggaauccagauuuacuucuguuuuuuucuucccuacgguugauuuuguuggaagggaccagaaguccaugacaguuguuccucuugguaagaauuggaugacuucauuugauccaagaaagauaguuaaacaagauuuccucgaagcacauaaaaaucuuuaauugaagaguauaggcauacaaaauauacacaagcuauaugaaaauaaucauaagaauuaagaguuccaggcugggcgcgguagcucacaccuguaauccuagcacugugggaggccuaggugggcggauccccugaggucaggaguucaagaccaaccuggcccacauggugaaaccccaucucuacuaaaaauacaaaaauuaacugggcaugguggugggccccuguaaucccagcuacuugggaggcugaggcaggagaauugcuugaacucgggaggcagagguuguagugagcugagauugugccauugcccuccagccugggcaacaagagugaaacuccaucucaaaaaaaaaaaaaaaaaaaaaaaaaaaaaaaaaaaaaaaaaaagaagaagcgcuccaguuaucuaucacuguauaacaaacuaccucaaaauucaguggcuuaaccaacaauuauucuauuauaucucucaaucaugaaggucaggaauuugggcaagucuuggcaauucuucucuuaaauguagcaucaucagcuaaugguauucagcuaauaggugggcaggacuggaggauucuaagcagcuuuauuuacacguccggugauuuggcuaggaaggcuggaaggcuaagcucaguugggccuaugucugcgccauggucuuuccagcaugacgguuuuaggguaguuggaaucugagcagaagcuauaaagcuuuuuaugacguucuaagauccaagccuuguucuguagucaaacaagucuuacuaaggucaccugaauuuaauguagaggaauuuggaggaauaaccaagaauaacuaauaccacacaagguuauuagaguuuuuuuuucuguuccugauuguugcuuuuaggagaaugucauuaguucuuggcuucuuagggaaucuuuuccuuaucccucccaucugaaggggauucccuguaguagagggauaucauguacuucuuuuucaguucacuuuuauaauaauauuuuuccccaugacagugguucccaacugggggaaucacucuccaggggcauuuggcagugucuggagacauuuuugguugucacaacagguggaaagggguacuguucgugucuaguggauagaggccaaggaugcugcuaaauaucccacaaugcacaggacagugccugcaagaaaguacuaucugggcugggugcaguggcucauuccuguaauuccaguaaucccagcacuuugggaagccaaagcaagaggagcacuugaguccaggaguucgagacuagccugggaaacauauagacccugccuuuacaaaaaaaaaaaaaaaaaaaauuuaaguagcuuggcuugguggugcaugccuguagucauagcuacucuagaggcugaggcgagagaauuguuugagcccaggaggucgaggcugcagggagccgugauugcaccauugcccugcagccuggguaacagagcgagacccucucucaaaaaaaauaaaauuaucuaaaugaaaaugucaguagcacugagguugagaaauccugcuuuagagcaauccuggaaaguugguauaauucucauaaaugaaaacuuugauucagagaggcuauugaaugucacuuaucuaaucaguugugaaaucuauuuugaacacagguuuugccaaugucaaauucacggaaauucuacguacuauauauuuuuuauguuggaauuaauguauuaaguauuuauuuguaaauacugagacaaguuaccaagucaaaugcaacagagaauguuaauucacauucuaccucaauaaugcuuauaagaaucaacauaauuauaauuuaaaauaacauugaaauagauuaaacuaacauuucccuauauucuuaaaaaagaauagagagaaaaugcucugucuuaaauuacugugucugagcuguggguucaucauuuccaaaguaaggauaauaccgcuuaggauuacaaaaauuaaaugagauuauauuugucaaaguauauagugaaauauaugauuaacauucaauuuuuuuuccacaucauggcuuuauaaucuaguuggacuuuucuuuauaaucuagggaaauuuucuaucugugauuuuuuaaaauguagaacauacaaaaagaacagagaauccaagaauacugaaucucuuauuugacccacugugauuuguguagguuuauggaccagaaaggagaaauaguucauguucuuugacaacugguuaguauuuucuguuuaugaaaucuuccacaucauaacaucauuaucaaagcuuucuauuauuacaggcucuuuuuugaguaugaaaauaaagaucauuucaaauaccacauuuaaaaacauuuuucuccaauauuguucacgauucugacuguacaggguuauacaaaaaccuugaacauuuauuuauuuauuuuuuauuguuauacuuuaaguuuuaggguacaugugcacaacgugcaaguuuguuacauauguauacaugugcuguguuggugugcugcacccauuaacuuauaauuuagcauuagguauaucuccuaaugcuaucccuccccacuccccccacuccacaacaguccccggugugugauguuccccuuccuguguccauguguucucauuguucaauucccaccuaugagugagaacaugcgguguuugguuuuuuguccuugcgauaguuugcugagaaugaugguuuccagcuucauccaugucccuacaaaggacaugaacuccuccuguuuuauggcugcauaguauuccacgguguauaugugccacauuuucuuaauccagucuaucauuguuggacauuuggcuugguuccaagucuuugcuauugugaauagugccacaauaaacauacaugugcaugugccuuuauagcagcaugauuuauaauccuuuggguauauacccaguaaugggauggcuggaucaaaugguauuucuaguucuagaucccugaggaauugccacaccaacuuccacaaugguugaacuaguuuacagucccaccaacaguguaaaaguguuccuauuucuccacauccucuccagcaccuguuguuuccugacuuuuuaaugaucaccauucuaacuggugugagaugguaugucauugugguuuugauuugcauuuuucugauggccagugaugaugagcauuuuuucauguguuuuuuggcugcauaaaugucuucuuuugaaaagugucuguucauauccuuugcccacuuuuugaugggguuguuuguuuuuuucuuguaaauuuguuugacuucauuguagauucuggauauuagcccugugucagaugaguagguugcaaaaauuuucucccauucuguagguugccuguucacucugauggugguuucuuuugcugugcagaagcucuuuaguuuaauuagaucccauuuaucaauuuuggcuuuuguugccauugcuuuugguguuuuagacaugaaguccuugcccgugccuauaccugaaugguauugccuagguuuucuucuaggguuuuuaugguuuuaggucuaaccuguaagucuuuaauccaucuugaauuaauuuuuguauaagguguaaggaagggauucaguuucagcuuucuacguauggguagccaguuuugccagcaccauuuauuaaauagggaauccuuuccccauuucuucuuuuugucagguuugucaaagaucagagaguuguagaugugcggcauuauuucugagggcucugcucuguuccauuggucuauaucucuguuuugguaccaguaccaugcuguuugguuacuguagccuuguaguauaguuugaagucagguagcaugaugccuccagcuuuguucuuuuggcuuaggauugacuuggcgaugcaggcucucuuuugguuccauaugaacuugaaaguaguuuuuuccaauucugugaagaaaggcauugguagauugauggggauggcauugaaucuauauauuaccuugggcaguauggccauuuucaugauacugauuuuuccuacccaugagcauggaauguucuuccauuuguuuguauccucuuuuauuucauugagcaaugguuuguaguucuccuugaagagguccuucacaucccuuguaaguuggauuccuagguauuuuauucucuuugaagcaauugugaauggguguucacucaugauuuggcucucugucuguuauugauguauaagaaugcuugugauuuuugcacauugauuuuguaucgugagacuuugcugaaguugcuuaucagcuuaaggagauuuugggcugagaugaugggguuuucuagauauacaaucaugucaucugcaaacagggacaauuugacuuccucuuuuccugauugaauacccuuuauucccuucuccugccugauugcccuugccagaacuuccaacacuauguugaauaggaguguugagagagggcaucccugucuugugccaguuuucaaagggaaugcuuccaguuuuuauccauucaguaugauauuggcuguggguuugucauagauagcucuuauuauuuugagauaugucccaucaacaccuaauuuauugagaguuuuuagcaugaaggguuguugaauuuugucaaaggucuuuucugcaucuguugagauaaucaugugguuuuugucuuugguucuuuuuguaugcuggauuacguuuauugauuugcauauguugaaccagccuugcaucccagggaggaagcccacuugaucaugguugauaagcuuuuugauguguugcuggauuugguuugccaguauuuuauugagaauuuuugcaucaauguucaucaaggauauuggucuaaaauucucuuuuuugguugugucucugcccggcuuugguaucaggaugaugcuggccucccuaaaaugaguuagggaggauucccucuuuuucuauugauuggaauaguuucagaaggaaugguaacaguuccuccuuguaccucugguagaauuuggcugugaaucuaugugguccuggacuuuuuuugguugguaggcuauuaauuguugccucaauuucagauccuguuauuguucuauucagagauucaacuucuuccugguuuagucuugggagaguguaugugucaaggaauuuauccauuucuucuagauuuucuaguuuauuugcguagagguguuuauaguauucucugaugguaguuuguauuucugugggauggguggugauauccccuuuaucauuuuuuauugggucuauuugauucuucucucuuuucuucuuuauuagucuugcuagcggucuaucaauuuuguugaucuuuucaaaaacaccaacuccuggauucauugauuuuuugaaggcuuuuuugugucuuuguuuccuucaguucugcucugaucuuaguuauuucuugccuucuucuagcuuuugaauguguuugcucuugcuucucuaguucuuuuaauugugauguuagggugucaauuuuagaucuuuccugcuuucucuugugggcauuuagugcuauaaauuucccucuacacacugcuuugaaugugucccagagauucugguauguugugucuuuguucuuguugguuucaaagaacaccuuuauuucugccuucauuucauuauguacccaguaguuauucaggaacagguuguucaguuuccauguaguugagugauuuugagugaguuucuuaauccugaguucuaguuugauugcacuguggucugagagacaguuuguuaugauuucuguucuuuuccauuugcugaggagugcuuuacuuccaaguauguggucaauuuuggaauaggugugguguggugcugagaagaauguauauucuguugauuugggguggagaguucuguagaugucuauuaggucggcuuggugcagagcugaguucaauuccuggauauccuuguuaacuuucugucucauugaucugucuaauguugacaguaggauguuaaagucucccguuauuaucgugugggaaucuaagucucuuuguaggucacuuaaggacuugcuuuaugaaucugggugcuccuguauuggaugcacauguauuuaggauaguuagcucuucuuguugaauugaucccuuuaccauuauguaaugaccuucuuugucucuuuugaucuuugcugguuuaaagucuguuuuaucagagacuaagauugcaaccccugccuuuuuuuguuuuccauuugcuugguagaucuuccuccaucccuuuauuuugagccuguguguuucucugcacaugagaugggucuccugaauacagcacacugacgggucuugacucuuuauccaauuugccagucugugccuuuuaauuggagcauuuagcccauuuacauuuaagguuaguauuguuacgugugaguuugauccugucguuaugauguuagcugguuauuuugcucguuaguugaugcaguuucuuccuagccuugaugaucuuuacaauuuggcauguuuuugcaguggcugguaccaguuguuccuuuccauguuuagugcuuccuucaggagcucuuuuagggcaggccugguggugacaaaaucucucagcauuugcuugucuguaaaggauuuuauuucuccuucacuuaugaagcuuaguuuggcuggauaugaaaugcugaguugaaaauucuuaauucuuuaagaauguugaauauugucccccacucucuucuggcuuauagaguuucugccgagagaucugcuguuagucugaugggcuucccuuugcggguaacccaaccuuucucucuggcugcccuuaacauuuuuuccuucauuucaacuuugaugaaucugacaauuacgugucuuggaguugcucuucucgaggaguaucuuugugguguucucuguauuuccugaauuugaauguuggcuugccuugcuagauuggggaaguucuccuggauaauauccugcauaguguuuuccaacuugguuccauucuccccgucacuuucagguacaccauugagacguauauuuggucuuuucacauagucccauauuucuuggaggcuuuguucguuucuuuuuauucuuuuuucucuaaacuucuccucaagcuucauuucauucauuucaucuuccaucacugauacccuuucuuccaguugaucgcaucgguuacugaggcuugugcauucgucacauaguccuugugcugugguuuucagcuccaucagguccuuuaacgacuucucugaguugauuauuguaguuauccauucaucuaauuuuuuucaaaguuuuuaacuuccuugccauucguucgaacuuccuccguuagcacagaguaguuugaucuucugaagccuuccucugucagcucgucagucauucucuguccagcuuuguuccguugcuggugaggagcugcguuccuuuggaggaggagaggcggucugauuuuuagcguuuccgguuuuucugcucuguuuuuuccgcaucuuugugguuuuaucuacuuuuggucuuugaugauggugacguacagauggguuuuugguguggauguccuuucuguuuguuaguuuuccuucuaacagucaggacccucaacugcaggucuuuuggaguuuacuggagguccacuccagacccuguuugccuggguaucaccagcgguggcugcagaacagcggauauuauugaaccgcaaaugcugcugccugaucguucgucuggaaguuuugucucagaggaguacccggccacaugaggugucaagucugccccuacuggggggugccucccaguuaggcugcucgugggucagggaccuacuugaggaggcagucugcccguucucagauuugaagcugcaugcugggaaaaccacuacucucuucaaagcugucagacagagacauuuaagucugcagagguuauugcugucuuuuguuugucugugcccugcccccagagguggagucuacagaggcaggcaggccuucuugagcuguggugggcuccacccaguucgagcuuccaggcugcuuuguuuaccuacucaagccugagcaauggcgggcaccccucccccagccucgcugcuacuuugcaguuugaucucagacugcugugcuagcaaugagcgaggcuccgugaggguaggacccucugagccaugugugggauauaaucuccuggugugccguuugugaagcccguuggaaaagcacagcauuagggugggaguuacccgauuuuccaggugcugucugucacccuuuucuuugacuaggaaagggaauucccugaccccuugcacuuccggggugaggcgaugccucgcccugcuuccgcucacgcacagugcgcugcacccacuguccggcacuccccagugagaugaacccgguaucucaguuggaaaugcagaaaucacccaucuucugcgucgcucacgcugggaguugcagacuggagcuguuccuauuuggccaucuuggcuccacccccuucaugaacauuuuuuaaaaaguuauuauuuaguaacuguguuauauaugaacaaguaaucaccaccaguuuguaaaagacaaccacaguuauuuuuguacuggccaguaggcaccucuuguuaacaccagcacauggcaguccuguggucugauucaucccaaacccuucguagcaugucaucagugauagcuggagugauagccaugaugaaugccaucaguuccucaagucuacauggcggucccaacucuaguuuuguauuguuuuguuuauauagccucacuagaaauauaauggccugauagaugggaaucuaggcggcuaguguuucguaggcaguucagaguuuugagcagaaugccugucuacuaccaugauagguauucauuaaagaaucucugcaacugugauagaaaugagguagagccccauccuguuggcaaaugaaguuguagaguuguugagacuucauuuucuaagcaauauauguuuacucauuuaauccucacauaaaucuuugagaaaauacuaccauaagcuccauuuuguagagcagcaaacuagaacauacaaagauuaaguaacuugcccaagauccuagagauacugagcggagggauccagaauucaaacuuaggcuguguaguuucagagucuuacguucuaaaccaguacaccauacugccgauccaaauauguaccuacauaccagugugcaguaugaacauauaauauccaugugguacaggaaucucaagccaaggaauuaaauuaaaauguacacugcaacuugugagccugaccuugugaauuucgaagcaguagcaaaugugaacugcucuuuaagaaugcuuguucaggccgggcgugguggcucacaccuguaaacccagcacuuugggagaccgaggcggguggaucaugaggucagaagaucgagaccauacuggccaacauggugaaaccccgucucuacuaaaaauagaaauaaauuagcugggcguaguggugcacgucuguggucucagcuacucggcagacugaggcaggagaauugccugaacccaggagguggagguugcagugagcugagaucgcaccacugcacuccagcguggugacagagugagacucugucugaaaaaaaaaaaaaaaaaaaaaaaaaagaaugcuuuuucaaacagagagaccuggacuugcacaggaaaaacaguuucuaugguaagauaaugauaaggaaacaguccaacaugagagagagucagacaaaaaggguaauuagaagauuaugaauugacuuaacagaauaaucagaaaaacauaucuauuuaaaaugucuaaauaaacgacuaagacacuauaguaggucaauuuguaaaagagccaaauagaacuuauuaaaaugaaaauuaucauuuggccaagcgcgguugcucauaccuguaaucccaggacuuugggaggcuaaggcgggcagaucaucucaggucaggaguuugagaccagccuggccaacauaguggaaccccaucucuacuaaaaauacaaaaauuaacugggcgugguggugggcgccuguuguagucccagcuacuugugaggcugaggcaggagaauugcuugaacccaggagguggagguugcagugagccaagauuguaccacugcacucuagccugaaugacagagcaagaccccaucucaaaaaaaaaaaaaagagagagaaaauuaugaucauugaacuaaaagagucauggagaaaauuaauagguggguuaaauagcagaauagaaacagguaaaaguccuaaauauauaaaaaugaaucugaaacuagagauucugugaaaucagagccaaguacgaagacaaucuucaaaacaccuaucacaaaaaaagaauuuuguauucaaaugaccaagaauuagauugauagucuacuuuucaucagcaacaauagaggucuucugcaaagaacugaaggaaaagcacugucaaccaagaauucuauacuucgcuaaacugucgugcaagaauaaaggaaaaaauacaguagucccauuuuauucgugguuuugcuuucuuugguuucaguuuuuggccaacugugguccaaaaauauuaaauggaaauuuuuagaaauaauucauaacucuuaaauugcagccauuuugaguagcaugaugaaauuuugaaccgucaugcugugucucaucuggaacauguaucaucccuuugugcaguguaucuacucuauaugcuacccgucgguuaauguguaggcagaaacauaauuuauguagaguuugguaauauuuaugguuucaggcauacacugagggccuuggagcauuaucuuucaugguuaagagggaacuacuguauagauauucuuuuaacagcguaucugggugaaggauacaugggagauuucuguucuguauuaguaacucggcuguaaguuugaaauuauuccaaaauuacaauuaaaaacugcagucuuagacaaacaacugagaagcuuaccaccuucucaguuaaccauuaaagagcacauauuacugaaaaauuguuugaguaucuuuuuuuuuuuuuccaagacagagugucacucugucauccaggcuggagugcaguggcaugaucuuaguccauugcagccuccaggugcaagcgauucuugugccucagccucccaaauagcuggaauuacaggcauguaccaccaugucugguuaauuuuugucuuuuuaguagagucggguuugaccauguuggccaggcuggucucgaacuccugaucucaagugaucugccugccguagccucccaaagugcugguauuacaggcacgaaccaccaugcguggccugaguauguacuuucugaagaaggaaguugaacuucaaaggaaggauugagaggcaagaagcaauaaucaaaucaauuggcaaauuuggaaaaauauuaaucaucagcaucauuguguacuuacuguauacuaaguguuuuguuuaauuuucacaauagucccaugguauagguacuauuauuuuccuggacaacauuuuccaguuugaaagaggucauucagaccccaguacaaugaugaaaaaggaccaaaccaaguaacaucucuguggcauuugagaauuccaagaguuaaggaaaaaaauguuuaacucuucuagaagggaaauacaucacacacaaaggaaggaaaauuggaaugucaucagacuucucacaacccuggaaguuagcagauacugaaauagugucuuuaaaauccugagggaaagauuuuugucuugguauucuauauucaacuaaacgaucaaucaaauaucaaauguaaggaauuaaaacauuuucauucugugucccacuucuuaggaagccaggggaguauguguaugauuuuacaacauaagugagaaggaugagaagaggaagacaugauucacagaaacagaacauaccaacuuagagcaguuaggauugaagcaagaggcuaggaagaaaccaaaagaauauuugaaucaguacaucuauuaauauguucagguauuuggaaauuacagguguuuuacagaucugauauagguacauaaaaaaacuaagcaauuaaaaaagcuuagcaguuauucagagaaaacaaaagauuauuuaagaaaagauaggacggcugagguaggagaaucguuugaacccaggagguggagguugcagugagcugagauuguuccacugaacuccagccugggcaacagagcaagacucuugucucaauaaaaaaaaaaaaagauagcuaauuauaccaaguagucuaaaaauugauaauuugagaaguagcaaugggcaucuuacuuacaauuauaaaaguuaauaccacgcugggcacgguggcucaugccuguaaucccagcccuuugggaggcugaggugggcagaucaggaggucaggagaucgagaccauccuggccaacauggugauaccccaucucuaccaaaaauacaaaaauuagcugggugucguggugcaugccuguaaucccagcuacucgggaggcugaggcaggauaaucacuugaacuggggggguggagguugcagugaguugagauugugccacugcacuccagccuggugacagaguaagacuccuucucaaaaaaaaaaaaaaaagguaaauaccagaagaagcagcuugguaaguuaaaaacaguucccacuaagagauggagaggcacaggucagagauuugccauuuuuaauagucuuuuuuuuuuuuuuuuuuuaagauagggucucacuuugucacugggcuggagugcaguggcgccgaucucagcccacugcaaccuccgccucucagguucaagugauucuccugccucugccucccgaguagcugggauacaggcgcccgccacuaugcccagcuaacuuuuuguauuuuuaguagagaugggauuucaccauauuggccaggcuggucuugaacuccugaccuugugauuugcccgccucagccucccaaagugcugggauugcaggugugagccacugcaccugguuaauagucuuuuauuauucauugauucuuuuuuauuuuuuuuuugagauagauucucgcucuauuacucagguuggagugcaguggcacaaucuuggcucacugcaaccuccgccuacuggguucaagugauucuugugccucagcuucccaaguagcugggacuacaggcaugugccgccacaccuggcgaauguuuguauuuuuaguaggaacgggguuucauuguguuggccaggcuggucuuaaacuccugaccucaggugauccacccacuucagcuuuccaauguguauauucacugauuuuuaaaaagucuaugugcucauauuauuuugaauaacaguaaagauuugcuuaaauguaagaaggcauuuuacaggaugguuuuauucagaaaacuguacguaguaggacagaauuuuaguaugcauugcuugauaaacaguguauaauggucccacccaccgagaagaguaacauagaaauagaugggaggaaaaagacaguauauacaaguuugccuauauugguuugaggugccaggagacugcaagagaugcuuauuagcagguggauauaaaugucuaguagacucaagagagaagucagaaugaaaauacacauuucaguccaucaucuauaauacacugaaaaccugcuguguuugugucacagcaucauuauuucuaacucuagggagcuaaggaagaguuuagggaauauggauaaagagauggaaaaggcccaggcacgguggcucaugccuguaauuccagcaccgugggaggccagggcaggcggaucuccugaggucaggaguucaagaccagccugaccaacauggagaaaccccaucucuacuaaaaauacaaaauuagccaggugugguggugcaugccuauaauccuagcuacucaggaaggcugaggcaggagaauugcuggaacccaggaggcggagguuguggugagcugagaucgcaccauugcauuccagccugggcaacaagagcuaaacucugucucaaaaaaaaaaaaaagagagagagagauggaagaggcagagagagaaauaaagaagaagagugggaggagaaagaggaagauuauuaaagagagggaaagaugaacauggcaguuacucuuacacaagugggagaagaaauguggauauuaaagaauggaagaguaguuuucaacauauuuuacuuuccucuuuauauugcacacucuuucauguuugagccaauauaauauucucucuuauguccccuaccauaauaauggauacauuuuuuauguuaaauacuucagauuuaagugggaaaaggaagauguuagaaaaagccugaguagguugaugucaagauggcugaguaggaacagcuccagucugcagcucccagcaugagcgacgcagaagaagggugauuucugcauuuccaacugagguaccggguucaucucacuggggcuugucagacagugggugcagcccacggagcagggcggggcaucgccucaccugggaagcgcaggggaucggggaauucccuuuccuagcaaagggaagccgugacagaugguaccuggaaaauugggacacucccacccuaauacugcgcuuuccaacagccuuagcaaaaggcacaccaggagauuauauccugcgccugacuaagagggucccaugcccacggagccucgcucacugcuagaacagcagucugagaucgaacugcaagguggcagcaaggcugggggaguggcauccaccauuguugaggcuugaguagguaaaaagagcggccaggaagcucgaacuggguggagcccaccacagcucaaggaggccugccugccucuguagacuccaccuaugggggcagggcauagcugaacaaaaggcagcagaaacuucugcacacuuaaacgucccugucugacagcucugaagagaguagugguucucccagcacggaguuucagaucugagaauggacagaaugccuccucaagugggucccugacccccgaguagccuaacugggagacacaucccaguaggggcugacugacaccucauacagccaggugccccucugagacaaagcuuccagaagaaggaucagacagcaacauuugccauuaugcaauauuugcuguucugcagccucugcuggugauaaccaggcaaacgaucuggaguggaccuccagcaaacuccaacagaccugcagcugaggguccugacuguuagaaggaaaacuaacaaacagaaaggacauccacaccaaaaccccaucuguacgucaccauaucaaagaccaaagguagauaaaaccacaaauauggggagaaacuagagcagaaaaucugaaaauucuaaaaaucagagcaccucuucucuuccaaaggaaugcaacuccuugccagcaacggaacaaagcuggacagagaaugacuuuggcaaguugagagaagaaggcuucagaugaucgguaauaauaaacuucuccgagcuaaaggagaauguucgaaccuaucgcaaagaagcuaaaaaccuugaaaaaagaugagacgaauggcuaacuagaaaaacaguguagagaaguccuuacaugaccugauggagcugaaaaccauggcacaagaacuacgugacucaugcacaagcuucaguagcugauuuuaucaaguagaagaaaggguaucagugauugaagaucaaaugaaugaaaugaagugagaaguuuagagaaaaaaggguaaaaagaaaugaacaaagccuccaagaaauaugggucuaugugaaaagaccaaaucuacaucugauugguguaccugaaagugacggggagaauggaaccaagcuggaaaacacucugcaggguauuauucaggagaacuuccccaaccuagcaaggcaggccaacauucaaauucaggaaauacagagaaugccacaaagauacuccucaagaagagcaucuccaagacacauaauugucagauucaccaagguugaaaugaaggaaaaaauguuaagggcagccagagagaaaggucggguuacccacaaagggaagcccaucagacuaacagcagaucucuuggcagaaacucuauaagccagaagagagugggggccaauauucaacauucuuaaagaaaagaauuuucaacccagaauuucauauccagccaaacuaagcuucauaagugaaggagaaauaaaauccuuuacagacaagcaaaugcugagagauuuugucaccaccaggccucccuuacaagagcuccugaaggaagcacucaacauggaaaggagcaacugguaccaccagccacugcaaaaacaugccaaauuauaaagacuaucaaugcuaggaagaaacugcaucaacuaacgagcaaaauaaccagcuaacaucauaaugacaggaucgaauucacacauaaaaauguuuaccuuaaauguaaaugggcuaaauguuccaauuaaaagacacagacuggcaaauuggauaaagagucaagacccgucagugugcuguauucaggagacccaucucaagugcagagacacacauaggcucaaaauaaagggauggaggaagaucuaccaagcaaauggaaaacaaaaaaaaggagggguugcaauccuagucucugauaaaacagacuuuaaaccaacaaagaucaaaagagacaaagaaggucauugcguaaugguaaagggaucaauucaacaaaaagagcuaacuguccuaaauauaugugcaucuaauacaggaguacccagauucauaaagcaaguccuuagagaccuacaaagagacuuagauucccacacaauaauaauggcagacuuuaacacccgacugucagcauuagacagaucaaugagacagaaaguugacaaggauauccaggaauugaacucagcucugcaccaagccaaccuaauagacaucuacagaacucuccaccccaaaucaacagaauauacauucuucucagcaccacaucacacuuacuccaaaacugaccacauaguuggaaguaaagcacuccucagcaaauguaaaagaacagaaauuauaacaaacugucucucagaccacagugcaaucaaacuagaacucaggauuaagaaacucacucaaaaucacucaacuacauggaaacugaacaaccugcuccugaaugacuaguggguaaauaaugaaaugaaggcagaaauaaagauguucuuugaaaccagcgagaacaaagacacaacaaaucuccgggacacauuuaaagcaguguguagagggaaauuuauagcacuaaaugcccacaagagaaagcaggaaagaucuaaaauugacacccuaacaucacaauuaaaagaacuagagaagcaagagcaaacacauucaaaagcuagaagaaggcaagaaauaacuaagaucagagcugaacugaaggagauagagacacaaaaaagccuucaaaaaaucaaugaauccaggaguugguguuuuugaaaagaucaacaaaauugauagaccgcuagcaagacuaauaaagaagaaaagagagaagaaucaaauagaugcaauaaaaaaugauaaaggggaucucaccacccaucccacagaaauacagacuaccaucagaaaauacuauaaacaccucuaugcaaauaaacuagaaaaucuagaagaaauggauaaauuacucgacacauacacucucccaagacuaaaccaggaagaaguugaaucccugaauagaccaauaacaggcucugaaauugaggcaauaaucaauagccuaccaaccaaaaaaaguccaggaccacauagauucacagccgaauucuaccagagguacaaagaggagcugguaccauuccuucugaaacuacuccaaucaauagaaaaagagggaaucuuccccaauucauuuuaugaggucaacaucauccugauacuaaagccuggcagagacacaacaaaaaaagagaauuuuagaccaauaucccugaugaacaucaaugcaaaaauccucaauaaaauacuggcaaaccaaauccagcagcaccucaaaaagcuuauguaccacgaucaagugggcuuuaucccugggaugcaaggcugguucaacauaugcaaaucaauaaacguaauccaucauauaaacagaaccaaagacaaaaacaugauuaucucaauagaugcagaaaaggccuuugacaaaauucaacaacgcuucaugcuaaaaacuuaacaaacuagguauugaugggacguaucucaaaauaauaagaguuaucuaugacacacccacagccaguaucauacugaaugggcaaaaacuggaagcauucccuuugaaaacuggcacaagacagggauguccucucucaacacuccuauucaacauaguguuggaaguucuggcaagggcaaucaggcaggagaagggaauaaagggcauucaauuaggaaaagaggaagucaaauugucccuguuugcagaugacaugauuguauaucuagaaaaccccaucaucucagcccaaaaucuccuuaagcugauaagcaacuucagcaaugucucacgauacaaaaucaaugugcaaaaaucacaagcauucuuauacaucaauaacagacagagagccaaaucaugagugaacucccauucacacuugguacaaagagaauaaaauaccuaggaauccaacuuacaaggaaugugaaggaccucuucaaggagaacuacaaaccauugcucaaugaaauaaaaggggauacaaacaaauggaagaacauuccaugcucauggauaggaggaaucaauaucaugaaaauggccguacugcccaagguaauguauagauucaaugccauccccaucaaucuaccaaugacuuucuucacagaauuggaaaaaacuacuuuaaaguucauauggaaccgaaaaagagccugcauugccuagucaauccuaagccaaaagaacaaagguggaggcaucacacuaucugacuucaaacuauacuacaaggcuacaguaaccaaaacagcaugguacugguaccaaaacaaagauauagaccaauggaauagaagagcccccggaaauaauaccacacaucuacacccaucugaucuuugagaaaccugacaaaaacaagaaauggggaaaggauucccuguuuaauaaauggugcugggaaaacuggcuagccacauguagaaagcugaaacuggaucccuucccuacacccuauacaaaaauuaauucaagauggauuaaagacuuaaauguuagaccuaaaaccauaaaaacccuagaagaaaaccuagguaauaccauucaggacauaggcaugggcaaggacuucaugacuaaaacaccaaaagcaauggcaacaaaagccaaaauugacaaaugggaucuaaucuaacuuugcagccauaaaaaaggaugaguucauauccuuuguagcgacauggaugaagcuggaaaccaucauucugaacaaacuaucgcaaggacagaaaaccagacaccgcauguucucacucauaggugggaauugaacaaugagaacacuuggacacaggggaacaucacacacuggggccuguugugggguggggggagggagaagggauagcauuaggagauauaccuaauguaaaugaugaguuaacgagugcagcacaccaacauggcacauguauacauauguaagaaaccugcacguugugcucauguacacuaguacuuaaaguauaauaauaauaaaaauuucuagucaacagcaugcuguuaguacuuaaacuuuucgagaaucaacaguuauauauugguuuucgacugugcagggaauuggugccccuaacugccaugucguucaagggucaacuguauaugaguauguguuuugagcaugauccaaaguaggcaaaauccauugggaacaacccauuguaaugaagucacaugauggaaauuuuaugcagguauuaaaauaaugaauaugaagacuaagggaaaaauguacauaguguuaaauagagcaggagauaaaauuaggaauaauucaaaugcauaugcaguuauuuuuaagguaugugcacaaaaggacaaauaaaaaauuuaauauacuauuauucuaggaagguaggguuaaugggugauuuucuuaaucuuuuugcuuuuuucuaaauguuuaaugaaacuuguauaauaaauagaauuugugaaaacaaaaaacuugauuuagaacuaaucaagaauaaggagaacauaaauuauuuguagaauauccugauuaaugucaacaucauagauuacagaguaauugaguuuaaaguagauauauuuaaaaaaaucaaauauauuuguuuaauguguacaagggccuugugguaaaucaacuugaccuaagauacauuuccuucuauguagcaaaugagcaauaauuugguaauuuuaaacauuucaacaagaaacguauaauuuagacauuuuuaaaaaaagauuaaaauagccuuccuacucgcucauguauacaauuaaauuccuuggcaguuucugugguauaauucauaaugauuuucauauauuauuaaauuuauaaaaauacaaaaaaaaagaaaaagccugaguaaacugugaaauauuaccuaaucacacccuacaaaauauuaaugucaaaauugaauuacagaaguaaaacuuaacagaacuauaaugggaugauugauucauaauccugagauaaagaaauguuucuuaaguaagauaaaaccacuaaucuguuaugaaaauugacauuugacuacauaaggcuuuaacgcccugauaugaacgguauaaacaaaguuaaaagugauacaacaaaauuuauuuuguguguguguguguguguguguguguguguauauauauauguauauauaauuugacuuacguauaaauauauaauucuuagaauaaaugcagucccaaucagaaucacaggaggcuuuuuuuuggguagaaauuaacaagcugauucuaaaauauguaugaaaaugcaaaggaccuagaaaacuaaaagcaauuuugaaaaagaguauaauuggaagacaaaugacuaccuugcuucuaagucuuauuauaaugguacuggcauuggauugacaaauagacaagugcaauacaauaaucagcuuagaaguagacugaauguuacucaauuauuuuauuuuauuuuauuuuauuuuuagagagggucucacucugucgcucaggcuggaguacaguguuacagucauggcucacugcagccucaaccucccaggcucaagugauccuccugccucagccccuccaaguaacugggacuacaggugugugcaaccaugcccagcuaauuuuuguaguuuuuguagagacgggacuuugcugcccaguugcccaggcuggucuugaacuccugagcuccagcaauccacccuccuuggucucccagagugcugagauuauaggcgugaaccaccaagcucagcccugauuuuccuuuuuuuuuuccugagacggagucucgcucuguugcccaggcuggagugcaguggcaugaucuuggcucacugcaagcuuugccucccggguucacgccauucucuugccucagccucuggaguagcugggacuacaggugccugccaccacgcccagcaaauuuuuuguauuuuuagcagagacgggguuucaccauguuagccaggauggucucgaucuccugaccuugugauccgcccgccuuggccucccaaaguguugggauuacaggcgugagccaccgugcccggccucagcccugauuuucaauaaaggugcuaaauuaaucugauaagaaaaggauaucuucagcaaaugagcuagaacaacuggauauccauauuuuuuuaaaaaauagccuuuauacugucaaaaacuaaaauuuaauuaaaaacagauuauagguauaaaaauaaaagcuaaaaagucuagaaaaagaaacagauuaucuuugcaacuuugggauaugugaaagaauuuuuagaacccaaaaagcacaaaucauaagagauaaaacuuaugcauaagacauuaucaaaguuaaaaacuuuaacucuucgaaagauguuguucgguagacaaagaccaggacaaaauauucacuaugcauauauuggagaaaggauugaccuagaauauaugaagaacauaguaagaugacugaauuuaaaaaugggcaaaagguuggaacauauuuacccaaagaaaauacaugaauggccaagaagcacaugaaaagacuuaauaucaccaguuaucagaaaagugcaaauuuaaaccacagcaagauacuacuguacacccacuaggaugacuagaauuaaaaagauugauaguacaaagaguugguaggauaaggaauaacuggaacucucaaugcaaagugguaaaacugguuuagaaaacugguggguaguuucuuaauaaaguuaaaaucauacuuaguauauaacagcuuuauuuuuaauagccaaaaagcuggaaaaacauuaauauccaucaaaagauggguggguaaacagauuguauaauauccauauaauggaaaucuacuuagcaauaaaaaauaauuuacuaauagagacaacauagguaaaucuuaaaaacaugcugaaugaaagaagccagaugugaaaaagagugcaugcuguauaauuauauuuacaugaaacuauaggaaagucuaaucuguaaucagucauuuuaaauauaaggaaaaaauuaacccucauauuuugauaauuauaugugcaucccuaccucagucuuuuauaacugaguucagggaacaaugguuuggacuucgauuaaccacagagaaguagcugugugauaaauacauaguuugaaagaucaucuuaaaauaaguuaauuuuuuucaaaacgguguuguaccacacgugaguaucaacuguuucagcuaguuugagacggauuuagugcugcuacagcuaugaauaagguuuauugauauuuauauuuggucauugauuaauguuugcauuucugacagaaaccucuuuggcaucugauggaacuucagacccccuuccccaguaauuuuaccaguucuuccaaaguuucuagcaaggguguucacucguacuuaauucuguguuuugcauuuccacuucugaucuuccucaauucauuauuaucaacugcucauuguuaguuuuuuuuugagacagggucucacucuggugcccaggcuuuacugcaguggcgcgucuugguguacugcagccucgacuuccugggcucuagugauccuccaaacucagccuuccaaguagcugauaccacaagugcuugccaccacacccagcuaauuuuuaaaauguuuuuguaguuacggaauucugucauguugucuagguuggucucgaacuccuggucucaagcaauccuugugccucagcaucccagaaugcugggauuacaggcgugaaucaacaagccuggcccaguauuuauuaauaauuuuuuuuuuuuuuuggagacacggucuuguucuguugcccgggcuggagugcagugguaugaucccagcucacugcaaucuccaccuccuuaggucaagcaagucuugugccucagccaccugaguagcugggauuacaggugcaugccaccaugcccagcuaauuuuuguauuuuuaguagggaugggguucugcugcauuggccaugcuggucuugaacuccuggccucauguaauccucccacuuuagccucccaaagugcuaggauuacaggucugagccaucaugcccggccuacuuuuuaaauugacauuucauuuaaauuuuugucauuuaaggcugggcaugguggcucaugcccguaaucccagcauuuagggaggccgaggccagcggaucacuugaggucaggcguuugagaccagccuagccaacauggugaaaccccaucucuacuaaaaaaaauacaaaaauuagcugggcgugguggugggcgccuauagucacagcauguacucaggaggcugaggcaugagaauuguuugaaccugggaggcugaaguugcagugagcugagauugugccacugcacucuggccucggugacagagcaaaacucugucuaaaaaaaaaaaaaauuaucguuuaaaaauacauacaaauugcauaguggccaggcauuguggcucaugccucuaaucccagcauuuugggagaaggaggcaggcagauuacuugagcccaggaguuugagaccagccugggcaacauagugagaccuugucucuacaaaaaauuuaaaaauuaacuggacaugauggcacacacccguagucccagcuacuuggaagauuaaggguaggaugguuugagucugggaggcagagguugcggugagcugagauugcgacacugcacucuagccugggcagcaaagcaagacccugucucaaaaaaaauaaaauaaaauaaaauugcauaguggauacauguauuauuuaacaaauaauuauaaagcaaauaccuguguagcuaccacccaggucaagaaguggaacacugucagcauuccaggagcccauaagcaccucuuccuauuuguaauccuugcccucaggccuagagguaaccauucuccugacuuuaauuauaaguuuccuugcuuuaauuuuauauguauguaugcaucucuaaacaaaauaguuuaaauuguuuuugaaauucacagaaaucauugcauguauauugugucauguuucuuaucucgccaugugagaaucaucuguguugccugaagcugucauucauuuuguuuuguguaaaaccauaauucaccuuuuuucauuuucuucauuuuuuucuagauagauuuuaggcuguuucuucaaaguuugcagcaaauuaccuguuuuugcuauagcagaauaaugcuauuuugccauuuuaauucucguaacaaaaaagcaucuuauaucaauacaaggugagcauccaaauccaaaaaucugaaaucugaaaugcuccaaaguccaaaacguaaaaaaaaauuuaaaauuuaaauuaaauuaaauuguuuuguagagaugaggucuugcuauguugccuaggcuagucucgaacucuuggcuucacacaauccucaugcuucagcugcgccaaauguugggacuacaggugugagccacugugcccagccagaauuuuuugaauacugacaugguccaaggaaauguucacuggagcauuuuggauuucaaauuuuucagauuuaggguguucaguaggauaaguauaaagcaaguauuucaaacuacaagaaaaucugaaaucuacauuacuucuggucccaagcauuuaggaaaagggauauucaaccuguaugcucuuuauaauauauacuguacuuucauauauauuagcuaacuuaauccucauuucagaccugugaaauggcaaugcaguauuucauuuuauaacuaagaaaacugaggguaagccugggcaacauagugagacccugucucuauaaaaaguucaaaaguuagccaaaugugguggcauguaccuguagucccagcuacuucggaggcugaggugggaggaucauuugaacccgagaggucaaggcugcagugagccaggauugcuccacuccacugcagccugggcaacagagcugaaacucugucucaaaaaaaagaaagagagagagaaagagaagagagagaagagagggagagagggagggagggaacagagugauagagcuugucacuugccugaacuaacauuucuaaaaaauuagugcuauaacugucacagaucuuuuauuucaaaguccaaauucugaauuuuuuaaguuucacacaaacugagcguacuuaauaccugaacugaguuaagauauuuuagauuaaaaaaaaaaaccuaguuaccugacaugccccacugucuaguuuuucacaucaaaacauuauuauuuuucuuuggaaguugaccuaaaaagcauuuguauuaaauugcggguaggauguuggaguuuaacuucauuaaguugucagcagcaaaacuucaugcagguaggaggcugguaucuguagcauuugauuuagguggcaaaaaggaggaggggaacugauaguggauaauauuuugaguacagaauacuauugcacuuuucuacucaugucagucucauuuguaagcaaauuuaaggaagcucacuagcuaagucgccuuggauaagcuauuuaaugaccaaguuccaugauguucucuuuaaaagucccuucccuuucuaaaaucuuaugucuuaugaaucuaugagguuguuaaaauacucucuugugcuguagaccagucugaccccuuaguuauguguggaauuugcugagcuguauuuaaagccaaguuuauauguugauguuauuguaaaaugacucuccuucuguuaucuaaagauuucaaaaaguauagguuuuuaaaauggucauguuuuaagcagcuuucagcucaagaagugaaaguaacuauuaguauaguuauuaguggcaguguugaaguuucuugugaagaauucaauacuuccuugaagguguuuauauguaaauauguuuuacauauauauacuuuagaaaccuguucuaaaaaaaggaaauuuguuuagaaaagcaagaagauagaagauguauugauaucacauuccaaagcaugucugaaacauuuuaagauccauauauuuacuuaaauaaaaauccauggaauugcaaacaucuucuugguuugaaaauauauuuuagcagauccauuaucuaaauggaaauauguagcaauagaaguuauuguacuuuaggccaggugcgguggcucaugucuauaaugccagcacuuugggaggcugaagugugagcucagcaguuugagcucagccugggcaaaacagugagacccugucucuacacaaaauaaaaaauuagcaaaguguggcagcacacaucuguagucccagcuacuugggaggcuaaggcaggaggaucaccugagcucagaaagucaaggcugcagugaucugugaucaugccacugcauuccagccugggcaacacagugagacccuaucugaaaaaaaauuuuuuuuuuaauuucacaaaggcuucuuaaugggcaagauuuuugauccagggugaaauuaaacuuauuaaauagcagcacugaaauaauguucaugagacuguauauuuaagccuuuucucuuauauuccugcuaagaggauuggauggaggaaauaagugauacuauucuuugagcuuauaaaacuucacaguauuuacccaauucauuggccaaagacugccacuuccuugauuuagaguuuggguaagauaaggaauguucaucucugcuuaaauaaacauuccagguucugaauuuuaauuaauggcaaaaauguaaacuuuucuuucuuuugauauuccuuggauguaugcuuaaaucuuaacauguuauuuuccuguauguuagaggacuuguccucuggacuguagaaucaggguccugaauucaugccuuguuauacuacccagauuugugacacugagggugugugccuuaacuuuacauuacaucuuuaucuguacagcuacaaaaaucaccgucacuucugucuuuccagguuuagagucguggcuuuggaaaaagcaaaagggaggaauuuaauuucacuuaauguucaggacucugugauccuguaaugugguuguuacugaucuauaguuggcaaagcuuauaaaugugugaggucucuuuccagaauuuacaaauaagugauuuauauuucgccauuugggacaaaaauguuaacaucucuuugaacacagucaaauugauacaucuuuagucuuugaucuuuucauuucaaggaaggcucauuuucuucauucuaccacucuacuuuuuaaacuuuauauccauuuuucuugcaaacauugucuacacuuguugacucugcugcuuuccuuucacucacuuaaccuccuguaaucugaugucuacccacacuacuuuacugaaacugcuguugccagcgccacacuguguuugcugcacagucuaaggaauaguccucagucuuuccuaucucaguggcaguuaauacugccacccacuuucuccuugaaacaggcuccagugacaccacauuuaacggauuuuccucuucuaauucugguaacacccaaaccuccuuaguagacuucucuuuuucuaccuaugauuuaaaugcuguucuuacucagaggacucuguugagcacacuuugcuugucaugauaccguuuugccuagagaucauucauugcuuuagucauaaucugaugauugcaaaacuucuccuuggcuucagauuuauauaucaaacugucuauuggacaucuuaacuugacuauuguaguagucugcaagugauauaaacccacuucaucauaacuucaggcuaaagagggagauauguugccuuacaaaaccaaacgucuggugcacaggugaaacugaucuuagggaugccuagaaucagagauugaugucaucuugacuucccacuucucuuuugccgcugcuugucagcauuauuaccucaaaaccaucuuccacaugagguauaggauauuauugacuaaggacauccuuaaagucaacagcuuggcagucagaaauaaaaaauagguuuaacucuuuguccaacugcagauagaacauugccugacaaggauucugauagacucagcuugguuugccacagugggauguagaguauuuugacuaacaugcguucuaguaaugaugguaggaguggugggagugguagggaucuaauagcucgauucacagaagaaagccaacuuaaccucuacccauuuuucauguacagcucuaauuccaguggauaagguaauaaguuuguuuaugguuuuugaugaacugcaccugcuugauuaucuccuuagaauucauugcugugucaauuacugucugaguugucugugagaauaaaggacucaacugaagaaaccuauaugaaaauggugaucauuauuucuucuuggaauuagaaacuuguauguggcagucauaauguucuaauuagugauuuuuaaaaauuaacucauuaaaauaauccauacuuuuauaaucauaaaauaggaugccccacgaaggcaaagauuucugucugcuuuuacuacuacaccuagaacuugacacuuaaaaaguugcucaaaaaauaauuuguugaaucaauaucaguuuguuaaaaucuugauuuuuuuucaguguuuacuuuuuuugguaauauuuauuuuaagaaauaaaagcuuucaaggauaaguaaaguuuaacuuuuuuuuacuuuuucuuuuuuuucccuagacuaucuguuauagucccugggucaagacaacaauuuuuauaccuucgucgugguucagaaaggagucucuguagaaccagaagcaaagaaaggaaacaauccaaauuuuucuuuauuaaaucgacuguguaagauacuugacuuccaggaacaaaaacacggugaaauaauaaaauuucaucuuggcaucacuggacaucaucguauugaggagcguauuuuuggaacuucccgaguugagauuuggaaccuucauuggugcucauuuacuguggacuguaagcaugagugaauucugguuguguuucaacugcuguauugcagaacagccucagccuguaaguaugaaguauguggacacaucagguggggugcuuauuaaacuuuccacugguucucaaacugaggauugggauccuagcaguaauugcaaagcaguuguagagaauaccacagagaauaguucaguggaacuccgaacauauguuuaaaaagaaauaauguuuuuaaaguaaauacuguaugucaagaacucuccuagaccauucaucguacaugacugagaggagguguucuucugucaaauagcuucuggaggaauagugagagaaaaaggagauaguaaccugagguaaaacagauaaaucagccuuggaagucaguggguggaagaugugacagccauauugccaucauauuccucucagcuuaccaucucauuuuccucagagcaacccucugaggaagauaucauugucuuuauuuuucaguugaaacagguucaguuuuuugcccaaagucauauagcuugucaguggucuugacugacuucuugguauaugccuuguuuuugugcccucuaauauaugcacauauuguuaccucuaccaaaauccugcccuccagccuccaaauucuguuuuuuauuaagacggaguuucacucuuauugcccaggcuggagugcaauggcgugaucucggcucacugcaacuuccgccuccuggguucaagugauucuccugccucagccucuugaguagcugggauuauaggcaugugccaccacgccuggcuaauuuuguacuuuuaguagagacaggguuucaccauguuggucaggcuggucucgaacuccugaccucaggugauccacccgccucugccucccaaaaugcugggauuacaggcgugagccacugcaccuggccuccuuuucauuuuuuaaggugccuaaauaaaauguuacuuacauaaaaauugccccagcuuuccccugaaugagauaauacucaucuguauucccacagcucuuuaguucauuuuucuauuauagcauggaaccuuuugcauaguaaauaacuauucuacagucucucccacaacauuuugaauuauuuaugggucuucaccauguuaacuugguaucuucaggaucaaauauaauaucuuggagaguguagguauacaugauugauuguuggcuggcugaacaaaugaauugauauuuuauuuauauuuguaacaacguaagaggaaaaauaaggacuaaauuuuaaaaauauaauuguacacguaacucccaaucucaagugauucaccugccucggccucccaaagugcugggauuacaggcaugagccacugugcccuaccauauuguuuuaauugcucuacuuacuuaauauguuuugcugugucauaggggaaauuuuuucuuagcucuucuuuucuaacucuauuggugaugucuuuuuuaaaagcuggauugugguuacauguuuucuuauuauauuuuucuuuauuuuuuuucuuguuugagauauuucauaauacauauguaaaucuuagaguuuguuuguuuguuuuuuuuuuuggauugcauugaauuuauuuuauuuuauuuauuuauuuauuuuuuugagauggagucucauucuguugcccaggcuggagugcagugacgugauauauaauaaaggguauauaauaaagugaauucucuucaauauaugauaaauguauacucaccaauagcuaaaauaggaagacacagauuagguauuuaaauggcaggagcauaagccucuggaguuaugagacaucagaaauacauuuucugcuacacagaggauuugcaacuugaguuucucucauacugaaacgggaaaaguucccuugucccccuagaagccaugcgauggggguguggcucgcuucuucagugcccugcugcucaaaccucuaggggagcauacagacggggagcugugggguucugaccccacgacaaugucuagggaugaaucuuuauagcugaagugccagaaggcguguguuacagggugcuuuuuuaguuugccuuguguuaaccagcucaguuagacccucuaccuugucacagggacagaaggcuuucuguauccuggguucuugcuuuggugugcuagaagaauuggaucacacgugggcuuggagaaggagugcaaaguuuuauugaguggaaguagcucucugucgaugagggagccagaauggagaugguuuuccccuggaguugggcugcuagguggccccagcucuccuuuaacugccccggccaaacuccgccucauccagccaguugauggccugcuggcaugcuggugucuguuggugugcucuugugcaggcguguucccucgacgucuuuucaccgucuaaccgcuugugucuucuuccgcugaugugcuccucucgacguuuggcugucuaugugucugccugcuagggucuuggguuuuuauaggcccaggaugggggcacggcgggccaggguggucuuggaaaaugcaacauuugggcccaaaagcaggagugccuguccucaccuauguuuguccguggggguggagcccuagccauggaccugccuuucucuacccagcacuucccuguucccacucccauaucauuuaaagggaccacacucuucccuucccagcacucccguaucaguacaacauuuacauauguuaguuguuuguuauuguuuaaugaauacauacuuaugugaaguauuccauaaaaauuccauggacaucugauuucuuaccuuuuugauuccugagaaaaauuacauaaaacuuaauggggcuuuguggucaccauaauggaggaauagcuugcuuguuggcaucaggaaacagauguaaagaaucacuaauaauuuuuguuucuuuacauuauacaaagacauauccuugguauucuaaacaauaucaagacugccuuaucuuaaagcugcuugaucaucugcuaaaguuuucuaaaauauuuacugaaauaaagugcugcaugccgacucucccacuuguucccuaucacccccugcuuuugcacauuccaugugugaaaaaggaacaacccaauauugggaagaaaauagaauguauuuuucugaguauaguagaauaaucauuuuucuccuccuacuccuucauuuuaauauaguacaaugcaggguauaauagagccccaauguuuugagccgugguauuccaaaacuuaguaacuuaguaaugcuguaguugcuguugcuagauauagcuaagguuguagauuuuuaacuggaugguugcugcccugcaauuuaauuuuuuaaaaagauuuguuagggcugggcgcaguggcuaacaccuguaauccuagcacuuugagaggccaaggcagggggauugccugagcucaggaguucgagaccagccugagcaacauggugaaacccugucucuacuaaaaaaaaaaauuagccggugugauguuaugugccugaaguccuagcuacuccggaggcugaggcaggagaacugcuugaacccgcaagguggagguugcagugagcugagauugcgccgcugugcuccagccuggcgacagggcaagacucuaucuaaaaaaaaaaaaagauuuauuagcuguugacagaacuauagugaauucuucaccaacuuauugagcaucagaauacuggucagcuucuaagguagcuuuaaaaaacaaggaacccugauuuacagaaaaaaaaaaaaaagccacuuuucuauucauauuauuugccuucccaucuaaugguuucccacauagcacugauuuuuuguaaugcugcuuguaucuggaauguguuaauuuguuuuuguuuguuuugagacggaguuuugcucuugucgccuaggcuggagugcaauggugcgaucuuggcucacugcaaccucugccucccggguuuaagcaauucuccugccucagcguccugaguagcuggaauuacaggcacccuccaccaugcccagcuaauuuuuguaguuucaguagagaugggguuucuccauguuagccaggcuggucucgaacuccugaccucaagugauccacccuccucgaccucccaaagugcugggauuauagcugugagccaccgcgcccggccuuuuuuuuuucucuuacucuuuuuuuuuuuuuuuuuugagaaggagucucgcugugucucccaagcuggagugcaguggugcgaucuuggcucacugcaaccuccgccuccuagguucagacaauucuccugccucagccucccgaguagcugggacuacaggcaugugccaccacacccgguuaauuuuuauauuuuaguagagauggaguuucaccuuguuggccaggcagaugucgaacuccugaccucaaaugauccuccugccucagccuuccaaagugcugggaauugcaggcaugagccaccacaccuggccuuggaauguguuauuuuggacauguacgcacuuacaguacauuuguaacaauaacacucugguauuucuacaaugagccagguaguggugagauaacagugaauacaacagaugucaucucuaccaucaucuugucucacuuuaguggaggacauauuuacuguacaaauaaguauguaugguaucagguggugauaagugcaccguggaaaaagaaagcaagaaaaaagaggaugacguuggagaaauggggauaugaauuuaaauaguguguucagggaaggccucucagauuaagugcuguauaggcacaaguuuaagggaguaaaauacacaaauacuuggggcaaagcacuuagagugaguaguaagugcaagguugggugugugaguggaacaucagagaaggcagaguggcugugaggcauggggccaguggugggaaugaggucuaagagguaaccaagggccaguucauguuuggucuuccaggucaugaaaagacugguuuuuauucuuugugaaauaggaaaucauugaaugguuuagagcaaaaagccaaaguauguggaagaacauaccuauuuuuucuagugguuugacuuacuguaugcucagacagagagcacugacaaaccauacugcacacuguagcccagugagccacuucacuccuucaugcacauuuagccuccucagcugucuggaguugaguauggaauaugcucugcaauaagguugcuuauucccuuuguggcuuuucuuucugccauuuguuguuguucugauguauaguuuuaaccuauaauagucagggugggggcaugaggauaugugcaagugauggugcuggaguugccacagugaaacagaggaagugcagugugcucaguguuuagaugguucaagguuacuucaagggaagugguugaggaaacggaguggggauggaucaguuagacagcuaaggauugcuauaagaccuuagacauuuuagaaaacaucaaaguuaggccaggugcaguggcuuaugccuguaaucccagcacuuugggaggccgaggcgggcugauuaccugaggucaggaguucgagaccagccuggccaacauggugaaacccugucucuacuaaaaauacaaaaaauagcugggcguggugucgcaugccuguaaucccagcuacucgggaggcugaggcaggagaauuguuugagacugggaggcgaggguugcagugagccgagaucgugccacugcacuccagccuggacugggccacagagugagacucugucucaaaaaaaaaaaagaaaacaucaaaguuacuacugcagccucagaggaugaaccaacaauucccaugaaagguggcuagagggaacucuagcugagggcacuccaugaggggauuuauguaaaacagaaaagugauuggucaaauaugauggaucuccauagcuacuaugcaauaauaaccucguauggcacagauuuguauagaacuuccauuuucaggaaccacauuuuauacccuaaauuagguaugaguauaguaaaagugucaauuuuuuuccuucuucugaaaacacaaaugugcauguuccugauuuaauuucacacaucacauuauaaaaccauagucaucucaaaaugcuuaaacuaaauggauuuacuuaauaaaagaagaaaauuagccuuaucagggccuggcgugguggcucacaccuguauccccagcacuuugggaggccaaggcgggcggaucacgaggucagaagaucgagaccauccuggcuaauguggugaaaccccgucucuacuaaaaauacaaaaaauuagccgggugugguggcgggugccuguagucccagcuacucgggaggcugaggcaggagaauggugugaacccgggaagcggagcuugcagugaguggagauugcgccacugcacuccagccuggagacagagcgagauucuguuaaaaaauaaagagaagaauauuagccuuaucaguugagaaaugaaaacccuacguuuuagaaaaacaucauagaagacugauucaaauguuuuaacuguacuacuaaaccuagaaauucuaaagacuaguauacuggaacuaccuccccugccuuaggacugacuauugcuauuuucuuguagauagucacuuuguaauguaguggaugguauucacuguauauuguaccucuucagcuccuuuaauauaacuguggagauaguuugaauuugucuauauguacuugaaaacaaacuagaaaggcucuuuucaaaacuguggaacagacagguucugguguuccaguacuguugucugugcccuuaaccaauuaggaacuguugguaagcuaguguccauagcauucggcgugaguucaagauggggaaaagggauaagaaggcaguagaaagcuauuuauguuuugaaauuauaaugcuuuuauaaguuuguaaaugucagagaagaaauuuugcuuuaauguuuuucgguugagaauggaguugaucuuuauucaguucagauuggaggguuuuuuuuguuuguuuuuuuguuuuuuuuacuacauaccucaagaugaagcaagccauuucuuuguaaaccaugugguuguugcaauuuuuaguuacuuaaaaugugacaucagcaaaaguaauaaucuuuaaaagaaaaauuaaaucuucuuucaaacuguaauauauuugguacaaaaauuauaaaacaggccaggugcagugacuugcaccuauaaucccaacacuuugggaggcugaggcgggagcauugcuagagccuaggaguucgagaucagccugggguguaacauaguaggaccuugucucuacaaaaaauuuuaaaaauuagcugugugugguagugugugccuguaggcccagcuacucgggaggcugagguaggaggauugcuugagcugggagguugaagcuguagugagccaggaucgcaucccugcacuccagccugggcaacagagugaaacccuguuucaaaaaacaaauuuuuuauauauauauauaauuuuauaugcuuauauauauaacaggucaaaauauacaaucaaauauauauguguguguguguauaucauauacauauguguguauauauauaucauguaaugauauauauauguguguguauauauaucauguaaugaugcacaacaacaaacagauauaagcuccuacccaauacagaugaucuguugguggacauuugaguaguuucuaguuuuaaguuuuuuuucuguuacaaacugcuguaaauucuuguacauaucucaguauauacaugacuuugaguauacuuguuucuguagcauauauaucuaaaaguggaaauacugaauuguggggugugggcaugaucaguuucacaagauagugccaaauuauuuugcaaagggauaacugcucccacauuaaugugguauaguuucacuuucacaacaucuucauuaaugcuuguuuuuucacuuuuuaauuuuugucagucugauggguaaggugggauuucaugguauuguucuuuuccgauugcuagugagguuaagcgaagcacuucuucaugugcuuguugcucgguaugguuuccucuugugugaaagacaugccuguucaugucuuuuguacauuuuuaaaauuucuuauuuauucauagacuucccucuuacguucugaauacaaauucuuuguugguuaugugugauuuaacaaaguaccuuuuuuggcuuauauuuuugugcuuaagaauuuuuucuuaccucucauucauaaggauaauucacccaaauuucccuauaaaaguggaauaauuuugccuuuuagaagccuggaguugauucuguggauuuuuggagaagggauuuaauuauauuuauuuuccauguggggaacccucugucccacagcgacuucauaagaagucuuuccuggacaggcacgguggcucacaccuguaaucccagcacuuugggaggccgaggaggguugaucacgaggucaggagaucgagacuguccuggcuaacacggugaaacccugucucuacuaaaaauacaaaaaaauagcugggcgugguggcggacgccuguggucccagcuacucaggaggcugaggcaggagaauggcgugaaccugggaggcggagcuugcaaugagccgagauugcgccacugcacuccagccugggcaauagagugagacuccaucucaaaaaaaaaaaaaaaaaaaaagaagucuuuccccuccccacugguaugcaguguacauuaucaggcuucccuacaugcaugagucagacucuagauucuguuugaccauuuguucauccuggugccaauacacgaugauacacaaugucuucuagaguuugcauuaauacuguuuugauaucugggagggcagaucccuuugucuuuguucaccuuuugucguguuuuggccagucuuaguccuugacuauuacagaucaguuuuaaaauuaguuugucagguuuuccauaaggccuguugggauuuggauuagaccuguauugaauauaauucccauuugugaaacugguguaucuuuauuuuuaagcuauuuccauaaaagcuuuuuaaaacuuauauuuuuaaacauauucagaaguagacaguaguauaaugagcccuguguacccaucucucagcuucaacaacuuuaauucuugucuaaucuucaccucauuccauccacuuuauccuuugcucuauuauuuugaagccaaaucugagacauuauaucauuuuguccauaaauauuucaguaucccuaaaagauaaggacucuuauuuaacauaaccacaauaccauuauaauaccaaaaauuaauaauuugaaaggauuuauuuuacauauaaauguacaguauaaaaguuaugaaacaaauauauuaugaagcacauauuacucguuaagaaauaggacauugccagcaccccagaagccuccuuguguccuuuccaauuacacacgugccuguuccaacaccuggaggaacugcuguccugauuuuuaugguaaucacuuccuuguuguguuuuacgauuuuaccaucuauguauguaucccuaaacaguauaauuuaguuugccuguuuuaacuuuaaauggagucauuacugguuguaaucuuuugcguuuucuucuuucauccaaugguauauuuauaagauugauucauauugaugcagauagcuaauuuuuauguucauuuuucuuuaauguuuucuuguuuggcuguaccauaauagauuuuuccauuacaguucuuuugauaaaccuaguacgcgacuauuaugcacaaugcucuuuugugcauuuguguauguguagccugguaacaugugcccaaguuuuucuaggguauauaccuaggagugacauuacugggucuaacagcugaggaaguuaccuuuaccaagcaaaagcaaauucuuuuagacuugauguuaccaucuuacauucccaccagcuguuugaguguuccauugugccauauccucuucaacacgugguauuuucagacuucaaaauuuuuaucauugggggaagaauguaguaacaguuuuuugaagguuagccuuguauuguuuugcauuuuaauaugagagugaacaguaacucugacuuauuaauagguugugagcuucaggauuaugcacaaauuagagauuuauugaaguaguaaccccaguuccacacuuccacacccuuugucaucagcauauuccauuucuauuacaguguaagacuaauuauuucagaguacagaaaaagacacauuuagauaaacugaagcagauuaaagugacuuuauaagacaacaucuuuguuuuuauguuuaauuucaaguaugguuaagcacuaauuuaauucagugcuuucugcuuauucuguuucuaguaacucuuacagaaacaaguguagucaguagccaacauacauccaugucagccuauauaugacuuacuaggagggcuuaguuuuuuaaaagagaugaaaaauaaagagaaggucuaguauuuuccucccacauuccaacagaucauuuuaugugcccccuuugggugagcacauuccauguuguagaccauugaucauaguagucagagcauggagcucuggaguucagaaaaauuauuuuauuauuguuguuaugacaaaaauaauuaccauguaaaggaaaagaaaagaaacucagcgaaaaaauuuaugaacaaaagagaaaagaaacuuaugguuaaauaauuuuuaaaauaaauauggcaaaugagcaucaauuauuuuuuuuucuauaugcccauuggaaaauaucaucuugccucaucuaauaggcaacguuaaguggagucacuauguguuccucuuaacuggaagauuucuuucauucagugugaauacugaaacauuuauuuuaccuuuuuuuuuuuuuucuccccagcagagacagggucuugcuuuguugcccaggcuggucucaggcuucuggccacaagugaucuuccugccucagccucccaaagugcugggauuacaggcaugagcgacuuagccuggucaaacauuucuuuaguuguuugaaagucaucugacuauaucugugaaauuauguuuauuuagaaaacauagccuuuaauuacaaauucuguuauuguguaaaugaugugcaaaucuccaucuuuucaugagguggcuaaugauuaaaauggccaaagaguugcuucuaaaacaccaauagcaugaauuuuuuuuuuaaacugacuuuugggguuuauaagccuagacacaacaagaaugaagaggauuaagccuuugucugucuagaguuagugaggauuggguucugauucucacguggccuugauguauacaaauaggaaagaaaggaauacugguaaggaacucaaaauugcauuauuuuucaaaucaguaguagggugagacuagguagugcauuguuguagaaaaauaaaauguuuuugcugauauguaucugugacuaaagggaaguuagaacuuaaguaauuaucugggauuuaauaauauaaugguauuuuaauaacuaucuggggcugguauuuaugauguuuauaauauauugaacaguuuuagaagcacuuuuuaagaaucuguucaucugugauguaaacagaugguauaaaccauucaguuuucauccucucaaacuuguucauauugaguaggaaauauuacagauauauuuuauuagcaguucucaugcaagacaaauucuaggucaguucucaguucucgggguacccuaaaguuuggucugaucucuuaucaccuuugcacauaguaaaaauucuucugguucuuagauauuucugguauuuauguuccaucuacuuuugucuauugaacuuucuuauaguuucuugaaaagguguuaugcuuacauucuuguuuuagcagaugggauauuguuuguuuuauaugugauuuuguuuucuuuugugaaaugaaaauaauuuucauccaaucuuaauuuuagaucuuagagacaucauaggcaaacguagucaaaugcaugugggcaugcgugcaugcggauuuggaaaacuauaauaagaaguuaauuaguaaacuaaguuaagaucagugaauuaguggcagagccuuuugcauuuuaagaccaguuuucuuucuaguauauuucaguaaauuuuauccaaauagaaaugaacacccauguuggauauaaaguugaauugugagacuaugcagauacagcacuaggugauaaguuacagugaaacaagcaguguuucaguauuucagaaagcguuucuugcuaccaaguguuaauuauuaucugccauuuuuacagacuuaguucaaaugcuuucauauauauuaacuuaaugagaaacaugucuaucauuuuaauuuauucguuucccccccuuauuccccaucacuguuuguuuuguuuugguuuugguuuuauuuguucuugcagugucuaccuggguaacaguugggugaugucuucauugggaucuuaacaugaacaaauacuuaugcauguaccuguuauguacuuaugcauauauucaaaagucauuaagauacuggugauaguguuagcugucuguggaucauuugggauaaguaaacagaaucuccucuacauuaagcaaaaaaagauauuacucaaugccauuuuuuuggccuaccuuaugacagauaaaauuuuuaagaaaccuaaggcaaaugugcuuucaggaguacuuagcuauaggaagugaucauauuuuuaagaacuccaagguucuuaaaaaccaaacaaguuuuuccccuuuucaugugagggcugguucucuauuagaguuggucagaaaggcugggcgcggugguggcucacgccuguaaucccagcacuuugggaggcugagguggguggaucacgacgucaggagauaaagaccauccuggcuaacacagugaaaccccgucucuacuaaaaauaaaaaaaaauuagcugggugugguggcacgcaccuguagucccagcuacucgggaggcacugaggcagaauugcuugaaccugggaggcggagguugcagugagccgagaucacgccacugcacuccugccugggugacagagugaaacucugucucaaaaaaaaaaaaaaugucagacagauccggauuugaauuccagagcugguacuuauuuauuuacuguuugaccuugggcagauuaauugaaucccugcaaaugagaauaaugacaccugucucauaggauucaagauagguagugaauuaaaauauauuaagauaauuuauguaaagugcuuagcagagugcauggcauaagugaaugcucuuauuauggauguugaguugauaaauugcaauuugcucucauuuuaaguaaugggcuuuuaaaauuuugcuuuuauccccauugguuauauucaaguacauuucuuuuugaaaugaacaugaccaucaaaccuuaaagagcuggucucuuaccagcaauauuuuguucucauuugauuugacguuaguuaccacaaagagagauauaguuaucucaacauaagagaggauguuggacuggguuuauauguauauuuucuucuuuccugaaacccuacuucacaagacauuaaaggaguuuaaauaacaaaaagauaaaaccuacaaagaaaaagagagugaagaggagagagaaccguggaucagauauaauaaaaaaauagaugggaugguagagugggaaccuauuuagcugagugagccacugccuaacugcguacagagggggauacugauaagcaagccagccagccagcauucuucaccugccuucaucuuagaaugccugcagcuagauucgaacucuucugucuggacuucagcagguccuuuucuagagagccuacugccaucacagaagggaccugcugauaaccugcaauugugguuuccccaagcaaaaagugagcucaccaucugaucacuguucauugaauuuacaguugaacaugacccgugcacacuaagccucguuuggauggccuguguucauuagacaacagaaaagcuaaaaggaaugaacugaauaaaagaacucggaagaaauagaugauacaggcaauaggaaagaacuaaaaaacaaaacagaaaacaugaauaggucucagaugauaagacacuggauucacuaaacaagaacaacaugccuacaaaggaagcgagagagagaaggaacaaaucgauaacaagaaacgaugcuuggaaauaauaugauagcugaaauaaaguagugcaugagaaggcuggaagauguaguucauucuuccagcaaguaaaagaaaaauauaaagaaauguaaaguagaagggaaaauuaagaaaguuagaugaucaacccaggaaguacaaaaucugccuaaaguuacaaaaaagaggacaaaaggcauuggaggauaauaaauuaucaaaguaauacuacaggaaaauuucccuaguaaauuaucaaaguaauacuaggggaaaauuucccugaacuacaaaacaaaacaaaacaaaaaacaguagucucuugguugaaugaaaaagaacccauacuacugagugaaauuucagacuaucuggacaagucacuuagcuauuuaaucgguuauaccacgagauacuuauggaggguauuagaacaauuaaugauaguuucauuaaaagguaagcaaacaacuuugggaggccaaggcagguggaucacgaggugaguucaagaccagccuggccaagacggugaaaccccauuucuacuaaaauuagcugggugcgguugcaggugccuguaaucccagcuacuugggaggcugaggcaggagaaucaccugaacccggguggcagagguugcagggaggcgagaucgugccacugcacuccagccugggcaacagagugagacugucucaaaaaaaaaaaaaaaaaaaaaaguuaagcagacauuguguguaaaauuugugacagaauuuuuuuuuuuaagcuaagcaagccagaagcaauuccagugcaaagugugguguaagaaaaauuaauuauaguacaguacuuggcucaauuguaaacacucuucacauagaguuaauauaaacacuugauuuuuguauuucaauuuuauauaguaaauguuuggggggaauuauaugacuugcuuugaaacacaguuguucacacagugaugugaaggaaacaacaguggacaaggaagacucccagaucugauuuuaguuagcugugggacuuuggcaaguaauaucuuccuagguacauuguacauuguauacauacaguguauagaaacaaucccagauggacccauagugacagaaauuucuagugaaaaguuuuuaacaccaaugauauuaacaauaucauuaauacuugaaagcuaguucagauuaguuucuccccuccuuuuuuuuuuuuuuuuuaaccuauuuugugcuucaguuuucauacuuggaauaugugacuuaaaccagauacuaauuuuaaauagaaggagaaaaaaacuguuuucacuucagguuucucacugagagaugagaacaacuaguuccuucaauuuugcuuuuagcaauuuggcccuugaaaaggucacuauagauuugcuuagagauucuuuuuaaaaacauuugggggucuccugcaaacuucucaucugucaaaagcugcaaaauacauacugaguaggaaaagguuaguuaccuacuaaacccuaaaggacagauaccgacagcaccacacuuaagauugaauuguaaaugcauuaccagcaacucaccuauuuauuuaugaauauuuccaacacaaaauaucuuuccuuucuguacuuugacuuagauaauucucugcuuauaauacuagcugguuuugguuucucuguggugaucuauggugugacucucaucuccucuggagagagcuccuuauauaagcucugucaccugagggccacugcuggcauuccagugagugagcuaagcucuagaagccagacaaguagaauuauuuuucccaccguagaagauacaguacaaguucauguauagaagaaguuuauuauuuucucaaguuuugaccuaaguaugagaauuuggaauccaaaguaggcuauucaguuauugaagagcagauauuuuuccagucucugcaguaucuaaaaccuuguuucucuuucauuugucccuuaacauauuagagauuuuuuugucauauucuuagaaacuagacuuccacaggcaguuuuaucaacucagauuaccacccaugggaaggcugaauucagcuucuuuaacaugaauauccaggaccuggacacuguuaagacucccaucuuggccaggcaugguggcucaugccuguaaucucagcacuuuaggaggccaagguggguggauuaguugaggucaggaguucgagaccagccugaccaacauggugaaacccaucuuuacuaaaaauacaaaaaauuagaugggcaugguggugcaugccuguaauuccagcuacucgggaggcugagacacgagaaucgcuugaacccaggaggcggagguugcagugagcugagauugcaccaccgcacuccaaccugggugacgaaugacucuugucucaaaaaaaaaaacaaaaaaccuuuauucaauagagaguacaaaggugaacaaaugaggacuucugagcaguggcugagacaagaagugagaguuugccagaggaucccagauuugaagggaagguaaaaugucauauacugcuauagaagguacuagcaaaugaguucauggcuuuaaaguucuuggaacugugccugguaucuuauaaguacucuuuauuacccacuuuuacuuuuuaaauauucagcuguuaaucuuuauuuuuuaauuuaccuuugagguucaggggguacauguguagguuuauuauauagguaaacugagucacagauuaccugcuguacagauaauuucaucacccagguaauaggcauaguaaccauuaggucguuuuuugauccucucccuccucccacccucuacucucagauggguccugguaucuguuguugccuucuuugugaccauguguacucaauguagcucccacuuacaagugagaacaugugguauuauguuccuguguuagucugcuuaggaugauggccuccagcuccauccauguugcuccaaaggacauggucuaguucuuuuuuaugguugugugguauuccaugguguauauguaccacguuuucuuuauccagucuaccacugaugggcauuuagguugaugccaugacuuugcgauugugaauagugcugugaugaacauauguguacaugugucuuuaugguagaaugauuuauauuacuuuggguauauacucaguaaggggguccugggucaaaugauacuucuguuuuucacuucuuugagaaauugccauacugcuuuccacaauggcuaaacuaauuuacauucccaccagcaguauauaaguguucccuuuucucugcagccucaccagcaucuauuauuauuugacuauauguaauuuuuuuuuuuuuuuuugagacagagucucucucuguugcccaggcuggagugaugugaucuugacucacugcaacgucugccucccggguucaaacgauuauugugucucagccucucgaguaguugggacuacaggggugugccaccacaccuggcuaauuuuuuguauuuuuguagagaugguguuucgccauguugcccaggcuggucucgaacuccugagcucaggcaguccgcccgccucagccucccaaagugcuaggcuuacaggcgugagccaccacgccuggccugacuuuuuaauaauagucauucagcuguuaaucuuuagagccaguguuuucuauuaaccauuaagccaucaauaucacuuggaaucuuguuagauaugcaaauugaagcuccacuccaaacuugcucaaucugaaaaucuucugugacuagagcucagaaaccuguauuuuaacaaaccuuccagggauucugauguacacuguagcuugagaaccacugcuuuacagguucuacccaauauaaaaacuaaaacaguguuaccaguuaaaaccucucuagagcacacagcauuucuaugaaagagagaaaauuaaaucagcagauaaguauuuuuuaugcagaaauguagacuucauuagaauuggcauuacauuguuuacaucuuccaaauauaauagguucuugagaaauauuuggcgauaauauuagauaagacaaacaauuuuuagagaacugagcugacauuguuucuuuaaaaaagccuuuuauucauucaacagucauuuauugucuacugugugucaggcacagcuacuguuacagaacucuuaguaguguaggaaaaucaaacuguaagcaaguaaguuacaauacaauguuuuaaguacuauaauugaauaugagccaugugcugugaauguucagaacaggaaauauccaacagccucaacucggaauguuuauguuugagcugggucucaaagaaugaguagggagagacuuggggcaaggguguuucauauaguuuguugacauuacuaccauaaaagguauuuucauuuuuugugucaaugaauauccacuaggaagaucauuuucaucaaaaaaugucaaauccauuuuuuauauuauuacaacuuuuguuagccuuuuuuuccauacugugaacuagauugauuaacuuggaagcagcucacgcacccagggaaucacugucacuggcaucauagaaaaaaaauacccacuuguuuuagaaaugccugguuccuaauuacacugucaauauuucaaaaaacuaauguagcuuauuucagagguucccaaacuucucuuaacgguucuguaauuuuuuucauggugccucuaggccaagagaaauaccguacagacuuguuuauuaacuaauuugguacaaacaacuuaguaaagauuuaugucccaacaacuuauuugccuuuaaaaaauaagauauaaauugaaaaauauuuuuauuuaauucuuaaauaaccaguuacauacuuaugguguguuugugccuguugggauuauacaacuucucaaacuguggaaucagacugaacaccaccaccuucuuuucuaguuccauacugacuuuugcauagugcuuggguuuuuuucacaguaaccacugaaaacucagcuucacaaagauaugcuguuaaaaagaauguauguucuaauguugaaguuacaaauuaucugaagcugguaguucacucagugucaaacacacauugagccucacuguguuucccucaaauagaaaacccuggcaccccuggguuuugcugggaugccccaagacacaauuuggaaauagugggcuuguuagauuuaauucauagauuuagggauuuaguuacacaacucaacugacuuucucuaggucauaaaguugagucagcauagcuuucaaccuuucauuuacuuuggccacauuugcauaaaugauugcuauuuuauacccugaaaguuccagcuuuuuucacugucccagauggcaaguauuuucauuuucuuuauucacucuguaucugcuucuagaacuaccucaggcuguaccaucuuuuacucuuacuguaggccuucugcuaaccugaugggaccuggccuucauuugcuucucagugacauguguuugcacacuaagcugcccagagaauagucuuugggaaaguuuuaacuuuuaagugaugauguaauuacuguuuucuagaagcuacaguugauccauaugccagaaaugugagggagguagauauaguaugguuauauacauauuguuuagauaaggaugcaaauaagguucucacaguagcaaauccuuugaaauuaaccugcuucucgccuccuuggauauacuccaaauuguuuaguucauuaucuuuaauaauuaugauguaauuauguaaaaaguuaugggaagagacauuuugccuaauguccccuccacacuaacauagcaguucauuugggucucuaguccuucaccuuaugcagaauaaaaguuaauauuuuaaggaugcaaggauuauucagaugguugacggucuuaacaaaguuuccuauaaagaauuuguuuccaggaaacacggugacucugcuaacgacaacuguuaauacguaucagagcagagugcaccauuuccuguuuuucuuugcggaggucugacucuggaauuccccuuguuugcccaugacuauucuuuuuuuuucuuuugaaacagagucucacucuggcacccaggcuggagugcaguggugugaucucggcucacugcaaccucuccccgccaaccccccaccccagguucaagugauucuucugccucagccucucaaguagcugggauuacaggugccugccaccaugcccagcuaauuuuuuuuucuuaaagaaaauauuuaauuuuccauaguuauuggggcuacaggugguguuugguuacaugaguaaguucuuuaguggugauuuguggauuuugguguacucaucacccgagcaguguacacugcaccauauuuguagucuuuuauaaaacccuugccccccucccacucuuccagagccccaaguccauuugaucauucuuauggccuaauuuuuguauuuuuaguggagacaggguuucgccauguuggccaggcuggucuugaacuccugaccucaagugauccaccugccucagccuccugaagugcugggauuauaggcaugagucaccaugcccagccacccgugacuauuauacaguaccccaaacaagugugccauucuuuaaauguccacauugugccuuaaaauacugcauuuuuauaguuuagaauauuuauuuauauuuaaauccagguuuuugauagaguguuguaggaaagaguguaaagaacacuuccaccugugucuagauccaccuuuccugccuucucaggaaccuuguaagguugacaauccauuuucuuuuuccuucuuuuucuguaccucuuuuacuggaucuuucccauuagaaauugagcauaaugaauucucugccaucuuacaggggaaaaauucaaucuguucucaucuccuuuucuccuuucagccacugaccugucuucuuccuguccagaaggccagacuuuucuccagaguugucucuguucucuuucuccauuuuccacuucuuagacccaccucaguccccugcagcgugucuucuccuccuauuacuccacugacauagcacucacuaaggugcccauugacuugauauugcugaauccauugcacguauuugucuuuaauugaccucucaccaccuuucagcucugcucccucuugacacuuguacacacugcugauuuuccuacugacuuucaggcuguuucuuuuuggccuucuuugauggcuucuucucugcccaaccacagaaauuuaguuugucuaggaaaucucauuaacuuggcuuuguuaaugcuggugauucucagucucuuaucuccaguuuggauucucucagaacccagugaauugcacacucucugcugaaaucugaagucugugcauauuucuuaacuccucccucucacuguuaccaaauccagccugcaaccaagugcuguuuuuuuuuguuuuuuuuuuuguuuuuuugagagaagucucgcucuugucccccaggccugagugcaauggcucgaucucggcucacugcaaccuccgccuccuggguucaaacgauucuccugucucugccucccaaguagcugggauuaaggcaccugcuaccacgccuggcuaauuuuuguauuuuugguagagacgggguuucacuguguuggccaggcuggucucgaacucuugaccucaggugauccacccgccucggccucccaaagugcugggauuacaggcgugagccaccacauccggcccaaaugcuguugauuuuauccacugacuacuucuugaaucuauccacuucuaucuguguuauuaguugaauccacauaaucccuuuucaccaacauuaauaacuuauuuugaccucuucuaacauguuuuccaccuauagcuauuguggaauagucuucucaagcuauuuaaucauguuauuccucugcuuuaaaacacuuucaauuauuucccauuguucuugggaggaucacacacuucaguccuuuacaaacucuaugugaucugguucuugcuuaucuuacuauuuucaucuuagguguuuaccuuuacuaugcucgcacaacacaguugcuccuuucaguuucuggacagcugaguucccucagccuuggggagcgaaggacugaaagcuucuuucauaucucacaaacuguuagauuagaugccaugaagaaaccuuccaauacuaaggugugacucccagcucaguauaguucaagcugaaaaauacucacuauuauuuucacauucauauauauuaguuaucuaauaacacaguaugauagaaguaagcugaagucuucccauccuuugcuuuucagugucagaguagcuucuugggaacuaguuuuguuaucagcuuuugaauauucucaguaaucauguuugcugaauuauuguuugugaguauguguuaauacccuucuuucacaagcauaucuauucauucuuuuugggugagaugggugguggccugagcacacuaugguuucuguucucccccaacacaguccugcaguaacucaacagaauaaaucacuuaauauggagguauagaccaaguggagccuuuuggcaagcucuaaacacacccuucuggaggaaaugaugcagaaugagaacuguuaggaguugcuucugcagguucacaggacaaggguugaucaagacuccuccuaguggucuggaaguagguaccaggaaguauucucugguaccaccuccuccccugcuugagagagccaaguggcucucucugcauaucagaagcaguuaucuugacauguuuacugcaaacgccuggggaagagucugguguccugcagaugccacuguccuguggaacugugacaagaaccuagaagcuucccucucuaccugucaguuaaguggcucacuggggaagaaaucccaauaauuuguccugcccacaugcugagaaaauucguauccugugaugguaaagauuacauuucuggaccugcccaaauagcuuccuaauaaggaaauuuaguggaaauguaauaauauauuauuaagaagagaaaaaggcacaaaacuguuaacaucuuuuuucccuacuuuauuccuaaaaaagauaaguuagcauuguuuaaggcuaauucauagaauuaugcuuuaucauuccaaacaaaaauaguaugaagagaaguauguugaauggggugguuggaaauagacaaacugagucugugaaaaagauggggaacagaggaaaagaccagugcauugcuggcaugcagcacuccagaucaaaggaugguugugggugucaagucugccauuaggggcagggagucuuuguaugaggcaccucuaagaucaucagagggagcaguaugcgagaaaaagauagcaggaaaccagugcauugugcuaggaaauagaaaaauuaaaacacauagacaaaagccucuuuugacuuuaugauaccauuuuaaccugcaaguuuuaugauucuguggaacagggccccaaaagacagacaguuucuuaccaacuuucaaaaaaaggcuugaaguaaaacuaaaguuguucaaauaaagaaaugagaguucuuuguucccuaguguuauagacuuauaauuuauauaguuaaguguuuuuagggaaaagagugaaaaacuauaauaauacaacuuuuucagagauuaaaaaauguugcaaugacaugucauaacagccucugaaaaauaaccauaauggaaaaaaugaaauuauguggcuacuacugaaaaaaucuagagcuggggucagcagacuacuacuuuuacaggcuaaaucuagccugucaccuguuuuuguaaauaaauuuuuaccauaacacagcuauacucauuuaauuucaugugcucugcagcugcuuucaugcuacaauagcagaguugagucaaagcuacaguggagauuguauuuggccugcaagguuauaauauuuacuaucuagcuuggaccucugaagaggauaaagcagaguuacuuuucaaugcagugaaauuauaaagagaaauaaaggaugaaaauauaagaaacuuggaagauuauagacacacacauguucaaauguccacauaggcaggaacuccagaaauagcaaaaugaacacauggagcaauuaucaaggaacuaacagaauaaaacuuuucuaagauacagaaaaccuguguucagauaaccgugugccacgcagaauuacuggaaggaaaacccaacaaacuuggagauggucuaaugucauugcugaauucuaaggaugaauaacauaaauauuucaaaggaaaagcgucaggguuuuuugugguuguuguuucuaucuaugacaauauaaacgagaggacaguaaaacaauguauauggacuucuaaaauauaugcaugggcucgccacuuuugugguuuuguagaaagucauguuuucacccugaggagcugucauaugggacucucgugauaaaauuuuaggguuuaucaggaucaugccagcguuucaguagauaaggacauaaaaguguuauguucaaaggcagcuaauccagcaaguuuguaacucugcuugguuuugagggaagcugcaauuucaggagaaguauacuauugacaguaaacugggauaagcagagccccauaguaggacacuaacccaacguggccaguggucucucccaauaacauuaucauaucuaagggaucauggaaaacaggacagaucuaagauaaucuucauaucuggaaaacucuuagauaaucagugaaacacagcaguacagucaggaaauaucucuaagggguagaugagcauauuggucagaacagggacaccagcugguggcuaaaguuacuggaaaauggggcucagcaccccaugagaagugcuuuucaaaaauuaggaagagucagccaggcguaguggugcgugccuguaaucccagcuacuugggagcugaggugcgaggauugcuugagcccaguuaaaagaccagccuggguaacauagcaagacuccaucucaaaaaaaaaaaaaaaaaaaaaauuaagaagagugaguaagacccagccuaguuagucaacagguuuaguucccagcuagaacagaccagagaagagugaauggacuaggaccaaaucugucacccucucacccucccaccuccacccccuccagcugaaaugacagauucauuuuagcauagaaagguaauuggguauaaucugaauaauaaccaucaaaauauaauacaucuguuaaugaugaaagccagaaaguaauguuuaaaaucagacaguguauucaaaccacuguguucuuugccaacaauaauagugacugaggguaauuuuacauuugucucguuuuuuaaaaagaauaaaacuuaagcaguuauuaaauauguggaugaccaaagcuagaccaaauaaucuauuaagcucuaaauaauaaccuguuauuuugcuuuacuaaucauuuuugugcauauauuugucuuggggauuucaucauaagaaguaauuguggcagucuaagagcuaggcauuuuuguguucuuggcaaauuuauuaaacagucauaguauaaaaauccaucagaauaaguugcucauaagaucacuuucucaacacauuuguuccccauauuuuagaaaaggcgacggcggauugacagaaguaugauuggagagcccacaaacuuugugcauacagcucauguuggaucaggagaccuguucaguggaaugaauucaguaaguauguuggugggacaugcagguagggcauuggggcauagucauaugaaaccugugugacaggcacaagcauuuuuaauagcauuaugcuaaaugaauuuguguacagugaauguaaauacauaauaugagcauagaagagagaagcaaacuacugaugaaaaauuaaucucuuugaauuuccuggauuagguauuuguuucuguuucuuguacgcaacucuucauagcugccuuugucccgaauaaauacuuugaaacuugaaaggauuugaguucagaauggagguuaauauccuauugauucucuugcucccaccaaagagacuuggauaucagccuuuuuaauaauaaucucuuuuuguucuuuuaaguucaguuaguugccuuuugcacacauuuuuauugcuuuacuuuauaaaccaguggucuccaaccuuuuuggcaccagggaccaguuucguggaagacaguuuuuccaugggggaaaugguuuugggaugaaacuguucuaccacaguucaucaggcauuagauucucauaaggaguccacaaccaaauccuugcaugugcaguucgcaauaggguuugugcuccuaugagaaucccaugccaucacugaugugacaggaggcagagcucaggcggugaugcucacuugcagcugcucaccuccuguugugcagcccgguuccuaacaggccacuucugguuuugggaccccuguuauaaacuauucaucuuuaccugguaauauuagaauguuggugauuuauuuacucuaaguucucaugcacuaagcauaggauuagaauuuucacauaucccuuuagggcaaggcaguaaaaauuugucacauuugccaguaggaugugaagaaccagaaauaagauuuauucgcugucuuuuaauagagguuucagugaguuucagaauaggcuuuagaucuacucagcugaccuuuuaguccuuaauuuuuguugaagagaaaaccagaaugcauuauaauagaagcagcaccaaaugcggguucuuaucagaguuguuccucacauuugccuuaaagcaggccacugaguuucaacagacugacucuuuuccccaugccuaaaguaaacaaguauaaaugaucccuaaaguguucaaaaccagaaaggauuuuauaaacauaaaauuaugauccacuguauaccaacuuacuagacagcauuaacaaaagacuuaacagggacuuuaaaaauagguagauggguauccuggauacagcaacgacguuugucacugcaguuacuagguaagcaaaggaaugacauuugaaccuugccggaaaggaaacagcuuguuuguuuuaaauccguaggaaaaguacuuuguuucacuugacugcuuuguggaaaugcaagagguaucauguugcugucaaaacagucaguaguuuuguuuccugcaucaacauagagugaaaagacuaaaugaggcccuauuacuuuuauuaauaugguuacuauaauaaagagaauggguaguuucaaauuuguuauauaugaugaauuuuaauuucucucucaucaacagauguugucucugccaccucagauuuuuaaaaaauccaacuauaaggccaggcacgguggcucacgccuguaaucccaguacuuugggaggcugaggcagguggaucaucugagcucaggauuucaagaccagccugagcaauguagugaaacccugucucuaccaaaaauacaaaaaaauuagcugagugaaguaaugugcaccugugguuccagcuguuugggaggcugagcggggaggacugcuugaaccugggaggggggagguugcagugagcugagaucaugccucugaacuccagccugggugacagagugaaaccccaucuuaaaaaaauaaauccaaccguauaggaggaauuaaauuuuaguucguggcauuuaaaaucuuauguacauuucggaauuuccuuuaagauuccuccuugaaugaaaaaccugucauuggcuuacuauuuuuuugcuucucauaguuuagguagaacuuuaggacuguacuuugcagggcuugcacaccugccucuuaaucuuagaugcaggauugagaugggacuuuagcugugguagaguuucuaccuugcugucuccaggcagccuucucugcuacugaaguggacuuuuuaugaaguauuucagcccuuuagagcuaaaugugcuucccaaauguguucuauaguuauuucguauuugaguuugcuaucucuaaagcaauauucagcauccaucccacugucacagagcacuguguucuugcugcuaggaaugguguuguucaauuaguaacuuuuuuuuuugagacagagucucgcucugucacccaggcuggagugcaguggugcaaucucagcucacugcaacgucugccuccuagguucaagcaauccugucucagccuccugaguaacugggauuacaggcuccugccaccaugccuggcuaauuuuuuguauuuuuaguagagcgggguuucaccauguuggcgaggcuggucucaaacuccggaccuccggugauccacccaccucggccucccaaaguguugggauuacagccaugagccaccacgccuggcugaguaacuuuucuugaaaguaucauugauaguacugauuugaugagccugacucugugagaaaaauuauguucuccuaugcaaugcaauaauaaauaagaagaaaccauaaauagacaugcuguuuauucaaauaaaagaacugagcagcuaguauuaggaauguggcuugacgcauaugaaacaggcuugccuaaacuauauuauugaaugguuagaugacuuguaauuucuuuuuucuucuaaauauauuauucuucuaccuuuacuuaguguaaaagacucuuuucuacuacccucuuuccagaaaagauuuccguuacccguucaguaauacaaccuugcguuaaaauauuguauauucacagucacaauaauacauugucucaacacugaaagauuacuuauuaaaguuacuuaauaaagguuacuuaagauaaaccaaaucuuuuaaauugaagaauugacuuuuggagaaaaauacuuuuuuuuucuuagaaucugcuuggcauuauugaaugcacaauguaaaaacaaacaaagauuuuguguuugguugguuuugggcuuuuuugaugcagagucucauucuguugcccaggcuggagugcuuacugcagccuugaccgccuaggcucaaucgaucauccugccucagccucccccaguagcugggacuacaggccugcaccaccaugcccagcuaguuuuuguauuuuuuuuguagagaugggguuucgcuauguuuuccaggcuggucucaaacuccugggcucaaguuaucugccuacuucgaacucccauaguguugggauuacagcugugagccacuguaccuggucauaaagauguuuuuuaagccaggccuaaaauaucuauaaaagcuaacaugccauguuaaguggaaaauuacuugguaucagguuugugccacauaacuuaauguuaguuaccauaaaggggaagaugacgaauuugaacugguaucauaugacaggcccuagccucuucacacugcauuaacugagcaaguuuauguuuaaaaaacaaacaaacaaaaauauagauuucuucuuacacucuuaccugaagguagucauuuuauuaaucugacuauuauagcaauaccuuauaaugugaugucauacgaauaagauguuccauguaaguaaauuuccagguuaguaaaaauguccccauuuaagagcaaaacacauuuucucauuaagacucucuugaucuaaauaagcuaugcauuuucuguuuugccauuauguucuuuuacaguauauauugaaaccugacuuacucaaaaaaugaguuagacaagucuuacuuuaaauauauugacucagaaucaccaguggaaagcaccucacccuucaugccuuauguuacaguaggugcucaguaaguauuugauaagcaggugacugauaaauagaugaugccccgguuccuuccaaauuguggaagugugcagggcccuuugagcugauuccaugaaauaaauacucgaccacauugcuagugcucucucuccacuaguuaggccaucaccuccaaaaucauauugcuuguguuccuucuucuagcagucuagccugacucuccaauucucugcuuccagacugcuucuaauuuauaugaacuaagacuggaauaauaaugauaugcuaaaaguacuucacaguuugcaaaugacuuuaugugccuuuguuucagcaaaaagaaaauaucccaauuuucauauaucuugcacucuaucaggaaacagcccugcaauguggucgggagagauuaccaucuuaacccuuuuacagauaagaagccugauacucagagaggauaaauaguuuacccaguuacaauauuaauaaauaaacugggacuauaucugucuuuggauucuuugauucuuuuuuaucaggcuauauuaacaugguacauuuuuugacacagacuuuuaagauuuaucuuugguugguccaauuuuauucaugcuuauuuucuugguuuugauucuuuacuaaguaauugaggugauuauauaugugagauaucuguaaauuaagauacuugagguugagaaacaaaguggaguugaucggccgggugcgguggcucaugccuguaaucgcagcacuuugggaggccgaagcagucggaucacuugaggucaggaguucaagaccagccuggccaacauggugaaaccuaaaaauagaaaaauuagcugaguguggugaugugugccuguaaucccagcuacuagggaggcugaggcaggagaaucauuugaaccugggagguggagguugcagugagcugagaugacgccagugcacuccagccugggcaacagagcgagacugucuuaaaaaaaaagaaaguggaguugaucuauauauuuuugaccauuuuucaaauguuaccaagugccuugugaauuacaaaacugacuuuuguaauuuggaaauagagaaaauagggguuuuugcaaaaaauguuucaguugcuagccucccuguuuguccuuauaacuagaaaauuguuugucuauaaaaaaauuuuugucuauaaaaguacccuucugaaaaaagcagcccaaauaaaauucugggaaaagaauuacuuaguugcaccggaccuacuuccugacuuccauuuuguuuuguuguauuuuugucuuguuuuagguuagcuccauucagaaccaaaugcaguccaagggagguuauggagguggaaugccugccaauguccagaugcagcucguggauacgaaggcgggauagcccugguccuuucuccagugaguacucagagcuggggucuggaccugacggccagacauggccaggccaauaauaguaaauauauguauauauauauaauuuuuuaauggugaacuuauugggaaaggcaaaauuacucagcuaaguguaguuucugcacuuggaauguaaguuuuagguucuuuuccuuauuaagaacuuuaaauacuuuaaaacaucugguuggggaggauucugaugacaagaugcuucuuauguguccuuuaaacaagagugaaaucauuauuuugaguauugaggccgagcaugguggcucacaccuguaaucccagcacuuugggaggccuaggugggcugaucaccugaggccaggaauuggagacuagccuggccaacauggugaaaccccaucucuacuaaaaauacaaaaauuagcugggcaugguggcgcaugccuguaaucgcagcuacucaggaggcugaggcacgagaauugcuugaaccugggaggcagggguugcagucagcugagaaugcgccacugcgcuccagccugggugacagagcaagacccugucucaaaaaaguacugauacuaaagauaaucucuuggguaguaauuuuacaguuaagacuucauuguuuauaaacuuuucaaauuaauuaaaaagacuacuuugaaaaaggauaaacccugaaaauguagaaauaauuucaaguuuuuuuuuguuuuauaggguuauugugaauuucuauauuuucucuguccacuauucuguaauuuuuuuuuguccugugauugcuuuuauuuugaauuacaaaaaagaagugugauggcaccuuguccacccugucgugauuauuccagugagauguuacuguucugcucugaagaagauacugucagacgaauccugcauuuccuucagcuggcaugcaugccuuuggacucauggacagaguucuuuggauugucacugaauuuucaauguuuaaucaguauggaucugaucuucgcaugaucuuuuuugugaaugcuaacaccauuuugcaguuuuuuuuuucuauuuuaaacauuuuucuuuucacugccgacccccugccuuacgauuuuauuggaaagcaaggaccugcuauuauuuguuaauuugccaucauuuauguauauuuuggaagguaugagacccacaagcacaaugaucauuuuuauuuguuuguuuguuugaaacuucagcagaauagauaucugcaugcuuuaugaaguuguugcuucgguaagagcccaugggaugccagaaauuaacauuucuuugcugccaugggcugaugaugcugcuauuagauaaaguuuagcuguggcaccaagucacaucauuuucauagaaaaagauuacuuguagcuuauuuuagaaguaugaccuuuuggucuguuugauugauugauuagaauugcaauaaaagaaaagcuugcauucauaaggcauucauucuguuguaaauguucaauauauuuauuuugagagcaaggaccugugguuguaaacaggugugguuacaggugugguuauguaucugaguguugcggucauacucuccuccaguccaauccugagcaucuucaucuuauuaauuagcuguucguuucuuugugcacucauucuuuuauuuuuacuucuuuuuaauguuaugguauccaguuguuuccaguagcaguuucuugaacuucuggccuguacuacuaacugcagaccuccagagucacuggccuuucugugcucuacauauuauuuuaggggccacaucaguugccaagagcaacauacauaccgaccuggcugaauuauugccagugaaaacaaccuguacgaagccuuugcucagguucuaaaauauguuuguccuugcacgaauuuuguauauuucaaauauuucuguaaagguuucuucuuuucuguuagagugugguguuaagccagagucagugguuuguguucucauuaaaauguuuguuuaaauccuauguccaauucaagccuaucuaacuacauuugguaggauuaacauuucauauaacaaauggggcuuaauuaaaaacuuuaacuuggaauaaaggaacagggaucacuuuaucuucugccuucauuuaccuuaguccaagauucuugcaaaacaggcaacugaacaaacauuagguuuauguagguaaaaugugaaagcauuucuccuccacuuuuuaaaauuuaauuuacccaguacagcggggcaccagauuacuugaucuuuguauuuugcaguuuugagccuuugugucaaucccaagcacagagaggaucugccaaggaaaaacauuugcaucuucggaguagacauuuugcaguuuguuuaauaacaacuucuaaaguaaguugaauucauccauugucacugauucaccaaguggauguugcauuguggaauuugccugaguacuguugucauucugcucagccaggcacggucaguuucuuggccagggacauugcuaugugcugugugcaagcucuuuagaagagagauuggauuuucuuggcauuaucagcacucaugcuauuuagucuacuucuauuuugacugacucuuuaaauuaguacaauuuuucuacuugucauauaacuccuggaacaauaguacgggaagccgugauccuuuucccugacucaugauuuuagucuuuuuccaaaucgcuguuuuuuuuuuuuuuuuuuuuuuuuuugcugcuccaacgaccagcauguguuggagcagaucuccaugguaagccaaaaguggacuugucagccuauaacuacucugcagcugccacuaacucuacaggcacaguaacuacacuuuauacaggagcacaugccaaagugccugggaggugccaauaaaaucaagaaauaagaaaacuacaaaaaaagauacgguauuaaccuuggacauaauuuuuuuuagggaggcagcuuucccacuuuuauaaaggggguuguaaaucucaagaggucauuuguuccccauagcagcauaucucauuuuuaaauugaagcgaauuaaauaggauuuuacuacucaacauucauuauacuguuaaucuuugcugaaauauaugcuaacaaauguuaagcaagggaaacugaagacuuagucauguggauuguuagcagugaucugcauucuguaaaagagguacuuucccaugauguaggcaugaaguggugccaguaagcguagagcggaaauguugacuuuaguuaacauuggguuuagcauuuccagugcagcauuaucagugggccuuuaaaaauacuucguaaguacauuagcuuucacuuuguuguuaaauuauagcagacucauuauagagaacaaguuugccuugauuuuguuuaaaaugacuucugcuaagcacccagaagauaaaauugacauauuuuuauaauauaagcauacuuuuuuuguacauuguguucauucuugaauaaaaugaguucuguguuggcuuguagauacuaaaaagaaaguauugauuuugauucaauaaauguuuucuuucaauccugguuggccuuuccuuuaa

SEQ ID NO: 192234 - RNA, 27409 nt, Homo sapiens
ggucuggauuuugucauucagcauauuuauuuuaagauucauacauuuuauuguguauuucaacaguuuguuucuguuccuugcugaggaauauuccauuguauggcuacaucacaauuuauuuauccauucucuuguuuauagacauuuagaguauuuccaacuucuuugcuuuuauaaguaaaguuaccaugaauauuuuuguacaagucuuuuuauggauauauauuucuuuuuucuggaguggaauaguuggaucauaugguagguauauguuuaaguuuuaaagaaacuacaagauguuuaucaaacugauuguacuacuuucuauccacauagcaggguauggaguuucaguuacuccaccuccucaccaacacuagcauggccaguuuuugugguugguggauaaguuaauuucuuuuauucacuuucagaauaucagaguugacagaguccuuaauaaucaguuaguccaacuguucacuucauagacugagagauggggaggaacuugccugagggccaguaggaaaucaguggcggagccagugguuggacaaaauuacugcugaguucuguuuuuguucugucuaugacucuucuacuuagaauaucuaaauagaaaacucccuucgcccaacauacacuuuucuaaaucugaugcuuuaagggcagcuacugcaguguagagaaaacaguuacuuuuguauuuaugcuuggucucuguuucaagggcuauugggguaaguggcaucccuuuuccauaaaaugaggcugauaauaugaauaguugaaucuaauuuugguucagagguacaaaaggccauccaaaaaauauaaaaccaaaagagguguagccugagagacaucagugcuaacuuuucucaucugcauuucucuuggaaagauaaagacgccacuaauuaauauagagauguugggauuugaugaagguauauaacauccacauggaagucaaacuggggaugggaggaagggagagcuauuagaauaaaaacagauaauuaugcauggacaccuguggaguuggccauggaauggcugauggguuggggcaacucauagagggcuugguaugucccaaauauacacccuaaaaggcccacgaugcuaaucaugauguccuuggcaauggugacacagcucauguccucagaguaaaagaugacgaucuccaggagggcugggaugaugagagccagggcgcugcugcucacggagccuaccagggagaugaccaaguccaggcgggggaugaggauggcugagacaccugcaaugaaaggagauauuuagaaucacugaaugugcucagaaacaagccauugcuuuggagcccuagaauuucacagacaccugagagaccacuuuggagaggugggagggagccuacugcaggcuuggggaggucaggcaacucccaccccugucuuaacuaguaauauagaugcucuccuuuuauauuuuaucuacuggauuuuuuuuuacauauaaucuuuauuggaagggcucuucuaccacuuaccuguuaauaaccuccccacuguagagauggggaaaucuagagcucuagaaggaacaggacuuguucaaggucacacagagcugagaugagaauucacugggaugccccaucuaagguccuuuucacucuacuaugcugccucucauguguaagaaagaacuugauacacaguagaugcucaauaagugcuugacucuugcccaggcucagaaccaacauuuguaguaucuauauaauauagccuuugucuagaagcaaggauggauaaaaaaaugggagaugcuucugcugcuguccgaauaucagccacuuauuuuucuauucuuaauaggaucuuaguaaugaagcaggccauaaaacacaaagacagcauuaagcuauccaacccccauccuucucuucucuucacacuccuaaaauuccaucucuuauacacaugaugagcauauaguaucacagauuuuccaagggaguccaauuucaauaauguuugaaugaguaaauauauaauuuauaugauuuaauuuuaugcaaauuuauuauuuuaaaacaauuauuacauugauguauacuauguguauguaguuuggggguacaugugauaauucaauauguuuauauaauuaguaaagaucaaaucaguguacuugggauauccauuacuuaaaauauuccaaucauaugauuuuccuaugaacaaaauagagaaagccuguucuggaaagcauccauacaagcuugcuggaucuuuaaaaaaaucaccucuuucugaaauugcucugacacauccaguccaagcauaagagagacucauagacucucauggcuaggagugcauucuccuucgaugggaggucccuguccacagcuuuccuucauccaauguuuaauaagccgcuuauagagaaaacucagcaucagucuuccaggaaagcucacaacgaggaggcagagaagauacaugcaagaaaagcuauaauucaagguggaauggagaaaggccuuacgcuccauucuggucaugccaguccucugcucagugccuuuccauggcucugcauggcccaaacuccucagcacaaugacccuuaggacuuggcccugacaaagcucugaccucaucucucagcacucuccacuucuccaaaggggccauaggcaauacuugccucaggucugugcacagucuguucccuucccgugguacauucuucacuccuccgucuauuugcuacuuauuuaggucuucacugaagugucacuccacuggagaggacucccuggcucggccaggcugaguuauaggacccccuuauguguagagugugucuucuacuuacgaucuuaaccaucauauggugcauuaucaugucccaucuuaacaaucauugcaaugcacuguaauuauuuccuugcauauauuugccacucaacuguagguccugugaaggcagaagcuacaucuucuucauuauucaucauuguaucccuugugucuagcacaaugccagguauguaguaggugcucaacaaaugauuguugaaugaauaaaggguaaaggguaauagaauugauggaugaauaauggaugaagaaugggacuuucagcauauaucaaaagcaggacaugucauuauaaggucaacugucucuagucaugcauucccugauacucagaggcuccucagucuuucuugucaacuuacacccuuccuaguaggaaugaucacaaacaauacuauuuacagcuuccugaugucucagcacagacugggaacucuaacaccucaaaccaaguaggauuuugcuguuucugcucauagaacgccugccauuuaaagcuuauuaucugauaguauguucugcugcacagcuccaagcauugcauaguuucuccugaccccguacggaaacuugauuccuucaaugacuuuaaauucugacuccuggagccuugaagacuaaauuucucccuucacuuuuacaauaaucccacagguguuuaaggauaaauguggaaauuuccugagacuuugcuucuccaggcaaaacaucccuuguuguuuugcucauuccucaugggucaucguuugugauccuccgucuagacauguuccaaagaaagaauuccccagcccuguucaugagguuucccaaacacuacaacagugcucaugagugagugaaugaaugaauugaaaggaacaggaagaaaggaagggagggaagagagaagaguacagccaaaaaaugaucucuggcugggugcaugguucacaucuguaaucccagcacuuugggaggcugaggcaggcagaucacuugagaucaggauuuugagaccagcuggcaaacgugaugaaaccccgucucuacuaaaaauacaaaaauuagccgggcaugguggcaggugccuguaaucccagcuacucaggaggcugaggcaggagaaucucuugaaccugggaggcagagguugcagugagccgagauagcaccacugcacuccagucugggcaacagagcgagacucugucucaaauaaauaaauaaauaaauaaucuccaagacugacaaaucagucccacugggauuuuucccuacaguuaaaucucacuuuaugauacaggacuuguucauaauuuaugauaagaagaaauauggcaccaugaaaaacaguuguuacacaaucuguguucaaaucccagcuuugucacuuaguguguaugacucagguguguuacuuaauuuaucugggccacaguucccucuaaugguaauacauuguuaggcuaucaucaguauuggauaaugucaguacggugccugacauauaggauugaaugaaugauacuucuucuacaaaccagccagcaucuauuuucuauguguaggcaguagagacgacuauaacauuuacugugugguaauucuguuaagcccuuuuuuuucacguggaaaaauugagguccagggaggugaaauaucccacccuaggucacaaagaaggcaaguggcagauccaaugaugguggggugggcgccagcguggcucccugucauagcuuuggguaaagagugcccuuuuaugcuacucacagguuagacagaccaaggcugagcggacagacaggucuacaaacagugcccagcucucugacacuugggagauggcaaacgggaugaugaucucagcugggacguggaacuggagggcauaggugaagaagaugccgauagaguacaucagcuugacugacugguacaaccugcagacacaugaauuggaugugaaaggugauguggcuccccggaagggccauugaggacucacuuacugcucagaagcugguauggguugaguaucccuaauccaaaacaaaaucugaaaugcuucaaaauccaaaacacuucuggucccaagcauuuuggauaaggguuacucaaucuguacuuuucacugaauuauagaacuggcuaauguuagaugauucaggccagauuggacaucagggccauccgggaagcuuauuaaaagugcuuauugcugaagauucugagucaguaggccugcagcucaggaauguaugccucuucuuuuuuaauuuuuuaaaagacaauagccgggcgugguggcucacgcuuguaaucgcagcaguuugagaggccgaggcgaguggaucaccugaggucaggaguucgacaccagccugaccaauauggugaaagcucgucucuaauaaaaauacaaaaauuagcugggcgugguggcaugcaccuguagucccagcuacucgggaggcugagacaggagaauugcuugaacccaggagguggagguugcagugagccgaaauugcaccacugcacucacuccagccugggcaacagagugagacuccaucucaaacaaacaaacaaaaaagacaauauaugcauagaguaaaauucaugguacaaaagucauacagugaaaagcauucuucccacccuugauuccuagcuucuaguuucccuuuccauaggcaaccauucagaguuuucuuguggcccuucuagaaaugauugguguuuguacaugcucauacagaauguaggaacauacaugcauauccacacacacacaugcauacacauaugcacauacacauguagacuccucuuuuauuuacccaauauuucuuuucuuuuucuuuguuuuuuuuuuuuuuuuuuuuuuuuuugagacggaguuucgcuuuuauugcccaggcuggagugcaaugguaugaucucacuugaucuuagccaaaaggcugagaagcgaugcaacgguacgaucucagcucaccacaacuuccgccuccuggauucaagcaauucucuugccucagccucccgaguagcugggauuacaggcaugcaccaccauguccagcuaauuuuauauuuuuaguagagacgggguuucucuauguuggucuggcuggucgcgaacucccaaccucaggugauacgcccuccucggccucccaaagugccgggauuauaggcaugagccaccacgccuggcugucucacccaguaugucuuaaagauuguucccugccaguacacauagaucuggcucuucuauuuaauagcugguugauaugucaauugcauggauaugcaaucauuuuaaaaaucagucaccaauuaaugaauauuuagauugggcuuagacuuuucccaaguaaacaauacugcacagacuauccuuguacauauauuaaugcacauauaauauaaaaacuuagaaguuaaaaugcuggguaaaagucuacaugauuuaaaauuuuaauagcuguugacauauugcccauuugcuguccuaguguauaaaaagaccugcuuucccauguccuugccuaaacagugugucgaugcaugcaucuuugcccuuguauuuauuuuuuaacucacauuucuauuaucuuucuuucuuucuuucuuuuuuuuuuuuuuugagacugagucucgcuuuugucaccuaggcuggaaugcaauggcgugaucucggcucacugcaaccucugccucacaggcucaagcaauucuucugccucagccuccugaguagcugggauuacaggcucacaccaccacgcccagcuaauuuugauauuuuuuagcagagaugggguuuugccauguuggccaggcuggucucgaacuccugaccucaggugauccacccgccucagccucccaaagagcugggauuacaggcaugagccacugccccuggccuucuacuaucuuucugagcaucucuuuaucuggccaucuggccauuuuuuuuuauuugccugugaaauaccuguucugcccuuugcccauuucucauugggugguuggucuuuuucuuauugggaagggauauuuguuuaaggcuuuccuggagaaccugaugacuagugagguucacaccagcaggugugaaguccugauggagcucaacacccauguuuucuagcugaggucccaggaaggaaagugcccuguccaaggcagcuagugacagcccaaauugcccagaacaagaacagcauauuaggaugauaucuugaguaaaauaaggcacaacuucaaagaaacuccacauuuauugucucaucuagucauuaucauaacacagcaagguggguggggaugguuacauuuuucucauucuacagcucuggauuugugggaaauaaaugcaccaucauccuacucaccuuggaaaaaugaaggcuguggggaugcauaacaaugauaauagcuaacgcucaugaaugcuuaccacgugcuaagcacuuuucuaagcauuaucuauguauuaauccaauuaauccccacggucacugcaucagguagcacagcaguuauuugugcuguucaccaaauacuuccaggcacauggcagaauugcacuucccugcccccuuggagugaggugcggccauguggcuugcuuugacugaugcagugugagcaggagagacauaugucacuuccagugauggauuaccagcuucauggcucagcuuugcugugcucucugcuaugacaaccagaacaguuccagugucucucccuaucucaccugaggugggcaggacauaccagcaauugggcaaguugagggugaugcuggccugggugucugacccaaacuucauguagcccaguguccccaguaagauauagaggaugaugacaauggacauccccaaguacagaacaaaagaaaacugcuguggaugcuucaucugguuuuugagaggcagaaccuggagggaaaaaaaaaaguugggaaagaaaagguagaaagagauguggcccauugugaaggagaggguucccguacaagcacaaauguccuuccccaggugggcccaguaucagaaaggggacucuccacauggccacacuccuuucauuuucucucaugcuuucuauugucaggaaugcccuacuuagucuugguugauuaguaaauucucagucuucaaugcuuagcgugguauauuagagcaguagggacccuguauguggguacagacuuucccuucaccaggagaagaucagagucugcaccuuuucauaaauacuauuuauucagacaucugcaacuacaguuggccacuguagagggcgcuagggaccauucgcgugaaccccaucaaucuuaccauaccgacgccuucaaaugugaagauggcuguaccaaagaacagcaagaaggucuuccaguuugccaucaaggguagguugcugggauauggaauccccuaaaagaaagugggagaagcacauugguguuguuauggugucgaagucaucccaaaucuuugccugguagaaagcugggucacaccugaucucaacagagaaaaucagaagauaccuagaccucagucagccuucuaaucuuuuaaauaugaugauuuauucauuuauauugugcuaaaauacacauaacauuuuaccauuuuaacuauuuuaagugcacaguucaguaauaugaagaacauucacguuguuguguauccaucaccccuauccaucuccagaacauuuucaucaccccaaauggaaacucuuuaucuaucaaauaauaacgccccacuacccagccuccuggcacccccugcucuacuaucugucucuaugaauuggacuauucuagguaccucauguaaguggaauccuaucauauguauuguuucugugccuggcuuauuucauuuagcuuuagcguccucaaguuucauccacauugugguaugugucacugucuccucacuuuuuaaggcugaauaauauuccacucuauauauagacaccaaaucguguucauccuuucaucacuuacuuggacucuuggauuaucccacccuuuggcuacugggagcccgcucaucucuacauguggagaaaguggaacacagaggagaggggaauugcccaaggucacuaugcaaguuaguggcacagcccagauaagaauucaggucuccuguuucccagcccucuaacaugucucucccacacuucuuucagggcugugcaguccacuaguuaguauagcagcucucaugaaucuagggggaaugauuauguuaauagauuucuaugguggguagaauaaugguuccccaaagauguucacauccuaauccccaaaagaugagaguauguuauguuacauggcgagggagaauuaaguuuuuagaugggauuaagguuuccaaucagcugacccuaaaacaaggagaugauccuggauuauucgggugggacaagcauccuuaaaaguggaagagggagucagaaggggaagaucagagggaaggcaacaugagaaagacuuggcuugaggcugcuagcuuugaagauggaaggcggccugagccaaggcacacagacagccucuacaaagcuggagaagacaagagaacagauucuccccuggaauccagaaaggaaugcugcucugccgcacauuaaguucaaccuagcgagacucaagcacuggaaaauaaauuuguguuuuuucaagccacuagauuugugguaauuuaucacagcagcaauaugaaaugaauacaaccccagagacuuucacucaagaaaaugaaaguauaauggugggauuucguggucugugauaauggagcauggacaugggaggcagucugaaauucaugaaagaauuacuuuaucaauuuccuugucuguaaauugcagauaaagauacuauaguuguuccuuggucuccaugggagaacuaauguuccaggaccucccguggauaccaaaucugcaaaugcucaaguccuugauauaaaaugguauaguauuugcauauaacccaugcuuauguuuuuuugagacggucuugcucugucacccaggcuggaaugcaguggugugaucauagcuuacuguagccuugaccucaugggcucaggugauccauccaccucagcuucccagguagcuaggacuacaggugcaagccaucaugccccacuaauuuuuaaauuuuuuguagaggcaggauuuugcuauguuguccagcuggucuugaacuccugggcuuaagcaacccucccaccucagccuccucaagugcugggauuacaggugugagccacugugccuggccaauaguuguuagaccuaguuguuucuuaacuuguaugauuuuuuauuguuguauauuuuuaguguuuuuuucucccaauaguuuccauuugugauuguucagauccauggauguggaaaucauggauacagagugccagcuuuacuuccaaaauaguauugcgaagguucaauaaguuaauguauguaaauaauuuggcaccaaguaaauaaaauuccuuuaucaucuguauuucuuuuguccaucuaccacuuuuacaauuuuuuuggugauuugauugauguuuaucucuccaaguaaaugcagcuuccaugagagcaggcacccuauuuauuuuugcugaccacugagucccuggccccuugcacaaugccuggauugcagaagguauucaguaauuauuuguugaaugacccauuauuauccaaugugacgaugaugaugaugaugaggauguugaugacaaugaugaugauaauaauuagcuuuuacaacuugugggacagaaguguuccuagaugucauguuggcaggggcugcucagagcagaggaucaccuuccucagcuucaccugcccaucaugauaacaaacccuccuccccagguguuucagagacccaggacccugauccuuucuucccuauggcacagaccuccaugauauacucaaagaucagagccaugcucccaaggguggugauguuggccaaugucgagaagacggacagcaccuugagguucuggauaaacaccaacaggaucaggaagggcaggauuaucagcauguagaaacgaauguccaggaugggggucagcgucagaaucucccugggcuggcagauguuggaggucacgugggcuuuuuccaccaucugacauaaagcacaaugacaggcagugugguugcuacguaaaacacaggacaccaauuacauuugaauuucagguaauuaauguaacuuuuuaguauaaauaugccccaaauauugcauaagacacgcucauaguaaaacaaaaucacuacuuaucugaaauucuaucauaacuggguaucauauauuauuauuugccaaauugggcaacccugucgggcccaugauugugacaaccagaaacccuuagaaucauaaaaucucaaggcuuugagguuguuaucuacucaaaccuuuucuucuccacaaaaugaguuucuuucauacauccagagaaagggaauucaucacacaagaauauccucuucaaauuuagauagcccuaaaaucugggaagcucuaaauauuggucaguauccaucugcuugaauauuccgucuacaauacuugucacaguucuuucuggcuguuugggugcgcaaaaacaaggaugcucccucuaauccacaaagccaagaaagaaggcugugguugauuuguaaugucugauaggaaugcaaugaggggaagguggcagcuuguuguccuuguauaguuagacaucuucuacaugacaaccuugagauacucaaaguaaaugucaccaguguuuuucaggcuaacaauuaucauugauuucugacuggacaugauugcaggccucucuuucuacccuggcuaaacucuucagaaguuacuuuagcucgucuauccuuucaaaaugugauucccaggacugagagagcucccaagcguggucugaucuaggaguagaaaugaaguucucuccucccaugagccuaacacaauacuuuugcuaauguagccucagcagcaggaggucugcuuuucccccacucugcccagaagagggcucuuuaccuguuguaaauugucugccauaaacauaaaauaaacacugcagaagcccagcugggugaugacuaauaagaagcugacaguguaccugggaaggaaaggaagaggcagacagagggaggaaacaaaagcuaaaauuauuucuuaagaauguuuacuauuugaaacaauuauuuuuguuauuauuuuuaaaaauuucccuacuuucuuuuauuuugaaaaauuuuuaagccaaaaaguugaaagaauaguauaauuaacauccauguacccuuuaacuaaauauaccaguuguuaauuuuuggccccaaauugcauuacauauauauauaauauauauguauauauagacgaaugaauauucgucuauacacacacacacauacacacgcaauuuuuuucagaaucauuugaaagucaauugcaggucacuuuggaaggccaaggcagguggaucguugaggucaggaguucaagaccaaccugacuaacauggugaaaccccgucucuacuaaaaauacaaaaauuagccaggugugguggcaggcaccuguaaaucccagcuacucgggaggcuugggcaggagaauugcuugaacccugaagguggggguugcagugagcugagaucuugccacugcacuccagccugggugacagagccaaauuccaucucaaaaaaaaaaaaaagaaaaagucaauuguagguauccuaauacuuaaacccuaaauucuuaagacugcaauagccagaaaaucaacuucaauaucuucauauauauacauauauacaguuucuauuuuauacauauauacaguuucuauuuuaaauacacucauucauugguauccaagaccccuuacaaauucaaaaucugcagaugcucaagucucuuacauaaaaaugaguuaguauuaucccaauucucucuaaaguaccuuuuguaguuauuuuauuuuuuaauucaggaucuaaugaagguuuguauauugcauuuggcuacaucucuagccaagugggaggaucacuugagcccaggagguugaggcugcagugagccaugaucacaccacuacacucuagccugagaaacagagugagaaucugccucaaaaaaaaaaagaaauuauuauuaauuuuguaagagaugaugaugguaugaugauuauacuuuuuaaaguuauuaucuguuagagcuacacacugaauuauuuuauuuuauuuuauuuuuugagacagagucucaguguguuuucaucacacuggcuuuguuugaagaguauaggccaauugucuuauagaacgccccacauugcgggcuuguaugauugcuuccucgugauuaaauucaggggagcacuuuuagcaagaauacuacagaggugauaguuuuguaccucuauuucaucauauugggaggcacaugauauccuguuguuuugcuuuguuggugacugccagaucuccuauuggaaauguacauuuucccuuuguaaucugugggguaaaacuuugagauggcaugauuauccuguuccucaaaccaaugguuuuaccacucacugauguuccuugcuugaaucauuggugguugcaagguggugguuuucuaagucuauguaucauuucuucuaaauuuauuagcugguuuuuaagagagauauauuguuuucuccucuuuuuuuuggcaucacaacagacacauguuaauuauuucuaaauuuaauaucuuauacucuguuauugccauuauucuuuuggguucuuaaauuauuccaaauuuggagaugcauuuuucuaaaagaacaaaaauauguuccuuuacuuagauuauaauguuuagauaagggcuuuucaaaauuggcuuguaguaucaaccaauuuguugguugaggccuauguuaaaaauacaggcuccugguucucauaucauccuauugagucagaaucuuggcagugucacaugugacuucagaauaauaucuuuuucugucuaucuuaggaagauuuucaaacauauacaaaagcaaugaauaauuuaaugaauauaacgagaauuuaacgagaauaauuucaugaauucacaugugcucaucccagcuucaacaaugaacuuuuugccacuuguucucuaucucuucagccccaucacacacauacugaauuugucgguguauuuguagcaaaccagagaccccaaguuauuucaccuguaaauaauucaguaugggccgggugcaguggcucacgccuguaaucccaccacuuugcaaggccgaggcgggcggaucacgaggucaggagaucgagaccauccuggcuaacacggugaaaccccaucucuacuaaaaauacaaaaaauuagccgggcaugguggcgggcgccuguagucccagcuacucaggaggcugaggcaggagaauggcaugaacccgggagguggagcuugcagugagccgagaucgcgccacugcacuccagacucugucucaaaauaauaauaauaauaauaauaauucaguauguagcuguaauagauaauaacuuuaaaaaguauaaucaucauaccaucaucaugucuuacaaaauuaacaauaauuucuuuuuuuuuuuuugagacagauucucgcucuguuucccaggcuagaguguaguggugcagucauggcucacugcagccucaaccuccugggcucaagugauccucccaccucagccuccugaguagcuggauccacaggugugugcuaccaggccuggcuauuuaaaaaaaauuuuuguggagauggggucccaccauuuugccuaggcugucuugacaccuggucucaagagauccucccaccuugaccucucaagguguugggauuacaggcaugagccauugugcuuggccaauaauuucuuuauaccaucuaauauucaguccauauucagauuucuccaauucucucaaaaauaucugucuuacaguugguuuccaaacaagucuacacauuguauuuuguuaagucucuuaaguuuuuuaaacugcuacauuccccuugcccuguuuauuuuuuccuugcaacuuuuaauuuuuuguuugcugcugaagauaccagaucauuuguccuguaguauauccuauuuuuucuauuugguuggugacuuccucaugaugcuauuuaucuuguuccucuaucccccgugcuuccuauaaauggauauuagaucuaguggcuugaauaaauggagguuucaaauuuauuuuugaaauaucagaggugguacuacucuguacucccuacugugggcuauuaugagacacacauagcuagcugucauguauauaaauaugagaugcuaagaugaguacauggggucagguagcaucagugcauucucccuuuauaaagcuucccagugaccauuccucuaacagcuugagcauccauuaaugaccauugccuccauggaaugggcagcuuuuguuuguuuguuuguuuguuuugagauggagucucacucugucacccaggcuggagugcaauggugcgaucucggcucacugcaaccucugccuccugaguucaagcgauucuccugccucagucuccugaguagcugggauuacaggcacccaccaccaagccuggcuaauuuucauauuuuuaguagagacaggguuacgccauguuggucaggcuggucucaaacuccugaccucaggugauccacccaccucagccucccaaagugcugggauuacaggcgugagccaccacacauggccaaggaaugggcaguuuuuaaucaagcuccucagguaucucucaguaaauuaaagaugacaaauuauuacuuuaaauauuuuuuaaauguuucuaacucuuucucaugaccucaucuaaucauuagaguggcuccugaucaggagaucaaugaccuacugagaaucccaagagaggagcugcaaaggaaucuuagcagccacaauuugacucacuaccuccugagggacuuugcuggggaaggcuccaauguuagguucuuggucaaaucucugcuccacccauaucaauguccaugccuuuggauauguuauuuuaucuuuauaagccucauauuuccagggcaauaaaaacccacccugccuaccucacaaggcuguugagaggaacagaggaacuaagacagagaaaaccauuuuguacaccguuaacuuuuuaucaaggcagggaacaaccugaauguucaccuuaggggaauaagcaaaugaaacggauauacauccacacuagggaacacugugagccuuaaaaaauaaugagguaggcugggcgaggugguucacaccuauaaucccagcacuuugggaggccgaggcaggcgggucaucugaggucaggaguucagggccagccuggccaacauggugaaacccugucucuacuaaaaacacaaaaauuaaccaggcgugguggugggcgccuguaaucccagcuacucaggaggcugaggaaggagagcugcuugaacccaggaggcggagguugcagugagcugaggucacgccauugcacuccagccugagcaacaagagugaaacucugucccuccccccccaaaaaugagguucauuuauauguuccaacaugaaaaaauagggauauauuguuagaugaaaaaucaaauuuucagaaauuauccuaaguaauguauaagaaaauagaaagcaaauuauguacuuccauucacacacauauauugauguacauguagagaaaaaaagucuaaaggaauauuuacuaacuagguuucaaugauuaccuuauggguacagagugagaugggggaugggguuaucgaggugauucucucuauuguuugauaguuuacaauaagagcauauucauuuaaaaccuguguaaguagaaauaaagaaaagugauaugaugauuuuuguuguuacuacuacaacaucugugacuacuaccuuccccacacugcaugggcccucagccagguguucgggcagguuucaaggccguacaucguggccucuccauaguucacaaaagucuucugcagucuagggggaaagaacaaacaaugcauaauuuaaaacauuuuuguuaaagguacaguuuucucccaaagugagugauuuuuauguauuugugugugagcaugaagccuucugucaauuuucucccagugaucuacuuuauacuuuaacaacuuucaggaguuugccuuuuuuucuuuuuuugcaauuaucccuuuaagcacaaauauuuaacugacuaucauuggauuuauucuucuugaguaagcgguagcugugcauugacguagaucugcaaagcaggaaaggggauauggagggggagaggaggagggaggggaagaggugguguggguguggccaggccagugauucccuccuucccauugcugauggugucagaacacucgagauccuggccugggccagaccccucacaaaggugauacucgggauccugcccagcccccuguaggaugugaugcccaaguuccagccuauuccucuugccaugucccucuuucucaacccuuuuaaggguggagcaggcccugcugcagaaacaccuuuggcuggagcaaguggaaacagcagcagguugcccagauccuggaagcacggcauaaauugcaggacugaggggaacaggugggagagaggaagggcuccagccuucuucagauaccagaguuuaaaucccaacaugacccucagguagccagacauguagagccagucucuugagaucucugggccccaguuuucuucacaugcagucuggauuuugggggaagagacagugagagacggauauagagaugugcuggaacaugacauuuuuguuacugcucaccgugauaggcauuuucaauacaaaugaagucaccuugcauagaacuggcaaggauaugaaucugaggguugcaaauucagaagcuaugggaucagacagguacuggugaucuggugggugacaggggcugaguauaagagacaguagggaacauuggagacuguggcaaaccagaauaacacaucccauuguaaaagggauugcucaggaguugccucuagaagcacaucuaaaaaaugaaggcucagaagcagucgguugucuaacugauuaagaaggcagagauuuuuuuguuuugugaaugugaaugugaaaucuccaauucacauuuugugaaugugaauuuuuuuuuuuuuugagacagaguuuucacucuaguugcccaggcuggagugcaagggugcgaucucggcucaccaaaaccuccgccucccggguucaagcgauucuccugccucagccucccgaguagcugggauuacaggcaugcaccaccacgccuggcuaauuuuguauuuuuaguagagaugggguuucuguauguuggucaggcuggucucgaacuccugaccucagguggucugccugccucggccuccugaauugcugggauuauaggugugagccacugcacccggccgaaaucuccaggguuuaaacauugacuaaaaaauaaaacugugaagucccccaaaacauaacugaaggccauagccaacucucaggccaucacucugcaaccucuauauuagaaaaaauaaaagacaagucaucagagaaaaaaaaaaaaucagagaaaggcuuucagaaauggccugaugucagaagcuuaucuggugauauaaugaucccagaaggcuugagggaagagaagauuugcaaaaugguuaacaguggagucacaguaggucuuugaauacuggcucugccacuucccagcuauaugacccugggcaaggcauuuaaaccucaguuuacucaucuguaaaaugggaauaaaaauagugccuaucauagacuuacugugaggaguaaacaaggcuugcaaggcucuuggcacgauaaccgcaguguaauugcacaauacauuuaacuacggaaugaguaaaugcucuuaaaagcguuuugugagcaggaaagugcucugagaguuaggugugacugauauguacuccagguacaccuauuuggguuaugauaauuaggcuuuauggagaguuuuguuuaccgucccuacuuugacuuuugagaccuuucuucacauuuacgaggaccuauuugguuuugcaugccuugggaguagcugagcgcuguggaucucugcauucuuuguuuuuacugcauuugucuuuucuuucugaaauuguuuuugcauuaaaguuucaaauacauaaacauugauuauuauaaguaugcuuugauaaugacugaaaucauugugaagacuucuuuucaguaaguaugcuuuuuacuuuuacuaacauugcauggaccaaauuacccugacaagguguggguauuggagugggagaagguuggggauggagaggcuaaaaggaagagaagaaagucucugucucaaauaaauagaguaauuuauauagugcuuuugcaucuuuuaucacuuucgaugcuuucaguuaaggagaucugggcucagggggaugcaggaauuugacagucauccagcuuguuagcagcagcguuggaucugugccuagagucucuaacugggacucucugucaugcucuccuugccuucauagaauccagauugguaggaagguggccuggagcaguggccgaauuaauugggucaguggucaaaagaagagcaacacacccucagaggggccccagugcuggaaugagagagaagcaggccucugaccucuggcugagguguugagcacaguucaacaggaugaccaugcagugcacggugaggaccccgauggccagaaggcugacaggaccgaccuggaggggagaggagaaagggggaagugagccagaaaugaucacucccauucccuggcccucucacagucugcgugcuggggccuguugcauaauaaaacugucuuuggggugacagacccagccugaauguccucaugcucccagaugcuagaauuugaaugcucuucuuagcaucccuguagaguggcugcccaacuucugcuaggauacuuccagugacagagagcucauuaccuucccacauagcccaugcauuuucucauuuuccuugaguucuaccaguuuagagucccuugugguaaauuuauuuugucugacacacccuggcccucacuuccuccaagaugauugagggccaagguguucuuaugacucaguucucuuccucuaguacagaguuuaucaacaggugcccuauugacauuuuggggcagauaauuauuuguuaucaggagcugucuuuugcauuauaggauguuuagcagcuuucccgagccucuacccacuaggugucagagacucuucccccagauuguggcaaccaaaaaugucuguagagauuguaaaggucuuuggcuaggguagcaggagcuggugcaaaaugaucccaaguuggggaucacuacuguagugugucuaauuugucaaauuccuuuuaaaaaguggggcugauuacuaauuauaucuuccagaggugaucagaaggguauaaacggggacccucucacauccuuuguucugaacacuugugucuuuauagaugugaccuaucacaaagacauaaaugagggaucaagagcaccacuagacuccacuggaaugcaggcuucaugcagcagagacucucgugucuuguuugcuucuauauucccaggggcuacaaaugcacaggguagauaggugcucaauaaauauuucucaaaugaaucauggccagagguucuggugggagaugaaagguaaagaaaucaucuaaugacucugaggaagcaaauaucaaagaauaaaagcauugucuuaaaaacaaauaccacccuggcaaagauaguuuggcugaagaccauguuuuuuuguagaagcucuagaacccagaggauuccaaaggggagaguccagucucuggguuggaaccacugaagaucagaagucaugacagaggcagcaagggucucgccuucuuuagacauagaagccacuuaccaggccuggagauaagaaaagauucacuccaaggaaauggaauuauauauuugguaucuauuccauucaguagauguuaauggaaacuugcugugugccagucccuacagaggcuaccguggggacgugcaaagggaaaucagacaguucuugcccacagagcuuucaauuaaaugaggaaggugggucuguuagaaaauaaauaugucgaccggacgagguggcucacaccugucaucccagcaccuugcgaggccgagaugggccagucaccugaggucaggaguuugagaccugccuggccaacaugaugaaaaccucucuacaaagaauacaaaaauuagcugggcgugguggcucacaccuguaaucccagcaacucgggaggcugaggcaggagaaucgcuugaacccgggaggcggagguugcagugagccaagauugugccacugcacuccagccugggcgacagagcgagacucugucucaauaaauaauaauaaauaaauaaauaucuuaucuucguaagugcuuuaagaaucccagguaagguagauauaaaugguagaaaaauacaaagugaggauggcauuagugaucauaagaaaguguaaaguuuuagagaggaggcacuuuaaaaagacagaaaugagggggcaggaacagcacaggaaaagagaaagagguaggcugguguggggagaguggauuggugggauugauggaggcgucuaucuucauguccaagacacuuucucaugcgcccucaagugguuuggaacaggagucacacacucaaaugccugcagggauugggcuguuaaugcaaaugacgaaaugagcugcaugugauccuaggaguggggaggacugcggggagaauuguggcaaaguagagucagaugagcauggugagucuuuaagaguaauggugugcccccuucagggaugcucagguuggacccagguugacuccaggggauugaugccaacaggcacauuuucaauugcagaggguacccccaaauugcccauugauaacagugugaaggccuucaggaccuaucacccccuucugcaaaugagcaaaccuaguucccaucccacagaugccucuuaccaacaagccggcauucuuuauggccaggggaagccccaggagcccugugccaauguugcauuucaacaaguggaucaaaguuugcaucauccugugguggggagaguagggagacagaggguacuguuaguggaagggaagcauggccagaaacucagccuccuucuggcaucuccagagcgccugauaggaagaggggcaaaaccugaugagguggacuuggagacaacucucaguucuaggggucuguccuggaacaucugaucuggggauggugcuaguucaagugacucaacaaaucuuuaauacacacuaggcucuaaaggaaauaaaaauugcuaccauucuggauaacacucuaguacugguugguucauuaauucauccagugauuucuuucaugaguuauucucucaaauaacauuuauugugaccuaauacaugucuaucaguuagauagacaauggaaaaauuaguaauaguugccucagucuacagugagacaucagguuauuuauuaacucacucacuagaaacaaaaaucuaccauauaugggauauuuacugguuuuaguuuacuccuucauccauuuguucaaccaauauucauugugaauaugaauugcuugugcgcucucucucucucucucucucucucucucucucucucucuauauauauauauauauauauauauaugaaaugagcugcaugugaugcuagggaguggggaggacuguggggagaauuguggcaaaguagagucagaugagcauggugauauauauauauauauauauauuauauauauaugaauugcuauauaucgacauuaugcacuggguaaaauuuaauaauuuaauagcaauuguuacugugcauauagaguacuuaugauggucccagcagggugcuagggccuaggguucuaaauauucuucacaccugugcuggcagcuccugcccaggcagcuccaauccugauguggauugggugggaaaggugggaacaggaucaugagaacagaaucaaaaaggaacuuaaauaaaaaguacaugcguaagcauugaacccagagaugggagcacuuaauucugaguuccagcucugccgcuaaccuacuguguuugguuacuacuuugggaagccauuagcugcuuugauccuguuucacugccaaaaaagggagaaaauucuaguuuugccuaugucccagggaagcuguaagacucaaaagagguaacaacaugaugaaucauggaaucaugaagugcuucacagaugugagcaucaucaucgucauaucauugucucaucaucaucaucauccucacugccaccuuugguuuggccuucauggugcucauuuguuagaaagcgcauccuucaagaggaagaagaauugggaugauaggaaaaaggcaagcaugggcugguuuaagcaaguagaagugcccccuccacccaagaacaaaaggguaccuugaagaugccauugggagauacagacgaagucucaggcuaagacagagaaugcccucuugccacacuuaaauugucugcagguggccaggagagccaaaaccaacugcccaagugaguccagcagagacagugcucacaucucuuugucuuauccauuagagagucauggcaaggggcuaggaagaagcuguaaccaaccaggucuuugcauuucaaugcugaccugagagaggguuggguugagagaacagaugaacuguuggggacuucugugacuucagucuauugagugaagucuauugaccuaacuucuguuagggcagucuauucaccuaaggaugggggggugggcacccauugucccuuuacuuccaagagauaaccuuuauuucuugauaacuguaauuugucaauucuuaaguaguaauuucuccaaaagauguggucccauuucccacccucugcucuuuuuuccuuugucucucacuucuuucccaugacagcaucgaugucuugccccuauuugaaucagauauugugggaaaggugagacaaguuuucggaggaaccacugugccuuagcugacagcauuuacccaucuggaccuugaagcauaaauagauguugcaagcuccccugagauuuaaaaaauuggguuuauauuuuuucucgaaaacuauacaauugcuauuauaaaaggaaauuccaaaaucccaccaauggaaaauaaccacacauuauaauuagcccuccucugggcaucuuuauuugcucuaaaugcaccgaauuuuacauaaagagaaccgcuaugcaugcuggauccucaacuaauuuucuguaugaauaaaugugcuacacacuuuccauguccauacauuuccuccaucacuuguaaugacuguaucauauucuacuguauguuuguuucauguguuaaccuuucucuuaauguuuccaaguuuucaauauuauugaaacugccuuugcaaaauuauaacugaggaaauuaagacagcgaaagaaaucagaccuaaccaacuccaucuugcuucuaaccuuuaagauguccuuguuuauuccuggacauaggcugagcuaacuuugggaaggaauucauuucaugguuugacuauugguaucaccccuuucccaaaaagacccccuuuuugccuggggaccauucugccuuugcaggacuaacaaauuagcuauaagauuggaaauuacaguuuaggggucaugcagccucuggcuccaggagucuaaaccuccccacauuguuccuggggauaacaucacauuguaaaaccuaagaucagugcuugaguuauuuugcagacccugcacucugauggaccaucugaaaccacccagaccggucaucuggcucaaccaguucugccaucccucccaagaacagaaaacagcaagaaaaacucacuucgagccccugugauuccaucuccaaccugaucaaucagcacuccccacuucccaagcuccuacccaccaaauuaucuuuaaaaacucuaauucccgaaugcucagggagaccgauuugagugauaauaaaacuccggucucgagcuugcagugagcugagaucgcgccacugcacuccagccugggcgauagagcaagacuccgucuaaaaaaaaaaaaaaaaaaccuccagucucuugcacagcagauucugcaugaauuacucuuucuccauugcaauuccccugucuugauaaaucgucucugucuaggcagugggcaaggugaacccauugagugguuacauuauaacaagugcuuugauaaaaauuaugcacucuugugcuauuauuucaucagaaaaaauuccuagagggguauuauuaaucaaaggguauauuuauuuauauuucauuauacuuuaaagaacuagauuguaauacuuacaguacaaaauucaaaagauaaaacgcaauaauccaaauccuuaugaaacaaauauaaaucucuuuucucucagccuccaaauucucuuccccagaggcaaccacugcugucaguuuugugugugugcacgaguuguauacuuucagacagcauuugccaaauaaauauuuguauguuuuauacaaaugacauuuuacgauuugaccuguaacauugccaucuagaaagauaccaauuuaauucuucccaaaagaugagagagggcauuuccugauauccuuaucaacacuggggauugucaucgauaaucucuuugugcccacaguuguuaccgaucugaugauuaccagauagcagugugauugacaguaaguccuagaagaagaguucuguugaaaucauguccuuugcagggacauggauggagccggaagccaguauacuccgcaaacuaacaaaggaacagaaaaccaaacacugcauguucucacuuguaagugggagcugaacaaugagaacacauggacacagggaggagaacaagacaaacacuggggcugguuggggguggggggcaggggaugggagagcaucaggauaaauagcuaagguauauggggcuuaauaccuaggugauggguugauagguacagcaaaaccacuaugacacacguuuaccuauguaacaaacccgcauguccuguacauguauccuggaacuuaaaauuaaauuaaauuuaauuuaauuaaaaaaaaagagagaagaguuccaugugucugaguuuggggcaguaaagguggagacaugggguuagcaccuuuuguuuucuggauggauggcaugggggguuggggagaagaggcagagagaauaauggcagaugugugaggagaagaaggcagccagagacuguggaagaaagaaagggaggaaggaaagggcagacagccugagauaggaaacuguuccuggagacaagcugcucauguugaggguggcugcucuagcuggguucuucguaaaaacugggaaacagggcuaguagccagagccacagggauugaccuccuuagauucugaagguuucaucuuuuauccacgcauaucguguuaauggaauaagcguguuaaggagauagaugaaggaagacauaguccagaguugcaaaaacagcagugcuugaccucaggccuggaagggcggugcggccacuuacgauaguccagcuucuccagcaggauggacauucucugaaguaaugcuacugcugcucucugagggugacugagguccguuguccaaggaguucagcucacuguuguagucccuuccaagcaaugacaucuucaacacgguggguagguggcagaggcucaggguuaaggcucugaaugagccucugaugggucuuucuccagagaaaccauggcugcugaccugagaugcuggcuccuaaccccaaggaugcgugcugcuggcugaagccugaagugcaugaaucagggaagcggugguggcaggagaggcugauguugaugaugccucaccuggcucuugggggacuuaugaaagacccaucucagucaggaugguccucaguuucacucgcaauugcuugcccaaccaggacuugccugggcuuuuggccucuccuaguuuagcccuugcugcuguagggcaaagugaacagugugacugggaggaagaagacaccauuggauuggagguccuggugccuggacguggggccaggcucagugcuu

SEQ ID NO: 192235 - RNA, 15828 nt, Homo sapiens
gcgcacucucggaagcgcagccgaacccgcccuccgaauccagagaggcgcugcugacaccgccgccacaccgccgccacaccgccgcugccucagucaugccggugagugguugcgccguccccgccacgcagacuugcagucccggguugcuucucggcugcacagccgcuugaccggaugcugaucuugaagggcucaggcggcggccggagccgcuguuguccccuagcuuaccccacccagcccccagcuuuugcgacccuucagaaaaugggauccgaagggaguuuaaucugggagccaggcuucaaaacgucggagcuggaaggccuccaggggcgacaagcccacaccuucccugcguacacagagaaacagaaccagagagggggcaggggaugggggaguugguggccagcgggaacugagacgccuagucccugagccuuccuccuggcugcccugcccgcggagcuggccugaaggagggcgguggggaggcucuggacaagggaguggacccgguuauuuccucacggaccgggcagguuuucagagguucaugcuuuucuuaauuucccugcccacucuggccuacuuuucagaucaacucugggcgacacugaauggagacacuuucucagccugaacccaugagccccagagagguucaggaacccccccgcacagucaccaguugcucaguggcugugucugggaagucagucuuagccugccuuugcagaucacucagucuuaucacauauauuguugcucguggccucguuuuuuauauaaagaauugaggccuuuggcagauaaaaauauaaaaagcccaguaacuuauuccaggucguguugaaguuggcagagccaggauucagcuccuuauccuuaggcuccccaucucuccaggccugaccacaugggaggugccaggcaaaagcagucacaccggcuugggaagaugcucugaucucaguugcaucuugguuagggucaugugguguuuagcauuuucuucagggugccuaauucauggcucugggccagguggauacccagagguaucccacaguugccaugugucuuugcauccugucuuuagggagcuggcaggugagccugaggccuccugggcagagccacugacaucucaggugucauuuccugugggucuugccaggugccuugagacaaauccuccaacaacaaaguauggauaaggaaucugauagaaucagcccuaccaguugggcaagucagccuguggcaaugguagaagacaguauuaauugcccuggggcuuggggagugaaggccaccaggauuuuuugugggggguggcaaugaggaaaaggcuagcuugaucaucacuguauucuguaucuucuggggauuuugacaaaaaacccucuggagcagaugaugggaaugaggagggcacuuggcaccauguaccacaagauaacagcugaaggaaagaggguguuagucaagggauuuccucaaaacuggaaagggaagaaaaaaauauaucuauauacacauacuggaaggggaagaguguguuaccugagaguuuucucagacaaaugcccgagagcacaggguuuggaaucccagaaaccucugaaaaucugugccccagcuugccaacugggugaccucaggcaaguugcuuuaucucacugccuugauuuccucaucuguaagauagggacaaaaacuuugaccucacaggacuguuguuaguauuaacuggaaaaaugccaguaaaauaugucacacagccacugauauaucuaguccccaagaaaugguagcuccuguguagacguaggacaggugggcuagagcuauaggcaggugaggccgggcaugguggcucacgccuguaaucccagcacuuugggaggcccaggcgggcagaucacuuuaaugcaggagcuugagaccaacuuuggcaacaugaugaaacccuggcucuacaaaaaauacaaaaaauuagccagacgugguggcccgugccuauagucccagcuacuugggaggcugaagugggaggauugcuggagccugggagguugaggcugcagugagccgugaucgugccacugcauuccagcuugggugacagagugaaagugaaacccugucucaaaagaaaaaaaaaaaaggaaggaaggagagagaaagaaaagaaagaaagaaagaagagaagagaagagaaaacuauaggcaggcagcuuucaaucccauuuuaacaagaucucagugguuaagcauugagguuuuagaggcugacuauguucaauucaggcccuacucagccgaaucaccgugagugugugaacuaaccccuaaaucucaguuuccucaucugucaagaagggauaauaauaggccaggugcggcggguaaugccuguaaucccagcacuuugggaggcuaaggcaggcagaucacaaagucaggacuuugagaccagccuggccaacauggugaaaccccgucucuacuaaauauacaaaaaaauuagccgggcaugguggcggacgccuguagucccagcuacucgggagucugaggcaggagaaucgcuugaacccaggaggcggagguugcagugagcugagaucgugccacugcacugcagccugggugacacugugagacucagucucaaaaaaaaaaaaaaaaaaaaagaaucaucccacuuacugacuuuaaaaaccuacuuuaaaccuacuggcuuuuaaaaucuacccauuuuauaagucuuuauaaaagaccccagaggccaugaggaaccagaacuacccaguuaugcaucuggugguagagccaaucuugagauucuccuauaaagaagugauuacucuguccaugaaauagauuuuccaucacccucaaauuuauuuuugccccucagagguggaggaggagagcacugaacuguaauguuuauacccagaagcugguuucuggcuucugaccuuuauacugugggggaugggaccuacucccuguagucagcgacagaaaguuucagguaucuguugacuuuagguccuugggcagcaaaaaacugugcucccuaaaaauguguuucuaguuucagagcuucugcugagagucaggguuaugagggcuggcgguguacuuugcuuuuccagaaccagcaagauuucccuggagcgaagaaagccuagguucauauuccauacucaguaguuauuugccacaugacugcaagcuaccuagugaacucuugggaacuucacuuuccuccugagugaaauaagauaaauagcucucuuuccaggcucagugaggacuaacuuagauacuguacaaagauaauuugacauguaauagacaaucaguagauuuagcucuuauguugaucuugcaaacccuucaaagcuuuggcucaguauauaaguacaaaccauagaugaauugauuuucugcugguuauccuagagcaagacucagcaaacuuuuuuuuuuacacggcaccgauaguaaacauuuuagucuucacaaaccauagggucucugguacaacuacucaacucugccauucuagugcaaaaguaaacaaaugaguuuggcuguaguuuuuuguuuuuguguuucuuuuuuuuuuuuuuuuuuuuuggacggugucucgcucucuugccaggcuggagugcaauggcauggucuuggcucacugcaaccuccgccuccugggucaagcgauucuccugccucagccucuugaguagcugggacuacaggcgcaugccaccacuaccagcuaauuuuuguauuuuuaguagagaugggguuucaccauguuggccagaauggucucgaucucuugaccucgugauccucccgccucagccucccaaaaaugcugggauuacaggcaugagccaccacaccuggcccgauuugggcuauguuuuaacaaaacucuuuguaaaacagguaguuuguagugugccaauccauguuccagagcaucaucauuuuuuuuuccaaaacaauuuuuuucuuuuaaauuaaauggagccaugaucucacuguauugcccaggcuagucucaaacuccuggguuuaagugauuuuccugccucagccuccuaaguagcugggauuacaggcaccugccaccaugccuggcuaauuuuuuuucuauuuuuaguagagaaacagguuuugccauguuggccagacuggucucaaacuugugaccucaggugaucuaccugccucagccucccaaaguguugagauuauaggcaugagccacauugcccagccuaaaaaaacuuuuuaauagaggagagcaucaucucagacuguaauguggggaggaaugacuugggugucuuguuaaaaugaggauucugauuccggacuucugggaagggaccugagauucugcauuucugacaggcucucaggugaugcucauauuguugggcugaggaccacauuuuaaagacaagauuuuguaauacuuacuacaaauccuucuuuccagaaucuguuauuguugcugucugugaauagucaggaaacaagaugaaaaaaucagagauguuuagaagaaaggaaagacugaccauuuucuuuaagacagauuuugcagauuuggccuuaauaaaaggagugguuuacuagucacaaaggucaaacagucugcacuggaaaaucgagcugcuuaauucuuggucuucguuuccucuguagagcacagugacaauccagacucagcgguguuuagagacuuggaaagaguuugagaagccacuuagccacuuuauuuucagguuuguaguuuugccucccguucucuccccaguagguuaaaaauggggaguggcagggcccgcuccacauccacagagucaguugaggcaggugucugggagcugcacuuuccacaagguccccagauucuuccuaugcacacuaaaguugaaaaaaauugaguuagcuaauacccuuuugguauagauuagggaacuggagcccuucuggagcagagauuuugccugugguuuucuagcaagauauaucacuacacccaggauuccaacugagguaauagacuucaaauauuuugaagugcuccaugaaaaauguagccauugauuuuugaagggaaacaggagagacaaauggaagaaauuaauaauccaauagcuaaccuuuuacccaacggaaccuaguacuaggcucuaauuuccuuaauguguuaguuaucuauugcuccuuaguaauuaucccaaaacuuuguaguauaaaacaacaaauauauuuauaguaacucacacaguuucugagagucaggaauuugggaacagcuuggccuaguggcuccagcucagaggcucucauaaagcugcagugagauguuggcuggagcugcauucaucugaaggcuugacuggagcuggagaauccacuuccaacaugucucacucacaugcuuguuagcucgaggguucaaucucucacuuuguggaccucuccuugugguugcuggaauuucuuuguaauuuaguagcugacuuccucuagugcaagugaccccagaaauggagcaagacagaagucacaguguccuuuaugacauugugauagcuucagaagccacauaaccucacuucaagccauauucuauaagacacacagaccaacccgagacauguggaaugggauuacucaagggcauaaauaccagaggcagagaucauugaggccaucuuggaugcuggcuaaccguacuuaaaauccuguguucaucccauucacaaaucuagagagggacucuuacccucaauuuucagauguggaaacuaaggcacagagaaguaacauauugaugaucaugcaacuaguagugccagagcugguaucugaagccauauuuaucugauuucagauggucucauuuccagagauuuuaaaauaaaguauugguauaaguaauccuugugugaaagcaaagcaaaagauccagaaguucaaaccagccaugucaauuauccauugacucaaaaauaaguuuuaagcaccuacucuguccaggcacuguuccaaguauuaggaauccaguagugaacugaacaaaaccucugucuucugggagcuuaccuucagacccuugaucuguuagauauccuagagacuguagaauguagagcuuacaugaagacuaggagccggggaucccuuccugccuggccuccaacccacuggggaacccaggcaauccuuucuuucccuggacccagaugcugccucugagaaugcggcccuuggaugaaagcagaaucaccugggguaaugaguagacauaacagauuccccagcccagaccugcugaccagaaccuguaguuuuugcaagcuguaggugacucuagugcagaaaauaauuuugugguucauaagugggcccaccagaucagcauugcucagaguaugggggcccaucccugucagaguuacugguggcccugagacaaagcucauagcucaagaaucaguguuuugaagguaggacugggaaaaagcauuuuaaacuagaucuccaggugauucuauuuacuaugugccagacacugcuaaaggauuuauagggaugauuccauugaauacaacuugugagguagaaacucuuagcuacucuauaguugaagagacgggcucagaaacaggcuucugaugagucugaugccaaccagguccugcccagucucucugucuucugucuugacccugagugggccugucugcuggcacugugugggggucacucuacagggcucgggucauggucccccuguguuuguuucagaagcacgaguucucuguggacaugaccuguggaggcugugcugaagcugucucucggguccucaauaagcuuggaggugagugaguggcccugaguugggugcacuuaugccauguucagaugcaugcagauguugcaggagagacuuaggguuaagcugaucauaacaguaaaacuaaaauauauugaguacuuagcacgugccaacuacucuuguuauuuucuuaguggcuuaugugaaucacaucauuuaauccucaccacggccauuucagauaguuuuuuuuuuacuagcuccauguuaaacaggagacagcugaaguucagaaacauuaaauaacuuaucugggaucacauggucaguaaauggcagagcugggauuuagccaaauuaacuaguacugccaggaguagcucuggagccauggcaguacuaguucauauguuggucaucuccaguguguacugcaugacacaucugagugucauuuucuauugaauuuuuuuuuuuuuuuuuuuuuuugagacagaguuucgcucuucuugcucagccuggagugcaauggugcaaucucggcuuguugcaaccuccgccucccagguucaagcaauucucuugccucagccuuccaaguagcugggauuacaggcaugcaccaccacgccuggcucauuuuguauuuucaguacagacgggguuucuccauguuggucaggcuggucucgaaccccugaccucaggugaucugcccgccucggccucccaaagugcugggauuacaggcgcgagccacccuacgcagccucuauuaagguuuuuuaaauggggcugggcacgguggcucacaccugugaucccagcauuucggaaggcugaggcgggcagauugccugagcucaggaguucccgagaccagccugggcaacaugguaaaaugccaucucuacaaaaaauaccaaaaaaauuagccaggcaugguguuacaugccuguacucacagcuaauuuagggggcugaggugggaagaucgcuugagccugggagguuaaggccacagugagccuagaucgugccacugcacugcagugggggcaacagagcaagacccugucuccaaaaaaaaaaaaaaaaaaagaaagaaaaaaaggaaagauuuaaaaaaagguaaaaauuuuuaaaauuuugucuuuuucuguuucuuuacuucaaaaaaaaaaauuuaaauuaauuuugaaucacucacaugcagauuuuuuuuuuuuuuuuuuugagaugaagucucacucuguuuguugcccaggcuggagugcaguggcaugaucucagcucauugcagccucugccuccuggguucaggcgauuuccggugaauuuuuguacuuuucauagauauggauuucaccauguuggccaggcuggucuugaacucuugaccucaaguaauccgccugcuuuggucucccaaagugcuaggguuacaggcaugagccaccgcaccuggccacaugcagauauucuuaaagcaccucuuuugaacaaucagucucauccagccuugucauuuuacagcuggggaaacugaggcccagagaggacugggaucugguccugggacucagugagguaauaacugaguugugaucagaguuuuggcaaugccagugcucagucagccuucuaagauuuuuucuuuucuuuuucuuccacaugaacuaucacacaaucuucuaaaauuuucuuuuuuaaaacccuaaauaauaaugacauuaaguuuucaaauggcuuccacauggacgugaucucauuagcaguccucugagcuguacuuuccaucuuuggaauggggaugucgaugccaguguccaggagguuaagugacuugcccguagucccgcagcaagucaguggcuggccucuagcccuguaaacugggaucuuaaucugaaagaaacugaaacaguggaaagaaccuagcugcugacuugucaugugacugugggcccuucuuucucgggccuggguuuccccagcugugguaugggaauguauaucuuguaugucuguaucagcuuuugcuguugaugcuuuuuuuuuucuuuuucuuuuuuuuuuuuuuuggagauggaguuugcucuuucacccaggcuagaguggagugaaguggcaugaucucugcucacugcaaccugcuccacucugccccggguucaagcgauucuccugccucagccucccgaguagcugggauuauaggugcccgccaccacgccuggcuaauuuuuuuuuuuuuucugaggcagaauuucgcucuuguugcccaggcuagagugcaauggcgugaucucagcccaccgcaaccuccaccucccagguucaagcgauucuccugccucagccuccugaguaucugggauuacaggcucaggccaccaugcccggcuaauuuuguauuuuuaguagagacgggguuucucuaucuuggccaggcuggucucaaacuccugaccuuaggugaccugcccaccuuggucccccaaagugcugggauuacaggcgugagccaccgugcccagccuguugaugcuuuaaaaaugaaacuguacaggagcuccucaaauacaaagcagcaggcucuggaugaaguggggaugggccuaauuucguuugacagcucaaagacaucuacccaucccaggaacuucauccaggcuggagugcaguggcgcggucuuggcucacugcagccucaacuucccaggcucaagccauccucccaccucagccuccugaguagcugggacuacaggaccacacccggcuauuuuuuuguuuuuguuuuuguuuuuuguagagacagggucuugcuuuguuaugcaggcugggaaaccauauguuuuguuuguuuguuuguuuguuuugagagggagucucacucugucucccaggcuggagugcaguggcaugaucuuggcucacugcaaccucugccucccagguucaagugauucuccugccccagccucccgagaagcugggauuacaggcacaugccacacacugagcuaauuuuuguauuuuuaguagagaugggguuucaccacguuagccaggcuggucuugaacuucugaccucaagugauccacucgccucagccucccaaagugcugggauuacagacaugagccaccacgccuggccaaccauaugauuuuuaaggccccuugcuggaagaucugccuuuaagcuucggcagguuucugcccaucuuuuccuacugucccugcuuggguggccucuugagaagggucaggaggguuuuuugaguugcuuauggcccuaaaagaacagugguagggcugaggaaucacagacugauggcauccuugagcuggaaaggccacaggagcuggccagcccugacuccuucauguacagaugagguagcugaggccugugagaagcaggacccuccucccaccgacucccugcccauggucacccagcaagucaauggugaggccaggccuagaaccuaucaagaguuuuccuuucuuuuugcacucuuuugucagaguaaaacucuggguccucccaugugcugcuggggagcuguaaauuggcauagccauuuaggagggcgauuuugcaaugucuauuaaacauucaaaaugugccaaauaucuguugccccacaauuuccauucugugaauucaugguauaacaauauuuuuauaaguguuuuaagacaaguucaaauauguuuacuauaacauugugauaguggugaaaaauuagaagcauccucaaugaccuuuaacaguggauuaauuaaguggaugugugguacguccacacuguggaagauuguagcuuuuaaaaaaagaauagggccgggcacuguggcucacgccuauagucccaacacuuugggaggccaaugcagguggaucaccugagaucaggaauucaagaccaaccuggccaacauggcgaaaccccaucucuacuaaaaauacaaaaauuagcucagugugguggcucaugccuguaaucccagccacucgggaggcuggcugaggcagaagaaucgcuugaacccgggagucaggcuacaaugagcugagauugugccacugcacuccagccugggugacacagcgagacucugugucaaaaaaaaaaaaaaagaauggaccgggugcaguggcucacaccuguagucccagcacuuugggaagccaaggcaggcggaucgcuugagccuagaaguucaagaccagccugggcaauaugcgaaacccugucucuacauaaaauacaaaacuuaaccaggcauaguggcaugugccuguagucacaacaacuugggaggcugagaagggaggaucaccugagcccagguauucaaggauacagugauuugugauugugccacugcacuccagccuguauaacacagugagacccugucucuaaauaaauaaauaaauaaaaaugaauaaauaaagagaaaaguaaaauauuagcaagaccuguuuauauagugugaugcgauuuggaggaauuauuuuucauuugucuaucuaggacaaagucuagauagaagccagacuguucacagugaucucuaggggcaggaucaguagggggccuuacugcuucuacuuuuauuuagaaauguuugcuuuuuugaaaaaaaaaaaaaaagugucuauauuacuuuugcaauuaaaaaaaaaagguggcugggcacgguggcucaugccuauacucccagcacuuugggaggccaaggcgggcagaucacuugagauuaggaguuugagaccagccugggcaacaugacaaaacccugucucuacuaaaaauacaaaaauuaaccaggugugguggcauacgccuguaaucccagcugcuccaaaggcugaggcaugacaaucacuugaacccaggagguggagguugcagugagcugagaucaugccacugcacuccagccugggcaacagagugcgucucugucucagaaagcccuaguauagaacagagaucagcacaugggccaaauccugcucacagccuguuuuuguauguucaggaauagaguuauaaaaaaaauacacagaauauacaacagagucuauaugugacccacaaugccuaaaacauuugcuuucuggccuguuacagaagaaguuugccgaucccugcucuagaggaaagggcaagggugguugugaguaguaauuuagagccugaacucuuucuugcuguaacugggagggucugugcuuccucuccccauaccccauuuccucuuccugcaggaguuaaguaugacauugaccugcccaacaagaaggucugcauugaaucugagcacagcauggacacucugcuugcaacccugaagaaaacaggaaagacuguuuccuaccuuggccuugaguagcaggggccugguccccacagcccacaggauggaccaaagggggcagguggguaaggccccagcacuugcugaacaaaccuacagcucacaccucucaucagagcgaacaccuuggccuuugagagcuugaguggagcgggagagcccucuggguucuuuucaauccacuguccaccuucuuuggagugguuacaaauauuuuauuauugucuaaugcaaaucacaaguucagggaauucuuacagacccugugaguggacagagcacuguguaaugucucccagaguccucuuucagacuugaggguugcaguucaugguuagcaggguuuaaguuuacaguaugugacccuaagcagugcaccuuugacuucuuuauuuguucauugguuugagacaguguuucacuauauggcccaggcuggaggguaguaacucuucauaggugugaucauagugcacuauagccuuuaacuccugggcucaagugaugcuccugccucagccuucuaaguaacuggaacuauaggcaccuaucaccacacauggcucuggcuuugauaaacugacuaucucaucagaguugacacuugugccuugggccuuguucuccugugcccugaccaagugaguuaauucagacugugccgcucucucuacuugaaacuguugucagcuuccugagcaugcccucuguccagacugguacaaaaacaauagcauguuugagcuagauguucccuucacuuuuauguaauccagugaugcaguaaggggcacugugccagcacucuucgcucuggaaccaggcagaccuuacucauugauccagccacagucucagcagggcacuccuggcugccacugcccauguagugcauuugacucgugaauuacaaugaucgccacaccucugaugugguuuggugcccugacgugacugagaaaaaugaggccaagagaggggaagugauucaaccagagucccacccuggugaguagcagaggcaggaagaaagucagauauccugaaucggaguucuguaacuguuacugguggcauugucccugugaaugggcccacagagacccccuggacagaggcuagccacacugacugguagguccucuuugaggauagccuccuucccaaaggcauacauuuggaaccugagucauagcaguguucuguguaugugguaacaucacaugcaaguuacaagaugucagaugcaucuguuuucgucaugcacuuuccauccauagauagaacccauauucaggaaugaacccaggaugaauaaugaggaaucuaggauucuaauuccaacuuuccucauuucacacugacuuuggggacuuuuuacauuacagagauuuggucuucccaucgguaaaauggggcuaaaaccuccaaccugcuuuccugccuuguggggacugcugugcaaucucuccacauaugaaaguuuauccucuagggaaguaaaacaucagcgguuuccagcauguugaagaacaguguuucuuacaucauuccuccaccccuaggguuuuguagggagggugaguggauggggcuuuggacccuccauagcucccaaacgguccugugucauauugggcuucccguaagacuguauuuuauaaaaacgcucuguaacaagaaggaauggaggcagagaaggaaaaaaauacucuuccugaacuagcuauauacauggggagcccuaaugcacacaucuuggauuagaaacuccaggccugggcauacgaacuuuuuuaacuaaaaaaguaauaucuguuggauguaaaccauguguagcuuaauguguuuuucucauagaaaacauguuuucucauguuauuuuauugagaugaaauucacaagacauaauaacuauuuuaacccauuuaugcugaauauugcaaaguuuuuuaugugaaaaaucaaaccuuggugaugaccuugaacaguaggauauaaauaacuccugcaagcuuagcguuccaauaauggaacacuaggcauaaauggguuaaagucuaucauuuaguggcauuugguguguucacaauguuguaugaccaccaucucucucuaguuucaaaauuuuuucaucaucucagaaacacacccuguauccauuaagaagucacuccccacuacccaucucuccauccccuggcagccacuaauuugcuuucugcuacucuggauuugccuacccuggacaugucauauaaaaagaauuacauuauaugugaccuuuuugugucugccuuuuuccauguagcauaauguuuucaagauucauucaagucauagcauguguuguaaaucauuccuuccaauacuuaauaauuuucaugguacuuuuaaucuacuuuagauuuuuuaugauaggaaguuucaaacauguguaaguagaguaauagaaugaauccccaaguacccgucacucagauccaacaguuaguauuuauuucaccaaggccuguuauuuuuugauaaaagugcucugugacaagaaggaauuaaggaagagaaggaaaaaaacucuucuggagcuaucuguauccaugugggggagcccuaaugcacacaucuuggauuagaaacuccacuguccucauuguuucaucugggugaugaaacacccagauuauuuugaagcaaauucuagacaucaugcccacucccuccugcccagauuauuuugaagcaaauucuagacaucaugcaaucuuaccuguacauauuucaguaaccauguauuguuuggaaaggcuccuggaaauucagaugcacaguacucaguaagaaucacccaauaagccagcuuuaguccacaugcucaggcagcaugucuuugaagucuguuuuaagaggcuccucagugacugauuugaagccaggcuugggaaccucaaagauagaguguuuauugguuuugaagucaccuugaucaucugacucuuggcagauuuauuugccaugauuuuguucauugccuuuccaaccuguaacaggauagagagugcuguugacuggguauccuggcagcccuggaaauuccccagaagagggcuuuggcagugauuggcuuagcaagguuaaugcguuccagccaaccuaaguauaacagacuucaugggagcagugugcagggcuggacacuggggcucuaguccugcuccugcaucugcacccugcguuuuccaccucaccccugccuuuuagugcaagacucuuagugcaccccugcgucaccccugucucuuagugcauuuauugccuuugcaaugucgcuauguccacaccagauggcaccuuuguuccaucuaacuuuccaucuuuccuaggaugcugauccucccgcuggcuuccagacagaccugggacuuggcagucaugccgggugaugguguuccugcggagacccucaguuguccuauuccuuccuagcuucccugcaauaaaaucaagcugcuuuuguugga

SEQ ID NO: 192236 - RNA, 230249 nt, Homo sapiens
guuggagcggggccggcgccgcagccgcuucugcuggcugagcugcugccgccgccgggcggacgggcggacgcgcggagcugggggcggcgcggcggggccggcggggcgcggcggggcugaccggccccgaugaggcggaaggagaagcggcuccugcaggcgguggcgcuggugcuggcggcccugguccuccugcccaacguggggcuuugggcgcuguaccgcgagcggcagcccgacggcaccccugggggaucgggggcggcgguggcgccggcggcgggacaggugaguccccccguugcuacaggccgggaacacccccuucccgaauucacuuuuagccugugguuccuuccuccaccuucugcugucugccuccucagagucagcuccgagacucuucagcucuucccauuuuccggaugggaaaauuaaguccugucgggacuuguccagggucccacgccagucagagacugaguccgaacuagcacucaggacgcuauuucucaccacauguuaccaccuuccuuucuguccccgucugguauuccuugacgucuuccagcggaucucuuuugaaggauccuaucugcaucccuguaucccaggaugacuccugccuugugccaauaggaaugaagauucugguucuucuauuugguguccagguccucucugcuucccuccucccacccccccccccccacaaccccuaccugcugaucccaguguucuuugcucaggucagcccuuuuccugauuucucaucugcccaacgagacacccgggccuuccuccucuccccauuuauucaacacccccgccccaacucuagccuuuuccuuucucagauccuguggauuccuugcagaauguaaagaucaugcucccuuuaaagcuucaagccccuggggguggagaaggggguaagcuccugguccuugagggaccugcugccuuugaccuuaugggaguccagagguggggcucugguggggggacccccaaaaugucccagaggcuauuggugcccaguguccugaggauggaacaccagaagccuucccuaucucuucugaacuugucuagucugguuaguuguaguguuuauugcagccaaaacugggaucggaaugguuucugccuccuuugaacuuacccacguauguuuguguguaugugugcgugcacgcauuuagacuagcagcucccucauagcagaagcucugucacaucacucccacccucccaggaggugcuagugaguguauugcuuagacuguuucauauaguggaacauuucaggcuuucuuacgggauuucucuggucccaugagaaguggauaauuuguguaucagggucagacuugacugacuguuggcuggccucgacgaaagaggcuggcuuuucugagauugaugguuuuccuuauucuucccaguaucaggcugcugucuaggcagucuggcaucuggagcacagagggcucuuugcuacagagcugaccaauuugagcuccgccuguaacucuguuaauugcugcaaagcaucccagagggucucauugaucuuucugguagagcuuacuguuuagaaacuaagguuuccaucucuuuccuaaaccccugguucaaacccugacagcuagcuuagaccucucucccugaaauucuguaucuguauggauuuuccguucaugaaaucucuuuccucuguuccuauucaguaccagcaucagagucaggaguuccaggguucugaccucagcucuaccacuaacuuacuguguguguccuugaucaccuuucaucuccuuuucugagccuuacuuucuuggucuguaaaccaugauuauugguccaguucuaacauucugugauacuaucaguuaaucaaugaggaauacaacggucccuucuuuuuuucugucuugaguccagaguuccuuguagcaucccuagcuguggaggcuccauacuggacacagcuccaggucaagggggaguguccuacccuagugcaaacucuccuuuagaauagcuguagcccauucuaaaauagugcuugacauucugccucugcuuggagaaagaccucguauuucauuugcaauagaugccaaagacauccugauuuucauuucuguagacccagauggguagagaaggucaagguuaacugccaguuuggccugagcuuucaaaguaaauuacucacuugugcaagaggguauugauagaguaaggcagacuuuugggcagggagagagaggggagcaacagcugggugcugcucagagccccuaacugaaauggauagacaggcucaucugggaagaucuaguuuuuguucauuucuuuuucucuggaauagcaugaagaggaggaggaagaaguggugaaggggguuuggggguuuggggggaauaccaacugauuauucuugcuuuaaagaaaaucucuuugcuucaugggagcagcagaauggagcuguuuccccaaugauaagcucuucuaggugcuacaggauucagcauucaucugcugccuuucaagaacgcccugccaaauuuccacacagccccuuuuuguuucacucucccacagaugcagagcacugggcuuggcccccaguccguuguuugaaugucagcuggccuugaggaaagaggcugacuucucagagugaugguguuccaucccucaucccaguguacuggaacauacauguaacaugccaggcugcuaucugggaaaucuggcaucuugagcauacagagcuuuuucaacagggcugaccaguucugagcucagccugucauucuuguaauuguugagaaucaucuuugagcaucucguugauccuucugguagaaauaacugcagaggcucuggagggaagucugacaggacuuuauccaaaugaaaaauguguuccauauggguuugaaagaagauucuuugagaguaacauauccacuacuugaguaguccucuaacuccuugauuucuccacuggauuaaagaacggaguuucaaauuuauaguguuuaucaucugcuagaaugaaagucuacauaacucaugccagcucauccugggaguaccucuggagcugggugggauagcugauuuauaaaggacacauaaugcuucuaggauuucagcagucaucuggucagacaguuggcuucuugggaagcugcaaaaccaagcaagaaaugccagccuugaagacaucuuccuuuuaauuugugggucccucucauuccaagccccaaucuguuuaacaucuugguuuaauucaacagucuguuucauauuccagguuugggacagguuauuaaaagcucaaguuagaaacucagugcagucucuccucauuucugagccauaaucucuuguugaaaaaugacuucacuggauaaauagcauauguggaauagaaauugguggaauaauggaauaccggugacuuuaauuuucaaguaucaggauuucuuucucauuguguuagagcugaacuuuauucuuagaacauccagaaaucaauguuuuuuucucuuuuuucagucuuccugguggcagaagccuugcccaucagaaaguuaaguauagaaauguagccuuggaacgauuuccuuaauuuuccacagaagggcuaguauccuuuagcuugcuaaucacuccucugucugcaugcccaggugaaaucugaugccacuagggaaggguuguugauuugccagaacaaauccggcucccuacauucuuucugucauucuuggcuugcugucuaccaaggaguccagcugaggaaggccugggaacagagaccuggcuuuuaguccuuucuccugcccuaaacucacuguguguccucaggaaagagguuuaaccucucugggccuuggauuccucaucugcuaagugaggcuuagauucagaagggaaaaggcaaaugcauauuguaacgaugcuuccccucccauggccagggcagacauugcuaaucaaccuuuucauuacuaauaccagacuugggcucagacuguuucucagcagggcuacucaaguagaguuaacgacauauggaaacucauuagcaauguagggaauagauacuguguuagggcuuuuccaacucuuacauccugagguucugugaguaugcuuggaaacacaucugaauagugauaguauauuuaaacaggccucuguaucuaacuuguaaugaggccacaacuuaaggguauguucauauuugaaugucuuuucucaggcuguagucuaaggauguucagccuuugaucuguugguuccagugacacgguaacagauaacggaaucaggaaugaaaagcaaaagcccauuuaaaagauaaccaucuagcuugcuaauuguaccuuguccacagucagcucuuacacagagauggcaucaggaucuccucacugaaucaaaagcaccuugaggcaaaccuggcagcuacaaguaagccccauggcagcuaaaugcuccugacgguguuugcagagguuucguguuuuacauauaucugacccucugcaucccauauaugugucagaacugguaagggaaggccuugaauaagagucuuguuucuccagagaaccuuucuccucaugcgcaguggaguggggaaaggagguagcgcauauacaccugaauucccgcagcaagaaguguaucauggccucccugcuggaaaugucuuaagguaggaacacauccuccucuagcacaaagcacaagauuuggcucuuggaagacaggauguguuugcugaaugauugaaauauaucagagcaggcagggggcugcagaagucaucuaguccaaucuccucaauuuguagguaugaaaacugaggccgagaaaaagggaaacaaauuaaacaaguucccauagggaggaacgcagaucagaauccauucuccaaguucuuguucuauuucaccaugagaaauuuuuucccuccauauacuaauauuugauccuucucuaccauuauuucuuucaggagccaagauuaucaccccaaauuuuggaggccacugcuuaaugagaccaauuaucugcuggaaccuaucuggcuauuuuuuuguagaucuauuuuuguacauuuucuuuccaacauuuuauaguguuuuguuuuuguuuuuguuuuuuuuugaaacggaguuuugcucuuguugcccaggcuggagugcaauggcgugaucucggcccaucgcaaccuccaccucccagguucaagugauucuccugccucagccuucccaaguagcugggauuauaggcaugcgccaccaagccuggcuaauuuuguauuuuuaguagagaugggguuuuuccgugugggucaggcuggucucgaacucccgaccucaggugaucugcccaccucagccucccaaagugcugggauuacaggcgugagccaccauacccagccucauuuuauaguuuuaaaagcaacuaaaauggauuaaaauuuaagguggcaaagggacaagaguagaggaauuaaaggcugggaaguacauggcaccauuacugcuaucccugacagacagagagaacuugagccuaagaaccaccucagauucucuaucaguugcaaguaacaaaacaaauugagccaugugggcugaaaugaguaagggaauauauuggcuccugugacuguaguuggcuucagguauggugugaucuagagguuuguggcauugucagggcucggucuccuuuccucugguuucuguugguucugacuuucucuguguguuggcuuuguucuguuuugaggcuccauggcagcaaaaaaugguaauagcucuuucagaccucagauccacaccuagauccuagaggagagggucugucuccucugguagcuucuacaaaagacagagaacaucuuuucuauaagcucuagcaagaucuuaggucuuaccggucuacuuuggaucuaaugugcugucugaaccauucgcagauuucaggaggagaagcuguauugauugacuuaacguacccuagagcuaggaguggagucagguuacccagaucuaagaagagcaguuccccagagaagacucugggugcugcuuuugggaagaggagaaagauaucuagagaagaagcccacaaauauccacuccagaguccugcugacacaguguuccaggcaguaaucacuccuuggggaugagauuugguccuggagagaaaaccccuuugccacccuggacccauuuuugggcaccgaaccugcagucuggaggucuguguucucauuccagcacugccaccccuuggcugagaugauuagcuguguggaccucaguuuguugcugaggacggcuugggugcaaaugcuugccaacacacaguggaggguggagauaaagagcaauugaaagcugucuuuauugaaucuuacuuacccguucugccgcugccuuccuuuccccucacagacgucccgagaacugucuccccugcccccauacacacuaaaagucaauucauugaaaauuucucucaagcugaaaaagaacuucugucucugcagcuuccacguuuuuucugccuggcccucuuagcuggaggagguggaguguucauacuuuggaagcuagaggaagcuaaacaauucugcuugcugugguggguggguguguauuuaugcguguguagcuuucucuccaugugucucucuucucucccucuuaucuuugaaugguuccuguuugcugcccucugcugaguguagauaggagagaaaagaaaaaagcaggccuauuuuuuuccuucccuauggcuuuaagagaaugcugagcuucagauguuaaauugucuucaguuuucucaggugaugaaagccacagcauaaaaugauacugauccaaagaaugaugaugauauggcugauaaugagguugauaauguuaauaguaguaauagcaguuaccauuuauuuagcacuuacucugcuagguccuuuaccuguacaucuguuaaauauuguuguaaccagguaggaaagaaggagggaacugaagcucgaagaggggcaggugcuugcccaaggaugcacagccuguagugguggagcugguauuugaacucugaccuagugcugaguccuuaaccaccauacuuccuccauaucugagcaggacaaaggaccugucuuccaccccugcccguuaagcccuuccugcaagccuggacaucugagcaggugagagggaccauugcccuaagacagccucuucaguagcugaaguggagcacauaaggucauguggugguggugugugcuggaagagaaaccucuaccucagccuccuccugucuccguuccucuugguuugaggcauguggggcugcguauagugcucuagcuuuggagcuacacugccugauucaaaacccgaggcuugggcaagcuugaccugugugccuggaauucuuggucuguaaaaugguaguaauguuaacuguggcagagaguucucuugaggguucagugagucacuguggguaaaaccccaaacacaaugcuugguacagaacaagugcuugguaaacauggugaugccgcugccuuugugaagugccucgccuauggcagggacucaauucucuguggcuucccuuuggcggagguagggagggcugcauaacauugucuuugucuagaaggugagcaauucgaagauaagugguuggcuuaacagcacaggguucagaagaacuggaagaagccaggugggugcagucucugauuauuggaggugggaaggaaauugugcaugcagaggcugcucuugguaccccucuuccugaaacuucggaaugcgaagcaauuguuggggaugccuucucaacucccacccugggacaacccagacccucuguauccuucuagauucagcucauagccugcugccuccaggaaguguucuuugguuacuccagcccccaggggucacucaagggucuuagcuccucugagccuugauuuucucaucugccuacuuagaucagaggcccucuagaagauuucuaacauccuucuucccugcagccuugccccuagaccugacuaacuccugccagggcagccuagguuagcauucuucccaaccagggcccggagaccuguauauaaaucugucacgcaaugcuguaauuguuuuuaaucuguccagacugucugcuuccuaaaggcaggaacuaaccucucucuuggucacucuuguuugccuaaaauauuugcugaauggcugagggggugagugaguaagugaaucauaugguugguacucaguaacugcuggcugcaugcuggaagcuuagccuuaggaaugguucuucuugaacuucagggugcuucacaaucccuagggagccuguuaaggauggugacaccaggauccaugcccaaagagcaugaaggggcugguuugggcuuggccaaggaucacauauuuaacaaauccuacugaggguccaacagggaacuccucuccacccaccugacaggagacagaccucucuuuccccagggacccacuccauucuccccaggagugcuucaggacccgcccuugaacuucuguuccugggaaguguguuuaucugcagcuucccaaguugucaaucagcacccacaggggagcucugugguacuuuuagcaguggcacuguaucugaugcaagcagaucaggcuccaguucaggacagggaugggaggugcacuuuggaaucccucuccugugggcugcgaggauuggcuggggcgguagagcuuuauuuuccuuugaugcccacagucugcugcucuuccaggaugcgugcucugccuuccugccaugggcaaggaugagguaggugccucuacguggguguugggcugaacuagggggucucuugggaaggguuaguauuguggagacccuguaaaccucucccuuguacuggagagagcagaggagagaguguggaguugggaaccaaugugaccugauccucaggcccagcucugccacuugcuggcucugugccugaccucuggggcuuccugcuccuucuccuaaaaugagcaaagucaucacuacuuccuagugucauggugaugauuagaugaaauuaaauaacaguugugaggauugagguacagagaggucagguaacauauccagggccacgcagcuaggaagugauggaaacaggauuccaauccagcugggaugcuuccuuccgguaucugcgccagccacugacuggauggucuggggcgagucugugggucugccccugcucacagggacuugcggaggccucagugggagguuaucacugagacccccaugagccugguucuuguuguuggcuccagaaagcucuuucagcugaauacccaggcagccgugccagggcagggauuauagcaagucccaugugccgccuggaugcugcacucgggcagccucucacgagcccaguucgccaggguucuguguguguguguuuguguaggucucccuugugaguuacaaaugucagccuccucugagaggcgggcugcugagcagaggggccgacaggggcuccuggagggaaggggguuucuucgagggaacagguuggaaacaucuggcaggggugugugugugaaaauuacguccugcugcuaaagcacauuguauguucucaacugaaaacuguuauuuuuugcauguuuccuccugaguauugaucagagucagcugcugagaguuaaaauguguaugugugugugugugccuauuugugaaauaaccaguuucuaaauuugguaccuaacuucagugaaaaguuaguaauucuguucuuggagagccaggaucugucauuuggauuugugguuauuuuauuaauaauaaacuuuaauggcuauuucauucagagagcuucuuuuauuaauuucuuugaccuuuauguauuuuuaaucaccuuaccuguauacuuuaauggaaguugcaaacugguggccugugggccagaugcagcccagagauacguuuugugugccuugaacagugauggcccauagauaguuggguuuuuuaauuuuuaaauguucauauguuaccaguaccuaaccaugagaauauuuccuauuuuaaaacaauucuauacuaauuucuguuuuuuuuguuuuuguuuuuguuuuuuuguuuuuuaaucaaaguucagcugcugaguucagguucaaguuuuguaagaauuugcuggaugugggaacagcugucuccucuagacagacccuagcucuccaguuggccaccaccccugcugcacuuaguggucucaaaccugggcacuucacccuuucacacaacuggccaggcugcaggagacauucgacuuugggagcccuccuuuaugauaugcaaauucccauaggcuuuucccaguucugccuccaccaguaucacgguggaggcagggcagggcuuacgguccccacuucacagaugcaaaaacugagguucaaagagcauaagugacacgacuaguaccaaagccaauaaguugaugcuaauccuucugucucuaagacuaauguacuuuucagagaaaaaaaaauaauuacuuggaaguguaaguauauaaaccuuaggcucugacagacucacuuauguuuauauuuagaugauucuugcucuaucucagcucaagaaaccauuugccuugcuucuguccauuucuagguaucugaauuucaggucuacccugucuaauaaaguuuuguuguuguuguuguuguuguuuuuagccaugucaggggcugcucuagauuuguuagaaaugauguagguacaggccaggcgugguggcucucaccuguaaucccagcacuuugggagaccaacaugggcagaugacgagaucaggaguuugagaccagccuggccaacaugguaaaaccccgucucuacuaaaaauacaaaaauuagccggguguaguggcgcacuccuguaaucccagcuccucagcaggcugagguaggagaaucauuugaagcugggaggcggagguugcagugagcugagaucgcaccacugcacuccagccugggugacagagcaagauuccgucucgaggaaaagaaaaaaaaaaaaagaaaugauguagguacagaauccaccuuguuuucugccugugcuuccuggcaugucgggaaaccccagaauguaucuuccuauuauuggggaaguguuaggauccauuaaaugagagugaagacagguuucccagcagaaaugguacaugcuccacucccuggucugaggggaccucacaggcacccaggagguuucuagaaaagagagaaccuggaugagaacagcuuagguccccccagaggcagcugaacauagccacucaugucucugagaguaggguucauugccggggcaggagugggggucccucugcccgccauuucaagaaccuucccuuggaggcuccagguggcuccugguguggcaguggggcauggaguguggggcacagcucggugugguggccaggaguuagcuuuguccuugagcacuggcuccacagcagaaacagcaaugaucauuaguuuauugagcucuuacugcgugcuaugcacugugcccaucucaguucaucagcacuguaaucccagggagugagugcccuuacuguugucauuuuacagaugggaaaacugaggcucaggaaacuuaagucacuucccaggccuauacaagaaacaaguggugggacucaaacucagauuucugacucuccaacuugugcucuuagcuaccauguuuuauugacuccucugggcaagucuuuuaacgucuuuuggccuccauuuccucaccuguaagugggaauaauaccuucuuggcacacgagcagagucaguuuucccacccauaacucuuccugccaccccucccucggggcgguugucagacacugguguggugugagcuaucuuucccgcuaggguggggccucucugcuuguggggguggggucucccagcagagucagccuggggugugccucucugcuucucccuuucgcagccuagaccccccucgccugcuauucugcacucugcccuggcagcaagagaggcagcugagggcuccugccauccaagcccugccagggaacaauggggcacguuaagaaggcugccaagugccaagccagagguauuaaagggacauuugauuaguuuuaacucuaauugucaggcuuuugcuuucuuuuguucucuguagcaguuaagggcgaggggaagccccggugugaguuuccucccucugugacuuguauggacucucuuucacuuuggguguaugacucuuucaccugucuccuauucucaggccucuccccucucugucuguguguguuucucugucucuccuuccaccuccccccgcaacccccauagucuccgugaugugugucucucucuuagcaaauaugaugagaaaugacacuaaagaagccauaagccuaccacgguggaauccacaauuucaaggaauuguaucuuuuaucauauccagucucccucaaccuuaucccugccaaaugguuaccaucuuugacuugaacacccccagugauggggaacucaccuccuuuagcucagcagaguccuagguagucugccauggcucaggggugaccuaagaauuucuugaguacccucuacccauccuuucagguaccucugaaaucuuuuucuucccagaaagccuucccugaucuuuccaguuagaauuagucugucucuuggaaaugccuacaaaacuuaauuuguacaacugugguggcgugaauguuauagugccauguauugccauuucccuagguggaggaauguauuguugaaggaggcuuccuagcaggacacucccuuggaugaggcuccagcugggaagaagagaucccagagcucucucuugugagccugggcuuccuccucuuucgaaaaguuccauucccaaacuugaccacuguguuuuauguggucuuuuaguccagagaauauuccagguuuuuacaggccauacagucucugccacaacuacucaaucugucuuuguagugugaggguagccauagacacuacuuaaaccaaugagagugcuguguuccaauaaagcuuuauuugcaaaagcagucagcaagcuggauugccaggccaugguuugcugaccccuuucuagucuuuucaugaugaaagagcccuggguuuugaggcaggagccugacuccucagguaggagccaccuugaguugcuuugugacccuaguugggucccugacucagcagugcuuccguccucuccuauguaagcuguguuaauugggaggacaaguucuaaggaucccuccagcuuuugauacucagugaggcccugaauucucugcuggaucugacugcaucucugaaacagauuccaaauccaccuauuuucuucccgcuucccaccagccugucacaucucaccuggauuccugccacagccuccuggcuccucuccuaccuccacccugaaaucauaguccauucuuuaugcacagcccaaguacacauuugcaaggguaaaucagagguuucugccucuuuccuaaaacucuucaguggcuuccacugcugcacugaaacacagcacagaccccugucucgucuggcccugcuuacccucuggcucacugugucuccuccucucagucacagcacagcagcugcauuagccuucuuacacauccagcaugguccuucugcaggaccuuugcaugugguccugccuguaauacucuuccccaagauuauagaaggacugguuccuccucaucuuuuaggucuuggcuccaaagucaccuccucagagagggcuuccgugaacauaccaucugaaguaccucuuuccuacccacucugcgacuugaucaacugugaaauguccacauagcaacuuagcacugucuggagucaccuugcuuauuuauuuacuuguuuauuucucugcuccaguagauacuaaacaccaugaggguagggaccuugugugucuuauuuacugcuguaccuuauagugcuggcacauggcaggugcucaagaauauuuguugaauuaaugaaugaaugcaugcauaccuguguucccagauacccuacagauaggacucugacuucuccauguuucuucucaccacuccuccguguuucauuuggacaccacucuguucuugguguugugggaaauugcacacuuucacccuaaggggcuguguucucauagugggggaagagacagacuuccuucuccccuguugagaucagaaggccucaaaaguguuagcucccuaaggcaacagucaaaggacaccguuucucuugagaucuuuuaaucagaagcagcuccuguccucaguccacguggcuucauuggugguaucucuggaugaggauccauuugguucucucccuccagacagucuuuagaauaugaaguaaguagcuugucugggauuauauuuucccccugguucuuaggaggaaaauauaaggguggaccccugcuuacuuguuuugugaggagcaucccugcagucuagagggagcgucuuaaggaagagggcugcuggucgugccccaggcuuucccaaggacugcagcucccaguaaguggguaaaugggcucauggguugaaucaugucucucaaaaagauacggcaaaguccuuacucacggcaccucagaauaugaccuaauuuggaaauagguuuguugcaaauguaaccaaucaagaugaugucaugcuggaauagggugggcccuuaauccucugugacugacugauauccuuauaagaagaggagaagagaugcagagacagagagggaagacggcugugaaaagcuguagacagagacuggagugaugcugcccuaagccaggguacaccuggggcuaccagaagcuggaagaggaggaaggaagcaucuccccuagaggcuuuggagauaggauagcccugccaguaccuugauuuugaauuucaagccuccagaacugugacgcaauaaauuucuguuguucaaagccacccacuuuaugguacuuuguuaugguagcccuugggaacuaauacauggaccauuuuccauuuucucaucagauuguguuguguguguguguguaugagugugucuguauguuauauuuguaggcagauagauaaaacaccuuugcaaaggcaaggauaauugucuuaaucucuucuagcuacuuacauuucuuuuuaauucauggaaaagauccucucuuucuguggaggauuagcauauuacacugcacauauauauucuuuaacuaaagccacucugcuuauuaagagaucaaccuguuaaaaaaaaccugagccauuagccuugaaucccagugaauaaacacaugguacauacugccuuucacuuaacuguauuauccuuuuguucugagcucaacaauuuauuuuuguacuggguccccacuaaauugauuugggggauuacuaugugauagauacaaaaaacagccgcugccuugagagagcuccuagucuaaaaagggacgcagacaaguucacggggaugcagugcaucaggcagagcaugacgaguguugcaagaggagaucagccagugcugcgggaagccaagaggaagggagcagcacccuaguuguaaucaggaaggacuucugaaaggugcugauuuuuaagaugguccugaagaagguuaaaacuuuagcaaaguguacauggugggauuggggucucucagauggcaggaagcggggagccucuuucaagaacagcaaaaggcagagucacugaaacuucacgugucuguuagagaguagcuggaaaagugggugagggccaggucacagggucccugauugcuaggccagggaggcuggccugcaggaggcaaggaagccauggauaguuuuugagcagaggaugacuugaucagggcuaggccucagaaagguaacuacggcaacgcaggagccacaggaggcagggagagcaguuuggaggcuauugggguggagagauucauucauccacugugccuuucugugguccagaugcuaugcuagguucugaggccaccaagauguguaacgugcagccuuugagcuuaaggaauccauugcuacuguugcagacuguuuuugccaggcacaguguuaagcacuuugcauacauuaucaucuuugauccucacagcaacccaauaacauacucacucuaauuauccccauuuuauggaugaaggcagaaccagccugggacaugcgcaauaugcguucaaaaacugcuggauaaaugacauauugaaggaagaagaacugcagaccuaaaugccagcuacacagcaggcugagccuuccaggucagguccugugccuggagugcccuggccccucgagagcuguccugggagcaccucugccuuaucuggucugguugcagggagguugcagguucaucagggagaugaaauguuucacucaaggucacacagcuggucacugguagggcugugacuggccuacagaguccugggccuuaaccacuucucugggcuccacauacuaaacaggucaagucagaguacagugagaucuuucuugguagcuguagguacaggguucuaugugagcacauaggagagccaguggacccggacgggcagggcggguaagcagaaaaggcucccugaaggagggaauccugaccuaagucuuuuacggggagugggaugguuuagccagacagggaaauggcugggcaggggguggguagugaagggauuccagguagaggagauagcacagucaaaaguccagaguugggaaaacagcauagggugugcagggucuccuaagcucauuauuccuggccccaggaguggggcugggagaggcuaaaacacaguuagggccaggucaugagcuacacuccauccucaguucccaggagcgugaaggguguugggcagagaaguugggugaccagauuugcuuucguauggguccuggaguucaauaguugaaagagaucgggaggccauguugucaaccacugucagauguuugcaaccagaccagacaaggcagaggugcucccaggacagcucucgaggggccagggcacuccaggcacagguccugaccuggaaggcucagccugcuguguagcuggcauuuaggucugcaguucuucauucaauaugucauuuauccagcaguuuuugacugaacacugcacaugccccaggcugguucucugcuaagcacuugacauucuaagagaaaaggacauggucucggcccuugaggaccagguggcccauuagacagauaauuccagggcagugggaugcaugccauagguggagugagcacaggccugagagcacagugaaggauucacguuagccuucacgcuggcuuccuggccgccaccucuaccugccccucccacucaccucaggcuuauaaagccauggauuugccuaggauugaaucccagcucugcccuuuacuagcugugugacuucgagaaauuuccuuaaucuuuuauuuucucucucucauuucuuacauuuuaaaaugagccugauaauaguaccuacuucacaaguuaguuaucaggauuaaaggaauucacauacacaaaacacuuggaauagugcccggcauuuaaaaagugguacauagauacccuuaggauuacaggucuggaaucucuuagcccaaacccuguguauuaggcauauuuuagcauuuagaauuauuagucaagguucagucaggacagagaaaccacacagugauuugaacacaggaaguuuaauauaaagaauuauuuacuguaacaggagauuagagcgaugaaaauuggcuauuaagaagugaaaagcacucuaaagaauauaggaauggcagauagaggaacagcuccuacccccaguguugaguuaacagcacccaaggaagaggcccccguaagcugagauccugacuuuguuggagagggcacagcuaugcuuacugagugguagagagucacuagagugccaccccagcaaaguucacaggaaaucugccugcuagggugcuggaggaagaaacacauggugagguaucucauggaagacauucugcuacaaaaccacccaagggaaugggugcugggagaagcuguuggucgcuggaugccggugauugcugcacaccgcaggagcuaggcaauggagaagcuacgcguacugcaggagcuagacauggagaggccaugcacgcugcaggaggcuagugccagagacgccacccgugcugccugccuacugaacacaccagaaccagggugaaaaaagccuuuccuucugcagugucucuccagcaucuucuacuaaccacuguuaacaucauguuagcuggcaagggaaacacguuuaagggcccagaaccauuuuugcauagcaggcagugaagguggguuuggggcugagaggcaauaaauuaauaacugacugucucagugaguuugggcugcugcaacagaauacuauggacuguguggcuuaaacaagaaacauuuauugcucacaguucuggaggcuggaaaucgaagaucagggugccaccauggucagguucuugcggagggcucucuuccugguuuauagacagugacuuuccugcuguguccucauguggcagagagcagaaagagagcaagcacucaugucucuauuuacaagggcacuaaucccauucacgauggcuccaccuucaugaccuaauuaccuuccaaaggccccaucuuguaauaccgucaccuuggggguuaggauuucaacauaggaguuuuggggucauguaacagucagucucuaacacuggcagaagagucuuucugauuuaggaauguuaguaaagugcauguguuauuauguaauagcucuagugggguuuacagugcuccccauaaucaaacacauuuuuuuuuucugccacaaaaauguauucacaguaagagaauaaaucaagacuauaaauagccucaugucuauucaagucaggcuuugucacuaaaugaguuauuuuuuuaaaguuauuuaaaaagccuguuuggacuuuggaauugaggcuaagggaugguugaccugcaucauuuucauuuccucucuccaugcagcagucagaguuaucuuuuggaaauguaaauuaugccacugggaaagccuaaguggcuuccuguuccaggauaaagacuaaacuccaccccuggcccccuacccacacugugcccucacccaccucugcccuccaacgacucugaucuccaacaagccauguguccuucugcaacagagccuuggcacaugucacucucauuacauggagcacucuuccaguuaccuaccgugcacacaagugcaugcacacaggcacacaugcacuugcaugcacacacacaugcauacacacacacacacacacacacacacacaguuuugcuuggcuaauucugccucacccuucuaauggcagcucaggugucccuauuccaagagaacuuucugacccccuucuaccccaacccucagcccacucaggcauuaaagcauauguguuaguuugugauuauacagacuuacaauaagugugauuauuugauuaacaugucucucuauuaaacuguaaguguuauaggacaguggcuguauccguuuuccccccaacuauuuuauucccagugcucuacgcagugccuggcaugugacauauuugaugagugaaaaaaggaauaaaccaucuuggauuagauccugaaccagaaaaaaauaaauuagacauaaaggacauuauuggaacaacuggcaaaauuugaauaugaacuguagauuagauaauaguauuuuaucagugugaaguuucuugauuuuguugucuguauucuuagaaaaugcacacugaagaauuuaggaauaaaggguuaucaugucuucaacuuucucacaaauggcuuagaaaaaaauuguagauacagguagaugggggagagggagagagagugauaaaacagauguggagaaugauaacagccaauguggauaaaggauauacaggauccucuguaccagccuugcaucuuuccuauuaguuugaaauuauuuuacaauaaaaaguuuuuuaaaaaaugaauaaaaaugaauaaaugaggaaagggaugccaggaggaggaggaccccucagguauaaaggcaggagggcaggaaagggcuuggucccuuuggggaacuugcagguaggcugugugguuggaggguggcccuggggcuggggagggaagagcaggggauggagcuggagcccccacuauggacucucuggagggagugcaguauugaacuguucagucaacguucaucuacacuuuccccucucuuuuucccuuggugauuuuugaccaaaagucugauugcaugaagccagugugucucaggucuuccaucugauuucucuuuugucuuaacaauagagaaaaucucauccguguaugcagguuacuccuucugcugugaaacugugacuuuccuguugucugcuugcuguuaaacucaccaugcauuucccguuuugguuauauagugcugcauaacaaaaugugguagcguaacacaacaaacauuuguuaucuuaaaguuucugugggucagaaauuugggcuuagcugggugguggugguacagugucucucgugaggucgcuaucaagauguuggccaguccugcaggcaucuaaagucucaaccggagccgguuaaucuacuuccaagauggcucacucccuuggcagccggaaggagaccgcaguuccucaacacaagaccucuucaugaguaagcuugagugucccugaagcauggcagcucacuuuccccagagcacaccauccaagagacggggagagagcaagcaggaagccacaguccuucuaggaccuggucuccaaagcuauauaucaugauggacauuuuauccuauuagaagugagucaugaaguucagccuaugugcaaaaaagaauucaacuccacuucuuggagggaggaauguggaagaaguuauggacauuuuaaaucaccauaguuccugaaagccuuuugcuucuggagggccagugucugcccuccagaaguuuacaucaucuguugaaggaaguaagacaugcucugaaauugcucauaaaaaccaagaugucccaugagagauggcuugacaggguucugaggaagcagaaaucagaauagaugguagcaaaggagagcucuuggaaggaacugacacugccuucauggaugagcagcuuuccccuugguucuuaacccugauuauugauguugucauacaaugguaaugaauaauaaugauagcauuugaacauuucuaccaugacaggcacugcgccaggcaggacugccuuguagcacaucuauguguauaaauaacauccuuggaauugugcagugggaccauacugaugcuaaauauuaauacuucacuuacguuacuucauuuaaugcuuugaacuaccuuguggaguugcugucauccccauuucacauuuucgucugauuucucuguuugucuuaacaacagagauuaauucacagauuacaaacauaaggcuuagaaaaaauuaaguaacuuaagcacgauggcacagcuuguaagugagugaguuacagcuuguaagugagugguuaagaucacaggcuccaggccgggcaugguggcucaugccuguaaucccagcacuuugggaggccgaggcgggcagaucacaaggucaggagauugagaccauccuggcuaacagggugaaacccugucucuacuaaaaauacaaaaaauuagccaggcguggugacaggugccuguagucccagcuacucgggaggcuaaggcaggggaauggcgugaacccgggaggcggagcuugcagugagcggagaucgcgccacugcucuccagccugggcgacagagugagauuccaucucaaaaaaaaaaaaaaaagaucacaggcuccagagucagaccuauggguuuaaauuucaacgcuucuacuuuagagcuuugagcaggugacuuuaaccucucugugccucaguuuccuaaucuguaauaugcauauaaaacuauucaauguucucagcacagugccuggcaugugaugagcauuaggugcuauugcuacuauuaucagcucacagucaaacacagcuaugcucuccuugaguucuuugcauugguuuguuauaaagaguugagaugagagaaguaagugguaacuacagcuaccacucuucauuuguagggauuaagaauuugaaaggaaaaacaaccucuccaggccgaacauuccuacaggucuuaaaugacacauucuggccauucccaguuucucucuguuuuauguccaugaggauaucaaugcuuugagggaugccuggccauuccccucucuguauaggcacacauaguggcuaagcuggguuucaggaagcugaacuugaguugacaucuuucuuuggaaaugcuuucccucuugaggggcaagggacacuggcuuggauauaaaucaggauaucacaggauaucagucauucaggauacaagucuaugccgugggguuauuuuuuuuucccuuacuguguggcccagacugaagugcagugaucauagcucacugcacccucaaacucuugggcucaagugaucuuccugcuucaacacccccgguugcugggacuauaggcaggugccaccaugcuggcuaguuuuuguacuuuuuguagcgacagggaucuugcuauguugcccaggcuggucucaagacuccuggccucaagugauccuccuguccuggccucccaaaauguuaggauuacaggcacgaaccaugugcacagccuguauuguguaugcuagagccaauuacuaaaucuuucugggccccaagggucucuuuugcaagaaggacauagcaacuucucccuuccagaguucuccaucagaaagaggauugagaggguauguuauagaaacuguucaacucuagugcaagguuuuaggagucuucguuuccuuccaguuauuugagaaauguggcuucuucaagcaacuggaauacugaaagccuuuuugaugggaaucacuccucccuaaccacuuccacccacaccuucuuugguaaaacauuuuugagaaaaauugguuuugaucugaauucugaggaccaaaacagccuccaaaaaucaagcacaaaaaaaaaaaucagccuccaaaauaaaaaaccaggugguucuccuauugaaaauucaaaccugauaaccaaccagagggacuuaucuuuuagaauuaaucuuuuuuccaucuuuaaugaauuggcauuugucugcucugccgguucauuguggaauucagccucauguuucauugugaucucagaagcagcgagcacucaucaccggugggaaugauagagccuaauuuggaaaaaggagaaaaaaaaccccaaaccuccucccuuucauuuccucacuuuagacuaaaaugcuuccuuuuuuaaacuuaaaaaagggacuaauuuuuuucuuuucaaaauugguucagauaugcaugaaccauuuuuuaaaaaauuauugcacaacucaguauauucauuacacaccgagguuaugaguaagucuucccugaaucaucuugugguacaaagugacgggaagggauucagucagcuaccuguacaggaggcucauucuguuucucuccuccauuuucucauuaugaaacuguacuuuucagaagacaaaaaggggagaagauaagggaagaggaggaggaaaaugucagagggaaaccuagagcugucagcaauuacugcuuuccaacugccuaaccucagagcaauuacuuaaacucagagccccugccccacuucugaaauggggauaauaacaguaauggcuauguugcagggcuguggcaaugauuaacugagaaaauacccaugggaaacaugcuuuguaaauuccauuauacuauuguugguacugagauaugacugcauauauguauaacuugugugauucuuaaaaauuaauuuuaaaaggguugccuuuauuuuuagaaacagaguuugaguuggaagggaacguuaggaaucauucaguacgacgugucacccuggagagaaguccucucuauaguugccuucaaagguguuaucuagccugggcgcaguggcucacgccuguaaucccagcacuuugggaggcugaggcgggcggaucacgaagucaagagauugagaccauccuagcuaacacagugaaaccccgucucuacuaaaaaauacaaaaaauuagccgggugugguggugagcaccuguagucccaguacuugggaggcugaggcaggagaauggcgugaacccgggagguggagcuugcagugagccgagauggcgccacugcacucuccagccugggcgacagagcaagacuccgucucaaaaaacaaaaaacaaaacaaaacaaaaaagguguuaucuagguauuggcuugaauagcuccagggauguggaggucaccaccucugucuuuucuucuuuuuccuaauuaucccugccuuuuaguucuucuagaccuaagauauaacagugauuuuccuucuccugaagauagacagcaaaagaauacugucaugguuaaaaaugaauaaacaugccacagcaugcauugugaagaucugccaucugugugcaucgcugcugcagguauguuagccagucuccaaaguguuugaacuacuuguucaaggggaucugguguucucuguagcagaagcuacugaguuauuagggguaaggcuucagcccuggggcagaaggaggacuuggcagggcccucuuagcucugagcaucugcauaccuuucuguuuuuuagcuggugguuuaucuagcuuuagguauauaaagauuuauuugaaaagguagaguuuguggcaguaauuguuaccuucucuucuucucuccucucuuuccccucugaaguggaggggaaaccuguuuguuucaugccagcuucugccacugauguuuucacugcuuucuguucaagauguuauggugagggaggaggcagagaccagggucaggaggaucuuggagaucaucccagccagcacuuuacaaacugucucuggaaguucacauggaugcuucaguguuuacauuguuucaaauuguuagcucuuuuuaaaguuguaauaauaauaauauuauuuuuaaaaaauacugcuauguguuauauacugcauuuuuacguguugaaggucaccagcuuuuucuuuuaacaucuguuuaauugaagauaauccugagauuauagggcaggcuguguuuuuuaaaaaaauguaucuacuuauucaucaaaugcaucaacucuccauuaaauuaaaaagauuuuuuuuagcauugggcaacuaaaaccaaacagaaaacuauacuuugaggcagauguaagcugcaagcuguugucuccaauuccugaguucagauuauuuguguucaucagaacaaccucauuguccucguugguuaauuuucaguaaauaaauguuauuaauuugaaaauuagaaauuuguaaucauaaaaugcaccuccaagucuuaccaauugaaagacuucacucacugaaaaccuaccagcuucucagagaacaugaaacuggcauuccucaguuguuugggaauuccuucuaguccaucauuauuuauuuauuaaauuguacuccagguggacuauauaacaagaucguauuugcacaagaaggccuacuuacuggcaacaaccuuuauauugucauguucacaucucagcaauugcuuuuuacuugugaguagacccuggcagcuuuuacuuuuguagauugugucaacuuaugaaaaaaaaaaucuccucuccuauccuccagugugagaaaugcuucccucugcccaaccccgggaagcacugcuuuaauuaugagaccguuguuaccuuuuaccuccuauucaauuguuuccuaugugcuuagagauuuguugagccauuugcccauaaaaaucacuccagcaguuaucgaaagccuuggaugauaaauuagaucaucccucaaccucugaggucaggcagcccccacuuccuuccuccuccuuucacuagaucucuuuuccacccucuccgucugucuggguagaccucucugacacuacucccacccuucccaauuuuugugcgcuacaguggcuuccgccuaaagccuuguuugcccucugagagaugcccauggagcuccaggaucuguguguuccaugaccccuggcagaucacgcuccucuuguggaaaaugggaauuuuacaucucccuuccugccuuacaggguuuguugugaggggcaagggagacagugagagggugguugggggcacuugagugcugugggaauuggagguucugcugccucuucucuguggggcuguuaucugagcucuuucacucuuuaguaccgcgucccugucucgucucaagaaagcagguaguggaagagauggagagaguuccagcuugccucccagaugaauuaaaaucaaugaaaguucccacaugcacagagccagaugcaucccucuuccuguccacaccccugucaccaaaacaaguguggugaggggccccugcccucucaagcaggucagcgcaggcccugcaguaaggaaggccugaguugaaucuugguucugucauuuguaacagccauguggaccuucaggaugaugccuagacuuaugcuaaaaauuaauugggagacuguauggagagggcuugugccuugcacauuguaagagcucaaaaauagcuauuaauuuuuugguguuuggagagacuguuguacuuucuauaaauaaauuguacaguuuaacucccugauuggaccugaauaaaaauguugggguagggauagaagaaagggaaucauuccaugugguuucuuccuucuauuucuccugccagcucgcuuccccaccccagccugggcacugcuguucgacugagaccaggauuauucccaccgcccaagagcagagagggcucagaugcacagccucugccuucguggagugggcauuuucagguggggaugacauuuucuaacaagccuggggcaccuccucccuccccaccucaugggucccucucucauuuuaaaagcccucccaggacuucaagaugaaacacuuccacacugggcagagauucucauugaauucuccaguucgcugucuccagugcugaggagagacauuuuaauuaauuauagucccaugggcucggggaucaauagcagugaagagccguggaaugaauuccagccucugugcuguuuccagcucucccugugaccuuguaccagucgcucaagcucucugggccuugguuuccucuucucuagaaugggaauauucauuucacaggcauaaugagaaucuucaaaaagguauggcgaucaaaguguuguaaaauguagagugcuaaccacaaguaaguuauuauuaaggugguauuuauauucccaaaggguaagcaugagugguguuucucuucugagccauuucuagaaccuucuugcuuuuuguuaauacguuaaaaccaccuggcagcuuccauuuuccuuucugagucugagaagcaagcagcccagacagaauuggggggagaggguguagaugggaagaaguuccuguucuguaagccccaaguuucuccagcaaggaaaagguaaucauaccugugggaccuggaauaagaagacagaagccuuggcuuuccccgagagucagugcuguucgccacacuggccaccucuagugcugagucuuuguuuauugaagccucuucuucuguuuuccuguguccuuuucccugcaguguauucugcacacagcaaccagagugaucuuuccaaaacacaucuggucauguccuuacccugcccagagcccucccccggcuccccuagacuuuaggauaaaauccagcuucuugcuauggcugcucaggcccugcugcuccggccucugaccgcaucuguagucguaguccccugcucucccaccugcucgccuuuggcucccaauguagcucaucuacuccccgacaugugcucuaccuggguccccaggccuuaaugugccagucugggccucccuggccagguccuccacgugcuucaggugucuacugagacaucaucucccccagcaagccuucccugaccacccugcccuccucagccugaguggguuccugugguguccugugcuuauggaugucuugguccuaaccguaucccaggacagucauccauguccuugguggccuccccucaccuacccuacagaugcaugagcuccuuucaggcugugccugugugaccaguuuacuguucuauccuccagcgucuagcacaccuccugccacacaaugcaugccaaauaauggauggaagaauggacaugggcuguuaccaccagauugaaaaaccugcacauacuagaaucaccugggcacucucccagccaacggcuucggcuuccuggugccaccuuaguccuccagauucagcauuucuaugggugggccggggaaucugcauguuuaacaagcacacgcccaggugauuauaaugcaaauuugagaaccucucagugaucuuuccaagcccaacguuuuacaaaacagauaacugauccagagacaguaagugaauucuguaagaucucaaacacucucucgcgcucucucucucucucucucucucucucacacacacacacacacacacacacacaccacagagagagagggagagagauuucauuuaugagaugacaugaacacccaaugcuuuucccacucccacaaaguagaccuucaagaaaaccaugguaggcauaggagaauuuuugucuuuguuuuaaccuuuguccuaaacagaucugaucuggcgaaucuucacauauuguuuauuuccuuuccauaggaagugcuuagccuccaaguaugggcuacuuauuuuuuaacaauuacuuucacuccaagacguacauaauuuuuuaaacaugggaaucccugauguuucauuuuuguuuuggaaaugauuuuuagagaagaugaauuauccugucugaugccaugagaucuauuuuuaucauuugggauguugagacuaaaacugacaacauauuuaguauugcuuauaguacucagugacacugccucccuuugaagcccgccagagagccaccaugcaggaacaugaguuacuaauuaauucaaccugcucacugggacaaaaugggaaggaagaacccacauuugacacagauaaaguggagcauguucaaagcgccaggacaccaagggaucaggaaauuaugucucaagggaagggcugaagaaacugcacauuuagguuuccauggaggaaacucaguggcuguaaaugccagaagugcugaaauagggguggguaggcuugcaaggaaaguagaccuggaccugaggguggaaguuaccaggacagaccuuccgcuggaauaugugaaagaacuuccaagcaaauggaauccugcaaauaagcauccuuaaaagggaguucccacagcaagagaaauguucaaagcuggagccaucugauggggcugucacagaauguccugggugaggaguggucuggacuagaagaaguccagguaccuuucugacagacucuggggugaacacaaauggccacaggaccaagccagugaccugaaugagucagucauuacucagcuccagccaauugcuugggaauguggguccagcaaggccagauccuucuucugauuuuucaagaaaagacagacuuguggauuuuuaaaaauauggacuguccugaguuuuaaauaucaugcaggccaaauaaagccaucugugccugcagggucuugauugugaccugccaguuugaccccucuguuccaggauucucaggguuaugugcacuuuuguccuucacaaguaagauaaaugaaauagguagggauuuuccuccuauucaacagaugggcaagucaggacaccgggagguuaagggacuucuagauagacgcacucuuauaauauaagguaauguuauaacagacaagggcuagaaucaggguacgugggugaauagguaguuaugucccucggcugcuccacugacauuucauuuuuuagcucuucucuuaaaauaauauuugcugaagggagcacugggaaggccccauccuuccuauaugacuggagcagggaauucugccucccaggggcucuggggugagggguauccucccugcaccgcuccggggguuagggugccccugaguugugccuuacugagucugcacauccugcacagagcuccugccuggagccauucuaaaacucagccgcuccuauuccccaaggaucugugucuuuaggccuccagccaugccugaaauuucaccauuauaagccugcuuuugggugaaggcuucacaggcacccaggaaucacuuucacagugaacacaggaaaaggaaaaaaaaccacaggaaugcaaccugacaucucucucaggcucuaaguauuggacugccaggacuuggguacugaagaaauuaguuuugccacgaaggcaaccucaaaaagccagucaucuucaagccacauuuacagcacuccgcagugcgacuugaggccugucugccuagcuuccugcuucuuggccuuccugccacucuuuaugcugacaccgcgcuuacaguagcagcuuucagaccaacuugaggccuugcuuacuuugccaguggacugccugcuuguuuuuuaaaggauuuuuuuuuuaaguauugguacuuuuuuuuccgugaagcuuaguugaaguauauuugaauuacaauaaacugcacauuuuaaaagugugcaacuugaucaauuuuaacauauauauaaaccugugaagccaucaucacagucaagagaaugaaccuuucuaucaccuccaaaagguucuuugugccccuuuguuacccauuccucucuguguccccuaauaaccaccugccugcuuuuugucuuucuggaugaguuuacauuuucuagaaauuuguauugaaggaauaauauaguauguguuccuuuuugccuguuuuuuuuuuuuuuacucagcaugaugcuuuuugacauucauccauguucuuguguguaucaacagugcauucuuuauugcugaguaguagaccauuacauggauagacuaauucauuuauucauuuaccuguugauggacauuuggauuguuucuagcuuuggguuauuacaaauaaagcuguuauaaacauuuguauacaagucuuuguguauauauauguuuuuguuuuucuuggguaaauacuuaggaauggaauggcuggauuguaugguauauauauaucuuucuaagaaacugccaaauuguuuuccaaaguggcuguaucauguugcauucccaccaucaguguauaagagucuggcugcuccgcauccucaccaacacuuagaauggucagucuuuaauuuuagccauucugguagaugugaagaagugacaucuuaaugucucacaugaaauuuacauucugccaugaagagcaucucuucauguguuuauuggccguuuuaugucuuuugugaaguaucuguuaaaaucuuuugccauuuuuuaauuggauugucuuguugaguuuuaagaauguuuuauguauucugccuacaagucuuuugucuaauauauguuuugugaauauauucucccaaucuguggcuugccuuuuuguuuuccuaauaagguaucaguaucaucuggcaaaaucuagagcauaugggguuuccagggauaaguaagacauugaaauuuaacaaauguaguaaaccuuaagaaucccguggaaccugaaugugguaccaacaugaauauuuaucauauuaacucugaguuuggauauuauuuugcauaauuugagaaaaacacuguguagggcaccguacuaggugcuagaagagauggaaggaaagguacagacauaaucagacauggacacuguucucaggaugcccucaucuguggagggagaggcguaaggcaugcauucuaauacuaaucauuauugcaugcgugaucugcuuuauuggcuugauaauccucagaacaacccucugagguagauugucuuaauuuggcagauguggaaacaggcuuagagaaguuaagucacuuccccaguucguacagcuaggacaugggggaccuggauucaaucccaauacugucugacuuugaaggccccauucuuaaccuuugggcuaaauugccucucuaguauaagguagacuguauuaaggaacuauaagcaaguuauaaacagagcauuguagagcaagaagugaacauuuauuuuuggcucugugccagaaagcaccaugaagggguuagcauuugagcuaggccuugaaggauguacuuaaccuuggcaacaaagaugacagaaagggaauaacaauuggagggagcaggccgggugcaguggcucacaccuguaaucccagcacugugggaggcugaggcggguggaucaccugagguuaggaauuugacaccagccuggccaacauggugaaaccucaucucuacuaaaaauacacagauuaacugggcgugguggugcaggccugucaucccagcuacucaggaggcugaggcaggaggaucaccagauccuaggagguggagguugcagugagcugagaucgcgucacugcacuccagccugggugacagagcaagacccugucucaaaaaaaaaaacuaaaaaacuaaacaacaacagcagaacaauuggagggagcagcauaaguaaugaugcagaggugggaaugguccugggaucuguugacuauagccucauuuuccuuaaggggaacagagagaaaaggcgauuaaaaucuauucucaaaaguccuugaaauuugggcuuagaaguuugaauuugauuccagaggcaauagugauccacugaagcauuugagcagcggggaggggaaguauuauagaagguuguguguccuagaaggacaaggaaguagaggagguacagagaaccguuggggaucuugugguccccacuguaaguguuggggcccccagcuaggucauuagccacagaaauggacaagaaaggauaaauacauaauccaaaaguaguagccaccuuccccauucaucauucuuauucuaucaauucuucuauaaucugggacuaauuugacccagucucuugcuuccuccuucuuccucguccaucuguauuuugcauacuucauugcucucagacguaacaagggagaagagagaaacucaauuuguccagcuuguaauuuguuagcuaauucugauaaaugaggugguuccuggaaaaggcagaaacuuuuggcuaaaaugaaguuuuauacuauuuguacauuuauuuauucauucauuaagcuaaccagauucauucauuuaccauucauucauccaaacauuuauucauucuauaaacagucauuugauauuuauggaguaucuaauauguuaauaugugccagacauugugguagauacugaagauacaguggacaacagaacacagucucugucuacaagaagcucacuucuuuuuuuuuuuuuuuuuuuugagauggagucucgcucugucucccagguuagagugcaguggcaggaucucggcucgcugcaaccuccacuucccggguucaagugauucuccugccucagccuccuggguagcuaggacuacaggugugcaccaccaugccuggcuaauuuuuuguauuuuuaguagagaugggcuuucaccauuuuggccaggcugguccugaacuccugaccucaagcaguccacccaccucagccucccaaagugcuggcauuacaggcgugagccaccacaccuggccuuuuugggguuuuuuuguuuguuuuuuuuuagacagagucuugcucugucacccaggcuggaguguaguggcgcaaucucggcucaccacaagcuccgccucuuggguucacgccauucuccugccucagccucccaaguagcugggacuacaggcacccgccaccaugcccggcuaauuuuuuguauuuuuaguagagaugggauuucacccuguuagccagaaucgucucgaucuccugaccucgugauccgcccaccucggccucccaaagugcuggggauuacaggcgugagccacugcgcccggccuuuuuuuuuuuuuuuaaaggcagggucucacucugucgcccaggcuggagugcaguggaaugaucauggcucacugcagccuugaccuccugggcucaaguaguccucccaacucagccuccugaguagcugggacuacgggcaugugccaccacacuuggcuaauuuuuuuuuuuauuauuuuuaucuuuuguugagaugaggucucacuguguugcccagguuggucuugaauuccugagcucaagcgauccucccaccucggauucccaaaguguuaggauuacaggugugagccacuaugcccagccaaaguucacauuuuaauggaggauucguucugccaucuucuuuuggauuuucuuuuugucuuaccuuucuauguuccuuuuccucugcuuucuuuccuuuggauuuuuuucucauuuuacuuuuucccucucaucugcuaaaagaguuucguauuauuucucuacuuugaauaguuaaccaagaaauuuaacaugccauuguuuucacucauaggugggaauugaacaaugagaacacuuggacacaggaaggggaacaucacacaccggggccuguugugggguaggggaaggggggagggauagcauuaggagauauaccuaauguuaaaugacgaguuaaugggugcagcacaccaacauggcacauguauauauauguaacagaccugcguauugugcacauguaccauaaaacuuaaaguauaauaaaaaaaggaaaaaaaaaagaaauuuaacaugcauucuugaaucuaaaauuaauuaauuuuuuauagcuaauacagggaacuuagcauaucagcuuugaucaccauacuuugaccuauauaugcuaugguugucauguauuuuaguuauauuuuuuaauuuccuaagacuauaguauuacuguuuucuacagaccuuccaaggggaaucacauuccuucugccugaagcuuauucuuuuaaauuuccuucagcaagggcucuugauagcaaacucuccauguuugcuugggaauaucuuuauuucucuccuguucuugcuggguauaugauucuaguugacaguguuuacucucaguauauucaauauauuauucuacugcauucugguuuccauuauagcugcugagaagucaggggucaucuaaugauuauugcuuuaaaugacaucugucuuuuauccagcuacuuuuaagauguuaucucuguuuucaguguucuguacuuucaccauaauguagauuuuuaaaaauagcuuuacugccauauaaaugacauaaauuaaacugcguguuuaaaguauucaauuuuguaaguuuucacauaucuauacacccaugaaaacaucaccaccucaagaaaaugacuauauccaucauccccuagaauuuccucgugucccuuugcauuuguaaccucucccuccugucccuccugcaccuccucuaaucccaggcaaccacugcccucuaucaccauagauuaguuuguauuuucuagaguuuuauacaaauggaaucauacgguauguacucuuuaaaaaaaaaaaaacuuccuuuuuucagugaccaugauuauuuugagauucauucauguagcauguaucaauaguuuguucccuuuuuauugggaaauaauauuccuuugugugguuauaccaugguuuacuuuuccauuuaccuguugauggacauguggguuguuucuaguuuugugcuauuacaaaguuaccgugaaauucauguacaagucuuucugugaccauaugcuuuuauuucucuuggguaaauacccaggaguagaauggcuggauuauguguauauuuaacugugguggcaccauuuuacauucccagcagcaguauaugagaauuucaguuuccccacauccucaccaacacuuaguaugaucagucuuuuaaauuuuagccuuucuaauauguauguggugauaucuuaacgugguuuuaaucuuaauguguucucuaaugaacaaugauacugagcaucuuuuugcaugcuuauuucccucuguacaucuuuuuuuuguuaugugucuguuaauaccuuugaccauuugaaaaauuugguuguugguuucuuauuacugaauuuugagaguccuuuauauucuauauacaaguauuuuaucagagauauguuucugcaguauuuuuuucccagccucuggcuugucuuuuauucuuuuaauaguguccuuugaagagcagaaguuguaacuuuugaugcaguuugauugaucaauuuguucuuuuauguauuaugcuuuugguguuguaucuaagaugucuuugccuaaccauaagucccaagguuuuuuuuuuucccuuauguuuucuccuagauguuuuaugauuuuagacuuuacauuuagauuugugauccauuuugaguuaauuuuuguaugugguugauauaguuuggauaucugucuccacugaaaucucauguugaacuguaauccccagugcuggagguggggcuuggugggagguguuuggaucauggagguggaucccucauggcuuggugcugucuucaugauagugaguucuugcaagaucugguuguuuaaaacuguguggcaccuccccucccagccauuuucucucgcuccuacauucuccaugugaugugccugcuccuacuucaccuuccaccaugauuguaagcuuccugaggccucccuagaagccaaacagaugcuggcaccaugcuuccuguaaagccuucagaaccgugagccaauuaaaccucuucucuuuauaaauuacccagucucaaguaugucuuuauagcaaugcaagaauggccuaccacagugguauaaaguauggaucaaaguucuuguuuuucuacugauacucaguuguucugguaucauugguugaguagacuaucauuucuccaguaauuccuuuugcaucuuugucaaaaauuaguugcccauauaugcauauguauaugaacucauauuucuuggaaacuucucuggggauccuucgagggcuagguaaaggcgggcuccuccaguaaagauuggcauuugcuucugccaugugccuaauaaaaucacuuuacauuaaauuuucaguuugaaguuugucagaucucccagguacucugauuauggaccaaaaaccuguacgagagcuggcauaguaacaaauucucaagagagauuccuucccaucccauuuacucuuugccagaauugggggguuuauuucucacucacaguaaggauggcgggagucccaauuguauguggguggugguauagagugaacugccaaacucccaccuugcguggacucugggcuuuguucucuguguccuguguucuaagaggaugugcaaauccacauucaaguuaaccugguuuaguaaacgcccucaaaaugaaagccaguuucaguucuccacuuaacucuggguucucauuuucauuugguuuuugguuucugauuauuucuuacuuucuugcaaguuuguccaugcguuuuaaaaaugugauuuugcuuuugcuuuuaauucugccuuuuucauuguuuucaccuaguggguuggccaggguauucuaccauacugcuggaaauggagguugggucuuggucuuuuuauauuguuaggaauguuucuucucugguaacgugggauugauugcauuuuuguuaguuuuuguuuccauuucuuuugguaagcacuagagaaccagaggaggaagguacuuacuuuuccuauauuggucgucuguacauugugguauuaucaccaccuaaugaacuccugggcuuuacaucuuucccucuuacuaaaucaucugugccaaaugaguugaaguuuuauuuuagugugauuaaaauuccugcacuacaccacaucuagaguuaauuucuuaucuacuugcauaguaugcucuaccucucuuuuagauuauuuaguauaauuaaaacaauaugauuauuuguaugacuauugauuuuaaucuucccugcaaagauuguaaguuccugccggacgugguggcucaugccuguaaucccagcacuuugggaggcugaggcagguggaucacgaggucaggagaucgagaccaucuuggcuaacauggugaaaccccaucucuacuaaaaauacaaaaaaaaaaauucgccgggcaugguggcgggugccuguagucccagcuacuugggaggcugaggcaggagaguggcgugaacccaggaggcgcaccuugcggugagccgagaaugcgccacuguacuccagccugggcgacagagugagacuccaucucaaaaaaaaaaaagaaucuaaguuccaugcaaucacggaccaggacagucuuacuccuuccguaguaucccuacuuucuggcacagucccuggcauauaaagagcauuugauaaacaaagugaaugaaugaaugaauaacaggguuugucaggauacauugaggaagcagacaucugugauaacuuuguuugguccaacagccaucuguggagccccuacucugugucagucuccaugcugggcaccuuuggaaaaugcagagaugaguaaaacacaagucucacucucaagggaucuucaguccagugggaaaaaggcaguguucccauuacuggaauuuccauauucaaauaauaaauuuuuuguuuugugaauagacuuguguugagguagaaccucacuguugaucagcuauccagguuuuaaauacuauaauccuguguacgcaaagcuuuaugucccugaaacagucucagguagguaccuuaugugaugcucaaacuccuaugucaaaccucucuucaguccaguugacuaucaagugccucucuacgcccagaaguguaucaagucauuuggggaauacuaaguuuaaaagaaaaccuaaguuccuguccccaagggguuuacuaguuacggaguguggagauugugggcagcaaccacugggccugccuguagaagcccuaaguggacacaaguagaaaauuccugggcccugcagcacagggcacagauaaggggacacugccccuugguaugcagcaagacuuucaaggccccaaaucugcaccauaggcuucugugucuggcuuaugaguagcagcuuuauggucuuagaaguuguuuucuaggucugaugggacuagagagauaacagguaacaagcccacaguucugugcuucugagacuugugagccucucuugcauaggaccaccuacaucccugggcucaagaugugccucugagaagacacaagucagauaggagcuguaugugcccacagcauccuuuccuccugugcacuuccucugcaccacuuacuagcagcuucuggaguaaaccaaaggucagugacccugaaccuaauccaggucacaguucuuauucuuucuggaauccaggccaguccuggggucugaccuagaccaggaagagcagauguaccauuugguaaauaaaagaaagucaagcuuauuugacguuuuuuguucaugugacuucacagagauggcaaggcauacaccagacaaggcgggucccugcagcuucugaggacgccacgaaccagcuuugugaacguuggcugccuggccuuccuaggccuccuuguccuuauauauagaugagagaaauaggcuagagcugugauucuuuuccugugguucacagaccuguuucuguggcuaaaauuuuuaccaguccaagggaaaaugaggagagaguggugaguuuuucagaaagcuguguguuacugauccugaguggacaucuuuccaaguugguauaaugcauccucuuauuuuauaaaaugguaguaauagcagacgguagguuguuugccuucuugguugguuugaauguauauacugcacagaacacaaagcugauaacaucgucucuucccaacaccacuuuuuugggaaaaucuuuucaagcccauugaauucagaagucagaaaugccagguuagaugacuucgaaauuggacaaccucaaguuuuccugauguauggguuaugagagggugggagacacuuuucuguucuuauuagcugugaaguuggguuuugguuuauuuuugauuuuauuuuuuaccaugcucaaaccccugucucagcccucuuuuuaguccuguuaacuaucaagugccucucucugcccagggguauaucaagucauuuggggaauacuacguuugaauuagagugaaccccagucuccuguggggguaaugaggccauugugggacaacaucuuggucucuuaucucaaggccauacauguuuguaggucaugaguuuggcaugagcuuaauugcuggcacaucucuaccucuaugugccuuuguagcucucugggauacagaaaaguccuuugauacuuacguacuugucuuuguugguaauccagaaacccagguuuuggggcccaucagcuuuucugcacaggauccugcauacaguccaguuguggauuagccucagcccaaagagccuguuaagucacauguccucacuguauaucagcucaaagaaaugcugcaggcauggauggcccucugcccuccggggggagagagccaggagcucagcaaacuaccaaacagugaccuaugagaaccuuuaaggcagugggaauaaacuaaaggaaagauauuauaagcagauuuuuauagaaaguaaguugaaagccaccccacaggcccaccucuaccucuuagugcuguguggcuccaggcaagccacuuaaccucucuaggucuuuucuuuuauuuucauccuuaauaaaaacagaaugcuguuaucuguccuuuuaguugcuuauuguaagguuaauuggcuauuauaugugcuuugguuauuaugaguaagauacugugagcuugauaauggucaaaugcaaauaggauucauuuacuuauucaauacacuuguggcuaaugccugcuaugugccaggcaucuuucuguguaguggugagaaaaccauauauagccuucaggaagcuuacauuccagugggguggugggggaacagacaauaaacaagcaaacaaauaaauaaaacagugauaauaggugcuaugaaggaaacaaauaggcuggcauaagggucaggggaggagguuagaaaagguuucucuuaagauaugagggucagguugugauccaaagccaggaagaagccuggggaagaauguccagccagcaggcucagcaaguacaggggucaugaggcugcaaagggcugucuugcuugaagacgagaaagagugcaguguggcaggagcaucgugacaaguaacagacauguggucaauuucaaaaaguguugaguagcuacaacuuguuuucaugcauuucuuccuauuuuucaagcuuauuugucuuugggaacaaaauuaauuuauagauauguucuggauauuaaaaucauucuuuaaaauaucuuuagaauauggaagggagaauuacucuagaguaguuaacagaguauauauggccuguagagucaguuagccccagguucacaucagcuaugccacuuacaaggucgcugaucuuggacaaguuacucagccuuucugggccucaguuuccuuaucuguaaaauggggauaauaaucucugagcuccauucuucagaagauuguuauaaaaaaauuuuaacaaaaugauaaauaugaaaaugguugggaugcuuaaaggacauuguuaaugggaaagagaaugucuugacuccagguugguucuuugcauccugggccugcuuggcuguugguaaugggguacucucagauaagauuuucuguagcgggguuguaucaauguuaacuugcaggugggaagccuguucuagggcuuguccuuugagugcggcagaaaugguauuacaaggaaauaaaugaauaauaaaugaagggcuccaaagucaggcugcaccugcaagauuucugugugugggaaacucagcaaaaagaaaauggucucauugugcugucucugcaaggaaaagugggcuucugcaggcagcacuguguuaugaacaaaggcucuggcuucugaaaagagaccaaggugaggcaccaagggguggaggccuuguucuggggugcccaacagguuagugguggcacugggaugagauucuucagagcaccccccaccagccgcccaccauggucucuguaccccagcccucugcucuuggcauucugaaacaguuauuccacagcacaugguugucgaguggcugccauguuugugauacugugcuaggcccugaggauacaggguagacagggccgccuucauagcaccuacagucuugcugggagacuguaauggcaggaaggugacagaagugcuuuuggugggcagguagaggaugucguggguuagaauugcuguggguagcuucuuggacaguuuacuuuucuccuuauuaucugaccagauguccugagcuauggugguggccaaugucagauucaccaugaagcuucagagucccuuccuuccaaggcucugggaggggcccuagcaauguguuucauggucaucaguucucuuaacauuugcaaaagagcauuuaacuaugaucaguuacaaccacugucucucuucucucuaacuuccccuccucucuggugguggaguggccacaggcauuuuuaagauucuguggugggaaaguugaguugggauacaucuaacggcacuuauaaaaugcauuaugugcaugcuuuaauuucauauucuucuuaaagagccucuccucauccccaccugccaaagcaucaacaucagaucccacaaaaccagaccugcccauggugguggcuuugauuuuuccuacccagggucuuaguggcaggcaguggugacagaaaccagcaacuuugcuccaggugaagaacaggcucauaggcuaaaagagcugucugcagacaccaaaagggcuggcauggagacuacuaagcauauuuaucuauuccugguacauaaauuggguacaaaauugauagcauuuccucugugccaggcacuguucuaagcacaucauuacauaguaacucuaauccucagaaacaaguuuaugaaauagauaugauuaccuucauuuaacacgugaaggaaguaagguaccaugaggucaaguaacuugauagugggauucaaacccauugagucuggugucaggaucagguccugugggcaugugaccagugcauaugcacagggcccugcacugagagaggcccugcauauacgggauugguccugaucagggccugugcuucuuaucucucacuacauuauucugacaguaggcagaauauggcacaagcugccccaauaaguauugaguuccccagccugggagauguucaagaugagacuggacaacacuugagcaggaauacuuucgaggaggccuaaguaccagauaggaggagaguggacuagacacccuuuagcaucugagaucugcugagccuugagagucuaggauucugggacuuucccuuccacaacuuuacugaaagucagaaaauagaggaaacagggccugagggaaauagucuaguacauagaauuuagugagaaagugggacaguucccaaaggaaagaaaucuguggaaggacaaggaaccuggagacauuucccuagacuucuggcaauggcacugggcugcggucccuucgaagcccagcaccauugccacaaaaaccugcuucucucuccuuuaucaccagaaaugccccugacuagcugcagauaaauaaaaugaacauucaguuggggggccuucuuggucucagugagccuguagguucuaccaaugggguaccagccacagcagcagcugguaauaccaugauuacagcagcacagaugggguucauucugagaccuugaguuuuccuguccucugaggcugcagucuuugcagagucuuuccuuaccaccuggagagcugaacagagacuuguagcuucaguacuaggaaagggccuuagggguugauucaguuugagaacaggaguucucaaacuguucucuggaacccacguguguguuuaugugcuugaguguuuugggggaccaacaauugaggacaugagaaaccuaugaccuucuucuggacauuccgucauggcuguaccaguaacucuuaauguugugacccugagccaguuauuuaaucacuuugauccucaauuucuaccucugcaaaggaggcaugagaggauuaauguuaguacucaacuugaaaaauuuuugucuagcuauucccguuaauaacacaaguuggauagugcuuugggguuuucaaagagcuguucacauauguaaucucaccgguugucuuaauggcaagaagucauauugcccucauuuuacugauaaaggaacugaggcuaaagacuuaggaggaagcaaagccagaccuggaaauccauaauuuuagaauagggauccuuuguauuuucuaaaaguuugcccuuuuguucauugugccaaguucccacaauuugauguuuacauaguucccagaccacucuugugcacaaugauguuuugcuuaggucuggggagcccuugaugugccccaucuuaggucugcuuggacugggagggagacuagcagagggagucaaaaccugagcucuaaaguuagaucccuuguguucacaguuccaaucugucacuccccagcugugucaccagaacaaauggcuuaaccuccuggaaccugaauuuucucaugugcaaaauaaggacaacagugguaccuaccacauggaacuauugcaggaauuccgugagauaauccauguaaaaugcccagcucagugccugacccaaugcaucuuagcugucauuguuacuguuaauguaacuauuagcacauucacacuaaauguauccaucuuuaaaugagcuacuuuccauauuuuggucauugcacauuaaacacauuuuuaaucaacuuguuuuaggcuuaaauuguaggcuccucuggucuucuuuuuagcaucuguuagaaguauuuuuaaaagcucugccugaauucauggggagccccuguaaacccacuugaaagcagauuucaucacuaaaaacccacaaaacaccucagugugaguggaggaaucaggauguaauuuauggcguccacuucuugcugccauuuggcauuuugcaaacugccauugccauuagcugucacuuuugaguauuuaugaucuugcgguuggagcacuuugauucucauaacagaaacagggucacauuuagaaaauguacccuggaaaauguaccaccgagcuggaaacugagaucccccagggugguugauggauggggcugcacaggggaaguguggccugccagccaggcugcgcugugcccuuuccacauaccacaguuggaagcuaucuuugugucucaggccucagccugccaggccugggcuuucugcuuggcagugucuaggggucuggggcaaaaagauguguagcuaaauaccaaaaccauuuuccauauggaugcccuucacagccgugagauuggcaaagauagagcuaggauuuggcaggaauuccuccaugguccuaaacugguucuuugugucccagguagcagagaguuugggaucuugcaagugaggaagcaugaguuaaguguggcaccaauauacugaacuggcaagaggcaggacauugucgcccccuuugggccucaauuuuuucucugcuaaaugggaggauuugguuuuggugagcucugaggaccauucuuucagccccauugaaucucuugauuucagagaggugcuugacugugaaauuauuugggauuuuuggucaaaagaaguugagcguuuugagaggagagaagaaauugcauuuaaguugugggguuuuuuuuuguuuuuaaauccaggcuauucauugugugugaaaaagaauaccaucuccaucacuguaaugcauccgcacgcuugugagaaucugucuaccaaagagucugaggugaggaugcaaguccugacucggcuaucucugugagaccuuggacagaucccgguuccccuugcuuuguuucuccaauugggaaaucccugcaggauacugcauuacauuagguugcuaugucuucuuaagcuccucuuggcugggacaguuuaucagacuucaccuuguuuuugaggagcccuggccaagcauuuuuuuagaaucuguuggaauuugucugauguuuuucugaugcguagauggggguuauggguuuggggagcaagauuacagagguaaagugccauuuuccuugcaucacaucaaggauaccuacuauuaacaugacuuaucacugucgauguugaccuugaucaccuggugaaggucgcgccugcuagauuucuccaccgcaccaugacucauguuuucuucuuuuucauacuguacucuuugaaggaagucauuauaagcugcccuuggccuccucuuuugagaaggcuuuuggggccauuuguuuauuucauuaaacauuauuggcugcugccugcauacccggcacaguguuggguaccaggguuguggaguuacauacguaagacauggccugugcccuugaggcauuuggggucuagaaggcaacacagacacauguagcaacaguuacaacaacccaaggaaagugcagugagaaguucccacaggcguggaaaggaagucgccucacaccaggcuuuucuguuuucuguuuccgugcuuuaagugaauuuucuuaaugcccucuauuuccuucaaccauaaaguuuuaaauguuaaaaaaaaaaaaaagccuagcuuauuuccuuuccauaguuauccugagacuccuggauauuauuuuuuaggcauuugcauagcacuuucucuggugaaagcauuuuuuagucauuaauuaguaauccacauuaauaugcagauugaauuaaucuauuucaggcagaagucugucuugaggaagcaaaauagcuuaaguguuauuucuccccacgugcaucuucuccuucucccccugcgcuuuacccuggucauuauuaggauuauugcugugauuauuaaacgcugauugagcacuggaagugucugcggugcuucgaagaacuccagggaaggcaagucccugcucucuggacgcagagcugcacagaggcugccgugggggauucauuagcacugggaaagcgaaauuggccucauaaauagucauccucaggaaacaguuucagcuguccuauuuuuauuuuaguuguacuaagcugaauuccuucuuggcuguuauugucugaggauguuggcuuuuaccuucagaaaaaaguauauccuucauaauaugacuaccauuuauugugcuguuacugugcaccaaguguucggcaaacuuuguauuugauucgcaccagccucaugggggagguucuguuauuuuccuccuuguagaacugaggaagccgagucucagggaggggcgaucucagggcuggucagugucagagcugagcuuugaauucuuagccauauagcuccagagccuucccucuuagugcuucucuuuaccucaccauucagugccuucccagccucacugcccacuuuguuucuguaucuucacaucuuccuuccucuucuuguuggucucuggggaauacaagucuuucugagauaacucugcaggguaaguacugucuuuauuuauaguagggcuggcucaggaguccucugcugccacugaaggagguucucucgccucccuucugccuaccuguccuucugugcacaguucagggucaucacccugggcagggcacguauaaggcagggguccccaacccccaggccacggacuaccuuucaggaacuggcuggcacagcaggaggugagcgguggggcgagcaagugaagcugagcuccgccuccugucagaucagcuguggcauuagguucucauaggagccaaacccuauggugaacgugcaugcaagggauccagguugcacacuauuucugagaaucuaauaauaaauguaaugcacuccccucaccccccggaccccgguccccauccguggaaaaauugucuuccacaaaacgagucccugugccaaaaagauugggggacugcugguauaaggucucugccauuaaucgaacaucauuuauuggcuagugcugggguuacagaugugaaccgcccauuccuguccucaaccagcucacagucuacugagggaagaaaacaccuugaguuccaggugucccauuaauugggcacuucuguuucuggccuuguaguaauagauaucuguguuuuaauaagcaauucccacaugccagaccuucugcucauagauugauauccaugacucuuguugauuccucauccccuccuuagugagugaguguuuuguucuccccauguaacagguaaagaaacuagagcucuuagaagacugaauugcuuaagaagagacauuugggacuuggcagagcugcuuuucaaacucagaucugccugaauccagaagcucccuuuugaguuaccuugauugcuucccuuguaguguugcccauguguguaugagaauguguauucguguauacacaggcuuacacuuaccauacaucaggcacaggacuaggucauugcuauccuuaugggccugccaucugguggggugacagacagacacaaaaauaacccucaaauuugauuauagauacuacuugaccuugggcaaaucucuuaacuucucucaguccuaguguccucaccuauaaaaugacgauaauaaaaccuaugucccaggauuaugauaaagaguggaacagaggaaguacauaaagcacuuaguauauaguagacccaauacacaauagcacugacugcaaguguuagugaggucauaaucccagguuagaguacucaguauggggucagcuugacacaauuuuguggacuucucagucauuggucuuagagcuacaaugaguucuucagauacuuaaggacauggaucauuucugauaguuuucuguguccuggguuaagagggugaacuuuccuagcagacaagauggauguguacucaacaccuaauaaaugcuauuaauugauugaaaacaaccauuauauuuuguggcuggggaaguugggaaaaaucaugcaaguguagcugaaaguauuuuauugaguaaucuugagcguugauaagaguccaguuccuuggauaaggaaagagaaauucaaggccagguacacaaaaccaaugagaaggugcuauuucacugugguauggagcagaguuagaccugggguugaggcccucucagacgcuuccuggcugugugaccugggcaaaauauagcagagccucaaguguccucauuuguaauuugaaggaaaaaauaccugccuugcaaaauuguggagaucaaauaagguaauguucagaaugcauuuaguacagcuuuccagugaggaguagagcuuaaaugcucaguaaauggcuggagguguugcuuugagggggccucuugcucagauuuggagccccacgguguucugccugauagauggucuauuucagauuccugucauucucgcuuuugacugagguuuuucuggaaauguccauggaaagaaugugcuauugccaguuagacgaggccuucuggagaggcccuaccccagcccauuccuaaggaguauggguuugguguuuggcaguuccuuagaauucugggccccagcugaggggcagagcugugggauuagccaguucagagucacugaaauguggaaaggggcagagaggggugggguauagaggacaacagcaacauaaucucauuauagaaaguucacgaaaugcagauaagugcaaacaaaagaaauuucccaguaauugugaccauccagagauaaccauaguugcauugcauauaucuguucacauuuuuagcaugcaauuuauauauuuuuaaggagauaauagagagguuuguguuaacaagguuuuuuuuuuuacauguaucaaaacaucacauuguacuccauaaauacauauaauuauugugucaacuaaaaauuaaaaccaagcuuuuuuucacuuaauauauugugaauaggaauuauuuuguuaauagaguugugccucaucauuuaaaaauaccagauauuauuccucuuugggagaugaauucuaguuucuuuaaccauuccuauguuauuggacauuuagauuauuuccaguuuuucauuauuauacacaacgcacacugagcauucucuucaacacauauuggcuuguuuguccaguuauuuccucaguaaaaauccugagaauuggagucaucauaaggcuuuuugaauaacauuuuuuuccccuucgccacuacaagacuuagaaguggcauuaagagaaaggaugcuggaguuugggaacaggcuucuuauucuucaucaccaucaccaccaccacaguaacuuacagugcccaguccuucagaaucacaaaggauuuucaguccuugucucaugugacuggcucugugaagugggcagggcaagguaacuccauuuugcagauuagaaaauggaaucucagggaacuuuuaagggacuugcucaaaguugcauaauuagaaaauaguaauuaccagagucuugauucuacuccacucagucuaauucgaugagucuuuugauaauaaagcacuauuuuuuuagguugguccaggguucccugcaggacagccaucuuguuugaggaggguacagucucugccccacuuugaaccuccugaggccgcacuuuucuggugguagcccagaaagcugcauuuuaagguuucuagggugacuguuaugguuugagaauugcuggucugagccugggcccuuugcagcacuguugugucccucgggcacuuuucuucuuccugcuucuccuguauuaugcucuuugaauacucuuuggugcaucugcccaggcagcuuuuccaggguuaauaauaacugugauccuaugaggcauaaacccucccuggagagggucccaguggccaggcaaaagcuccuaaaucccugcuucccuccugucacucucuugagagcucaaugaccgugggcacuugugggauuaugcccaagcacucagagcccuccucugugugacaguauuguccuggcucagccuugcugaccuugucugccuaaagugucugagguuauucuagcuccuacccucaacccagacucccagauauaacccaugcauuuuaaaaagcccuuccuuuucauuggucuccuuggagcacaauagccaccacuccuuaaaagugcuucaagcuugucuaguuacuguuuucagcccuggucucuuacagcuuuguuauuuguucuauuuuggcaugucuuuugauucugcaaagcuuaaauuacuuuccuaagaguguaguaagucaguucuguuaaaagcacagaccaugaaacacaagcagaucuggguucacauuauagcucugccacuuacuagcugugugaccuugagcugguuacuucaugucucugugccuucucucccaucugcaaaaugagauagcaucagcccucacuuuauaaauauuuuuagagauggggucucaacuuaucuuaucucaaauaagauaaugaaugaaggugauuagcagugugccugguacacugucauugaugguaucacuguauccucccucgggaacagggacuacucuuuugcuuucuacucccacucacuucugagcauuugcaguucccauaacagacagaagagaaaugcaauauuuguugaacaaauuauuugacucuuccuguuuccaucugaguacuauuuaacauaggacugcuugccagguguaccuggguauacuuucccacauaagcaacuuucccuuuuggggagaauuuaaccaaaagugccaauauuacguagugguuaauaaugcauaguccagaauuagacuaccuggauuugacugcuguucugccauuugauagcugugugaccuugagcaaauuauuuaaccacucugugucucaguuuucucaucuauaaaagagaagcaauaauaguucuuucucauguggucaucaugaggauuaaaguaguuaauagaauuaauucuuuaaauagggucugucacagaguaaaccguugaugaaaguuguuauuauuauguucuuucaaagaucuuucagggaaggaguauugcugucuaaaggcauuucaagaaguugcuaggggagcuggucuuaacacucagaauucuuccucuaagccauuguuugacagauauuauaaauugguccccaucucuucagccacugguggcuuaauaaggauuuacauuccugagauguuagugcuuuaaagggugcuuagagagcuucuuggccagaguccucauuuuauagaugaggauaagaggcccagacagggaggaagcuugcccuggucacucagugggugaguagcagcaccaggaaccagaaccagagcccagggcuuggaccaugacagcaagcacuuaguuuucauugccauguuccgcaaccugcaagggaugagaaggcucauuuucucccuaaacgggagcuuugccacugcugggaauggagugaccgccuagcaagugauggauuacguaguuagauagcagucauguggccuguauuauuccuugcauagccacagccacauuuguauaauauuaagaauuauuucaggaggcuggguguaguggcucaugccuguaaucccagcacuuucagaggcucaggugggaggauugcuugaggcuggguauuuaagaccagccugggcaacauagugagauccugucucuaaaaaauuuuuuuuuaauuaaaaaaaaaagaauuauuucaaccugcuuugaaagugagaugagauuccaacauaugaaaggcuuuuuugggggaaugcuggaucaaguuucuacugugagcccagagggcaaagcugggacuggugagauugggggaguucagugcuuauccguguaauaaguuaguuaagaguguuuucucuaugcuggaggacugcccaggauggagugauaauccggcagacagcaaggguggcagaugugaaaacacgugagcccaguaaaggggaacaggugcugugagagaagcaaaggcagcagccagagagggcaaaaagcaggggcagccacuucagccuggaaccaggucucaaggagguaucacugcugggguauaucuucaaagaugaauguguguuuucuaggcaaauggagguugggacuuucccagcagagagaacacagcacaguaugaaaaguucaccauuuuugguggucucaaaacuccuuaaguguggaacauggaguugaggggagaccuagauguaagauagagauugggggugcugaucaccaggggccuguggguucuuccuuggagcugaaguccauggggugccacugcagggauucuggaagcucaugcagcaaaaugagcugcacagcuuugcaauuuagaaagcucacugggcugucagccuggaaagcaggcuggaauggacacuggaguccaggagagcuguugaagacuuguguggugaugcaaggggguggagaugacaacuagagccaccaugguggcagugaggaugggcaugcaaagacaaggaugagaggacagaagaguccaagagguggagucagcacgacuuggucaccagucggauacggggaggugagggacaggugauguugaggcuagcaaugacagcuguugugcauugagcacuuagcuaugugcccugcauggugcuaagcaccugacaugggugaucucauuuuauccucaccaguggguacuaccccuguaagcuugcucuacccaugucacagcugagaaaacuagcucagaaagguucaaacuuguccucaggucacagugaaugagucauauagcugggacuccgagcucuggcuuuuuuuuuuuaauuauauagucguccuuuaauaaauucuaccuuuugaacacuuuuaucacuuugugaucuucauauauuaauacauuaauauauguaagccacaaucagaggggagaaucuaagcauuuagucuaccagguaaugaugaaaagaggauguguaugauuaauucauuugaaauauuauggacgucaauaaacaauggaaaugguaagcaucugggauaaaagugggccuggccagggaugucuggugauaucuuaagcgcuuuuuuuuuuuuuuuuuacuuuaaguuuuaggguacaugugcacaacgugcagguuuguuacauauauauacaugugccauguuggugugcugcacccauuaacucgucauuuaacauuagguauaucuccuaaugcuaucccuccccacuccccccaccccacaacaggccccagagugugauguuccccuuccuguguccauguguucucauuguucaauucccaccuaugagugacaacaugcgguguuuuuuuuuuuguccuugcgauaguuugcugagaaugaugguuuccaguuucauccgugucccuacaaaggacaugaauucaucauuuuuuuuggcugcauaguauuccaugguguauaugugccacauuuucuuaauccagucuaucauuguuggacauuugaguugguuccaagucuuugcuauugugaauagugcugcaauaaacauacgugugcaugugucuuuauaacagcaugauuuauaguccuuuggguauauacccaguaaugggauggcugggucaaaugguauuuccaguucuagaucccugaggaaucgccacacugucuuccacaaugguugaacuaguuuacagucccaccaacagugcaaaaauguuccuauuucuccacauccucuccagcaccuguuguuuccugacuuuuuaaugauugccauucuaacuggugugagauguuaucugauugugguuuugauuuccauuucucugauggccagugaugaugagcauuuuuuaaugugccuuuuggcuguauaaaugucuucuuuugagaagugucuguucauauccuucgaccacuuuuugaugggguuguuuguuuuuuucuuguaaauuuaucugaguucauuguagauucuggauauuagcccuuugucagaugaguagauugcaaacauuuucucccauucuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuacgucuugaaugguauugccuagguuuucuucuaggguuuuuaugguuuuaggucuaacauuuaagucuuuaauccaucuugaauuaauuuuuguauaagguguaaggaagggauccaguuucagcuuucuccauauggcuagccaguuuucccagcaccauguauuaaauagggaaugcuuuccccauuucuuguuuuugucagguuugucaaagaucagauaguuguagauauguggcauuauuucugagggcacuguucuguuccauuggucuauaucucuguuuugguaccaguaucacgcuguuuugguuacuguagccuuguaguauaguuugaagucagguagcaugaugccuccagcuuuguucuuuuggcuuaggauugacuuggcaaugcgggcucuuuuuuggguccauaugaacuuuaaaguaguuuuuuccaauucugugaagaaagucauugguagcuugauggggauggcauugaaucuaucaauuaccuugggcaguauggccauuuucaugauaauugauucuuccuacccgugagcauggaauguucuucuauuuguuuguauccucuuuuauuucauugagcagucguuuguaguuguccuugaagagguccuucacauccuuguaaguuggauuccuagguauuuuauucucuuugaagcaauugugaaugggaguucacucaugauuuggcucucuguuugucuguuauugguguauauaagaaugcuugugauuuuugcacauugauuuuguauccugagacuuugcugaaguugcuuaucagcuuaaggagauuuugggcugagacgaugggguuuucuagauauacaauugugucaucugcaaaaagggacaauuugacuuccucuuuuccuaauugaauaccuuuauuucuuucuccugccugauugcccuggccagaauuuccagcacuauguugaauaggaguggugagagagggcaucccugucuuguggcaguuuucaaagggaaugcuuccaguuuuugcccauucaguaugauauuggcuguggguuugucauaaauagcucuuauuauuuugagauacgucccaucaauaccuaauuuauugagaguuuuuagcaugaagggcuguugaauuuugucaaaggccuuuucugcaucuauugagauaaucaugugguuuuugucguugauucuauuuauaugcuggauuacauuuauugauuuuccuauguugaaccagccuugcaucccagggaugaagccacuugaucaugguggauaagcuuuuugaugugcugcuggauucgguuugccaguauuuuauugaggauuuuugcauugauguucaucagggauauuggucuaaaauucucuuuuuuuguugcgucucugccaggcuuugguaucaggaugaugcuggccucauaaaaugaguuagggaggauucccucuuuuucuauugauuggaauaguuucagaaggaaugguaacagcuccuccuuguaccucugguagaauucagcugugaauccaucugguccuggacuuuuuuugguugguaagcuauuaauuauugccucaauuucagagccuguauuggucuauucagagauucaacuucuuccugguuuagucuugggaggguguauguguugaggaauuuauccauuucuuccagauuuucuacuuuauuugcauagagauguuuauaguauucucugaugguaguuuguauuucugugggaucaguggugauauccccuuuaucauuuuuuauugcgucuauuugauucuucucucuuuucuucuuuauuagucuugcuaguggucuaucaauuuuguugaucuuuucaaaaaaucagcuccuggauucauuaacugcugcgccucaccauuccuuggguuucuggcuuaggccacugagggaaugagggcauuuuucuuucaugcuggucauauagaggagucagagcgggagagguugacccagucuuauagucccauaugaggaauggcaguauuuuaggcuccaggcuccagauaaguugcuggaaugucuauggagauacuagaaauggcuaagaaugguuuugaaagagcucucaguagcuuugcagcuuugcuuuccuuuucuggugcaaugagaaagauugggagucaaauccagcuucuaguuuagucccuguguuaccagcuaucugauccuagguaagucacuuuaaguuccugggcuugccccuuuuccuuucacauaaugcaguuccuggucuagucuugacgugcauuuguucaaacacagauuucuggcccccaugcccaaaguugugauucaguaggccugauguggagccugagaauuugcauuucuaauaaguuucuaggagaugcuaaugcugccggacuggggaccgcacuguccuaggugcucuuucuguuccuuuugagcaagugagcuccauuccagugggcagagacaaagcaggcaaaugcacacaccaauauuaauaccagagggcauucaguccaaggcagacagcauaaaucaagcaaaauggguggcacuuugaaaugacaacagaguagaauucauccugcccuuccauucucuccuacucuuuuuuaauccuaugcccaccaccaguaagaccaaggccaacuccagccccccccaguaacuuguuucccuuuguggguuucaggauagauggguccauggaggaguccuauauaccaacuguggucagggccaagacaccugccccaaacaguugauggacugaagauacccaagagaggcacaaacuccccaugucacaggagucuaccaguuugagagacaaaacuucuacuaaaguagccuacagggcugcccuuuacccuaggcagcagaagccuauggucugaguauugccuuugggugaggagaagaaaagcuucucucucuugcuaccccacagaucacccauguuggccuccuuggccuucaggggcauauaagggaauuuuuuuuucuugaccacacucuaggcaugagcagcaucaggccucccugugacccugugccagaaaucugaugaagaaauuccagggagacaaauggagauuacauggaaaucaaucaugcacagcugguguuuucugcaggcaacuguucaauuuuauuuccuuuucauuuuucuccccguucccggggaucaacuccuuuaagagcuugacaccagcuagacuugugcgauuaagugguaaacuuaaacuggcugcugcagcccccuauguguuucuguggaacugggagauuguucagggcaacugauaagucaguccuuuggaccacugauggcauggaaacuauuuaaaggcauuuuggucuuucuuucuuggagucuuacuuccaauugucuaggugggcuuuuaaauuauuuuucgauaaagcccaugcaucauuuuggcugcuucagcugcaagugauggaagacccagcucauuuaaaugauauggagauucauuauuucauuuaucaagaacccuggcacaagggggacuaugggguuaauucauucaguggcucagcagcauaaucugaaauucauauuccugccacuucucuguacuuaaauguacauguacagcauguacuccccagguuaaaguuucucaucgccccaagauggcuggugcaguuccagacaucacacauagacacugaaaccuccaggauggaucacuggacaaaaucagaguucuguuaggaaggaggaggggguuagagugagaaauaaccaccagagucgcucaaucuaggugucaauccuuguugagaaacauuuacccauucucugcugcuuaaaagauuacaaacaucuuguccugacaucauuugacuuccacaguaugcccugacuucuuaguuuuuauuuucucccauauccucugcauauagccauugcacagccaaacaggaauaucugcuauugccagaauuugccacaugucugguuucuacuuucuugccuugcuuaggcugugcccuguaucuggaauauacucuguucaugaucccugucucaacacaaacauguccagggaccgggauaaaagcagagacuuucuauucucccucuugucccuaucuuuuuuagacaaucuuuuuauugcaaaauaaaauacaagauacagaaagcuaaacaaaacugugaacguaaugaauuguuauaaggugaaccccuuuggagccacuaccggcuaaaaaguggaacauugccauucccuccagaaaccccuucuugugccccuucugaucacagcccccucuuuccccuuaauaguaacguuacuuuuauaccagucacucuuuucauuuuaaaaauggacuuaucacccgaauguguacccauauuaguuuagccuuacccauuuuuaagugugauguuuuuaaagucucaaucuacagguuuccccuucauuuuuucuuuuccuugcaauuuaucuguugaacaacacagaccugucagauuuuccacagucuggauuuugcugauuuuacucucguaguucaaguuaacauauuccucaguuuucuuuacuuuuugcaaauuggcagcuggauccagagacuuggucagacuggcauugaccccucuggcaagaauuaggggaugccauguuucuacaccaggaggcacauuacaucuucugguauuuuaucauuucuuuuucauuuauucagugggaaucucuucaaauuggacccugaguccuugugacaugaccucaguagucuuugaugacugccuugcucucugcugcauuaagauauuccagauccaucuggcacauucccuacaccagaccuggaauucaucauuucucuaagaaacugcuugguuucuuuuagagggaaaugguauuuuaagaccacaaauugggcauuaggaaugcucuuugcuacugggcuuguuucuugccuugagauuggacagggggaggagauuauaaauauguuuauaguuguauuuuauuuacauuuaaagagaaaauacccugugaguucauaaauauauaaauuaaagacuguugaauuuuuucucuauuauauuucuguagcuccuuucuuuauagcaagagcccugguuuucaaggauacaggagguaguagaauuagauucuugucuuacccauguuauacacacaacaauaucagaauagcaauacuaaugcuaccgcugauaugauuauggaaaacacuaaacaguauuuuuugcauaugcucucccauuucccccauuguuucuauaguuguccuguaucuauguuauaccacugucucccucuuaacuuccacuuaguucuacaggugaguauauaggugaguauauaguuaauauucaccaucaguuuguauguugauguuucuccaaucaguuugcuugccugaagcucuaccucuaguagauuccuuacggagcacuagugggaacaauauuuucugaguacuuagauauugauaacaguuuugcccuuuauacuugaaaguugguuuugcuggauauaaaauuuguuguucacuuuuucuuuccuugcguaucuuguuguucuaguuucuucuggcauuaagauguuuacuaccauuacacuaucuggugauaaucuauuuuuuuuuccuuuauaagucccuugcucuuuuuuucuagauaucuaaaaggauguucccuccuuuucuccuucauuccuuccuuccucuuuuucaguacauuaaugccuuaguguugguuguccugagcugacauucuuaaguuauguccugggcucuuucaguuugugcuuucaaaucuucuuuucccuuaaauuucaggaaauuuuuauugaauuuuaguuuuucauauuuuuuccuuauuaccuuguuuugguuuucuuauucaggggcucaucuuaucuguauguuagaucuucauuaccugucuuugguauuucucuguagucacuuucucuugagucuuuaccucuuuuuuuccccauuucaucuugauuuaaaauuuuuaucugcuuucacuuauuuggggcauuaacuguuuuuuguuuguuugguugguugguuuuuuagugguuuuuuuuuuuuuuuuuuuaguuuagucuucauuugugaaaugguuuuuuuucuuuuauuucuaguucuuugcugaauuuguugccucguuucugagucuaauuuuaacuuacgucguauaccuuagagcauuuucuuaaugucuuuuaacuaauuuugaaaacauagguugcaguuugaucuguuuugugaccaugucuuucaggcaugcuuucauugucuauagaaaguccuuuguagggacauggaugaagcuggaaaccaucauucucagcaaauuaucgcgaggacaaaaaaccaaacaccgcauauucucacucauaggugggaauugaacaaugagaacacuuggacacaggaaggggaacaucacacaccggggacuguugugggguggggggagggggaagggauagcauuaggagauauaccuaaugcuaaaugaugaguuaaugggugcagcacaccaacauggcauauguaacaaaccugcacguugugcacauguacucuaaaacuuaaaguauaauaauaauuaaaaaaagaaaauauucugcuuuguauuuuuuuaaaaaauaacaauuuaguaugggauuugacaucaguacuuuuaaguuauccauauuuuggugaaauuaguugucuugaacuuucagaagaaggugggauucaggaaagcuuuucuaacuucauaaagccuccucuuuuuuuuuuuuuuuuuuuuuuuuuggugugguauuaaaaaacaugguggcuugcuuucuuagauuuccuggcuguguuucucucuccuacuuuuaucugaaauuccucuuuccuuugucuccauuguuccuguccugcucaguuuggacuuaccucuuugcagaucuaccucagugcaggucuugauccgcccuagaagaucagcuuuaagaguucauaggagugagguggccccguccccuucagaccugcucacuguggaccuucuacacucacccauuacugcauugggcagaaauccucccaguuuugacugcaguucuuaccuuagcccauagugcucucccagagaauguuggcuguuuuuuuguuaugcucucaggaccagcagccacuguuuccauugcuuccuauuuccucccacacaggugcugguaacauggaagccucaugguuaguagugguuugcucucacccacuuguauaggguucauagggaugccuuguuagcaaauuugguuguauauguuguuuuauggauuuuucuauguuugcuuuguguguguuucuguggggauucagagauacugaagaacuuuguugcuucuauggccaucuuauucuucaucccuuugauucuuccagugccucuuacauauauaguagaugcucauaaauauugagaucacacugaagaaucauuccuguuggcaaagaaauguuuacuaagagauguuuuguuuuuugcagcccuuuuggucccagaauucccacagagguguuucuuuucuuuauuucuuuucuuuuuuuuuuuuuucugucuccagguaacuuuuauuaguaaugaauuccugaaagagggauaacaucaaaucaggaauuuuuuacuggcaucaauaccucuuugaaaaaagucuguagccccaggaaggcaagcauacuuuuaugccgagugguaauucugaucaauugauaaugacuuucugaagcauuguauugagaagaugucuaaggccacauuacagcuugcuggguauauaaauuagcauacuuuuggcugcaaguaacagaaaacucuauucgaaaugaccaaaacaauaagugcauugaauauauuaagacaacaagaaguucaggggcagguaauuuagcagcucaauaaugucaucagggaccugguucuuccuaucuuucuuugcuaucauccucugcaugucugcuuuuuuccuucagagauguaagauuccuguaggagcuccucccagaagcagagaagggcaucguuguuguuguuuuuagagacaaggucucacuauguagcccagguuggucaacuccugggcucaagcagucuuccuaccucagacucucaaagugcugggauacaggcaugagucaccaugcccagccccuuuauuaccuucuaaucagugagaaaauccuuucccuaacuccugucucuaaccccgaacagacucccucaauuggcccuauccuugaacuaaucucuaauaauuaggaaaaugggaccaccaggauuggugcagacucaucaagguauaucccucaauuaugugagggaaaucugguacguaugugaaagucagggcccugcuggcauggcaaaaggaggaaauggcucuuggauaagcaauugcagugccggguauaaugagaaagagugucgugauugauaaacuacaucugccacaagcauaggacagagaugugauaucaugaggucauguauugguugcaccugauagaacuuuuuauagguuaaaaaaauguuuucacagacauuaucucuacuguuggucaacacuccuugaccuaagcagcucaaugguuauacuccuuauuuuauaguagggucacugagacccagaggggcauauugauuuguacaaggucacagagcaagaaaaugauaaagcaggguuuccucccuccaggucuaguaugucuuccacuuucccacacuuucccacgcugguggcuggcuggaaaccaaguuuuucucucaaggaguaggcaaagggcauuaaaaugagagcugggagguuacuaagggguaggccuugucaguaucacaaaaccuaaccuuacccugcaggaagccucccuucccuccccuccccuccccuccccucuccuccucuccccugccuucccuucuuccucucucucuucuucuaaauaacagucuuauugagauaugauucacauuucaguguuuuuuaguuuaucauagacuugugcauccauuaccagugaaguauaacucucuuaaguaaccauauaacugccucuagaguggggagguugacagaggagaagccugguuauggcucccugagcucccagaucuuccuucucaagguagacaaaaacagauccuuacagggcuuuggguaugccacuugaaugagugacacugccuauuuaagagacuggaagguggaugaguuggagaacaugcccaccauccccggggucaucucugccaacuuagcuccugccaacugcugucaugcaggaauacagggcuuggcuugccagggcuucugguuuuuugacagaaacuggacauuuggauuuuuuaagagaacuuucuggauuuuuaaacagaggcuguuguuuuuguuuuuuuuuuuuuaauauuguguguggucccuuauagauggaugaccuuagaccugcaguuugagacuuuuuuucauuauuugauuucucucauucaguuucaucuguuuucauucauuucacucauucauuuauuauuucauaucacuagggaguggaauuuuuuaggugugucacaggagccagcuuuuaaaaaccuaauacuggauaauuccccugaagauccauaagaugaauacaauuguguucuucaauauuaggaguaggcaauucuguaaaagagagagggcuugugaugaagauauagucaaauguuugguucacauauucuucaaacacugucacaguguuugggugagaugguuugauuuucccccuuguuccagagucaauggcugauguuuuugauguuaguccuucuauacaggcuucaacagaugucuccccaaauucagaugcucucccaacagugcaugcacaccccaucuccucccaucuuaucauguaccccagcaaagaaaagaaaggauucuuuugauugggcagugcugagcuguuucauccauuaacucuuugguuuucauaccaaaccugugaaguugucaccuuuauuuucaagguguagaaacaggcucggccaggcauuacagguggcucauuccuguaaucccaggacuuuaggaggccaaggugggaggauugcuugaagccaggaguuugagaccaguuggggcaccauagcaagaccccgucuccaaaaaaauaaaaaauaaaugaaaauaaacugagacucagguuaagcaauugcccaaagcuacuuaucuagccaguugcaaaguccaacugagacucagguuuagcaguuccccaaagcuacuuaucuagccaguugcagaguccauuuugaaauuggcuugcugacauugaaaccagugugccuuuuacuccuuuauaccuucaugucuuugugacuauacuuucaccugaccaaagcugccucacccuggaucuuaaaguugaguuuuagagauuagaaaaacccacuucaucucugccuuccuguguuuuccauuuuuaaacgacauuugucuuaggacucuuucaauugcaagugacagaaacuugucucaaaguggccuaaguggaaaagggaauuuauuggcuucuguaacugaaaagauggcacgugccuauaaucccagcuacuggggaggcugaggcaggagaaucaaucgcuugaaccagggagucagagguugcagugagccgagaucgcaccacugcacuccagcuuggcaacagagugagacuccguuuuaaaaaaaaaaaaaaagagaaaaggaaagggcaagcuuuauuuucccaugcaugacuaauauauguacaauauagauuuccuagggucuuaacauagcuuccugguaaagcaauguuacauuuaucugacaucauuagggagugagguuuuucuugaugaguagauuuugcagauauguuugugcuauuaagauuuaaaucuguuuuuaaaaaucuuucuugaaacacuucuuugcacuaccagaauacgcuguuacaauacauaaauuaacauuuucugagccuuuuugcaucaugcuucuagaaguuaagguauaugucagcagguacaaaaaucuacagaauaaauacggcauuucuuuucaggagaagaaggaagaaaggaguuaggaaggacuguaauuuuuauauaaaaauaaacaugaguauguuaugaaauagagugcaaaauucuuagggauuuuugagaugaagccugaauugauucaggcuacuaucaauaugccaccuuucccuccucucccauaccuuucucuauguccaugagccuuuagagaaaaguagacccagaauguacugagagccugugucuccaaacuacagugcuuuuuuucuuauucagugucuauugucuugagcaguucuccaucacugcuuauuccuuacauuaugcuagggaauaauugggcauugccggggaaaccagauagucaaacuuuuuuaaaugaauaacauuaaaauccacacacauauaccuaaaucaguagacuuggcaagacaagaguucuguccuuuuucuauaaaauaaguucaaggcugugugacuugucuagugaggacucacacugggaagagauuggugaagucuuugggauucugaucacagauaaauggaguauccacuggccuggucacugauucuagccugugacccuugucacuuacacggaugugggcuuucuaugcuucuugacacuagugcagaaugaucagccuguucaucacuguaaaugauucuuauuuccugcucuuuggacuuuuccuccaggcaggugcaggguauuauggccuggcuauucaugacuauuugaaacucauggcuuugaucaugagguugaauugcuuuugguccccacugaggccugccuuugccauauuuaaaggccaauccaaacaaaaguccaauuguguuucucaugaauggugauuaaaguguuuuuaguuacagaaacuuuuuuaaaaaaaaacucuuaauuugaaauaauuuuagauuuacaaaaaaaguugcaaaaauaauucuuuguacccuuuacccagcuuccccuaauguuaacauccuacauaagcauaguuuaauuaucuagacuaugaaauuauugaaacaauauuauuaacuuauauaccgauuuuauuugaauaucagcaguuuuucccauugaugccuuuuuuauuucuuuuucuuaaaacacauucaacccauuacauuuaguucugggaucucuuuaguuuccuucaaccugugacaucuccucagucuuuuguuuuucaugacguuggcacuuuggaaaacaguagccaauuauuuugcagaauaucccccaguuuggcuuugucugauguucucucaugauuaauuugacacauuuaggcaagaauaacacagaagugagauguuuaccuucuccuugcaucauaucagggcauaguccugacaucuuauuaugggugauauaacuuugaucacuuaguuaaggugaugucugccagcguaaaguuaccauuuuccucuuugcaauuaauagguaucuuuuuuggaggugcuuugagauuauaugaaaauccaguugcaggaacuauuucuucaaaugauauuuuaugugaaaguguagcaaagaaaacagguagaagugaguuauguugauugaaauggacaugagacagggcagcagcccagcagccucucccaccuccuccccuaaaacaaccacugagucacuucuguugagccccuaagucucuguggaaugcugguugaaaaucauggcucuagguguugguuuuggcuuuugguuguuacaauucuuacauauguuauaagccccugcacucaaaauguucuacaaaauuguuuucuuccaaauugaaauuagcaaaguuaguucuaaccaacaacaugaaguauaacugauaccaaucagcaaacauguauuuagcaccuuuuguauaccagucacugugcuaaaucuagggaauauaaaauucauaaaacacagucucuucccagcaauccuacaucuuuucuuucagaacagugaggacuuuauaaucuagacccaaggaagaaauaugaagggagaaaacaaacaaacaaacaaauuggcuuuuuggagggaaauacacuuguggauguuuuguuuguuuuuuguuugugugcaggggccacuuuggccuaaauggcugucaugucauagucaaaguacuauuucuccucugagaagcauauauucuuuagcagaaaauaaaagagagagacaguucuaaccaccuccccccaacccucccaaaaaaacccacccuuaggugccuuugauucucuuucccauauuugaaaggauccaaauccuuguccuucauggaugagguguuuuagcuguccauaauuacauuauuauuccagacacugucggaaugcuucuugcugaggagggaggauuaggccaagaaggcuggagcaagcgugcagccagucaucugccccgugccuggcaaaggagauuaugacucuggaacugagguuucuggcugagccuuuguuacuuaauuagucuccugucucuuuucccuuuaugacaguggcagaauccaggaugcaccccuuuuuaaaugaaugcaaauguuucuaacaaaguuuuauaaucauucauuuuaaacaaaucagaaaauauucaaaaccacucuaguugcagggaauucagagacaggaaauaacuuuuaaaagcauauguuucucaagggaguaaaguagcaaauaccaucccuuuaaauucuguuuaacaugaagccuuuguugacugcucgugaugguucugcauaauguaaugcucuuuuaagugaauacuauuuagcuucuucacgugagucaaugcagccucauggauguguacauuuagaugcugaucacaaccagaaguccauguauaaaaugguuacaauuuaauuaacugguaauagaucuaaugcagugucacguuaaagggaauguauaaauacugcuuuaugaaccagccucugcagaaaguguagacaccggccauucugucuccacuugcuugggaugaguuaugggauagcccuauuaacugcaaaggagugugaaauugggcuggggcggggguggggacacccauuguuaaacagcuguguccagccaaucaaccuugaagagucugacuucacaggucaauaaagauuucugacacuguuaauuucauuuuaggagacaccauugaaauucaucaaucaugccuugucuuugcuuuugauggagaaaggaagagagaaaguucugauggcucauaaguagguuuaagcuaaaagaaaaaaaaacagcauuaguucaaccuauucaccuuacagguggagaaacggagcuccagagcagggagggacccaggcuguccacacuguccagcaacaccacauacuacuggugaggucaaagaccucggggguguuacucaaacccuaagaucccuugagucuuaucuggacuuguugcuuuaggagaugagccccuuggacacuaaagugcauucauuccacaguucuguguuuagcaccaaacaagggaaaauguguuccauugcuuuucuuccaccagcuaagcaggcccuaggugagaguuuuauuccuacuaccggagguauauaucuccugcugccuugguagaauggaaggaaggaaccagaggucucauaccuucugugaaugacaccugaggcaaaucccuagccaagguuagggccccacacauggacucccuguauuucccuuaggaaaguggugcuuaccuguuauuguuacuuauugucuucccugcccaguugaaagcucacagcaaaaaugcaaaauccguaccuauuuagcuuacgauugugccaucagggucuagcauagcaccuggcacuugguggaugcuuuaugauuauugccccagaaugaaugaauuaaccucagaucugugagccuuccucugcaaaaugggaaugauaacaucuaucugcccuauuuggggaugaaggagauagcauguauggaagagucgugggauacuccauaaaagagaagagauaguucauguggguuacugguaguauuaccuuguaggcuuuagcuguauugcauuuagcucuuccuaaauuuuccuuugacaaggaauacauuugaguuauuuucgguaacauuaacugacaguauccugccuagaaugggagaccccuaacauuuaaagaaaucucaugugcauuccuuucucccgcauuguagauuagggaggggcccagacagguugauuuaccugccuggcaucaaugcagggaauuuggcuaagccagagcuaggucacgggaccccuccuucugucccucucagcucagugcuucaaaucuucauuucuguuggagaagcuguagaguauuuaauuagcuacagucugaaaugugauauaugucagcgcucauuacugcaguggggcugguagguauuauucuccagugcuacaccccauuguaguucagugaccccaauuaacuccaucacucaagacagcccagccaggcaggcaucaccaagggccacuugaagcagguacucagauucccuagaguccaucagaaacgcucuucuccaccucagucugaccugcuguccuuccccugagccucccuguugaugcugaacagaagcuuuaagagguugagaagcauuuaccagguaagagccacuaggucauugugcucagcacuaagcugggcuccauuuuaucucccuggaggcugcacccucaagacccucaaguugucagugcaaugggcaagagaagggugcuuuaggauccuaucagaaucaggaauaaaucccucuucugaacuagaccccauuuuuauucuuuuaauguuaacaucaggaaaggcaaaagaagacuggugaauugguccagauuaaagaaaaugaaagacacaugguaacuagauauaaugcagaaucccugauuggaucuugguuugagaaaaaaaaagcuauaaaagcaauuuagagacagacaauaacaaguguuggcaaggacguggagaaauuggaacccucagacauugcuggugguucuauaagugauguagccacuuuggaaaacagucuggcaauuccuuaaaagguuaaacacacagugaccauaugacccagcagucccacuccuagguauauacccaagagaaauggaaacagauggccacagaaaaacuuguacaugaguguuuauagcagcauuauuuauaguagacaaaaggugggaacaacugaaaugucuacuuaugaguggauuuauaaaauauguguauauauaccgacuguggaauauuauucagcuguaaaaaggaaugaaguacugauacacacuacaacauggaugaaccuugaaaacguuauacuacgugaaagaagccagacacaaagaccacguauugcaugauuccauuuauacggaauauccagaauaggcaaaucccuggagauggaaaguagauuuaugguuucuaagggcucaggggagggagaaggggagugacugauugucuuagucuauucagacugcuauaucaaaagaccacaaacuagauagcuuauaaacaacagaaauuuauuucucacauuccuggaagcugggaaguccaggagcaaggcaguggcagauucagugucugaugagggcccgcuuucuaguucguagacggugccuucuuauuugugcccuuacauaguagaaaggaugagcaaucucucuagggucuuauuucuaagggcacuaauccaagcccucaugacccaaucacucccaaaggcccuaccuccuaauaccauuaccuuuggauuugaauuucaacauaugaauuccagaggggacacaaacauucacaccauagcacucauaauggguacagaguuucuuuuuaggaugaugaaaauaaucugaaauuagauagcguugauguuuauacaacuuuauaagaauacuaaaaaacacugaauuguaugcuuuaaaaggguaaauuuuguguuaugugauuuauaugucacuuuuaaaaaggcugggugugauggcuuauaccuguaaucccaguacuuugagaggcugaggcgggcagaucacuugaggccaggaguuggagaccagccuggccaauguggcaaaacgccaucucuacuaaauauacaaaaauuagccagacgcaguggugcaugccuguaaucccagcuacuuggaagguggaggcaugagaaucccuugaaccugggaggcggagguugcagugagcugagaucaugccacugcacuccagccugggagacagagcaagacucugucuccaaaaaaaaaaaaaaaaagugauuugggggacaaugggaaaccugaauauggaguauguauuagauaauaauuuauaucaaugugauaauagaauugugguuauauaggagaauguuccuuugcucgacagaugcaugcugaaguacucagugaccaagcauuaugauaucugcaguuuacuuccaugugacucagaaaaaaaauguauauaauguauauauaggcagacagcaaaugcgguaaaauauuaacaaucgguaaaucuuggugaguaagaagaguaaaucuuuuuacucuuuuuaaaacuuuucuauugaaauuguucaaaauuguaggcuaacacauaguauuuuuacaagacaaugagguggaauuuuuagaauaccaagagacagagauaagucaaagggcuuuuggcuguccacagugacccuuuggucucuguccaagacaaggauaaaugaacacuuguuuccucuuuucuuggaugaaaucaauugcauuucuaagccguacagacccccacuuagcaguucucagagagugccugaaaucuacagcccaauacugugggcucuucaugccaacugucaaaagagugggcuuucuuaugacuuccagugggccagaaauuauagccaaugggaacaccagucagagcucccuuccugaccucauucuaggaucauuccaggggcaguaguuaggcugacuuucuuuaccagucucuaagggaaacacuaaaauagccagcgagcguaauuucuggagagacagauuucuugaugaguauucuaaaccuuacauguucuccccuucuugcaguauuuauaguuugggaauggauguagggagccuugugguaacauaucaagacuuuaguucccuguuccccuucccccagacaaucagcagggugucaugcagucuugaaggaaaauuugugcacaucccuuccagaacaaagggugaaacccuacuugagaacaguagaccuggaagggaccucaggaaauaagggaccucagaaugucuucaauuuccugaugcugacaaggccuuucacaagagaagcccacugauuucacaccucauggcuacccaggaaauacacucaggagcauuugcaaaagucuuuaaaccaacuacugcuuuuacaguguacagacugaguuuucaaugugcagauuugcuaugaauuuauagaguguuuugauucuaaauucacaaugugcaucuuuaauggcuccaaguuuggauaauuuuaugcuguuuauauccuagcagcaaugguuuaugcauauuucccaaguuauuacccuccuaggagaagagcgaacagccuccuuuuacaaaagacagucccauauguccugguuuagugcaucucucuucaaagaucacuuugcauugagaugucaggaaagcgugacagcuggaugaagcaccuaccccaguuugcaagcagguggguuuucgguuuucuggacccucuuacccagcucccagauggccaugcauuugaaaaucgccaauuaggcacuuugcagucaccuggaguuuuucuauugagacauguuucaaucucauuaaaaaaaaaaauguugcccaccuuccuccacucucaucagaaaagaaauuuauuaacaugcaaugagaacuuuaaaaaacucauccagaagcuuucuuucugagaguccagccugaggugauaaucagaaaugugggauguauagaauguuuauugaaacuuaaagaaauuuuucuauuguggcaaaauauauguaacaugaaaacaauuuaauaguaggaaacuggaagcaaguaaauaucgagcauuagggaauaugauauuccauguauucaaauauaauacauucuuugaaaauacuuucaaagaacuuuuaauagcaggaaauuucucuugacauaucaugagugaagaaagcaggcuccagaccuccaauuaggucuuuagauuucagauuucaggcacaugcauugaaacaagauaaauaaaggaacuacaaaauucuuaacagugaugauuauuggaugguaggauuauggaggauuucuuuaauuaaauuuuuuauuuugaguuaauuauggauuucacaugcacuuguaagaaaaauuacagggagauccuaugaacccuuuaccuaguuuccuauagaggauuuaaauuuucuccuuugugcuuuucucuuuucccaacaaucuacagucagggaaaauaaaauuaaagacuaucauuaaaaaaaaaaaaaacagcuucccaggugugaugacucaagucuuuaauucuggcacuuugggaggcugaggugagaggaucccuugagaccaggaguucaagauaagccuggacaagguagccagacccugucucuauaaaaauaaaaauaaaaaaauauuagcggggugugguggugccuaccuguaguccuagccacacaagagacugagguggaaggauugccugagcccaggaguuagaagcugcgaugagcuugauugugccauugcacuccagccugggcgacagagcaagacccucuaaaacaaacagaacuuauucauccuucuggagaacuuugcuccaaauuuuaauugaucucuccuuuuccuguguacccauagcucauuaccuaggcuuucaguccccuguagaucuuagcaccuucugcuaauauuggaguuaauuggaucccaugccuuuguauggucuuucauacagugaguucaugcuggauaaucacaacauuccuuccaaaagcaugaagaugacccaaacuauuuagagaagacaggaagagaaacacguuuuuauauuaaaauaaaguuaaaauaaaacauccaaaucauggcgugguaaguacgauuugcaauaugggaugaauauuuaaggugaagcaaaguagcuguggcuacuuggggccaaaagcuucccagaugcuccugcucuaagcacaugauguuuuuuggggaaagugguagcagguagaggguggcagaaagugugagaagcacuuguuguaggugacccagacaugccucuugaauugaauucggugaucugcuucuucagcugcuuucuugucccugcccagcaggaugccaggaaacacauagcccuguagaaaaucacuggagaagaggaugauuggaguucuucauuucuuaaaaaacaguuuagguuuucccugucugcccuagggcccaugucuugcuggaaaauaugcuacuuagaaauuaaggccucuggguucaauuuuuggccccaguguugaccucuguguaagccuggcaggaugucucauuucugggucaccuuuuccuugccaacauagugagguauguagaccaaaucauugcuaagagccuucuaacucuaagacacuagguuuagucagccaaaagcaugugauuuucccagauuucccaaacuccuuguaccuaauugaaaguacacaaugaacuugcaagaauuuaagcauccuuagaugccagucuucacuuuggguauuuuccugccuccucagugaaacuugacaccucuaguuugucauuaaaaaaagaaaaagucucaagaaaaagaagguuguagaaacugauuaacaggauauccccuuuuuccuuuccccugaagauuaucuugggaaugucaaaagcaaauuuuauaggcagcuuggucuuuuacaagagauauguuuacaaagcaugaaauuaacauuuuugcacagagccaaauaauugcuuauaacauagugacuuuagaagcagguuugcagcuugagcaguuauuagcaaggucagaugguacauacaauuaacagacuccaucaccaaagcaaaguuagccaagcaccuuguaagggagcaagucccuacccgugaagaguucacccaugacgucauuucaaauauugggcacagcacaguccauugacacugaaguucacugaauaccacaguguuagagggucaacccacucauggagcuucagacuccuacgaguccaccauaaaagguuacacucccuggguuggcuaaagagacucagccaaacagcauccaagcaacuucuuaccacagagguagcuguacuuucaggcucucacccagacuaaauaucacauuagaguuaaggagccccaaaugacaacauucaaggggaagagacaguagagcagacaggucuggauaaacagugugcacaucugaguaacaauuuaggauauccuuaaguuuauaaagauggcaaaagaauauuaaaucgcauucagaaaaaucuauucaaggaaguguguugguguguaacuuuggacuugcauucuuauugguaguguuaggugguauaacagaucaaaccugaauuaucaguguuguaacaccugagauuuauuucucauuuaauaaaguuuaaauuauacucugguauaggucuuaagagcaccucauaagagaaaaggaagaggaaauggauuucucaagaaguuuccagggaacuuauuaauauuaaaauucacuuuggagccaggugcaguggcucacgccuguaaucccaacacuuugggaggccaaggcgaaaggauugcuugagaccaagaguucaagaccagccugggccacauagugagaccccccaucccuacuuaaaaaauagaguuuauuuuggaaaauauaaagaaucugagaugcccucaucucauuguggcucaaaugcaccaucucagcucacugcaaucuccacuucccggguucaggugauuccccugccucagccuccugaguagcugggacuacaggcgcuugccaccacacccggcuaauuuuuuguauuuuaguagagacgggguuucaccauguuggccaugauggucuccaucuccugaccucgugauccgccugccucagccucccaaagugcacaggugcugcuaaaaaguauuaagcuuaauaaaugcuagcuauuauuguuccuuuccaagaauuuucuacuacaucccaacauuauugacucuucuauuggauuuugugaauacuuaauuuuuaaaaauacacacaaaaaaguccuauugauccauuugguauucugaaagcagaaucuauaauauacuagaaccacuuggucuauuaugaugugcuuccuccuucaugugguaucagaaggacacuaaaagcagccuggcucaauauaucuauaaaugcuguguccuuugagcccugacauauuucagaaaugugagacugucagaaccagagccgggcccagcuggacguggcuggggccaguggacuuggcaggccuacugaacuagguuggcuuccacaacccaagcaagguugccuccaggccucuaacagugagugguuauaggcuggugggcagagaacagugucaguggagggagccugguaugguugaggcagacaggacauuagagagucugggacauccuucggaagggaauuaggggcuggacuggcagaggguaggagggacugggcucuugagucagaagaccaaggggaagcccacagugacaccaaggugagaggugggaccuugucugaaggaagaaggaaagagucugggcacugaagcuagcagaacaaguccagguagucugacccaagcagggauacugagccccacaaccucggguccagaggucuuacucuuucucuuaucaaaggccagacuaaccuucaaagccaaguggcuuggcugagguuccuaauggagaugaagggggucucaacuuuuagaacauauuugacucauucaugugugacuauacuugauaaaugcaugucagcuaucuggcuucaaacuggagcuucuacaaacucuacugcccaacaaaagcuuacaucucacaucuuucagccuauacccacacaucuauuuccugcggugugcccugaaguuggaacaguagaguaggcauuccucaugcauacuagaucuagcucuauuauuuuacuuaguucuauguagucuaauugugugacuggauacccaguuauaugguuaaucaaaguuagcaucauucugcuuaagaacaagggcagggccaggcuggagauggccuggacccacgugcuugacaggccuuuuacagaacaauaagaggcaaauggagugauuucugcaucccugguugaacaacaugagaccacuggugucacgggugacccaguucagaggacgaugaugagcacuuccaugugcaugguccuucacguuacaaaacgcuuuccuaugcauguugcccuuugauccuccagucagcuggaugaaguauccuccuucuucuccagaugaagagacugaggccuggucauuacacaccauguucagggucacuugugaaauuggaacuccuggcugggcacaguggcucaugucuguaaucccaaaacuuugggaggcugaauggacagaucaucugaggucaggcauucaagaggagccuggccaacauggcgaaaacccaucucuacuaaaaauauaaaaauuagcugggagugguggcgcacaccuguagucccagcuacucgggaggcugaggcaggagaaucgcuugagccuguaagguagagguugucgugagccgagagcacaucacugcacuccagccagggugacagcaagauuccaucucaaaaaaaaaaaaaaaaaaaaagggauaccaaguggccagucuaaauucauuugcuuguguggcccacuggaugccuuaaaaaaggauaaaguggacaaguaguauguccaaagaaacaauagccuggacagauauuugaguccuguaaaugaggcuggggcuguauguagaucugguggugcuugcuguaaggguuuaauaauagagccaaagcccuguaaucccagcacuuugggaggcugaggugggcaaaucaccugaggucaggaguucgagaccagccugaccaauaugauaaaaccccgucucugcuaagaauacaaaaauuagccagcgugguggcgggugccuguaaucccagacacuugggaggcugagacaggagaaucgcuugaaccccagagggagagguugcagugagccgagauugcaucauugcacuccagccugggcaacaaggacgaaacuccgucucaaaaaauaaauacauaaaauaaaaauaauagagccaaagccucuuuuagaugauuuugcugcauucaagcuuucuaaguccaagggguugugugugggugugucugucugucuguccuucucauuauguguucauuucuaucuggugaggaagcagaagucauuaugucuauaaaucuugcaucuuuugagccuugacauauuuuagacaaugucccaguggaugccacauguccagucaucugugacuccuucaggaaacuaaaaugcacaccuagagaggaaagagucaaaagccagaaaugcagguagaguccacgcugagguucaggucauccaauagaguguuucuuagaaaauaagccuucugcaguaugcagaggaaaggcuuuccucccuaccuccagcugcugcucugccuccuuccugcauaauuuuuuaaagcaugcaaaaugaaaugaggcccuucacguaugagacagcuauuuucucaggucucaugccuuccuuaugaauagcucaaauaauacaacuuauaauuaugcuuugccuggcagcauauuuuugccuucugagugauaguugauauuuccuggcaaguaaauacccuugggaaugagccucuucugucccaccuggugcaggcggccccucuguuaguguuccuacccgcccuggccuccagggcugccucccugcaauucuuaggucuuuucgccaagaagcgcuccccaacuuccucacuuaucccaggggcacagggaggucugagcaccccuccugagggagccaugccaaucugauuaauuaagguaaauaggggagugaucgguaguggcuuaaacuccagucagguaaccuagguaauggcagggagucugugccacugcugacaaguaaugugggauuaauuucuucccagaucuauggccuucuuuuaggcucaggguccucuucaggagccucaaaaaggaacuaggcuauggauaacagggaggggaauugguaacagucagccaggguuaccuguggguguuuugucccuccaggaacaccacgugggcaguguaauggaguauagugggcagacaucagaggccugggggucagcgccacucaccugcaucaggaacuugagcaaaucccuccugaaccuugcguuagccagcuccauguuccuaucccagcuaccacuuccaugucaguuuccucaucuauaaaauaggaacgauaauaauagugccacccucuaggcuuguggugaagauaaggacuugaaauugccuagcgcagagccuggaacauagagaguccaauaaguguuagcauuucaggucuucucuaugggagaaagaggcucggagugcucugucuuauauguacucuuuuuuuacagacagggucucacucugucacccaggcuggagugcaggggccagaucauagcuuacugcaaccuugaauuguguacucuagacgguaggaaaugggcucagccuggagguggaucugcaguuucuggugguuaggaaagggggcugcagauggggaaugcugagggcgaggggucagcugaggccaagagggcaggcaggaagacugggacuagggagagaguggccucagagccaggagaggaguggagagguuaacacugcacucagagaagaaccuaagcuguuggaggaggaucuucugaggucacagauauagagguguggccccuugcaggaauuugguucaagccugacuuccugucuaguggcccaguuacuugcugagcaugcaguuuuauagcugcugcuccuggcuugaacacuggccggcacugagaaccugauucuggugguuucuccaccauaugaaacaaagaucguggagaaauaaagucacaugaaaaagacguguaagcuuccuguucagggagugaggccagcagaugcauaauguaugguuucucaugcugcaaguggacuggggagagaguuugcaaucuguggaaacauuucagacuuuugcaaguuauaaaaggagagaggguugccaggagcauaauguccaguaaauagcccugagccuggccaaauaaccucagacaagccaaucccuggggcucaguuuguuuauuaaaaaaucuggaggggauacacaagcaguuguuaauagugguuaucucuagggggugagaguaaggguugggaguagggagaaauuuuuauuuuucauuguacccuuuuggcugcaucuuucaccaugugccuuuauuacuuuuauaauugcaaaucaaauuauaggguuuuuggcauuuuaaaaaugccgugaaggaguuggauuagaucauugguuuucaaacuuguuuuuuaaagcaguggaacacuuuucacauaaucuuauuugaaagccuaauuaauguaucacaaagaagaaauuggggccccucuugccgggcucccccuccgccucccaguugcugcaucuccagagauccauugaauguaguuugaaaauaauagguuuauaugauuucucuggagccucuuucaccucuucaauucuaugcuucccuucuauuuagcaaagaaagcuagggcauucuagcccuguagccuaagcugcugcuuguacugcaguagcugcagacacacucuggcccuuuggagagucaacaguuggggaggaugagcuguguacaggcugaaugucauucagauucuggaggacaggaaacaggucaaccuugaguuacuucuggguugaaaugauagacaauguuagaagguggauuuugcaacaauuccagguaaaacugaaccuggggcuuugauagguaggaugcuaaagagacauugaaaugguguaaggugauagaaaaccauuccccuuguaaaaacaugcuuaugaacacagaccugcugcuuacuuaugcuacuaucuugccaaguuacuuagcuucuuggagucuguaaaaaggagaacuacuagugccugcuuccugcaacuguugaaaagauuaaaugaaacuauaggucuaagugccugguauauugccuugcccaugauaggagcucaauaaaugugggucaccaucaucgucaccaaauuccuggacaagucagaaaauggccuugccaccucuuccuacguguucuuggugaaaccuguaaccucucaggaccucauuuuuccuuaucuguaaauuacagguacucaaccagcucaggaauugcaaauugguggccugcuagauaaaaucuagccugcaaacauguuuguuuaucuaauguaauaaacuaaaaaucaagaaauagccccuagaaaucugaauuuuccagcugcucuuugaaaaaugaacaucuaguuccauuggcccucacuuggcaacaguuggcuggagcugggguagcagcugccccucacaugggcaugcaugcacucgccucucccccagccaucauauuucugcagugccuuacaccuggccacucccccuucacaacauacauaagcagcugaguuuccaacgucuggauuggaagguuucaggaauucuguggcuuucuccugguucugacacuggcucauuccaugacccugaguguacuccuucaccucucuggacuaccacaucaccgucuauaaaacgaaugaguugagcuuccagacucagcuuucuuugggucuucuauucaguucauaaacauuuacugaguugcuccuauuuccaggaauucuaaaaagcacgugggaggauacagagaugaauaaaaaugggucuggcccagagauguuuuauagcaaugccucucaaaauguagucugcagaccagcaccaguucacaaugagauagauaggggaauugaggauaguuguucagaaacuuuuguuguaguuugauauugccaugacagccaggugcaugcucaguagacuuaucuuguugaauagacauagagcaguucacaugcugucaggcucguguggugaauugcaugugacacaagcugcacacuuguuucaguuacuauuggugcuuaacaaauugcccccaaacuuaguggcuuuaaaagaacaacagucauucauuucuucaaaucuacaauuugagcaggacuuugcagaacacuuuaucucugcugcacacagcgccugccaggugggucagcaggggccacagcauccacuuccaagauggcucauucgcaugacuggugagguggugcuggcugucaguuccuuuccaugucgaccucuccauagaggagcuucuucauagcaugguggcugggauccaagaaugaaugucccaagagaacaaggaaaaugugccuggcacuuuuaugaucuagucauguagaaaucagaagucacuuugcaucucugcugccaaacucuauugauugaagcauucacaaagguuugcccaaguucaaaggcagaggauggaaauuccaucucucagugagcuuguggaaagguuguagaagagcacaagggacagaagauuucauugcagcuagccuuugaaaauacaaucugccauacuauugagaaguauaucauguuccuguugcuguguaacaagucgcuacauauuuaguggcuuaaaacaauaagaauuuauuaguucagaguuuuacaggucaugagucuaacuaagcugacuaaacaggaguuucugcuuagggucugacaaggccaaaaucaauguuucagccaggcugggcucuuaucuggaggcucuggagaagaguccacuuccagacucauucaggguguuggcagaauucaguuuuuugcaguucaggauugaggccccugguuuuugugcaggccagggguugcugucuguuccuagaggcuacccauacauggcccccuugaucuacaaaaccagcaaugccauauuuaauucuucucucucuucaaaucacuuugacuuccuucaguaccgccagauggagaaagcucucagcuuuuugugugugauuagguuaagucgaccuggauaaucuccuuuuugccauauaacuugauguaaucacaggagugauaucucaucauauucacagguuccaucuccacucaaaggggaggggauuauaggaggaugaaggucauuggaagucauucuuagaauucugccuaccacagaugguuucauucacagugaauuagaaauugaagugguucuucauuacagauaguuuaaaaacacuaguuuagaguccaguaagagggaauaacauguauauaaauggcuauaguuuaagacuuuaagugguaacuuccaaaaagagagaggcagacagagugcagugagaggucaguggaagggagauuauuuuguaagcggagcggggauagaaguggggccucuugaagaugugguguuugaacugaaccucagaagauagguguuguuuggaucuuaaaaaaugaggugggaggacaagauacaaacaguucuguuucuauuuuggcaccuuagcuugcaaacacagaacggaacugaauccucucuaaggucauuugauuccuccuuaccauaaacaaugcuguauaacaaauuacuccaaagcucagugaccucaaacaacaaccauauguuguugcucaaaggacuacacaucagucgggugguuucucuggccuuggcugugcugacucauguaucucuggucaacuggggcugggcugggcagcucugcuaaacuuggcuggggucucucauauccuuggggcuuggcucucugucagcugucuaggauuaccucaguucuucuccacaugucuuaucuucugcuugccucuaacaucuuucuagcauacuaggcuggguuuguucucauagaggaggaagaaggaugagaaauaaguaugaaagaguacaagucucucgaagcuuggacucaagcuggcacacugucacuucuaccucauucuuuuggccaaggcaagucacagagccagaccaacuucaauagguguggaaagagacccacuuuugaugggaggagcugcacaaucccuuugcaaagggccugggauggaggauugagaccacuuucacaaucuacuauaguaauccugagaaaucuuccuaaacucuagaaugaaagaaauucaaaugcauuguuucucaagcuaagccaaggcuuuuggagaaaucugcauguaauaaaccauuuggaaaagguacagugacccauaaaccagaguuaucagaagccaggcuuauaaaauagucuacagucuucuuugugagugaaagacaaaagaggaguauuucagggcaacuuuauuaccuuuacucaugugguacucauuaucaacacccagccccggugcuccucugcaaaacuguucccagaaccauucuucuggcuucugagaauuugugguucuucucccaggucccaguagcaguuuuugaaaugaaaggaucuccaaucuguccuguaucauagacauaaaucauugucuuuuaugauauucccuggaguaccuaaccuaaggccaaaaaaauaguaauugcacaauaaacauguuuuaggugaauggauagauggaugaauggaugaaugaguggaccagaugggugacggaugcuucagaaauugacugaaaccuuccuuuggaaaauguuaacauaaacuuuauuucccuccuuccaaguuaguaugucaguuugaaaucuugguguaguuguuucaugucugugagcuuuuuuaaaacaaaacaaaacuggauugcacacugccaaggggaagaaucauguuguauucucccucaucaacccaaucuuauaagcaucaaaaaagucugugagcuuccuaggguauuaaucauugucuaguggguggggguagaugagugguuguuggaguuggggacuucuagucaaauaaacuugugaaaugcuggauuaaacaaaguuagacagcuuucuuuucugugugacuucaaagagccuuuaauaugcuaauauacuuuaugaaucaccagaaggguauuagaauauguaagaguugaaaaugagaagaauuggcuuuuuuagaggggaggagaagggagguauuuuuuuauugugcuaaaugaauauaauaguugucauuuuaaccauucauaaguguacaauuguguggcauuaaauauguucacaaugcuauguaaccauuaccacuaucuauacccaauuuuuuaaugauucccaacaauaacucccuguaaacaacaauccccguucuuacuccccuguaaccucuguucuacuuucugucuuuaugaguuugccuauucuagguaccucauauaaguggaaucauacaauguaugaccugcugugucaggcuuguuucacuaagcauaauauggucaaggucuauccauguuguaguagauaucaaaauuccauucuucuuuaugacuuaauaauauuccauuuuauauauaugucacaucuuguuucuaccuucaucuauuaauggacacuugaguuguugcuaccuuuugccuauugugguaaugugacuauuaugaacauuggccuaggaaugucuguuugagucccugcuuucaguucuuuuagauacauaccuaaaauggaauuguuggaucauaugguaguucuacauuuaaccuuuuggaaaccacaaaaguuuuuaacagcagcugcaccauuuugcauguuuacuagcagugcacaaagguuucaauuucuccacccacauccucacuaacacuuguuguuuuccacuuuuuaaauuauagcuagccuagcagguguaaaaugauauuuaaugcuaguuuuuguuguuguuguuguuguuguuguuuuguuuuuuuuuuuuuuuugagauggagcuuugcucuuguugcccaggcuggaguacaauggcacgaucucggcucaccacaaccuccgccucccagguucaaguaauucuccugccucagccucccaaguagcugggaguacaggcaugcaccaccacacccagcuaauuuuguauuuuuaguagagacgggguuucaccauguuggccaggcuggucucgaacuccugaccucaggugauccaccugccucggccucccaaagugcuaguauuacaggcaugagccuccgcaccuggcuuaaugguaguuuugauuugccuuucccuguagugacauuguguacuugacucacugcagccucaaacuccuaggcucaagcaauccucccaucucauccucccaaguagcugggacuauaggaaugugccaccacaccugacaaauuuuuuuuuuauuuuguuuuuauagagauggggucucacuguguugcccaggcugguaugaguucuuuaugcauucugaauauguccuuaaucaaauacguguuuuaugcaguauggaaguuccucagaaagcuaaaaauagaacugccauauaauccagcaaucccacuucuggguauauauccaaagaaaaggaaaucagccugucaaagagacaucuguacucucauguuuauugcagcaagauaaggaauccaccuaaguauccaucagcagauaaauggauaaagaaaaugugguauauauacaaaauagaauauuuuucagccauaaaaaagaaugaaauuauguuauuugcagcaacauggaugaaacuggagguaguuauguuaagggaaauaaaccaggcacagaaagacaaauaucgcauauucucacucauacgugagagcuaagauaguugaccucauagaaguagagaguagaauagugguuacuagagacugggaagggaauggguagaggagauaggaagagguagguuaauggauacaaaauuacagcuuagauaggacuaaguucuaguguucuauagcacuguaggaugacuguaguaaacaauaauuuauuguauuuuuucaaauagcuagaagagaggauuuugaauguuccuaacacaaagaagugaucaagguuugaggugauggauaugcuaauuacccuaauuugaucauuauacauuauaugcagguaucaaaauaucauuuuguacccuauaaguauguacaauuauuauguguccauuaaaaauauuauuuuaaaagauacauguuuugcaaauauauucucccaguucauggcuugucccuuaaacaaccgaaguuuucaauugugaugaauuccaacuuauucauauuuuauugcaguuuguguccucuuuaagaaaccuuugccuaaaccaaagucacuaagauuuucucacauacuuucuucuacaaauuuuauaguuuuggcucuuacacuuaggucuaugaucuauuucaaguuuauaucauguagggugugaggaagugugagguguauuuuuuugacauaugaauaucuaauuguuuggacacuauuuguugaaaaguuauccuuuaccuauugaauuuucuuagugccuuuguucaaaaacaacugaaugcauauaguuaugagcuguccacuccauugaucacauaucuguccuuaccuuagggccacucucuguuggucacuguaucccaggagugccuugaaauuaggacauguaaguccuccaacuuugccccucuuuugaaaaagaauuauuuuggcauuuuuccaggucuguugaauaucaguuucuauaaagaguaacuugaguugauagaucaauuuugagaggacucacauuuuaacaauauugagucuucugaccaauaaacaugacauaucucuccauuuauuuagaucuuugauuucuguagcaguguuuuguaguuuucaguguauaggucuuacacauuuuguuaaauguaucucgacuauuugauauuuuugacaccauggaaaucaguauuuuaacaucaguuuucgauguuucauugauaguauuuagaaauaaaauugauuuuuguauauugaccuuauaucuuuugacguugcuaaacucaucagcucuacuagcuuuuuuguagauuccuuagcauuuguuuuauagauaaucaugucaugggcagauauuauuuugauccccauucuaccaucaaauaauggagaccuggaaagacaaggggaccugccuaagguccugcucuucauaaaugcacagccaggaaacugaagccugugucuuuuggguccuccuucaaggaccucuccacacccuaaccuaagcuaagcuguuccucagucuuucaagccugaagagaagaaucuuauauugguuacgauuauauuugaaugguucaaacaagauaguguauuuuucucucacuucaaagucugaagguuugaaguccaggacuaguaucauaguucugcccccugaaguccucaagaaccuguacucccuucugauggcuucagccaucccuagggcauggaggcaccucgugguccaucaugguggccuuugcauucuaggcagcaagauagaggaagggauaaacaagaaaggcaaaagugcacauuaguaguuuuuucugguaaguuccaugaggcuggcucguaaccuguuuugugcuauaauaacagaugccagaaacuagauaauguauaaagaaaagaagcguauuuggucacaguuccugaggcugggaaguccgagaucaaggguagcaucaggugagggcuuucuugcugcgauauaaggugguagaaagcaucacaugggugagagagaugguugggaccaaauucauccuuuauaaggaugcugcucucacaguaauuaacccacucucuccauaacagcauuaauccauucgucagggcagagcucucaugagcuaaucacaucuuaaagguuccaccucccaauacuguugcacuggggauucaguuuccaacacacaaacuuuggggaucaugcucaaaccauagcaggcuaccaugcagcuccuccacucgccucucauugacagaacccaaucaagccacaucuagcuacaaggaugucaggaaaauaucaucuuuauucugagcaaucauauucccagcuaaaauucuuauuacuguggaagaaaagaacagcuccuaggggauauacagcaauuucugccacaagccuuaguuaggaauccagaaaggaaaccauuugaaaaugaaagaaggaagaagguggaagaguucaaagccuguugcaucuuuuuaaaaauuauuuuaggaucaggugagccagcucucuuuugagcuuuguagcccauuaaguugaccugaagccauuuagucauaggauaaagucaauccucagaacccuuuuaugguauuaaaucuuuggacuauauuagacaugucuaauccuugagugaccuuuccuucaucuggaaaagauaaaagaugucuccacucauucauucauuauucauucauucaacagaaauugaugucuucucauagagcucacaauuuggggagagauagacaauauucaaaugaucauccaaaugaaugugaagucacaaaggagcagugaggaugcuguaaggucccauaucaggggcagugaucuagccagagggguuagggaagcuugccugaggguuuagaugauuccugugggagcaucugcauucauagcaguuugcuguggucugggaagacuguccuuugugcucucuugugguugcaccucacacauccugccugggacaccauauaucuaagaaaucguuauauaagaacaagagaggcugggcaugauggcucacgccuguaaucucagcacuuugggagucccaggugggacgaucaccuaaggccaggagguugagaccaaccugggcaacauaauaagaccucgucuguaaaaaaaaaaaaaaaaaaaaaagccaggugugguggugcauguaccuguagucuuaguuucuugggaggcugaggcaggaggauugcuugagcccaggaggucaaggcuggagcugcagugagcuaucaucaugcuacugcaagccagccugggcagcagagcaagauccuaucucuuaaaaaaaauaaauaaauaaaaacaagaauaccagagugacagagugagagugaggugggauagguaaggggcugggugcugcccaggagauucagagccuuuuguggccuccacccuaagagaaacaaagaagaagaguucagagaguucucaguuuccaagaugggagauggaggaggccaacaucauuguccaggcagagacuuuccuccugggccaggaaggaguccaaagaggaggggacuaccaucagucacauguugcuuccccaugccccuaccccucucccccucuugggggaccuuugcaagcagugagcagccagccagcccaaagagccaagauuguggaaaucaaccagugggucauugucuaccagguguacuuggaaauucacucuuccagcuuaaggcagcuguggcagauggguccuguccccugaccaaugccagcugauggguaagcgcugcuuggagcacaguguugagaaagauucucaaagucugggauccacaaggaaggauauuacaauagguuggugaugucugcuuuuacccuggugcaacugagaggaaggaaugggacauaaauauaaaaaugcuuuguaaauuauaaaauacuaccaaauaguaacuaauaaugguagcuagcauugcuagugcuuucuagauaccaaacacugcuaagagcuauacuugcugcaucucauuuaauccucauaauaaccuuuaugcuagguacuauuaauuucccccauuuuacaguugggaaaccaaggcuugugaaaauagcguaacuugcccaagaucacagagcuaauaaacagaacuguggcacaagccuaggcauuucugaugccaaagcagauggucuucuucacuuuggucugcugucuucagaauguaggggauuaugauuauaauuauuacuauuauuagagcaaguacuuuauuacugcguggcucaacccuacuuacccagcuaggagauuaauaggauguguuugcagucauuuuuuagucucucucugaaaaguaggaacuugccuucugaugagcuuuccaguuccuuuuuuucuuuuuacccauccacagcugcugugcagagcaauauugcagcccuugcuccugcccagcccgucaagccucuaagaagagcacuuucuaggggcuuuccugugauugaucacacaucagcuagacugagauuuucaaaaccucuugugaauugcccucuugguacagaaguaugauucaucucagcacguuuuccauauuugagggcuauguuccugcagccuuucuagauacugaguuugggaaggaaugggcagguacaugugguaggugcuauuagcugugaugauuacacucauguggugguuggcaguuugcaaaacgcuuucauaucgauuuucucuccaagccucaguuuugucaucuacaaaguggauauaaugacgauaauaauauagucaagucuaaucucaugaaagaguuaggcuauaauaaacccaccacuuaaggugaaaauaacacaaaaucagaaucacccuugacaaucgcucauggaauaugaagacacaccaccucucaaaaguccagugugggcaguuuuaaauccagcuugaacaccagugauaacuguuucuuugguugaaguaaucacagugccuucugagguaaugaaaauacuuaucuuccuagaguaggcucccccagcacagagcgcucacacuuccaggggccagagagaacuggggccuccagggacacugugagggcaaaggcacacucugcaugagcacgggaggcucaccaccacccuuguaggauuucucucuucuuucuugacuaugugucacugaauucuugaaggugaaauagacauaaaauccuaucucauuaggucugaucuccugacuugcuuucuauggacaguauugaaacuuaaaaguaacaugugaugacacagacaccaggcuaggugaggggagagcugggcucaggucccagguggguuucaccugcaucugugggacuauugauauccagcucuuacagaugaacuucucaccugacuguccaaguucucaggcucuauuucuugacucaaacccacaggacccuaguaacccuauuuuuaaaaaaaaucugugugugcccaccccuacuucugccuucccagcauaagcuaacaucaucucugccugcaccacugugauagccuccuucccagccuccaccccuccucuuggccuccuaaucccuuuuccacuuggcuacaagagagcuuuccaaaugcaaccugaucuuaucaccuccuuauagaaaacacuuguauuucuaaaugcuccuggaggaaagacagaauccucaccccuguccaccucucauuccuaccagacuuucccugcuucucugugcaccacacacacugcucuuccaggcccuccuaugauucauguuugcucagccacagaaucuuugcauaucuuuacuuuucccucugucuggaaugcuguguacuccucuuucuacugaguuaaccuguaauccaauuuucucaagaaaaccuugcaggcuggaucagauccccccagucugaucugaaagaaagggacuaucuuuguaccauguaccccucuuuuauggccugccacuguagcuuuuuuaauuuaccuguaguuucggaugaaagucuacauuuccccaccaccacacauacuucuauaagcucuaugagaguaggaccccguccgucuuccucaccaguauauccucagcaccuagcacaaggcuugauuugugcuuguguucaucauacacuuaaguugauggacagauggacagacagacagauggacagauggauugauagguaagagacucagaugaacauuaucaaauuauugaucagagucgauuuguuuuuuuuuuuuuuucccagugauaaaacauuugggcacuuauccugaagaaaguguugaaauuguucuuuuagaauggaagggaaaagcuacugaagguucuauuugcccuuuagauaacagacauuccaaaguaucuuggcuuuuuuuucucccugcuguuuaaaaaaucuuuuaaugagcuuucaugccuuacguagcaaaugaccuuuucuagagccaccuacaccaaacaaaggaauuggaggguugauaugguucugcccuuggaaacacaggaucagcccuuugaaacaauggcuccuaucugugagugaccuuccccucuuagagaagggccagauuucagauuucagcauccugguguugagacaauggaguuacuggaguggggacaacagacacagccccauugcugauuggaacagcaggacuugccugacgugggcccagcagacauagacucgugguugcuggguuguaaugccuccuuccauucauaaauagugccauucagguuugauuguuuucucauacagcuugguccugguuauagugaaaguuaaguuuucucaaaacagcagccuacugaauaggugcuaggguuaggucagccucacuuaagucugacugugggguaccagaaugaaugauccucagccuaugaaaaggggacauuuucucugaaugaaaacaaaaucaucuuucuccuugcauuucucaugggaggaggaggauucugagauuaauugaaaguggaaagguaguaacguauuuuauucuuggaguucuacuucagccuguuccuugcucaaaggcuuacuguggcugcccaccugccaagcagcucaaauguaaggcccuccaauucugguccagacuuccuuccuggucuuauugcucgugacucacuuuugcauccugcucacuccagccaaaucaggcuccuugcccuuaaguaaauaugcccuucacuuucuaacucgcauucuuuccacauacuuucccucuagcuggauuccacccccaacccccaccccucaacugcuaccaguuaaaauccuaccccuucucucagguuccugucaaagacucugcuucugcaggaauucuuccccgaucgucccagguagaauuuaauuuuuggcuuuuguaaauaucuaucgaauuuaucuguacagcuuucaaggcacuauguuauaggcuuguauguguguauguguguuuuccuuccuuaaauacuugucucauagcuguuuguggaggccauggacuaccuuguucaucuuugucucucccagaggucuuuggccauaguaggcccucaauaaucauuguuuggaugaaugaauuaauaaaaacaauccagcuuauguccucaaaacucaugaagaaaguacauuuaucuaauuguccaaacucccuuguuuaaacuuuauaugcuuugagcuaaauuaagcccuaccugguccucuuugaagguaaucuugaagaaauugcuuugcugugugugugugugugugugugugagagagagagagagagugugcaugugugugcaugugugugugugugagagagagagagagagaaguuuauuaaucuacuugguagauaaacagauguuugaaaugauauaguuauuuaaaccucaaagcaaaaucauuucauugccuuuguaggguucuuugagaggaagguggaggggagccauccuaaaauuugcagcagagccuggucucuaacacagccucagacuguggaugaagcagaugaccugcucagcuuuccuuccaacauugcuguuugagcgcauacagcccuuuccuuguuuugaagacacuagccagcucagccagagaugcucuuugccaagucugcagucuugggauuagaguaugcacuuuaacaaaucuuccuucuugagcagaauguaguuggcuugcuucaccaccauucuuuccuaccuccaaaggcugccaggccugcuaaauagugauuaaacaaagauuaaaauuccauuuguguguguguguguguguguguguguguguguguuugaacacuaaucgauucuuuuaguggaauguuaaguaaaagcaugcagauaccagaagcaguuauuuagagcagccagucaaaauccauugccaauuuauuauuuaaugugauuuccacauugauucugccagucuccuccacacacucucccucacuucuugccauguuccuuccuaaccccuuugcuuccuguagcagaaggacaucuggaaaccaagagaaagcaaaguagcaaaagaugguuguugaaggaaaauaauuacagcuuuuguagacaaaucuuugagcuuacagaauuaaagaaacuuaaaauuaccucuggauugaaaaauccagacgugaucuuuuacauaauauuaagugauugcuauugcauaauugcugucuuuugagaagcaauguuccugccuuuucuguuguuaauggucuuguggcauuuguuucuauuguagaaugccacuauuaacuaagacuuuuuucuuuccuugaagaacacuguguuucgaugugggcauaugacauccuguuaaugaggaaauucuaaauccuguuaucagcaagagccaguugaauugaaucaggugguagauagguugccucugcaggacccacaguuuuccuuauuaguuuccuguucgcucuccuauuccuccaaacaugguuaucacaaacacuggaacauaccguguuuucauaaacuuucccuaaaaauaauguauucauaguugcucaccuuuacuaggagaggaccuaacuuugucccagacacugggacacuuugucccggauuagcucaguuaauccucccaacagauacucuuauucuguuaguuuucucuauuuaucagucagggaaauugggcuccaccugcccaggaaguaaaaccuagguuuuccuaacucuggaaccagaauguuccaagucauuaaacuagacuaccuuucccauugaugagcauucauucauucauucagcugguauuuuucaagggccuaagauuagucagguauuggccuaggaaagugcagugguguaaugccccugccuucaagaagcuuacagucuauuccagggagagaacugcaagcucugguuugguccuuggggcugacaagcuguaggauuuagggcaaguccauucuacucuguuagccucagauuucguaucuguaaaaugaggcagcuagauuuagaccaaaggucuuccaacuuuauugugaauuagaaucacauggagaauguguuuucuaaaaaagguaucuuccugggcuccuaucuguagacauuuuuacuuaguagguucagggugugaguccaggaauuugcaucuauaauaagggcccagguucuccaagaaccaccuuuugaaagagacugaucuuucuguaaaccucauuaggccuacacaguaucugugcugucaaaccugaaucccuggugccugacacacugcuuuguacagaguaggugucaguaaacauuuggugauaguuuagaugaucugggguuucuuaaucugcacuaucucuagaaauuccauggauuguccucagaggcuccuaaaccaccugaaauugaccacaauuuccauuaagguuuuuggauaggauucuuagggcccuucaggcuccauguacucuguaauuuuuuuuuuuuuuuuuugagacggagucucacucuguugcccaggcuggagugcaguugcacaaucgcggcucaccacaaccucugcuuccugaguucaagugauucuacugccucagccucccaaauagcugggauuauaggugugugccaugacacucagcuaauuuuuuuuuuuuuuuuuuuuuuuuuguauuuuuaguagagacacgguuucaccauguuggccaggcuggucucaaacugaccucaagugauccgcccaccucagccuuccaaaguauugggauuacaggcguaagccaccacaccugaccaacucuauaauuuuaagacugaaacuaguuuuccacccuacugaaggcccagaccuauaacugggauacuuuuuaaccuauacaauaaaauuugaguuuuauaucuacaugauuuggugagaugucaauuuacaguagauucuuaaaauccuaaaggagucaguguccucaauccauguguaaauuaggagagcgcucaggcuauacuguuugugauugucuccguucaucugaaaguaccuuugggcagguagugcugucuccauuuuccaggugggaaaauugagguaccugugacuccuguagcucaugcaaggucacacucaaggguucuuucccacuaaaaacuaaccugggagucaaaggacaugguuuuuauccucuugccugcugugaggccuugguuggguagcuuggcuuguuuggacuucaguuccuuuaucuguaagaugagcggagguguacuaauugucucugagcagcuauuuagcucagauggcugaggacucuagcagcugcgugcuuagacauguagaacucccugugucagcaggcuccaaaguccuccugguuuagggaagguauaaggaccaaugagaccuaaaacagcauaguucaucucugcagacccugggagggagggauagagggagcagugugcaucauaaggcaaaggcaguggaguuagguaugaaacucccaggauuuuggagccuuaauucucaaugccaucaguucagcaauccaguguuucauuuugagaacaugauucuagggguuuacuucugugaggucaaaacagugagauuuaucccuguaccccauucccaguagcacuggaagacuuucacaagcuuguagaggaaauaguauccuucauggaaucuuagacucuugaagggcccuuuaaagguugccuaacccuugcuacucaaagugucuuuuuuggcccagcagcgucagcaucaccuggguucuuguuagaaaugcagaaucucaggccccgcccuagaccuacugugccagaaucagcauuaacaagauccaugcaugauucuccugcacauuaaaauuugagaagcacuagucccaacccugcacuugauucuucuccuucacauccugaugaacacucaaucuuucuauuccuggccacuucuaauaucuucuuccaaaugguuuuauuucauccuagcagcgacccaacuuuuggaauuucuucucugucugaggccccucaaucauucaguaacaucuaccauuggcccuuaguguagccuuaggacuucauggaacaaaauaacuucucccauguccuccagggcuucuuaucuccuaguccucauaguuucuaaucuuucccaaccaggauacauuccugaauaucccagcauguuucaagcucaccagggccaggcagguaacaaaaaugagauaugggaggcaggugaaaugcaauaaggaaugguagggacuguggcaaacuggggagacgugccccauccacacagcccagcugaugagcugagggaagucagcccaguacuggcaugucuuuuagguuuucaagagaagccaaaaaucuugauaaaacaauaugaaaucuccccauuuucacacuagaauuaagaaaaccaaaccaaaacgaaaagcaccuugaaagccaccagguuguuugccagugaccacauuuggcccacgggccucaggguuuugcagccuucuaugauaauuaucugcucaacuugaugugacaacacagaucagguaggauuaucaucugcuucauuguagaccagcaguucucaaaccucagcguguaucagaaucucuucgagagcuugcuaaaacacggauugcugggccccauccccagagcuucugcuucuagaggucuaggguaagacccugggaauuugcauuucuggcaaguucccagguggcacccauccuguccucuucagauacaacacuuugaacaccauggcuuuaguuuugugccuuccauuaaaagauccucaguuugcagagccucuagucccaccagggcugaaguaaucaaccaaaguuuccaaucugugggcagcagaagaggaaaaagagauugggagggagggcuggagaaaggagagcuaacuagccccuaacugaucaaccuugacaucacagaagcagaauauuaccuugggcagguuccuggccuaccccaaggcuugguuucucugucugugguauagggaagugguccuagcucagcuuccagauauauuuguuugcuuguguaggaaauuugauaucuauuuauuuuuagcagaagagcugucuucaaaugaaaucccacauggaaccccaguacauaaaacagauguguuguugcucugauugaagagcaggcagagcaagccccuacucucugccuuccucuucccaaggcagugccgggguccccuccuguagaacuguauccugaacugauuagaugguuccauaaggaccuuccagcucagcuucugugauuucuaagaaugcugagaacuguugaaagcaugccgccuuaguuuuuguaguuuuuuuuuccccucucuaaccaagacaucuagcacaccaacuuucagaauuaucuucuugcaauucagagaggucuauaggagaaagaauacaaaggauuguuauuauuacuagagcuguuauaaagauguugagccauuguggaaaaccugcuaacacagggaucagccagaggcuuaauaaacaagcgcagggacgauuuuauucagggggcuucuuguuagcacuaauguccagcacaccacacaucagggccuuugaaguuaauuauauaggaaauagcacuauuggauucugccugccacaguggcaagaacaagucugcaagauuuguaaugggcaagguguuucagaaaguauuuacaugaacauggaagauauguaaguagcuguguggugcagcauuaccuggggaaggcucugggccuggaggccuuugacuugacuguuggcuugagaaaguaucagguuccuucugcugaccccagucacuggaaugcagccuccuuuaauuagggaaacugcuuccuaaugggcgcaugagggugggcucaccuccccagguaaaugauaaaugcugccaaagcccagccccugggggcugcucucuuggggcugauauauauauauauauauauuuuuuuuuuccuuucagccauucaauugcuucuucauacauuccaugcccauuugccacauguuuauucucuuugggucugggcccucaagaccauacagauguccaagaccugccaucugcuuuugcuugcggcacuccuucuccuugggccacacacagcuuugccguucuuuacccaaacaucacaagucagugcccaggauguuugucuugccugccucuccugucgaccugucugaggcccagcccaaaugcacucagguccaugaaacauucuccauuucuccccaguggaacugaacucauguagugcauucucugagccccugcccuauccaagccacaugcaacuguugagcauuugaaaugggucugaaucaggaugaacacaaguguaaaauacacacuggauuucaaaggcaguacaaaaaaaagaauguagguuggacaugguggcucaugccuguaaucccagcauuuugggaggcugaggugggaguacagcuugagcccaggaguucaagaccaaccuggguaacauagggugaccccuaucacuacaauaaauaauuuccugguaugguagcacguaccuguagucccagcuacucagagguugaggauggagaaucauuugagcccuggaguucgaggcugcagugagccaucguagugccacuguacucuagccuggccaacagagugagaccuugucucccacuccccaucucccuaaaaaaaagaauguaaaauaccuuaaucaguguauuacauugauugcauguugaagugguaauaguuuagguagaguacauuauuaaaacaacuucaccuacuuuuuuaaauguggauacuggaaaauuucagguuacacauguggcucacguuauauuucuguuggguagcaccacacugcacacuuucucccuugggugaaaagaguguguucaucuuuuuucuccaccaccgauuugugaguuccugaaagguagacgcugcauucuugacaucuugcugaccuuugcaaaccuagcuggcacauggcaaggcaccaacaaagguaugcugagggaguggauaaaggaacccaggaugacaggcauuuggucaauacaaagcucccuuaggcaguguaacuccugggccuguguuacugauuugcccuuuucuauuuuucauaguuuuugucuuuuuuuaagggcucacacagucgacaaaagaaaacguuuuucuugggagaugggcagaagcugaaggacuggcaugacaaggaggccauccggagggacgcucagcgcguagguacggagggcaggauuggccaugggugggcucugugaagggcauaugcacauaugcuuguguguguguguguguguguguguguguguguucauguguguguuuagcaggggugucuggaccuccuguuggcucccucccugucagccaccaucccuuccccugauucccagaugccccucuucaccaguuagcugaccccuuucuccacugccaucaccagaucugcugccugcaagaauuugccugccaccuuuauugggugauagaaaaugucucccucauaaaggauauuuuguauuuuauuuuuauaggauagaaaugucucucccuuaugagauuacaacuaaaacaaggagcaguaauaagagccagcauuuauugaacaccuauggugaggaagaucgaugcucuguacuuggaaauuuccucugugaaaccucagaucaaccuuuauggcccauuuaauaagaaggggccuguggcgcuaagaggggugguaaucugcccacuguugcacagaaagagaggcaaacuuggaauuugaacccaggucuggagggagggcagaguugauuccuaccuaacacugcagccaugagacugagucaacuuagagggcuucagcuaaaguuuucuuuggcuaauuagucuugggagcaguuccguuuacacuggugaguugggaaggguugggguaaggugguacagaaauuauauggagaaucaacucuagggagccuggacuaaggagucaggagagcagcucugaugccacuuacagccaucuaaucaauagauaaaguccauacucccagagccucaguuuuuccaucugucugugggacucaugccucaugcuuccugcuuugacaaccucaggauguuauugugagggugccaaauaaagcaaugaguauguaguagcuuugcaauacuagaaagcacuguagaaaucuaagggauugguauuaauauuuuauucauuuuuaucuccauuaaagccucccaccacuauugauuuuuuaaaguuacauuaugacaaaaccagcuuaccacaaggcucugaauagagcuggugcaauaacuuaacugaugauaagagaaaucuggagaugccagaaaaugagaagggggaaugggugcugcucuuuuuuuguuuguuuguuuuguuuuguuuuguuuucagauggagucucacucugucacccaagcuggaauucaguggugcaaucuuugcuuaaugcaaccucuaccucccagguucaaaugauucuccugccucagccucccaaguagcugggauuacagaccugugccaccacaccaggcuaauuuuuguaauuuuuguauuuuuaguggaguugggguuucgcuauguuggccaggcuggucucgaacuccuggccucaggugaucugcccaccucggccuuccaaagugcugggauuacagguaugagccaccaugcccagccggugcugcuuaaauuaagaaagaaaacauuugggaagagcugauuugccagacauacuagaauuauuaacacugggcuaaccagcaagacaagaguaacgagcaguggagacauuaauaauaauaauaaccugcaucugucgaacgcuaacuaugugccaggcaucuugccugcauuaccuccuuaaucaucacaucauucacauugaaccuucucauucuaauuaauacaaagggcaaaaucuucagacucggaaaggcugaaggcauguccaagaugacauagcuggggaugguagggcuggccuuggaacuccacuccaucuggcuccagggccugaacucugcauuggucuccuguacugcccuucugaagcuucccucccugagcaaacacuucuggucuccugcuuacuguguuugggucccucauguuaucuguccuggggucuaauccaugaugucuuaugaagcauuacaagcugcagaugacagagaccuguuucuugccugacuggauuggaguagucagagcccuugggcuccacgucucagcuugcaccuuccuggaaaucugacuuugucaauguuuacuuugcagaguaaauagguguugcucaguccacaagcuccagaaggcaagaugauuuuuaacccguugauuuuauugccauuucuucaagauccucaccaaugacagauucuuaagcuacuauugcaggggucgauguggacauucccacuuaccauaugcaccugggaaccuagagaaaaauuuccuggaguaucacacuccuucuccagauggguugugcagagaaaggaaagcuagcacuuuaacccacccaaauccaugacucaaagccacacuuuucaggcacuccugguuuagaguaggcagaucuuaauuuguuugcugcccuaaaaacaaaaauaaaaucaaagcaucuuucaucauuuauggcaauuuugauuuacuuauaaaguuugccuuaucuacaguaaucaucuuuccucguguuuaugagguguuuuguaguuuacaaaaagcuuucaaauaggcaacucucauuugacucuuucaagugugcuguggguaucagaggaggaagcuuuagcucugagagcuggugggacuuggcccaagauugaucagcucacagaugguggaccuagcuguccagugacuggucugcgagggcaggggucuuuggaguuccugacggagugaggggagcauggguuuuggaauccauacuccugauuugauaaccuuucucagucucagauuaucauucuguggaaugagaggucucauguccaccccgcagagcugcugugauuacaugagaacaagaugugcaaagugucugaauaaaugcuugcuccccuccuacucuuuguacugagcaaaaacugagcuaugcucuauauccaaaucaaguuuuaucuuggagguuuaaucauauuuuucauccuuuuuccccacuccauauacaguaccccauacaucauuagcaacaucgaauuugcucuuugcuucuaggaaauggagaacaaggaagaccuuaccccaugaccgaugcugagagaguggaucaggcauaccgagaaaauggauuuaacaucuacgucagugauaaaaucuccuugaaucgcucucucccagauauccggcacccaaagugaguguaacaucucucaaauucugagaucuaaggauguuucccuggcuguuguugagaauuaauuaaggaagcagguacauggagcccugcugacggagacacccuccucuuucacaggcauuugugcaaagguucaugguguugagggguaggagauaauacugucucuccagaugagccagccuccuuccucuuuucaggagguggaacuauguagccucugcauuuccccuuuugcucugggcugaagggaaguucagaccccaguguagacgacaaguugucaugcaguuuuuaacuuucauucucuucacuuucugugugauguuuuuauuucuuuuuaaaaaaaaucuuucuauauauuuguaucuuuguuauaaaccaucucuaaucacauugagagcagacauaucagaaugauuauaaagaugacaacaauggcaucuaacauucuuugaaccgguacuaugugccaaacgcuuuauuuguaucaucucagguugcugugagguagguccuguaaugaugccgauuuuacagugagaaaacuggggcuuaaaggagggucauaacucacuuaaggcuauaaguugauugacagaauaagacaggccuuagacuccaguucaaucaaaaacuauacucuggaccuuaaguuauccugccucccuguacauuuucaguaagggucauuguggugaugauggugauuuucugguagagccguucuuaaauuugaggugcguuagaaucacuuggaggguuguuagacacaggauauugaggccucaaagcuguugauucaguaggucuggaugggggcccaagaacuuccauuucaaauaggcucccuggggaugcuggcgcugcuuaucuugggaccacacuuugagaaucacugcaaguagauuucagaauugcuucuacaugaaggcaguacugaguagcacuggaauauaaguuuugcucagggacuaacaaaauagagcccaggaaaagauaauaaaagcuaacauuuauuaguugcuuacuguaugccaggcauuuuucuaagccagugguucucaaagugugguucccagaccagcaauaucagcaucaccuaggaauuugguagaccugcagauucuugggccccagcccagauuuaccaaaucaaagcuaugaggaaggguccagcaaucaguguuuuaacaaggccuccaggagauucugaugcaugcuugcauuugagaaccacuguuucagguauuuuaaguauauuaacucagucaaaucuucuaaaaucccugugagguuauuauaaccauuucauagaugaggaauugaggcacaaaaagauuaaguaauuugcauaggaugacauagcugaaaagagauggagccagaauuugaacccagggagucuggcucuagaaucugugguuuuaaucacugaaccauaaaagucuuuccaccuauaagaucucaaucaguagaaugcagugcuaaagacuucaucuugguaacauguuuggcagcuuacaaaaugccuucauucccauaaccuccuuuaguuccuacaacaauacuuugagguuggcauuaccaugaucaucucuacuuuguagauguaaaagaugugcugucaccuaggauugggcccuuuucccaaagaugccugacagcgagggaacagaggaggggccucacugugcuuucccacgggcuuugccauuuguuucaugguuuucacugucaaaucccagauuuuuuuuuuuuuuuuuuuuugagacagggucucgcccuaucacccaggcuggagugcaguggcacgaucucagcucacugcaaccucugccuccugagcucaagcaauccucccaucucagccucccguguagcugggaccacaagugugugccaccacugcuggugaauuuuuuguauuuuugguagagacaggaucucgcuauguugccuaggcugguuuugaacuccuggacucaagugaucuuucugccucagccucccaaagugucgggauugcagaugugagccaccgugccuggccaagcccuagauuuuuucauguaagucuagacuguuuguaguucagcuaugacagauguuacuggauuuggaacuguaaccugacucugagggucaaaaacucaauguauguguuuagcuccuugcaggguuccaaauucugcacuaauuucaucuuucugaaucuaggaaagaaguucaccuggggaguucauucauuguucucucaccgcagcugcgguucuugugguacuguggguucucaacccuggcugcaccuggaugguuuuuuaaacuacaaaggccaggaccccaccccagaccacugaaaucugaaucucugagguuguuaccuggaucucaguauuuucuaagaucuccaaaagcaauucucacguauaaugaggguugagaaucacuggugugcaaugaagaauauuucugcagugagagagagagacaggcuggguguggucacagcuuucuuccauucuuucaucuauucauaguauauauguaggucuucuaugugccaagcccugugcuugacacuaggaucacaaggauaaaugaaucauuaguguugccucaaaggaacucccacucuucugcaagggguggggauggaugacaugagcugggcauuacaccauaguugagaagaucaauaauaggguugggcacagggugcuuugugaccacagaggauaccccugacccugugucugcaguuuaagagcuaggaaggccuuccggaggggugcuaucuacagccucugaaaggaacaacuagggcuagccaggggauggggaugagcaagagcauuguggguagagagaguggccuggccagaggccuccaggcaaaacagcacauguucucuggcuuaggacuuaggaaguggagccaggaugaggaccuagccccuuugucucccauuguagugcucuuuccugacaguccagaaaaagaaaccucuuuuucaucgaagaguccugggauccacagaugugucccucaauagaauucaggggagucugugaaguuggaugagaaaaacguugaauuuuuuaaaaaaauuaaccuuuaucugaaauuucguguucccuucaguugugaauguaggcaacaaagcccugugaugucccccaaggaaagcauuugcuuucacaucacuuacagaccucuugaaucccauggacacucaucacuacuuugaaauggagguaguuuuuauaacuaccacugaucuuuuuuuuucuagauauuuacuuuuuaauuuuaauuaucauggcuauauaaugauuguauauauuuaugagauacaugugauguuuugauaugggcauacaauauguaaugaucaagucaagguaauugggaaauccaucaccucaauaauuuaucauuucuuuuaccacuagaucuuguugcuucuuguuuuuuuguuuuuuuuuuuuuuugagacagggucuugcuauguugccuaggcuggucucaaacuccuaggcucaagugauccucuugccucagccuccugaggagcugagauuacaggcaaaaccucaucacauuuggcuuugaauaaauuuugauaacuauauuucagucuaauugguuuucuuuaaaaucugguacauuuuauguauuaugagcauugcucugagaaguguccacaggcucccccagccuggcagauggaccucuggcaucaauaagcuguggaacuccuguuccaggugggugggaguggagcuaaggaggccuuagauaccucugucaccagcccacccacccagccagccagccagcauccaaguuacuaacugcaaaagaugucacuacugccagcgcuccugacaccccccuuuuuuggagucaccaaguguggaagcugacuuuucagaaaugaguugacagaugucucgaagagauuuccuuuuuuuccagaggggaaucuuuccugcaguuugacagcagaaaugugugaguaaauuagagcagucgagccgcucacuccauucaguuucuuuuagcuuaaacaacuucuccagcaggagcugagguuuauguuugccuuuuguuccuucaaacugaauuuuggcaacagcaugucaagaacaagauugaggggcuguuuguuugugccagcugccuuugcuuccaccagaagcugcacuggggacugcguagccagagaacggaagcgaggcaguuuggcccagacucacuggaccugcaaaugggagucagccagcuggcucugagugggccugcccucugcaccuccugccaagugagcgugaacaguggcuggcuggugggcuggcccacuuucccuacucccugggagcccugcugggcugcuuggcaacugagcguggaggccccuccagagcacagggcugauggcacaacagagacccaacugcuaaagugccugggaucugcaguuuccggugcaaaccccagguuagguggucaguuucuccuaugcaaagauuauccauggauauccaggauauccagagauauccugaccugcuuucuccauuccauaguuuuagcuucacaaugaaugaaccuguguugcaacaaaaggcccaagucuaccagaucccuccuuccauguuccuuuuugcuuuguccuuuuuguuaaauuaacacaguuaauuuaugacauauacuaaauguccucaaaagaacuuauaagcucauauuacuauaauagucccguauuauauugaguaccuuuacaucccuaacaggcuacaaaguguaauagaagcaagaaggaagggaguuaucaccuauuaccuuugacaaacauguauuaaaaaaugacaacuugccaacacaggaaguuuaagucaaccacauuuauuguaguaauaauauaauagugccccaauuggaacauacacauagguauaaaaucacauuugggccaagaugaaguaagauaaguuuucccuucugccuaaacaacaccccccacccaaaaaaaaaggccaggcaaaauacaugaaacacugguuuuuaagacacuggacaucaggcagugaagaacaauaauuucuaagaaauugaaacaaaugaggugagcccuauaguugccccagcuuauugccuuuggagaauuuccaggccaugguacagggagggcaagcccagauagagcccagaagacuuacugaguugaggaaguggagcugagaguccaaggagaucaagaaggcuauaguucagaggacacaguacuggagacaggagagcugugcaaagagagaccuacagagaucuacagaguccucucaaacacucaguggauuauugaucagcaccugccgugaggaagcuaucugaggcugggaaaggaaucacccuaaagggcuuuagggaacagugcauagugcucacucagggccaaaaauaguuccucuucccaccacccagacuggaaaaccuccuaauucauaacucauggggaaucagguagaguacuuagaagaguuuugccuuaguggcaucuaaucagcccuagacuaaacagugcucuggaccagucuaaaaauaucauaaauuauuacccaaaaggaucaaacuguuuccaaauauauaaugcacccagaacaaagcuugauaauacuuacaucaauacauaaauauucacuacuaagcaaugugaaacccaaucaaagauuaucagguaugcaaaaaaguagagaaacaugacccacagugacaaguauaaucacucaaucaaccaacccaggguagacacagauauuagaauuagcagaguuaauuguaacuguauuucauauguuuaaaaaguuagguagagauacggaagauauaagaagauccaaaucgaaauucuagaaaugaaaucaacaaugucuaaaaugagaaauauacugaaugggauuaauggcauagauauugcuggaaaaaaaagauuaaugaacuugaagauguagcaaaagaaacuacucaaaacacagaaaaagauuuuaaaaauugaaaagagguucaauuaccugugggucaaguuuaaaaauucuaauauucauguaauuaggguguguguaaggaaguaauggcugaaagucuuccaaauuggauaacaacuguaauaccacauccaagaaacucagugaaacacaagcucaagaaauacaaagaaaaugacaucaaggcauguuauaaucaaauuacuaaaaaaccagugaugaagaaaaaaaugucaaagcagccagagaaauaaagcauguuauauagagaggaacaaugauaagaggagaauucuuguuguaaacaguacaaagaagaauaugguguagcaacaucuuuaaaguacagaaaugucaguaaacuaugguuaguaagaaaaaaauaagguauggaaagagaaaacucugucaacuuagaauucuguacccagugaaaauaucuuuuuuaaaaaaagauacuagcuacaaauagagaucuuuauuuacaaaauaugaagaucacuagaaauaguagcuuuguggguaaauauaugcuauuugucuuauuguuuaaaucuuuuaaaagauaauugacuguguaaccaagaauaauaacauuacuggauuuaaaacauguguaaaauaaaaugugugccaacauaaagauugaaggggagaaaugguaaucugguaucguaagguucucauaguacguaugaaguauacaauaucaucugaagguagacugaugaguuaaaaacauacuauaaacccuaaagcaagcacuaaaauaacaaaacagaauuauagcuaauaagccaacagaggagauaaaaugaaaucauaaaaaguaauccaaaauauggcagaaaaagcaaggaagggaaucaaaaucacaaaggagaaauagaacugggugcaguggcuugcaccugugauccuagcuacucagcaggcugaggcaggaggaucgcuuaagccuaggaguuuaagaucaacugggcaagaccccauuucuaaaauuaaaaaaauauauauuagccaggcauaguggcauauguuuguagucccagcuacuugggaggcuaaggugggagaaucacuugagcccggaaguuugaggcugcaguaagcuaugaccgugcuacugcacuccagccuuagugacagagcaagaccucaucuguaaaaaaaaaaaaaaagaagaagaagaaauagaaacuaccaaaaugauggacuuuaaccugaccauaucaauaaucacauuaaauguaaaugcucuaauuauucugguuaaaagguggagauugucagauuggauaagaaaacaagauucaaauacaugcucccugcaagaaacacacuuuaaauguagagauacaaauaaguuaaauguaaaagacagaaaagauauaccaugcuaacaccagucaaaagaaagcugcagaggcaauauuaauaucagucaaaauagauuucagagcaaagaauauuaccaggaauaaagaaaguuauucauaauaaaaaaguaauucauaaggaagacauagcaauccuaaauguuuauguacuuaaucagugagcuucaaaauacaugaagcaaaaacugauaaaacuauaaggagaggccgggcacaguggcucucaccuguaaucuuaguacuuugggaggccaaggagggcggaucaccugaggucaggaguuccagaccagccugaccaacauggugaaacccugucucuacuaaaaauacaaaaauuagccaggcaugguggcacgugccuguaaucccaacuacucaggaaggugaagcaggagaaucacuggaaccugggaggcagaagcugcagugagccgagauugcgccacuguacuccagccugggugacaaagcgagacuccaucucagaaaacaacaacaacaacaaacuauaaggagaaauuuaaaaagccacaauuaugagauuaugagauuucaacaccucucucucaauaauugguaauacagauagacagaaaaucagcaaggauauaguagacucucacagcacugucaaccaauaugaccuaauugacauuuauagaacacuccaaccaauaagagcagaauacacauucuuuucaaguggauaugaaacauuuaccaagauagauuauauuuugggccagaaaacaaguccucauaaauuuaaaaggauucaagugauacaaaguaucacucuaaccacaaugaaauuaaacuuagaaaucaauaacaaaauaauccuuuuaaacuuuccaaacgauuagaaaguauauuacuuacauguaaauaacagaugggucaaaaaagaaaucaaaaacaaaauuagaaaguauuauuaacugaaugauaaugaaaacacaauauaucagaauuuguggaaugucacuaaacuacuacauaaggggaaauuuguagcauuaaugccuauguuagaaaaaaagaauggucuaaaauugaugacaucaacuuccacuuucagaaacuagaaaaagaagagcaaauuaaucacaguaaacagaagaaaggaugugaaaaagggcaaagcagggaucaaugaaacagaaaaucaaggaaaccaaaagcuggucaaaaaacaacaacaacaacaaaaaaaacuuaggagaaauuuaaaaagccacaauuaugaaauuaugagauuucaacaccucugucucaauaacugguaauacagauagacagaaaaucagcaaggauauaguagacucucacagcacugucaaccaauauaaccuaauugauauuuauagaacacuccaccaauaagagcagaauacacauuauuuucaaguggauaugaaacauuuaccacuuugaaauggucaauuaaauugauuaacaucuaaccagcuagaaaaagagaaaaagaagacaaaaauuaccaauaucaggaaugagagagaugacauaacuauagauucuauaacuauuaagagaauaauaaaggaauauucugaacaacuuugugccaaaacaucuaacagcuucgcugaaaugacagauucuuugaaagacacaaacugccaaaacucacuuaaggagaaacgaucaaccugaauaguccuauaucuauugaagagauugacaguguaguuaaguaccuucccauaaagaaaacuuuaggcccagauggguucacugaugaauuauuucaacaauuuaagaaauaauucuggccggguguggugguucacgccuguaaucccagcuuuguaaucccacuuugggaggccgaggugggcagaucacgaggucaggagauugagaccauccuggcuaacauggugaaaccccgucucuacuaaaaacacaaaaaauuagccaggcgugguggcaggcgccuguagucccagcuacucgggaggcugaggcaggagaauggcgugaacccaggagguggagcuugcagugagucgagaucgcaccacugcacuccagccugggcgacagagugagacuccaucucaagaaaaaaaaaaaaaagaaauaauucuauacaaauuuuuccccaaaauuaaagaggacgggguacuuuccaacucacuguaaaaccagcauuauccugauaccaaaaucagacaaagauauuacaaaaaaagaauuuuacagaccaauaucccucaugaauggguugggcaggugguaucaucgucauuauucacuuuucuucaggucagcaacuagaagaucaaaggauaaagaggugugccaaagucacacagguacacccugagcaggguuguauguuuagugaaaaauaauaacaauaaaguaugaaaagaaaaaccuagaauucuauacccagugaaaauaucuuccaaaaaaaaaaagauaccagauagaaauagagaucuuuauucacaaagaauaaagaucucuauuucuaucugguaucuuuuuuuuuuauuauuucugucugguaucuuuauucacaaagaauaaagaucacugcaaauaguagccacguggguaaauauaugcuauuuuucuuauuguuuaaaucuuuuaaaagauaauugugggguagaauguaguuggaaagggauuuguuaccaugguuugccaaccauugcggcauucaaaacacccagauaaaaugguggggaaucagaaggagggaguggacugugagggaauagcauccugggccuagcagagcugguggcugagguccuauucagggaccacccacuugcccccauaauaauguggccuuggugaugcugaguuuggcucgaggaguagaaaacuugauguucauaaauauucccauagcagaaaggaagucuucucgaauggugauguaagccuggggcaagaaagggcagggauguaacaagaauugagcuuuccugccccacguggcaucaccagcugugcaucccugucggagacccugagaacuaggagaagcuguuggcagagcugcugccugugcucucgggcuccugcuuugcaugcccacccaacugacguauccagagcuaacuagaucaggaacuuuaucuacgguaacuguguguuuguuaugggcuccuuucuacccuuccaccuccagucugcagcucaucugaaaugcagccagcccuuacucaggcuuauuaugcuaaaaugaucaagagauagucccugucuugaagagauuucaagcauauuagucacuuaaaacugucucugaaagccauuuauucauucagcaaauaucuauugagugucuauuuugugugcuuacuguauggccuagguccuagggaaucagcaaugagcaaauagucaaaaucuccuucccuccuagagcuuacauuccacuggggguaggggugggagagucauaauauaaacaaacaaauaaauggauugauuuuuuagauagcaauaagugauguggggaaaaaagauuaacaggauaaaggguagaaaaaauaauaagaaugggguagauuuuauuucaggggucagggaagugcugucagauaagauggcauaugaacagagcuaugaaguggugagaggccuagcaggaaaguugaccaggggaagagcacugcaggcagaggaaacagcaaaugcaaaggcccugagaccacugugccuggcuuguggaggccaguguggcuggagccugaugaugugaaugaugagaaguuaggcuggagaggugucugggugguggucggguuguaguggggcuggagcuuuucccaaaaugacuaagacgggaugccacuggaagguuuugaacagagagugacaugaucugauuuucauguuaaaaggaucacuuugguugcuauuuuaagaauagacuguaggcagccaaggguggaagcagggagacuaguuaggaguauguuaacagcaaggcaggggagcgugagagugagucaguccacaguaggaguaguggaguagccauggcugaauucuggacauacuuggaagguggagauggaggugccaggauuuacuuacaagaauguggauaugagaauaagagagaagccaaggauaaugccaagguuuuuggccagagcagcuggggagauggaguugccaucugcaggaauggagaugacuuugggaagagcaauuuuggggaaaaucacgauuuugauugcagacaaguuugcgacacuguuucacauccaaaugucaaugucaaguaggcaguugaauaaaugaucucauuuguguugugaaaaauggaaauagugacaagauuuuuuucugaguugcuguguuuuuauugugguuuuaauuaacucaccuuccuagaauaucaggaaaugccugaggcauaacagauaguaagccuaaaaaugacccaagaccggacguagucuguggcgugcaguguaauggaguuuguggucagcguucagguuauggcgagagcgguacccauaaccuuccacccuuuuuguugggaaugaaugacgggagucugcacccgcccccaccccauggugcagaguggcuugucagacccuccauagaauagagacaggcuucaaagacuauuuaguacuuauuagcaguuuuuacccuuuuuaucaugauucaugugguagagcaagcucgccugacaccuuuauaauggaguacuucaguauaagauuagugccccagagauacucagaguucaagagcaaugcagccucccuguuuugguagguuguuagcgaggcuguugugggaggggagggccuguagauggaaugauuuguaagcugggaaaggaaaaaaucuagguuuuucuuuuuuuggaccaucacuggguuuuuuuuguuuuuuuuuuuguuuguuuguuuguuuguuuguuuguuuuguuuuugagacagagucucgcucugucauccaggcuggagugcaggcgugaucucggcucacugcauccuccacuuccuggguucaagcaauucuccugccucagccucccaaguagcugggauuacaggcgcauaccacccaccacaccuggcuaauuuuuguauuugcagcagagacaggguuuuaccauguuggccaggcuggucuggaacuccugaccucagguaauccgcccaccucagccucccaaagugcugggauuacaggcgugagccaccgugccuggccacaucacugguuuuuuaggagacuuaaaucagcucuucuccuuugaaauuaaaugacucccuucugaacagugguguuucuuccacgauaacaguuauugauccauuggaccuaauauugagauuuaaaggugcucauauaccuuaaaauaaaaugcagccaauaacauuucuuacauugacuucuuuucucuaauuuuuaaaagaguucagugaauucagcccugaaguugaaauugugaagauaaauaaucuacagcaaaauggcugccuaucaacuaaaaauuauaugggcaucuacucccuacaauuuaugcuagauaaaagccacuuacaucuaugugacuggauguguggcuuguuuucuuuuuauuauuucugcaaacagaugcauuuucugagucuucuagaaauggaugcuguguucuccauuaauaacaacauguaccauuugucgagugcuccuauuuauuuaucgauguaccgggcauugugcugaacacauugccaguuguaucuuacuuguuccuauucagaauuguugugugaugaugauuuauuucuuuuauacucaacauugucuucugguuuacaaacuguuacaacuauuuugugguuuagccucucugcaauugugucaaauggggaacaucacuagcuccauuuuacagaugcacaaacuaaaccucagagaaccucagcccuuuguuccaguucacacugcuaguagaaggcaaagaaggcucgaccuagauccaagccuguguuuuuucuauugcaucauacacagacugagaccugagaccugagaccugaaacccgugucucacagagaauggagacuuuuuuuuuuuuuuuuaagacagauucucacucucuugcccaggcuggagugcagugaugcaaucucagcucaccgcaaauucugccauucagggugaagcaauucucaugcucagccucucgaguagcugggacuaugggcacacgccaccacaccaggcuaauuuuuguauuuuuaguagagauggaguuucaccauguuggccaggcuggucucaaacuccuggccuugaguugaucugcccaccuuagccucccaaagugcugaaauuacaggcaugagccaccguacccgguggagggaaacguuuuuaaaucugaauccucuguccaugaagguacuuggaccaggccuagugagugguauuugcuacauaaauccagcaaacacaaccagccgacuccucugcaugcaucgcauucaccaugcagaagguaauauguucuuguccaggagcagauaaauagcauucagcaaaauugguuacagagaugaguuugauuucuaagugguguuggccuugaaaggguuuaagcaaaaagaaaauaaugacuggaagauaagagugauuaucaguucucucccuucauuaagaugguaucaagggcagugugaugauaagacaagcagaacagcuuagcuuaggagcacuguuacauagaagagaacauaguucuuucuugauuggaagccuccuucuccacaccuuucaggggaagaaaucaauagucccucuccccucucuauccccccacuuuacgcuccaauccuaagucugccuggguaaugaauuguaacaguuuaguagcuuucuauaguuuuuucuuugcuuauacaguauauagagacauaugaauggggcuuaggguuuuguuuuguuuuauaaaaaugugguuguacuauuguguuuuauucuacaaguacuuuuuucacuuaauauauuguggucacauuuuaagauauuucuaauagcuguguaauauuccauaggaauauaauuuagucaacaguuccucuguagacagacauacaggucauuuccagguccuugcuucuggaaaaaguguggcaaaaaacauccuggaacacauaucuuuacauuuuuauuucuucuuuucuccucuuuuaugaaucaucaagaaacuugauauuaaaguccauuuccuucuaaggaauguuugccuggcagcuggcagcucacugggaugugaggugugguccuuaggguuauuuugugccuugcacaccauauucauccauuagaguuccucuuuccugcugucauccuugguuuaaagcuugaguauguggaauauauugcauguuacaucuguaggagggccaaaaauuuuaucaugugggacagcagugugaagaaacugucacuagauuuuuuuaaaauguuauuguuaggcugggugcgguggcucaugccuuuaaucccaacacuuugggaggccgaggcagguggaucacuugaggucaggagcucgagaccagccuggccaacauggugaaaccacaucucuacgaaaaauacaaaaauuagccgggcgugauggugagugccucauagucccagcuacuuaggaagcugaggcaggagaauugcuucaaccugggaggcagagguugcagugaguugaaaucacaucacugcacuccagccugggugacagagcgagacucuugaaaaaaaaaaaaagguacuguuuuuauaaccaucuuaaaacuagauaugaccuaaauaaaacaguucccaaaauguaaguucaaaaggaaggaaaagaaagcacaaaccaagauccuuuaaacacuccuuguaccugaaaucucugguccuagucagggggugcacaacuaguggcaaacugauacugcugagguuuauaauuaacaauaugaauaauaagaauaaaccucuguguguuucuuagcugucuguugaacagggacuagcagguggguuuggcuggcucucagcaaagcauccccugaauggcaaagggcuuucauaaagaugucagccuuggcacacguugucaaguaaucuuuuggguccuuuuauuccagucagacuguguuaaagagaaagcucaugucugucucauccccgagaggaggguagagaagggcuggagagcugagccugagccuugagcugaggaaagaggcuuacaaucaguaugugucaggagaaggccuaagucugcagcucgagggaggaugggggaaagggaacagggacuuuucacacucuacccacuaagacucaguuucugccucuuauucugguggagcugucucugacuuccacuuagucaguuucuugauggcuccaagacgacuggacauagucuuucugagaauguuauauuuuaagggacuguccuuuuugcagaauagagaggagaaaauccuagaauuuugaacuuacaccauuugcuggaaaaugaccuauaccguggccucuguaaaguggaaacuaaauuuacauuccagaugcuguaccaggugcauucacauauggcaccucuuuuauuccuugugacagccuuaacaggaaggauguauuuuacccaagaggaaacuaagucucagggagguuaugacuuucccaaggugacccagccacuaagugacagacauggauuuugaacccagaucugagugucucuucagccuauccauuucccucaccacaccuguaguugcaucccaaggaagugcccuuccuagaauucuuacccuuggaccaagggccacuguuugagauguggauaugcugucucccucugugacccugggaaggucccuccucauucuagaccucaguuuccucaucuuuaaaccaaggagcacaaaugauaugagagucaggcuuuccagacuuaauauucauugcuucugauuggccuuucagguuaaagcuccguauguggccugggaaugguaguuggcuuucugccuugguccucaacccaaagagaugcuggcgucugccuaucugccuccccgccucccacaacauacaaaccagcucccaaccagcuccaucucguuaagggaaaauccaaaauugucaucugcuuggcaaagggggguauguuggauuugguuaccaugugaaagugcuaaagugguaccccuuuccagaagaugauuguuuaucuaggaguccaagcacuaaaagcuuucaaacaagagucacuugacaauuuuuaaaaugauaauuuccuuaaaaaaaaaagacugaaauugcugaagaguaauuugccacaaugugcagagcauagagauggugaagugcugugaacuacaaguaauugcucuuaaugucaugauggcccaguugguucaguguugauagggccuugcaaaucguguagaacaacaacaguguguccuagcagucucagugucuaugaccuggaaguccagguuuccauauuagugguacuucugaaguuuagaaaucuuaacucuaaaagaauccaauuauuuucacaaucaaaaaaaaauaaaaauaauugauucagcuguaguacaacuuuuggaugcuuacucuugguuuuuuaauccagggaacagauuuagagauaggacagaauuccuuggcuucaugguuaccucagcuaauggaguaucccaugcaaggaaucacgggcaauagagggaaaugggaauguuuucuagguggaaugugagaaaggccacacagccaagccccgcaggggaaggagguggagccacggcacagacaggccucuuagugccugaaaggggaaauuuuuccaaggcuggccuccagguucucuuaugaucuccucagcaccaggaauuucuggauuccaccauuaagaggccuuagcucuccucuguguagcucugucugcuccccucauuagcucugugacauucuuuccauacaucaagguuguguccucaagaaagagaauuugauuggucuggugagccucauuugggcacagauuucuugcaaggccauugaccccuggcaagucaauggauuggcggcccugagucagaguucugcuucugcccuaaacaacuguggccagguaaggggcaaucauagagcccacccaggacuccuucuucagccagggcugugggcuuggucauuucugucagaagggaaggcaugggcaagguaggccccaugacugaccugaucagcauauaaauuccuuguuggaccaagaugguaccugaugacccuccuguuuacagagcaccaacauguuccuuucuuauucacuucucagcucaaaccuacaaguccauuuuauaaaggaagaaacuaagcagguguuugauaacuugcccaaggcuauauagcuaauaaccuuuggucuuuuuggcuccaaguccauaccaaacuacuucugagaaaagagaaugaacauugaauggacaucaucaagcauauuuagggcauccacauuuuuauuagugggaguuuuuaguugcugaaguucauugaaucuucuugaagaucccacuucucuaggcuguguggucagccccccauggacuugccaagccaacaggcaccacuuggaacauaacagcagacacuggcuccuuuaaacugugucugauuuagauuuguuauuuacauccagggucuccaaaagauuuucucuuuguguugggacuaaacugaggagccagguccaccucccagcuggccacguugucugggaucaccaagcagcuccucuaagccucacuaccuuacuuggaaaacagaaggguuggacgaggcaccuuccaacuccaguucaacucagcaacuauucauggcgugcuuguugauggcaaggcacaggccugggcaugaggcugugccacuaauaacacuucagucugugccuuucuaggcuguuuucauuuugcugucacuucacagccauacacaggaaggcagaaagaaauuaucauaauuuauuacuguuuauguuauuugcuugucccccacaacccugauuagacuguguaucccacgggacaggaacgacagcuuguuuccugccauuuuaauuccaggucuuagcauagugucugucacauuguaagugcucaguauuacguuucuugaauacaugaaugaugcaaggcagugagcaaaugagaauguuuugagucaugagcuggccaaagccugagguaccaaaagugggauucuugucuacuagagcagaacucuucagugaagccuuacugaagccccaugcccuuccugggauggccagcccugauucugagagaacugaaaucaggagcugugaaaucuuugcugugaguuguccuccacauuuacccaucuccaagaacagccagcuacuuaucccuccccauggcuguuuuaaauguacugucucacuugguucucaugacauucucaugguguuaccaucccuauuccauagauaaggaaacugaggcucaucaugggauaggaacuugccggggucucacaguugcaaaggagcagagucaggauuugaacccagguccagagcauucuugcucccuuaggcacauacaauauuggguuuguucaauugacuuacauuucaguuugaucuguggauggugucccaugccagggaauugaauguauguuauaguucccuuuuaaaugauuggauuguucuauuucaaaguuuacucagagagaagauuuuugaaauacuucucuuguauuuugacuuuuguuuucuagugcuccagcauuaagcccugaugguacaucuuaguauauuauauaugucucugugucccaagagcucagaauccuuuagggaguguuaaauuaggagcuguuuggucacaagcaagcugaguuaucucccuuuccucccaaucccaucauggcccucugcccaggucacuuucuccuggucggugaacaagcaaaguucuccuauagcagacagaaccugcccacuucagaucagagguaaagucugggcaacaguugugccucuuuguccuucagaagccaucgcuggguccaaaacagauucauuugacggaauauaccuggggauuaucaaguuaaaucagcaaagauuauucuaguuguaaaugacaaaaaaccuaacucaaacugacuuaaguaaagaaaauguauugguuuauauaacugaaaaggccaggaauagaccuuggcuucagucauagcucgauccggguccccgacugaugccaguaggaaucucucucuccaacucuuggcucuguuuuccacucuguuaacuucauucugaggcaaggaacaguccacaugguugccccaggcagaccagauauauauccucccauguucaaucucaacagaaaagaacuugcgucuuucccaguugucucagcaaagacuuucucugauuugcaggugccuguccuagaacuacuuauaacggggcuggagaggugacaugcuaugacuggcuaagccaggcuccuuuggccacccucaaggcaaggaaugagucagcuccaccccagcccuauacaggugagguguaggagauuccccaaggaaaaucggguugcugcuaccaagagaaagagaagaaaugcagacuugcccauucccucauugacauaaaaggaaacugagguccagcugggaccucaguugcauggauuguugacuuggauuguugcauggcagagcaaaggcuagaagccacgauuucaaacaccuacuuaguuuccucaauauuugcuuuuuagcuagucauucuuuuuugcugauacaauuaauaggauugauaaauuaucccuauaaaauacuaauauauauauauauauaaaagacagauggguuuaaaucuggacuucauuccuugccagcuauuugaccauaggcaaguuucuucucucuaucuuguuucuuccucuuuguaaugagaauuauauucccuacauuguaagauuauuuugacaauuaaaugacuuaaugcauauuaagugccuacagcacugucuggcauauuggaaauccucaacagauguuuucuauuauugucauugucacuuucugccuuauuuuuuaacugcuuaucagcauuccauaguuugaauuuuucaucuuuuauuuaaucuuccccuauugguggacauucacuguuucugcucuuuucacuauuucaaugugugucaaucaacauccccaauugugugucuuugucccugugcuguacaccucucacuaagcuuugcgcauucaggguugaaaccuaaucagaccauaaaccaaaggauagugaaagugcuuuugcaacagagaaaauguuuccaccaacucucaguugcaaaauucuaaacuccacagaagucucuucuuucacaguaccuuugggggucagaaguauugauucaagagggccucaacauugagguugugugcuggaaguuucagacuaccauugcuuugacccucagcuggaccaucacucugccugguccugaccccagagagacucuuccaagcaccucaggaggccacgcugcauguggaagcccacaaagaccuggaugccaucuagggugagggaaacagagggaggacacagaagagucugugugcuuuaugccauguuguaaaaacaaaugcacaugugcagaggagaacacagagaggacacaucccaaauguuuagcagagaucagccccacauguuagcggcaggacaguauguuugcuauugccaguuuuccuuugagccccucugucuuccagacuuuugugcuuagcaaugaucacuuuugaaauuuuuaaaaaauauuauuuuaaauaaauacuaccuggauuugaggccugaauccaacucauuuaccccucugagcuccauuuuccucaucuggaaaaugggguuaacacucucugcuucaucucccucauuugaauaugguacagauuagaggagagagagggaaaagugcucucuaaacugucaggcguaagccaugaggcagcagagguuauauugccuggcccacagugguagccaugcccagccucuuugcaaugggagcagugcccuaggccccuuucccuguggcuccuuucugaggacauguggacaaaaggaugcuucuuguuuaucauacacaaaagaacagggcacacuccaccauccaguguugagauccuaaaacacaacauguagacaagucuuaaguggggcugcuaagaugggagugucacuggugugaguggcggcuuucuauuuucuucugugucguccccagguccccuuugucugcugugaucugcagccuaauaagaggcggagaaaaggggcuuugcuugggcucucaacuggaagguggcuugugggcaggucuauagagccagguacccugcuggauacuggagagauuaauuugagcaggucacacaauuuuuuauuuaaacaaagaaccucuacuaagcugggaccaaacuaaugacuagugcucauggcaaaagucgaauuuaaguuuuguguuuauuuaggaaaugaauggauggauagaggagggagagaaagagagaucaaaaaaaauuuaaaagacaggcacacguucagggcugugauccaagcugagccuuuuauuugaguucugaauaaucuuuaauuccaugauugaauuaaauuagaagugaauuuagucuauuguggcuuugucuacuucccuuaaugcaugaugguguuugugugucuaacugcaggcuguggggcccggcucugggccuggagugagugagggcuuucugcuguguaauagcuauauuguauuucacccguggaccccaggcaauuuauuauagcuaacaccccaccccgcccccaacccugcuucaaucaagcaagccuccugugaaauuagauguuaaggcaggaacuuuuguagaaaaccagauaucaccagucuuucuuggccgcaaaggauucagcugaguuaaggaaaggggauuuuuaagaaggggugguuucauuuauuugugaaggccaacauaaugaaguuggagcagauucccagagaaugcuggaugaaaugaucaaaaggauuagagagaaggggaaagggcagaggaaggcuguguggggacuggauaaaaagaggccagcaagaugguaaagcaagagaggaugugaaggaagucuggaaggucccaaagggagagaggcugacuuuuccaucagaacuggacuacuggaaucaggggaguccuguucacacagcuggaaugagcucucugccagaugcaacgguuaagucagggcaaggacauaucuucccucccacaguuucccuuggugccucuagcagagguacaauuugaaacuaagaagucucuggacucugaccuguuuuuucccucagcauuucuuucuaaaaauuaucagacauacagaaaaauugaaagaauuauacagcgaacacccauguucccaucauguccauaauuagcauugguuuacuuacuugaucacaucucuaucuaacccucucuccaccccucaauccacuauacguuuugaugcauuucaaaguaaguugcaaagugacuccugcccauuuugacaguugaacaguagauugcaauggcauacaaagagacuuuguuguuacaugcauugcccugagaugucacaaguuucuccucaaaacuuuuuuuuuuucuccuugagacacggucucgcucugucacccagagugcagugacacaaucuuggcucgcugcaaccucgucugccucccaggcucaaaugauccucccaccucagccucccaaguagcuacaacuacaggugcccaccacuacacccggcuaauuguuuuuuuguuaguuuguuuuuuuuauuuuuguagaugaggucucacuauauugcuuaggcugucuugaacucaugagcucaagugauccuccugcuucagccucccaaaguguugcgauuacaggugugagccacugcaccuggccacccccagaacuuguuaccagucucuggagccccuucccuugaugcuuuuuacuuccaggcucucagauuccagcaucgccagggaucugggagcuaacaugagggaaugaaacagcugaagcugcccuggugugaggcuguggugagagccgaagugucuggagagcaccugcccccuagacagcaccugcccccuagagaggggcacccacugucaccuccagcccauugcuguugcaugagacucuggggucaguguugcccaaguuuaagaaaaaccagaaaugagggguuuuguauggaaucuuccacuuuuuaaauguuugcaaauaauguuuacacccugggcaaaaggguaucaaggacgacuccucguguauuuguuuucuauagcugccauaacaaguuaccauggaucuggaagcuuaaacaacacaaugcauaauguauucuuaccauuuuaaacaacauagagguauucuuacaguucuguaggucagaaauacaucaugcgugggucucaccaggcuaaaaucaaggugucaguggcaggguuaccuuccuuucugggaggcucuaggggaacguugcuugucuggguugaggacugaggcuccuguucccuggcugucuaucagcugccgacuguucccagcugcuaagagcugcccaucuuccugggcucacgacccuuuuccuccaucuugagagccagcaaccguggguggagucccucucguagcucaaaucucuacuucuucugucucaucuuuuaaugcagacagaaagguucucugcuuuuaaagaccccuugugauuacauugggaccaccuagauaauccuggcuccucaaacccaucuccagguccuuaaccucaaucaugucugcaaggcccccuuugcuacauaagguacacauguucacagguuccggggauuagggcauggccauccuugggggcugcuacucugcuuaccaugccugguuucuggcuggagacacaggugggcaguuguucuuucugagccugccugguccucagguucccucuucugggccugggaaaauucccuauccucccacaggagcugauguccucagccagagcucaccauguugguacaauuccugagacucccccuccugccuggauccuggccucccugcaggcaagggcaagagcauuuccugcaagagaaucacacugcccuacagcuacaaaucaagagauacggagacaaaagaacuugggauaugguauaaaaagacugaaguugaacucugguaucauuuauucauucagcaaauauuuauugaucacugugugccugauacugugcuaggcuaagcauaaaaauuucccucaucauggagcuuacauucuagggaagaagacagacaaguaaacacccagauaaaauacauaaagugcaaugaagaaaagcauaggguucuaggagauugaauagggcucagcaaacuuuuucuguaacgggccagauaguaaauguuacgggcuuugcgggccacauggggucucuauuuaauagucuacuuugauuuguauguuguuucguuuuguuaaaacucuaaaaguuagccugccaugguggcacccaccuguagucccagcuacucaggagacugaggugggaggaucauuugaauccaggaguuugaaacugcagugagcuacgauugcaccaccacacuccagccuggacaacagaguaagaccccauuucaaaaaaaaaaaaauguaaaagucauuuuagcuugagggucacacaaaaacaggcugccggauuuggccuucggaccauaguuuugacugaucccugggacggaguaucaggagggaccuaccuacagcuggggaaggaggggccaggaaagacuucugugaggaggcaaccuucaagcuaagauguggagauaugaggaacagccagccaggcagucaggugauguauguagcgggggcagguauggacagggaggucaggggaaccccugcucauauucgaggaaccaagaggaagcccuauuuuuuggugcuucuccaccucggcagguuccuucgccucauugagccucccucagcaucccuuccuccucgcaggcuugucuugaacauuaucugaaauccugucagguacugaaaccagguauggcaggcagaaugcugcuaccacccccuacgauguucagugcuucaagccccauuacaggggcagggcuguguuacacuguggagugccgcagcacugggaauuccaccuucuccuggccaccgccucugccuugagccucagcaccuucugugaaaugaggauagaagcccugccuugccugcucccuggggcucuggugaaaauuuggaugugaaaguggucugugaaugucagccucaugguugagagggcaagcucuggggugaguaccagguucagagccuacuguuucuaguugugugacugcauacauuucuacaccgucucugugcuucaggcucauuguguguaacauggggaagguaaucaugccuuccaugugggguucugucagugcugagugauaaggcagcgcucugugcagaugcaguguccccagcugcuggcaggaggggcagugggcagcucacagcugugcuucccacugggaauugcccuagacagccuugcugaagguuaugcccccucccaaugacuaauugaugcuuggauauaaaggccaggcugcuugucucacucuaggaccacuuagaaaggccuucucagcugcagaguuccugguaaaaugggccaggggcucacaugcagccacaugggugcagccucuuccucacuccucugccugucucaccucuuuacaggugaaucuccccagagugccucccaagaagccgucaaaaaacaauuuucaccucaagaucuguucccagggaacccaauaucuaccaguuauggaugugaauauuuugggguaaugauucucaaauuugagugggcaucaaagucacccagggagcuugauaaaauaaaaauugcugggccccacccugagaguuucugagucaaguggucugggguggccagagaauccgcauuucuaacaagaaccucucggugaugcuaccacuuucagaaucacuguuuuagaacucaguaaguugcugcccuccucuuauuccucuucugaacuaaagcuaaaucauagaguuuauugaaaugaaauugauaaaccuuauuucuguaaaauguuguggugugaccaaaucgacuugcuuagaaagaaaaaaugcaaggaucaaccauaaaauaaaauggaguccuagaaggagggaaaaaacaagauggaagauuagagauaaaagccagaaaucauuggauuacuugguuuuuggauuugacuugggaaccauguaaauauuuaauauaauuauaaaaacaagauuaagucaaaacuaaaugcagaaagcaaucccuaaaaauaaagagcuaaaugaaauaaaugagcccaauguaugugaguugguggccuaaccgugccucugagaggaauuguuucaagugacuuaaaaacauaaaaauuugacuguagauuccuaguuauauauaugcuagagacaaauaucuuaacuuuucuguaaucauacucuuagccauaauauugguauuguuuucugaaacuauuauauauuguagaaaaaagcaaauaaguagcuauauuaauguuaagaauuuauauuuuuagcaaaagagauacaauaaaaucagacaaagacauaacaacuauagaccagcgugccuuauaaguauugaugcaaaaauucucaacaaaauacuagcaaaccauauucagcaauauauaagaaaguuuauacacugugaccaaguaggauguugcaggaaugcaagacugguucaauauaugaaaaucaguguaaauacaucauauuaauaaaauaaaggacaaaacuuacauaaucaucucaguagaugcaaaaaaaaaaaaagccauuugacaaaauccaacacuucuuuuucgaggauuaaaacacucagcaaacuaggaauagaaaggaacugcuccaagcugauaaagugcaucugugaaaaacccacacuaacaucuuacuuacuggugagagacugaaagcuuuuccuccuaagaucaggaacaagauaaggaugugugcucuugccuuauguuuagcauuguacuggaguugccagccaagacaauuagacaagaaaaagacauaaaaagucaucuauauuggaaaggaauaaguaaaauuaccucuauuuguagaugacauuaucuuguaccuaagaaauucuaaggaguuuauacaaaauuauuagaacuaauaaaugugcucagcaagauugcaggauacaaaauuaauauacaaaaaucaauuguauuucuacacacuagcaaaaaaaaaaaccugaaaguaaaauauacauuuacuagccauuuuuccagagaagauguacaaauggccaauaggcauauggaaagauacucaacaucauuagucauuaaaccauaaggagauaccacuucacacucacuaggauagcuauaaucaaaaagauggacaauagcaagaauuggugaggauguggagaaacuggaaaucucauuucacauugcuggugggaaugugaaaugguguuaucacuuuggaaaaucauuugacaggucuuuacaaaguuaaaaauggaguuaccuuugacccagcaauccagcuguuugcuauguacccacagaauugaaaacaugucuacauaaaaacuugcacaugaauguucauauucauguuauucauaauagccaaaagggggaaacagcccaaauauccauuaauugaugaauagauaaauaaaauguggugaauucauacaaugggcuauuauucagcuaugaaaaagaaaugaagcauugaugcaugcuacaacauagaugaacuuugaaaacauuacaccaaguguggccagacacaaaaagccucaaauaugaauccauuuauauaaaauguccagguuaggaaaauccaugaacacagaaagcagauuagggauugcuagcagcuagcuggcaggaggggaagauggggaaugaccgcuaguacacacaggguuucuuuaggagugaugaaaauguuguggaauuagacagugguuauauuugcacaacucugugaauauauuaagaacuacuaaauuauaaaagaguaacuuuuaugguaugugaauuauaucucaauacaaaggagauacaauauaaaauuagaguucaguaaaacucaguaauucuauauguuaaauauaaaauuucugcuuaaacucauaauguauuguuuaaaauauauucauaccagccugggcaacuuggugaaaccuugucucuacaaaaaaauucaaaaauuagccaggcagaggguggcgugcaccuguagucccagcuacuugggaggcugaggugggauggcaugaaccugggagauggagguugcauugagccgagauugugucacugcacuccagccugggugacagauugagacccugucucaaaaaaauaaaaaauaaaauauauuuguaguucugaccacuggaaaggcauagaaacuauaaccaaccuaguaguaaggaacacccuuagugcucauguugcagcauccgaauggugauauugaugauaugaaggauuaaaaguucuuuggcagaauggcugauuccagguuagggcaggaaaugugugaguuaagccuggggaauauuuucguaucuuuuaucguaaaacaaagaagcuaucaguacucugaucauguccaaaggacucaggaaccaaccugagaagacuccuuuuggcuaaagauggguuuauuugggaaccaguaagaauaauaacugcauuugauugaaacacauuaauuauguuuccauuugugaguuaacauaauugaccaucguuggaggaugcuggggaaccagcucauucuaaagacuuguaaagaaucaagaacuuacccugccuuuccuauacuuuggggugaacgaauaguugaugugguaaaguuuucucuauagaagaauuucagcugguaaaugaagauggaguaauagaauuagaauguaaucguuuuucaaacuccugaugaaauaaaauauuuaggcaucgauuaucacaaaaggaaagacaacuggacacaaugugucuccuaagggaucccuguaccaccaccuuugaagaggcugucagaauagcuuauugaauuaggucaagcuuauagaucuaacuaccaguuuacaagaacuaaagggggacagacagaggaacaguuuaaaggauaccacagagaugcaagcagcaaaaugcagacugcagggacuccuauaagauaaauagcccaguuucuucaacaaacaaaucgaaggggaaaaaaaaaaaggagggcagaagcuuauguauaaaagagacuuaggagacgcaugagcuguaugcaguacguggaccuuguuuugauccuguauuaaacaaaccaacuauagaaagacguaacaucagggaaauuugcaaaccaacuagauguuugaugauauuaaggaacaauguuaauucuucuggguguuauaaugguaugaaagacgcacaaggggcagggccuuccaccccuaagcuuaccguggggcugguggagacuagagcccagggagagagaggaggggcugagccauugaagcccaguuuauucuuccaaacucauggauaaaucauuucuccuccauuggagaggaauguguaauaugaaaaaacaaacucacuguuuuuuccucucuguucacacaugcaacacagaauacuucugugaccaaauguguggggcagggaggggggcuccccgacaagcaauucuccagcaccagccugguguccugugauucaauucaauucugacacuaccuaccuggaguuagagucagaucccacagguaaagggauuggucccacaagauuaucccucacccccaaucuucagaugccauuugcaaauccagaccuuggguaauucugaccagccggcuguaaauuggugguuccccuccuuagauuugauuaucugccagagugucucacagaacucaggggaacacguuuaccaguuuauuaugaaggauauuagaaaggauacaaaugaacagccagaugaagagcugcauagggcagggucugugggaaggaccuccuacauucuuguggaggccucaucacauggcaugaucaauuaucaucaugaucuccagcuccuguccccuuccuggaggaugguggguuggggcugaaaguuccaagcuucuaauuauggcauguucuuucuggugaccaccccgccuccuggagcccaccaagagucaccucauuagaacaaaagaugccucugucacccagaaaacaccaagagauuuaggagcucugcaucaagaacuggggucaaagacgaaauauuagaacauaagauuuuccuagcacuccuuuugcuuaggaaaugacaaguuuuagaagcucugugccaggaaccagggacaaagaccaaagucuauaguucuuauuauaaaucacaauaucacagcuggacagagaggccagaguguuacuguagggcaguccuccacaugaaaucacaacuauucaaacucagggaggucuuuuauacauauccgcgugugcuguauaugcagagauuggagguaggacuuugggaugucauguagaaguuccugugugaccaagguaucccuggauuuugcucauucccuaaagacuggagaggaagugggguuugcaguuagccaaacccugugccugaguucucuuggcaggaggagagcugacccuguccucugccuccccuuauguuucccucuagcugcaacagcaagcgcuaccuggagacacuucccaacacaagcaucaucauccccuuccacaacgagggcugguccucccuccuccgcaccguccacagugugcucaaucgcucgccuccagagcuggucgccgagauuguacuggucgacgacuucagugaucgagguaggauccgucccacccagccucccacccucugugcuucaucuggcgacucaccaaagggauggcagguuuucccuucuuuagcagcaucaacauauaggccaucauuggcuaaaugccuggacguugcacugugcacacauuuucucauuuaaucuucacaacucaugaagugacugccauuuuuauccccugcauaucuguuuagaaauguauuaacugcaaaaaaaaaaaaaaaacagaaaacuugauaaacaauaacucaaacaaguguaaggauucauucacuuaucugucucuaucuauuuauuaaauauugcauaacaagagauccaggacugguacaacuggcugcucagcgcugucauccaagaaccaggcuguuucuuuguuucugcuuccucauccucauggucacaaaaugguaccucuggcaagucugccuuucaggcagggaaaaggguggagagcaaagggcacaaagccuucaucugucaagguuuugccuucuaauucaggaaaguguccuguagacucucagccagaucucugacaucugggcaccccuaucugcaaggaaggcagggaaugugaguguuuugguuuguggccucuuuggugaguuaggaaagggagaaguggauuagagaugucaaguaagcccagcugggauugcagugucuggcacaccauuuuacagaugagaaaacugagacccagagaaguuaagugacuuacccuuggucacacagcucucauguagucauguggugaccgaaccaugucuggccccaagcaugugaucuuagcuacauccagagccucuuagcugugagucuuacccuguggaauaacucagucucggguuuaagagacacagagauggggccaaaagugaaaucuaagaggaaauugcccuucagccaguggccucaagcuuauucuuugcaucaaagcuuucaccaauugcagcaaaauuaagagaagcccuuuccucugcucaccuucuugcagaggcacuaauaagcagugaagagagggaguaugcgugcacuccagaauaauugcagcugacaguuucaggagcggcucaccugcccaucgccccguuuuaauaccgcacucuuaauuacaugcguuuaguacagaggccucagagagacagagaggguguguguguguguguguguguguguguguuuguguguguguagacauuuaacucaguucuuacccggucuauaaagucuucccuaacucuugacauacacucauucucgugcuacccuuuacguuuccuuccuuuuccuuaccacuuaucacagguggaauuaaaauacauauuugugugaacauugguguguugugugccuccccuacuagacugucuauuuugauugcagggacuaccacauugguccuguucaccacugaucccagcuccuuaggcauacaguaggugcuuacuacguguuugaugaaccagagccugguucuccaguuuucuuaguacuuccacccuggaaguacuaacaguaagccuugagcacacuauaugagauuuaucuguguccacaaagcgaggccuaugagccugcugguggugggggugugccuuccucaucccauaguccugcuguuuggcagagagccuggcaauaucuauaucuuugauccuggcccugcuacauacuaucucugugaccuugacccagucacuuccccuuucugagcuuuaguucccucaucuauaaaaugggaucacaauaguaccuacgaccucuuagguggcugugacugucaaauuaguuaauagaugucuaucaagugcuuaggacaguaccuggcacagagugaacauuaaagauagacaucugagcuuguuaucauuucuguuguggacauuccuuaugguuggugugcaggaaggggagucagggaugaguauacagaggugcauguacaggacggaugugugggugcagguaugucuuuccuuucuguagggaagaagauuuuugcaaacuguaaaacacugagcaaacagucucuggucucaaccuccgccuaaaauaugucccugucccuucaccccucucuuuauaauagcagcccccauuuuggggagaagcucaauaugccaggcccauauauucucucauuuauucuugacagcagccucugagggaagccuuggggucccuccuuucagaugaggugcccaagcuaaguaauucgcccagaaucacaggccauggagcaguaccccuaggucuguggauucagcacccagacccuggguccucuucugccucuugcucccucucuucugcuuucuguuucccagucuccucucccagccucauccuucucccagcaugagcugccacccacaggccaagggcucacagcugggcagcagaaagggaaaaaaaugagcgaacugcucaagugauugauuuucugcagcauaaacagccuccaccaccuggggacaaacaccugagccuucccucagguacgggcugccugcucugagcaggcuccuuguuguacuccuucucagggccacagcaguggcagugagggcugcgcucacuuucucacacuccccaaagacccagccacagcagggcucucuguccuggagcacagcacacaccaugcucuguccugccuugggauccugugcccuuccucugccugaacgcccucuucccaguucuuccaauggcuggcucgccucaucccaucaucauuuaggcugcaccacuaccauuauucaccaugcugcaugcgcgguuacauggcuguuuguugagcuguuuauucauugucggucuucccccacuagaccacuuguggucuggaaggaggugauuaguaaauguuugugaaugagugaauagaugcaugaggagggagggaggaaauguauggcagcuacccaugcauacagaaaaccaucaccagcagcagggccaucuucauccagcaagacagauguggcuguggaagacacugcaguucuugcagugacuggugcuggcccgcaucuguguuuucaggcucgggucccuguauguaaccuguuuuucugaagcaccagcugcccugggguugggcuuguagcacucagcaggaucccccucuggguaucacagggcauccguccuucagacauggaauaaaccagaccucagccagauucaaaacaagcaucucuccuuguucaguuagaaaagaauuucaagaucaucuaggcccgugacuuugugccugcuccucagagcagcagaggccccagagaagucucaggaaacgcugugagaaguauggagaaccucacaggcacaugugggguucaggugccucuccugguguggucuguauuuacuuucugaaaaaguguucacuagggggaguuacacugcuaaaagaaguauaugaaaaccacuguguaacucaaccugcucauuuuacagaugggaagcccgaggccuggagcaguaggcagacuuaaccaggagcacacagccagcugguugcaagagagggacaagaccccauaucugggccacagugcagccuuguccccacucgccuugggugguuaagugacacaucugcagaaacacguuauuccuuucuauuuccaagggcacuucuuaauaaauuacuuucccauuguauuacggugcaaacuuuuugccgaaaagaauucauuaucaaacaugauuaguccugaccuauaaugguuuguaccucuaaauaucccaauuuccucaguguacauagugguaaagauaacagaauaacccccucccccaccaguaaaguauaacagucuugacaaagaaaagguacacuucauaacaagaucauucucuaagugcaucuguuucuccagagagcaaaaauauuaauucaauguggugccauacccaauccuaaaaagauagagaagaaaaauaauacugucccauuucacagaugagaaugaaaaccgaggcccccugaucacugcccccuuuucucaaccaauuaggcacccagcccagaggaggacucccaccucacacccuucagacuugcaccucagcugucauguuuugcagccugcauuuuucagaaaagcaaucauuauucuuguuucaagaagaaauucucaaggcagcuuuggaagaaaacuuacucagcagugauuguuuuaaaaacgagauuugggagaaacaauuucagaauuauggagaggccugucuaaaguacggcaaauauggaccauccuacaagauagauuucucugggcugcauuagcagaggcuguucucagagcugaaauucauagaugcuaacuacaagcuagauuggcacugccuaggagaaggcauuuuccucugaaaugaaucuccuccaggauccucagggcaacuaauuguaauucagcuaagggucgagaccucagguaggagacaaaauuggagcaaaugaauucucgaaauaagauccagagcuuugugcaggcagcaucaaggacucgaguggaagcagaagcugacaccagaauaauccuggcccugcuuacaaauagaacacugcacuuugccaggggucuccacaagcucuucaaaugcaugagcuuugcucgaggauuaggagaacauugagguguuuuugcacauguggaagggaaagaugggcguauaggcuggcagaccuguccccggguugcacugccuggguggcauguuuuuaugaggaaaaacaagagaggucuuguuaauuuguuuguuuuuauuccuuucuccuuagccucuccacuuucaaacaguguuguuuuuccagaaaaauuaguuaugugguaauggaaagaauuacuguguuuggauuaacuagaggcugcccggaaugaugagguacaaaagugacaggcuaugguaugaucucauugacagcauuuucuccagcucaacugccuuucuacaaacaaacacauguaggaaaugguucccagcagaaguucuuagcagguguuugcagagcuguugaaaaguuguugcagugauuggugcuggaaggaguauagacaaugcugggcccguuaguucacaugguagugagcucaccucacccaugaggccagggucaauaguccucuucccauaacgggcuuauuaacucugaccugcacucucacaccaugccagucaugggaacacaucacggaaauccauuuugccccaucccucuuugcauuucaacacaucacucuugacacugcccaauaaaccucuauuccccauuucuugucuucucuccagcagccuuaguuugcuucugacaccaccacaacuuguuagcauggccauuucccacuuacaguuuauugcuuggguucuuucgccuuuuugaguucuuuugcugcuuauuuuguuuuucucuacaucuguucugauuuaucaaaguaauucauauucauguauucagcaguauucaugacaugacucugugccacaugcuguacuuugugcuaugauauaagaggaaucaaauaggcuucccucgacagcuccaguaggccuagaggagguaaggggcaguuguaagaccgugagaccaugaaauacgugcuaccuggugaaaguccaggcaauguagaguacagagaacagcagggcagacuuucuggagaaaauuccagcgaaauuuaauccaaaguguuguagauauuacucccugggguuagggaagggaagaauguuccaggcagaaagagcaggacaagcacaggcugggagucgaggagaaaaugugggaaaugcaggaagagccauccauaaccuuaucacuuggaggcaauuaguauuaauauuuaggcuuuuugccccaguguuuuuucuuuuaauagaccuuauuuuuuagaacaguuuagguucccaacaaaacuaaguaaaaaguagguagguccauggccauacuacccugaacacacccaaucucaucugaaaguacagagaguuccccacugucaaaaucccauaccauagugguacauuuguuacaaucccugaacccacaucaauacaucacuuucuccuaaaauccauaguuuauauuaggguucacucugguguuguacauucuauggauuuggacaaguguaaaaugacauauaucuaccauaugacguauagcaucauacagaguaguuucacugcccuaaaaauccucugugcuccaccuguucaucccucccuuucccuaaacccuggcaaccaccaaucauuuuacugucacuguaguuuugcuuuuuccagaaugucauguaguuggaaucauacaguauauaaaaccuuuucagauuggcuucuuucacucacaaauaugcacuuaagauuccuccaugucuuuuuauggcuugauagcucauuucuuuuuagugcugaauaacauuccauugucuggguauaccacaguuuguuuauccauucaccuacugaaggacaucuuggcugcuuccgaguuuuggcaaauauuaguaaaacuacuaugaacauuuguguacaggauuuuguguggacauaaauuuucagcucacuuagguaaaugccaaggagugugauugcuggaucauuugguaagaguauauauaguuuuauaagaaacugccaaauugucuuccaaaguggcuguaccauuuugcauuuccaccugcaaugaaugagaguuccugcuguuccaccuccucgucagcauuugauauugucaguguuuuggauuuugucaauagcugcuuaguggucucucacuuuuauuuucacuugaauuuucuaaugacauaugauauagagcaucucuuuguaugccuaucugccauuuguaaauuuucuuuuuguucucaguguuuuauaauuucuguuuucuuuuuccuacccucccaauuccccuccagucccaccccacugaggaaauucauguuugcagucugguauguaucaucccagaccauucuguauaaucauacuaacauauaguaacauguaauaaaaagaacucauguuuaucgagcuucuacugugugcuaagugcauucacucuuuuauuaucacagcacuaugguagguucugucaugccuagugugaaaaccauacuggccucaaugauaucagaccucuucuuucuacuuauaaauuuaauauuuuugucccuauuuuacagaugaugaaacugggacacaaguaaguugcugauguguacuuagcucaaagagacagagcuuugauuuaaaaccauccauucugauucuagaaccuuuacuccuaagcuuuacaugcuuuuucccccauuuauuaggaucauacuguauacguuacuuuacaacuauuuuuuuaaaagacacauuuauucagcgucaugaucagacuauuacauuuagcaaucaacagcaugggugcaaaaaaaaaucaacauuaaaacccuuuguucgaaugcuuuacacuuuccacagaacagggacuaaaguaaccuguuauacaguuaaucacaaauacaguccuugaguuuuuugcccauacacaugaauauuugucuaaaacaugucuucuuuguagcagcugggcucugccaccauugugcuuggcugaguucacaaaucugauauaaccuguagcuuccccgucacuucucuggcuauccucuccugcuaagcuuuguuuucuugcaguaauuaaaaucuccugccacugccauggcuacugcugguacuagaacugccauaggcaccuugguuucaugguuuggcgaaguauuggccuccaucaccauagaggccagagcuucugccucuaaaguuuccucccuucauggguccaaaauuugaagacugauaguuguaauugccaaaaucauuguagcuuccaucaccuccagaaucgcuuccaucauuaccaaauccauuauagccauccccaccgccaccauauccaccaccaccauggcugccaccaaagccaccacaaccacugaaguuucauccaugaccaaaguugucauucccacuaaaaccaccuccacaaccaccaccaaaguuuccagagccacuucagccucuugggcuggaugaaacacuagguaucucuugcuuugacagggcuuuccuaacuuuacauuuguggccauucacaggaugguauuucugaaugacagucuuauccacggagucauggucgucaaagguuacaaaggcaaagccccuuuucuugccacugccucgaucagucaugauugcaaucacuucauuuuuccauacuguucaaaauaaucucuuaggugauguucuucagcaucuucuuuaaugccaccagcaaauaucuuuuucacaguugagugggcaccuggucuuugagaaucgccucuugagacagcucucuuugguucugcaacucuuccauccacuuuguguggccuugcauucauggcugcauccaucuucuccacgguggcauagguggcaaacccacagccccuggagugcuuggugcuuggaucucuccuuaccacacaaucucugaccauuccccauugcucaaaaugcucaaaaauuugaggcugagauuugagaccucaggcucucaucaguuguuucaaagcucaacccuccaaugaaaaguguccucagcugcucgggcucuuuagcagacucugacuuagacaugauggcagugggaggagacuuuaauggugcuuccucaguggcgcccaugggcagaaagcuacaauuuuuuuuuucuguuaauguaucacagccauccuucaggucaguaguagaaacagagcaaacccauuugucuuuuaauagcuagauaauauuccauagugggaaucuacauuuagucccuuuuuaugggcacuuugugaagugaacauuuaaucauaugcaacuuugcauccugguuucuuucacuuaacuuuuuacagucccuuccccuugucauugugaaaugacuacccaucucuucuucuuugagacaauggugacauagagacaggugucaagcaagaccagaauaucagcuguauuguugcagaggcugauccagagaacacaacaugaaucucuuuguaccccuuaucuucugaacugacugacccagggacaggcuuagcagguauggaaccauggccuugcuggcgggcagugucggccaauaagcauggcacaaggaggacagauaaagccagccgugcaggcacaaugacuguuuuuacuucagccugucuggccucaccuccacaaccucccuuagaggugaaauaguuucccacuaugaaaguacaagggcaggggaagugacuucuguuccagaugaugaagcugaggcuuggagagaugguugggagguggccucagcugcuuaccuacccucauaaucaucuccuccucauugggaaucacauugacagaagagauugaucauccccacaaugggcucaguaaucuuaagaaucccacaucucaaguaucagucuccagggugccuuaccacuaaggaaaucuacaggcuuucucgauucucuucuccuuucauaucuuugacauccuaaacgcuucucccucagacuccaaaggagagaacagcuaagaagauuaaaacuguuacagaauaucaauuaguuuauaaugagggaaaucuguaaaccuuuugguggacaucugguagaaacacaggaugcaagagucaauauaucuaugggauauuuugugcaucuuaaaaaaaaaaacccaggauuuugugaaucaaguacuguauaaaugauuuacugggagagcaaaaaaaaaaaaaucaaauaaaucgcucagauugcaucugaagaaucaaaagcuccaauguuuuggaaagaguuguuucuguaguggaaaauagcugcauuauauuuucagaaaggugaugcuucuauugacgugggugaaccuucuacauuuuaaaaacuuggugcaguaagagugugguaaaucacggauauucuccugauuuucuuaugaggauuaaagucuaaccuuuuccacuguuuuaguguuuccuuaaaaacauagugugggggaguaaaagccaauggaacacaagacuggggaaccuuggauaauauccccagggagagggcagaggaacugcccccuucugucauagucuuccuuaggaaagcuccugggccuuccugccagcugaggccggauguaaauucuuaucuacucaggguuugaagagagaugagauuugaggcugaaauaaaaguauuagguuggugcaaaagaaauugugguauuugccauuaccuuucauaggaaaagccacaguuacuuuugcaccaaccuaacaguagcuuccuuaauaacuaaccugcucuagugcacaccagccaaguccuauucccaucauucacauucucaagcucaguaaauggggagcugaaagugcucauuugccuguaucacagagggaaaaaaagcagugauagcaauaauaauaaugcgacacagcaccuauauagcacuuucuaugugccaggcacuguuguaagcgacuuaaauacauuauguuucacuuuauaggaagccucuuuauagacaacauuugccuaaaggaaaaauucacauuuaguagagcauucaaaccaaaauccaagagauuccccuucucugugugccccgccugcuaaauaaaacaaaaacuuuuaaauagugauaugaaauggcuccagcaugaccuuugauacaucucuauaugucuaauagguauguucuucuguuuucauuuauuauaaauccucuaaauaauguugguucuagcagguaaaugaagcacguuggccaaaaaguaggcauuaguucuaagcuacugccugacccaacccacgggcagccuccaaguaaacccauugcaaacagagauacuucagagcuucuucccaauuuccuuaaagaacuuccagccccugaagcuuucaagaacaucuuuaucagacaaccacaacuccagaguuaauuauguuuugauuugaaucuggaggcaccuuuagagcuguuuacaucagaggcuuaaaaugcuaccaauuuucauagccaaaaauaggcgacaguugacaacucuaaagaucaagaaggccaaauauacacauuuauauaucauuuauuuauuucaaauuuuuuuaaaaagaaaauuccaccacuguacauuaauauaguguucauggguauugaaaguuuaauuucuuuuuucccucuuuuucucuuguuuuacugucucaaauacugaaaucucaugaaaauggaauuuuuacaucauuauagagaacaaagaaauagacacguguuaaggccaaaguaacaucccuuccucucgugugauuuagugacauuaguuccuguaaaguauucacagaugcaggcugccuuuuccagccuuuggggauccucaauguucacucaguuccuucgccuaaaagacaaaaauguucauuccuccuaguauaauaauaaaauuauuuuaucugcuuacuuuauaaaugcagaccucuucagagaugcccaccuuauuuauaagcaaccaggaaucucaaaauaaccaauaacuuccugucaucuccuauuuguccuccauuccugggcuuguuaaugaaugagauuuauugggcauuguuaauaaucugcaaugaaggugaaagcagguggaauuauaaggcuaugcuuucuguccagucuucucagaaauugucuuuuuuuuccuauaugcugucagaacauaugguuuagaauauucuaaauaauaaccucacuccaggcucuguuaauagaaaacucaaacuaacaauuacuucccagagccuccacaccagcuagcagauuugucuuaaccaggcaagaggaaagacuagcccugacccuucacagcauucacguucuguugccauacgacagaacuugaacucaugaaggaaugaaaaugaccuguaaauagaccuucuuccugagcaaagugaugccgaauauucuuuguaguagacacaaaccccuguguccuugcccccuuuaggcugcagggggauggagaacguagucaggaugccagcuggguccuaaguccagaugugccucagaccagucccaccccguccuuuccccaucccaugagccaguacauucucuucuuauguaaacuagucagaguugauuuucugucaggacuaaccccaaagccauaaguacugucuucccuuuugcggguugggugaggacuggguaagguacugcaccgugacagggccgggcacauggucaucauuccuucagugguuguuguuaaugaugcuguuguuauggugaugcuuguuauuauuacuguuaccugaaaugcugcgcuacccugucuaccucaaagucucauuaugggaaugagaugaaauuaaaaaugcaagauuaaugagcuaaacgaugcaaugaggacguacaagagggugcugauuuucacagaaggagagaacccugaggagaacuuucuagucugguggccgagaaaaaugugaccuucaaagcagacauuccaaaccuggagugugccccugcggucuccaggucaucuggauucaagcaauggcucuuaacucuuauccuuaucagcaucgacugaagagcuuguuaaaugcagguuaccagggcccacccauaaagauacugauucggugguucuagggugggccucaggaaucuacauucuuaacagacaucucagauuauuuugauagaguugaaaagauccucguacuuuuggaaaacacaggauuccaggcauggcaggucacuaagugugcuuugugauagauuuggauagugaugucuuugaauguauacccugggucagcaaaaacgcauggcccuucuaggaggagauaaguuaagaugccuacagccuuggccagaccccuguuuuccaggaugucuuguccuaaauaauugccuugcuauaacaggccuguguggauuuauggucucacauuuaauuucagccgcuauucauuaauccugaugaucucacuuaaauuauuaaacagucauauauuccaauuuugagggcacuaauuauauccuugagaggcuguuauuauguggaugaucagauacacucagccaacacuaaacuguuuucuccucacucaucagaauuuuauacuuuuucaggauuuuuucaguugccacguguguuuuaugugacaagaucucagagcugaggaguuaugaaauaugagagcagagguucucaaauuuuggugugcauaagaaucaccugggaagaauguuuaacaugcagauuccccgggcccugugaguguccagguccucagucucgguggaguccaggaaucuguguuguaaccagcuuucugaggauugugaugcagccaguucugggacccugagcugagaaacucugccuucagauguuacugcugguagaagcucucaagagauauuugaugagaacaaauacugagugaugagaacaguccccucauuuuucaguagggaaacugacacccagagaggggaaagcucuccuucaaagccccacggcagagacacagcugacaucucuggcccauuguaaggaucaaaugagauaauagaugggaaagcacuuuggaaaguauucagcacucuauaaauacaaggaggcacuauuauuuucaaguugggccggccuugugacagaaauggcuuaguacuuucucucuaaauuaccauaaucaccuguuugaggccucaaccaagcccauaacucuaaauucacuaggcauggaauaaauuccuccugaaauguccaauaaaaaauauuuuauagaagaaugugcuugaggcccugccugguccucggucagaaauuuccuuuuuucuguugccucaucccaucaauucugggggguagauuacaucuccuccaaccucaggguaccugguuaaaaagcccuacuuuccagcauguggcccuucuugggacauauaaaacucacccaugaacauuuuugcccucaaaauccuuccucaauaugagcccacuucuaacaucuuuguggcuuuggacauaggaaagcugauaucagggcaccccaggucuuaguuccuuuaguucagaauacucacuggcucggguuugcugccaguguccuuugaggccaggucgcugauccugauggcugccucugugcuccuguguguguuuguccugcugugucaugauuaacuggauagcuaauucauauucauauuacauuagaaucacgcuccuugaaggguucaucagugggaugugcaucuaugcucaucuucccauggcucccuccagguuuuagaagacccuguuuguaucccaguccauaaguuccuuccacuacaaaauaaauuucuuucuuucuuucuuucuuuuuuuuuuuuuuuugagacagagucucacucugucugucgcccaggcugaaguacaguggcaugaucucggcucacugcagccuccaccuccuggguucaagugauucuccugccucagccuccugaguagcugggauuacaggcgcgcaccaccaugcccggcuaauuuuugcauuuuuaauagaaacaggguuucacuauguuggccaggauggucucgaucuccugaccuugugauccgcccaccuuggccucccaaagugcuaggauuacaggcaugagccacugcgccuggccaauacauuucuaaaaaagguggugguagacugaguucaagaacagauauuccgcuucuauucacauuucaaccuuuauuuuuaaauauuucuucuacacuccuacggauccuaucucuuggcgagcccuccacaugcaaaagcucaaguucagguauuugcaaguuacccacacacaaagucuauuuuuaaaucuagaagaaaucaaggcuuuccacugauauuagaaagccgaguuuucccaggcagcaugacuucagaguucagggaauuucugcacuguuuucaggaaucuucacccaaccuguacauuuuagagaugagaauauacauuuagggacuuccuaaagucauauggcuggguaaugacaagucgugcuccaccuucagggagcaccuauugcuggccaggcauagcccugacaagcugccaguccccuccaaaaaucaggcccacagucauagcccccgaguccaggcugucuguccccagugggcaugcugcagcagcagaacuguccacgugcucagaaggcaaaucugccagcagcagguauggacacuguaguuggguccuuuuuuguuccuuggcugacuuaauauaaugagccaaagaugcaucaaaacucauccuccccccacccccacauaugauugagggauaauugacaaguaaaaauuguguauauuuaagguguacaaugugaugaucugauauauauauacauugugaagucauaccacaaucaagcuaauuaauguguucaucaccucccauagcuaccuuuuuuguagugagaauauuuaagaucuauucuuuuagcaaacuucaaguacauaauacagcauuauuaacuauauucaccaugcugcacauuaggucuccagaacuuacucaucuuugaacugaaaguuuguacccuuugacccacaucucccuauuucccccacccggagccccuggaaaucaccauucugcucuguaacuaugaguucaacuuuuuuuagauuccucauaugagugagaucaugcgguauuuaucuugugugucuggccuauuucacuuagcauaauguccuccaaguucauccagguuguuacaagcagcaaauuuccaccuuuuuuuuuuuuuuuuuuuuuuuuaagaaagaguuucacucuguugcccaggcuggagugcagugccccagucauggcucacugcaaccuugacuucucugggcuccagcaauccucccaccucagccuccugaguagcugggacuacaggccugcaccacuacacccggcgaauuuuuuuuuuuuuuguauuuuuuguagagccaggguuucaccauguugcccaggcuagucuugaacucuggggcucaagugauccacccaccucagccacccaaagugccugggacuacaguugugcaccaccacacccgccuaauuuuuuuuuuuuuuuuuuuuuuuguauuuuuugaagagccaggguuucaccauguugccuaggcuggucuugaacuccugggcucaagugauccacccaccuuagccacccaaagugccugggauuacaggcaugagccaccaugccuggcuauuuccuucuuuuuuaaggcugaauaauauucgugugugcgugugugugugugugugugugugagauagauacacacacaccacauuuucuuuauucaucuguugguggacacuuagguuguuuccauaucuuggcuauugggaguaguacugcaaugaacauggcaguacagauaucucuuaaggauagugauuuuauucucuuuggauauauauccagaaaugagauugcuggaucauaugguaguucuguuuuuaacguuuugaggaaccuccauacuguuuuccauaauggcuguauggaaaauaugagccaaagcucauucucuaauaacauuucuugacuagugcauucaaguaucugcccugucuuaacauuuuagcuaauugcuaacacagcacaugcaguacauacuuucagcaggacugaacauuuuuagucaucuaacaaagacauuucaucucaugacaaguuuuuuggacauaccucaaugugcugugucuguagcuaacuuaauuacaggagccgccuuggcaguaccaggaaccaaauguuaugaccagcaacucuccuauagguaguacugcuuuuauaacaguguaaaucacaguugugccaauuuuuuuuuuaaagaagcuaaauggaagauuuaaaccuuaaguuguuugggcuuugaauccuuguguucuuagaacacaagcuuuagucagacagcagacuuugagcuaguacuuaaccucucugugccugauugaguaaaacugggcuacuuucucagaguuuuauagauuaauugagauauuuuguguagagagcuuagaacaguggcuggcucagagcaucuaucaaccuugauaccaucauauuccuugcuaggaaauucuguguuuauucaucccuucuuuuucuuucauccuccuuucuaguuccacauugaagaucccaaacuuaaaccaucauuaauaauaauauaugagaacaguaauaaaugucaccauuuauuaacaccuaaugugugccaagaucuguucauuuaugaucucaccgaguccugugagguuggcauuguugucuggcauugucugauauacaacagugccaaccucacaggacucagugaggugaaacugaggauuaggaagguguaaacuggacaagcgcauggcagagucagaauccaaacucaaauuuauuuggaucaagagugauacacuauuaugcacuacuuccuguuaccuccuauguggugauaggaauaacuuauaaggauuuuuuuuuuuuuagacaggaucuugcucugucauucagguugaagugcaaugaugcaaccauagcccacugcagccucaaacuccugggcucaagcagucauccuaccucgccucccaaguaacugggacuauaggcaugcaccaccacacccagcuaauuuuuaauuuuuaguagagacaaggucucgcuguguugcccaggcuggucucaaauuccugagcccaagugauccucccgccucugccucccaaggugcugggauuacaggcgugagccaccaccacacccagucuacuucuaaggauuuaaugccuuauguuuucuucauuuauuucucauagaaccauucacucuuagcacuuugacuuugaaaaucagggaccagguugagccagacaaaauauucaccuauaaggagaaggaaugaaaaaccagacauuuuucuacuuggcuaucaauccccaaguuugauuugcugagaauuuuuuccccucuaaaauagagucugauuuucuuucccuucaaccuucaugucacuggaaaauuuuaaauuuaaauagauccuaaggggguggcucaaggcucucauugaagguuuauuaucugcuggaaggcuguaauguaauugcaagguaucauuuaaagagcugucugucugugugaaccaccuuguucugaauaccuguuccugcauagagccagaagauguacauuuauuuaucaguggugguucauagcugccuuagaucaaucguauuauucuuccuccacggcucaagccccaaaauaaauggcuugugauguacagagcguugaaaucauuuguauaucaucagucauuuguuucucuucugucauuugcauuuugauggacagccauauguuugggggauuucauuuuuauuacagccuuuggucacauuguccauuuguaauaccaucuuagauauuaauuaccccaauuagagaaggcccuuucaaauauuacaucaccuccaagucgcgcuauucauaccauaaagcuauaaaugccaacuauuguuuuauucuuccuuuuugacaccugcuucucuauggagagguauucuuucccagaguuugucaucagugauaagagaaaauaucuuuguguagagggguagggaauuauuguuuuuccuccauaaauaccucaucaauucaguggcauuguggaguagaacauccauuagugacuuuucuagguguugguaugagaacaaguagacaagcuuugguuccagcccuaccaguaaauaaauagcuuugugaucuugagcaaauuacaucacuucuuugugcuucagugucugcaucuacaaaguauggaugacuucuaagaucuugucaagcuuuaaauccuaggacccuaugaugacuuucuucaccucuucccuagaguuuaagaguuauaaauugauaacuuuucaaugucuuaauaucaguuauaucuuuuucuaaaucuucucccuuacugcaaacucuuagaugauguuuacuucuugucaccuccagugugucugucccuagaaggcuuguacgcuuucuaauuugccauuucaauucagcuggaauaagaaacccaguuauuaguuuuucaaguauuaucuaaaguacggguuaaauagauccuaaggggguggcucaaggcucucacuugagguuagacuuuaugagccauguuuaaguggccacagagacagcgaacccuuuauuuauauuauuuuaaauaaaaauaaucaggaaaggcuuccuagauaggugucauugccuaguaaaggagguuccuugggcuaagggaacagcauaagcaaaagcacugaggcaggauggucucucagcaguccugagcagugauugucaggaggcuguaccuccugaguuacuguaccucuguccucccugcugagccuggagaucauuuccugauccccaaggagacccauaaucugacaaagauuccagguagaaaaaguagucugggaguuguaauuuaaauucugaaauaucagaauuuccagacauuuaaaaaauuucuccgggcaagguggugugugccuguaguccuagcuacuccggaggcugaggcaggagaauagcuugagcccaggaguuuggggcuuuagugcacuaugcugaucggguaucugcacuaaguuuggcaucaauaaggugaccuccuaggagcaggggaccaccaaguugccuaaagaggagggaaccagccugauuggaaacaaagcaggucaaaacuccugugcugaucaguagugggauugugcuuaugaauagccacugcacuccagccuaggcaacauagcaagaccccaucucugaaaaaaaaaaauuuuuuuuagcuuucaguauguuaguguuuaugagucagugggaacagacuauuugaaauuagagcugagaccaguaaugcaggaugucuggucaccgugguuaucaguuauagaagaaccauaagcccuggucccuccugaauuccaggagcuguguugucuguuacaguagccacuagccacacauggcuauucacauuuaaauuaaaauucaauaaaauuaaaacguuaguuccucagucacacaagccacauuucacaugcucaauagccguauguaacugagacagcacagauacagaucaucacagaaaauucugucggacagcccuacucuagagacaaguguggaacacaugacacagccgugaacauuuagucccuggcugcucugccuaugcaguagccauuuuuuuguuucuuuacuucucuaauaaaguugcuuuccuuuaaaaaaaaaaaaauguaguccccauagaacuggagacacugagaaugggguaggggccagugguuguucuauaaugucaggacuugcucuguucuucagcauggcuggggcauggugcaggauccuggguccgcaguccacagcucaaacauccauugcaaccagugcaggaaaauaaacucacuccuacucugcuagugggaguauaaauugacaggccaaauuggcaguuuguaucaaaacaccuuaaauaugagcauauccuuugaucuagcaauuccaucucuagagauuuuucuaaggagacaaucaaagauaguuaaauagauguaugugcaggguuauucaccauaaugcugcuuaucauacaaaaaccaauggaaguagccaguagcaugcugguaaaaguuaacaacaagcuggaguaaaggggaggagcccugauuuguugcauuugcugauuucuguggcguaaaaacucccaccuuggcugauuucaagcuaccaauggaacagagcugggaagagauguucacaguugcuucuugugagccugugcaagcucgcucccgcacaccgcuagcaaauagucuaagugucugaaaaaaggagaccaaguaaguaaaucgugguagaaaauuccaugaagccauuaaaaauaugcuguaagccggugguucuuaaacuugaggguacaccagaaucaccaggagggcucguuaaaaccugguuugcuggguccccccacuuguaguuucugauucagcaggucaagucuggcugagaacuugcauuucuaacaaguucccaggaaaugcugugagaacuacuguuguagaagaaacuuugaugacaugauaauuaccaaaaauaucccauuuugugaguauguauguauguaugaaaauaauagcuacacugauugaauuuguauaaugugacaagugcuaugccaaucaauugaugugcauuaccuuguuuauuccucauuacugugaagaaaauaauguuauuguuauccccauuuugcauacaaagaaacugagauuuagagaagugaggaaucuucucccacacaucuagugggaugugagacaggauuugaacuuggcagcugaccugagggccugcccucaaaccacucuagugugcagccuuguguccacucaucuggagcucaccuggggcucaccuaaggcagugccacacugaaacacaaccaaauacccaugguuauuucuaggugauagaaucacagaagauuucuguguuuuacugcuugcuuuuauguguuuuccaaauuuucuacaaugcaauauuuuuauaaucagaaaaaauauccaacauaguaaacaugauaaauuggaaaggccauugugacuuugguucacugugcacacaccuuguuccuggcuccuuugguuugaguggcuuccgcucgucuguaacccacaguccagauugacuuugcucagccacuagcauccguucacuuuagacuuuaugaaguuuucacuuuggguaccuuaccugauccccacagcaauccuauggguuuggccaucugacugcuuccacuuuauaaaugaggcaacugagacuuuaauaaaggaaaaugacuugccugagguuacacaccuaaguagaguuauuucccuucaguuaugacucauuuauuuucugguuccugcuccuaguucacaguguaauucaauggcuaccauuuauugaacacuuacugugugccagguauuuuacuuacugcauuuuaacuuugcaacaaccccaacaggaagacauuaucaucaccuuuuuagaggugaaaaugagaaucagaaaggcugugugccguguacagggaugcacagccaguugaugauuccaaagcccauugauucacuuagggaauauuuaugaaauacccacucuguaucuguuuaccagauaccugaguuucuagcauuggccauuccuggccugacucugcacccagcacccugaccugggccucagggacuguucccaggcagggcucacaagggaaggcucccucagccacccccggcuccagcuacucuuccacaccccaaacucaacacggcccacuggugggaauaacugagugcugacagccccucugcaaguggacauaaaguucaccuguuuaauuuggguuuccaccuggggauccuggcccuagauaaagugcuuacuaugucccagguguaguucuaagugaguuacccucacaucucaguaauucuucacagcagccuuguaagggagguauaauauuauccccauuuugcccaugaaaacccugcagcugggagagguuaaguaauuggcccaagaucgcacagcuaguaaacggaagcugggagcuucccugggcugggugggccccagguaccuaccacugcuuucuaccaucuugcccccagaggucuugccugucauucaggaagagaggaauuggccuuggaccugucccuguccugugccauuuuugaaaauuuugucagcugcauguuuguucaugcagaggcccauuuaguagugugugaugcuacagagcccuuuaaauuguguuaauugagcaaagccuuuugguuuaagaaaccuugaccaccccgcggucuugcaucgggacauggcuauggcagggaagaaauuuucacagggcgcccaacucagguggacaaagaugcaaacuuuuuacauagaaugcaauuuccuucugucucaagcucugugucauccgaaggugaacuuggauccaggaauccucaccagcucugaccucuucuccccuccucucugauaacugcccacuccccaaguccagaagaguuugcaguccagggcacggaugaggccucggagggcugguuacuuacucagcagauguuccuccacacggauugcugugucaggaccuugguuuuugcugaaaacuuuuguuuguuuuguuuucugauguugauuauggcuuucaucucugagggcaguggaguucaaggugaauucuguuuauguuuuggguugugguggagcuagugaagccgcaauuaugagcgaaaacagauugcaaugacaccaccccccgcaaaacgaccuucuaaauaucauccuaccauacucaauuuaaucauuaccaaccccuggcuaagcuucucacaggggaaacacuuuccacgccacccagaggaguggagcaaagcugcaaaaaggacuuucguccucagcaccccaccuuccaaggggagcacagcuccuuggagucacuguggccagugggaaggaaugagcaacgucccucaggcgcauuggguggaagggagggcuagaccacugagcugggcugucugugucuuucucugccgagcccuugccacaaaccaggccuugggcuagacuuuagggauacccugaugaacaagaagacaugggcccugcccugagggccugagauucuauggcaaaaugaagucuaugcugugagagaauaggcaacaggcaguggaaguucggagaagagugauucauucccucucacuuuuccuccuggcaaauccuguucauccuucuggaccaaacucaagaguccccuccucugugaugccuuccccaucucuuguccucagacagccuuaccucccucuucccccuuccugacucccagcucuuauguggcaccugcccuuguacuuccaugcugacccucccauagaccaugucuuaguuacuucugugucccaguacucgccacaaugccagaugcauagcgacaucauuaaguguugaauuaaugaauagguaugagagcaccuuugaguacuugaaucgcaacccaccaguacucuguauucuaaccuaccauucccuagcauugugagauacugugggcugggacgugcuauaagggugucacaaguaauuuugugaccguuccaaaagcaucaguguuugugaaugacuuacuuuuaucuuacaaauuagaucaaauguaugguuauucuuugucauacuuaagccuguguccucuagaaaacagagacuaaggcaggauuaagucacugacaguuuauuuggggaaggggagugugagccugagacagcgauggugaggauaaaagggaaagugauucaggaaacuucaaggggugaugacugcagcuuucucuucacaguagugccaacacccagcagguaugcucuugcagcaugggggcacugcuucaguagcucaccagggggaacagcaucucagaggaguccguagacagagagaaaaggaaguuuuucuaccugauugucucucaucuccugcuucccauuggucauagucccaacugacuucccaguugugucauccaguucugugguggcuacucagaaagccccaucccaugccccaguguagugugauguuucaucugagucucccugugaccugauucaggugagaugcuggggcauucggguggggggguaucguuggggagaggagacaguuaaggacauuacagaaggcacacaucuuugugucuaguacgucuuuauaucaugacacucacacaucugcuguacccugugcuuuacugggugggagaaaaagagaugccauuguagcucuuauagccccaggcauggaaacuguacgugacccuggguauauccgugugauccugucacuccgugaacaucaucagucauauguguuuucaucucagcuccaaguccaugugauaaauuggauauugcuuuugcuuaucuaauucucauugccccagccagacugucaagucguugugguacuguuugugcaucguacugaauuaugacauccacaugauagauguagaaugccccuuugaaauguaucgcacacacucugucugucuugcacgcuguagagcuggggugggacagaugagggguggaugcugcugcaggacagggcucaguaucugcccucccaaggucaggccugacauugcuaggagacagaggcacggggccccaccuuccuguccaaccucccuuccugcuccuccccccucacccucucucaucaucacacaugcuuucaugacccaaugcauaucuguuuaucugccuccugacagucccacuaguccuagaggcccagggcaaucaggcccucugccuucugagaaggcuucucugauacucuggcccagcccucucuucccuggagguccuggagcuugaaugguuggccucucguuauuugcucccccucccauuccgggccuggcccugccucucaagcucaggagggagccaaggaagggccagggccagguccagcgggaguaggcaugccuuagagcucacuggugaugucagcacucgccaaaaaaugacauguuugaggcagcagcugccauugcaugucaaagaaagaagugauuuuuuugguauccuauuuauggagaaucucugacaccaguauuacuucucucccgauuaguaaauuuguuugcucccauuuugcaguugagauaucugacaugcuggggcuaagugacaaaacacaucagccugccuccaggcaccauccaucauuugcacucucacuacauccagugaacacauuuuagagaugaggacauugacgcucaggaaggauacaugaguaggcuaaggucacauggcaaguuugagguaaggcucaccuuaccuggaagcuaggucuacaccaaggcaccuaccuuccacucuguaccucccagccccucccucuuccaggucauagaccgaguaccuggcugccacugucagacauuuggcuccaugacagagagagccuucauuuccugaaagccucuguuuugguauuuagaaugggaaugaauucucaaauugaauucauuucaucuucaguggaaucagaaaggugucuccagcuaaaaagauuaugucugcaauuacagaucugccgacugcaucaacucccucucccuuugugugcuagagacccuucagcauacgcagcucugggaugaugccaggauuccauuuggagacuucugcacccguugcuuuugugucuucccaucugcaugugagaggaaauacauagggaacucuuaaaaguugaugcuuauuuuggggaaagcaaggagacagugaagcaggguacugugagggcuggggguuggguaugagaaaggcucugggagagggaucugagguguggcagggcugggggagggagccucaagucucaggccugucugccacaaacuugcugguggcccaggaagcccugcccucucugauucauaauuucaccaucugugauaugaagagaauggcuuacauuugugcuuuucaagcuuuuuuccuuuuuucaauaguaaaaacguuuuucaaaauaaaucuuacccaggagccucauguagaaaaaauuguaaaggaugccuacucccccugaaggugggagaagggagacccugggagaaccugggcugcacuccagggcuccaggguguacagggugcaaaccagugaccugugcacuuucuaaggucccucauuagggaggaagggccagcagagcugggcccagauaaagagggcuacagaggccaaaccaacaaggaccuuggguuuugagggacccguuaucaugccuuagaccagugcuucucaaaugaggguucacugcacccaagagguagacaggaauuuuaccuuuuuauuuugauuuuuagugucuuaaaagauucuuuuaccaacuaugauacuccucuuuguagugaaaauucacaauuaaaagacagaaacuuugguuucuuugauuaguauuucuuagauacauucccggguauguuuauagaagaggccacagauuuuuuuugcuuuuaaaggggacugcuuauuacuuacauuugggaaacauuggcucagcccaucccagaaaaacugccaagugagcaaauuuugguaguaaggaggguuugguguaagggaacuaccgggaaacaacagccugcaaagaugauugcaaggcagggguuaagugcaggaaagccaaggcuacagauggggauguauaucugggcccauuccuaugaaauauggaaaccaagcaacacgucucuaacuauagguauguauguggauuuuuuaaugcuuggaaguauauauauaucaaaauguuaauaguggucugggugguagaauuacaggugguuuuuauugucuucuuuuuuccaauccauuaaaugccuuuggucuuagagaacuccauuuggugaauuacuccuccuuugcucuaggucauaaacuucuggcuuugaagaguuuauguuccuuucaaggugcuggaaacagccccaucaaccuccuuauuuggccuucaaaauaauuuuuuaaaaucugauugaauugccaauauugagaacucccauaaaaaucugcuucuccaguucuccugauaucaucucugagaccucauucccacgaggccacagguggguuugcaggcuucccuauggcccauuucccacauaugccuuagcugccuggcgcuggaagugugugagccccucuucugcucucaggacucccaacccuccaaccugggggcccguuaagcaucccacaggggccgcucccugugugagcugagauggacauuugacuuacccaaggcucagcgugcuccacaauuucuucaugggaaggguuuagggaugacaacugcguggaagagagggcuuugcagaguacuuuacauaaaaugaauagggaaagaaaaccccagaauggucaggcaggaccucuucugacuacauccucauuaauugcugaauauuacacaaaaaacaucagugagguauugguaccucuacccggcaguucacauuucugaaaaggccaaguggaaaacacucuuuaccauuuuucucccuaaauaaagcccauggaacacugggagggaauuguguguagcacaauuggaggccucgucugaucuugauaaggggaaggaaugggauuugaaauguucugcauggggggacgugucucuaguaaaugcaaauugggaaaguggggucuccuugggggcuccaaggcuggugccauuucuccuggcuuagaguaacaacaacaauaauaacaaucaccaccaacaaguguaaauguuggucugucucaguuacugggccugcugagcauucuguuaucaccuuauaucauccuaacacccagugaaaaacacuucuauuauuauucccacuuugcagauaaggaaacugaagcuuagagaaauuuaaguaacuuagcagagcuugcuggucuguuggaaaaguagacauuccacuuaagucuggcugcucuuagagccucucucccacacauagagccucucucccacacacugugcuaccucccacuccuccugugugcccucuuccacuuucaccacugccaguaaugacggugcucccacucucugcaucuuuaagccaccuucaguacaaacauccugccuggcaagcaggagagggauuacugccccauucaacagacacgacgcugagggccagggcaggaaagugaccuuuguggggucgcauggcuaguccucauccuaacugcucagagcauucucaggacacucuccccacugaucauggccagggcuucccaaacagucacgguccuucagaacuuguuuucacaaaccccugccucauugaauaugccuucgucagaguguuguauuauuuuuuccccuguuuucugccuguguguguaugagccuuugccacaagagccuuauuaaucauucgguguugaagguuaccaagaaaaauaugccagagugugacaggccauuaguauuuguguuguaaggaaaccaguaaucaucuuaauuggugcacauuuuggagcggaguggggcuuucuccugaagggcugucuccuccuucauguaccauuaacgccaugguaaacgcacccuccuaaccacagccauccgcagaggcagcuuuuugcuagagccucauuuugccccugaaaucuugggcugugugaguuaaacaagcccucuccacucagaccagcugggcaggaguguuugacccuagagagauuuaugaggucgguggagcaguccugccucuggccccagggaauucaugcucagcccgauuuugauggugaccagacgugccuccuaaaacacaagguggcccuggaggccuggggaggagagugcagucuacccacuuggccccuucuucccggcccugagucagugaccuucaccuaaauccuaaaaggacucuguuucuuucuuuaaaaaaaaaaaaaaaagagagagagagaaaagaaaaaacacuuccuuuuuaaaaacuuguaaauccuauauccuuuccccaucacccuaccagagauucuuggggggccaggguauggcuuccucuuugacaagggccauccuuuugugugucaccacaagccaagauuuugaccagcucuaaaaguagagcuggaggccugucuaguuuguguuaugaaaacaguaguuauuuuucuaaguauuuuauuauaucaaguaugccauuuaaaauacagcuucacuucucacucuaccccaucuucccucccaagauucuucucaccauucuaaauaggaacugcuugguggugggacuaaaauugggaaagccacuucagagggcaauuuggaaguaucaaaaaaauuuuaaugugcauauucuauaauccaggaauccuacuucucagugucuauccuggagaauucuucacuauuuacaccaugagcauacguaaagaugcucacugcagcacuguuuguaauaguaccaaauuagaagaaaccucaguauucaucaguaggcuaagggaaauaagcaaugccauaucucuaauauggaauaugaugaaucuauuaaaaacuaugcacugggcugggugcgguggcucacaccuguaaucccagcacuuugggaggcugaggcaggcggaucacuugaggucaggaguucgaaaccagccuggccaacauggugaaacccugucucuacuaaaaauacaaaaauuuagccgggcaugguggcacaugccuguaaucccaacuacuugggaggcugaggcaggagaaucacuugaauccggaaggcggagguugcagugagccacgauugcgccacugcauuccagccugggugacaagagcaaaacuccaucuaaaaaaaaaaaaaaaacaaaacaaaaccgcacuggauccacaugacauaagcagagcucuaagauguauuauaaagugaaaaaaaagcaaguugcacaaccacuuauauaauacagcacagaauacaaccaauaccauaucuuuucagugucaaguauauguguguaaacauauagaaaaagacacagaaggauauauuccgaagucccaacagugguuaccuaugagacaggggagccaaaccagauuaaagaucauggucaaaagaaacuucacccuuuuuuguauuuauaauguuuuauuuccuuucacaaggagaauauguuuauguauuucucauuuaauuaaaaaacaauacuaucuuggagaaaagaaagugguugauccaagaauuuauuuccugaaauguuuuagagauuuaacaucuuccccucccagcuggagauuugugucuuaauccuuuauaggcuaaauuuuuguuucucagcaaagccuauauuugauacucacacauacuuaagaaaugcacccuuuuaauugaaagaaauuauaaauuguuuauuaaaaagauuuaucauuagagagaauauaugggacucuuaauucccuguguacucagauguuuuaaaacucuguaucuuuccauggguuguuuuuuccuaucuagaauguccacccuggugagcuucacugaaacucugcuuaggagaccuccacugcccuuggucccccucuccaaaguuaauccuuuccuagagagcugcugcugaucuuugcauaugcuuccacuaugaaaggaaagcacaguaguuaggagcacaggcucuggagucaacccggccuggauucagucccugcucugucacuuaccagcaaugauaagauccuccaacucuccaaaccucgauuuucucauuucuaaaauggggaucacagucccaccuuguaaaaucaucaagggcauuaagggagauaauacauggaagaugcuuagcacaugccuggugcagaguacacucuuacuaugugucagcuguucauguucucauugcagaaaugucuuccucggacccgaacuugguuacuugguuucugaucggcucauaucaucccugaaaaauacuggaggcucaguuaaauguuauuuuguacugaacugugcagugaggaauaaggaaggaugaccuuuugguccauaaggauuuucugcuaaaagaacgugaaagccuuaacagaccauagguauuaaaagaggccaucuagacaguggguuaauuggugguguuuaauuuauguuuacauaucugauuuucaacaauuucuaacaugagcaccuauuaauaugacuuguauaauuucuuaaugccccccagaggaggacagcggugacccacaagaaucggguaaccagugguggaaggucaggcacugugacagacucaaauggaauagguacugaggagccauguggcauugcuggcaagacucacaucacaccaccuggcuucugggugaugugggucaucuauggcuccacccagacagccaucugggucccugaaugggaacaagaugccucuccagggcugagagucuuuugccacagcauguccaggccagugcuccuuguuugcuuuugagcuuaugauaccccaaauauaagaagcuccuucuguucaaacugggcaccccagcaggaggugaaaaguaucccccucauuccaacaauggacacugggaugugugcauguguuuguucauguuuguguuugagccugugcuaacaaaucgaauaccugggcaucgagcagcucauacauaaccagaggaccaaacagucuuucuguccaucacuggucuggguucagaaugcauagaccucccagcccacguugccucacauacaccacauuguggaguucucucggaggcagcauucagugugcuuucaggccuuugacaaauuaaacauucaaaaguaaaaauugcucacugcuaggguagggggaaaauuacagggguagauaaaacaggcuagagcuuaugaaaagaaaaccacagucucucuacgcuaauuacuaaugcaucucagaaggagcucagagguuaaaggacuaaguccuuagcuggauuuucaccauucuuagaaccaauugcagagaggcauagcaucuuggaacugugaaaugauacaauuccaaugcuggaggggggucuucgaggcuacacaguucaacuauuucuccaauauuugagucuuuuuuaugguuagcauaguaaguuucaccuaugauugaauucuuccggugauggacaacucacugucuuaugagcuaucccauucuuuugugagacagcucuucuuaucagaaggcuuuuuccuuacauggagcugaacucuagcucucugcaaaguauaucuucugguucuagucuugucuucuggaggcagagagcauggugucagggcgagggcauaagcuguugaaucacagagcccaguguucuaaccuaccaaccguccacuugggcagaagaacucucucccaaccucagucuuuguaucagucaaaguggggcuaccucccuggcuucaguuaauuugaagauaaagugagauagugaaaagaaaaaggacaugcuagagcuacauguacuguuauagaaagaugauuuuggcauauugucaacuggacaaaacagguuucagaagaaauaagcauaagaagauugggauauugggugagaaauagagcaaacuuaagaguggccaucucuggugggugugacuagcacagcuugucacucagauguuacauucugccaugaugguuaaaacauuuuuuuucaaaaaugcaucauauuuagaaucacaaaaaaauagucaagacuuuccauuuuagaaagaaaaagaugaaauauccagaauauuuuauguccaaaaauggagaccaccuguaucaauuuuggugugucuuucccugcaggacgucugaaucuucaaggcauauccugaaaggauuuugugccagcguuuaucugaaaaaaaaaaaaaaaaaaaaaaaaaaaaaggcuccaaacaucuaacaacaaugacaaaaucagugacugcuuuagguccugcccagucugccucagggccuuugcauuugcugcaugugugauauuaacagggugggcacaccugaaacacaaccauccacaaacacacuugcaugugacgggcagagauguuaaguggggagagagguuugagugggaacuucaugaguggucauuuuauugauaaauauccugcccagaugauagcauuugcuuccugacgcuaccuccuauguuuggagacucacaaguguaccugagugacaaggccucccaaacaugcuuuauaucuuccccugggugacauguugagucuuuggaagcacauuggguauauggauuuuauaaaauaaaagcagcaaaugacaagcaaaauauguuaaguuaugaucgaacaucugugugccccuacaguaugccaggugcugugaggaaaaucaaucacucugaguccugcccucaagaagcuugugccaagcagaucgacacaagucccaaaucagaacaugcagaugaugcuucaggagcacuuugcgcugagccuggggagaagaauagaauaggauuccuggagacagagaagcagacaaggaugcucugagcugacagauuugcaagaguaaaagagugaaagcaaggaaauuagucgagcagugucugcagagaaugcaccaggggcagggcugagaugagagaugguucuggaaagguugguucuggccauccugagaagccugaacugucaccauaugacaucaguagaccugugcuguagcaccgguagugugaaugagaugagaggugagggauuagauaccagaagaccugugcauaucagauuagucucugguaggggacauuucuguaaguggcagaagaucccaaugcagaagcagaaggaagaggcccugaaugggagguuucaaaauauuugguguuggauuggguugggguguuuugcauggggagggggcaguggugguugaaggaggucguaaggaaaguuccgacauauguucaguuuucucuuccugugcacugagcaggaaaacuucccccaggagaauacuuuugcccuuuaacaaauaugaaacugacaggccaacacuguugcugaaguggaaggauuuuuuuuucuuuuuuaauaacaccuuaaacgauagucauggaagccggcauccuaaaugaaauacauguugcucuccgacaccugacaaccugacauaauuuaagagcagcuaccagaagcccacaacuggaauugcccaugaaucugcucuccuguauaggcuccaacugggugaaaaagugaagugggcugaguccaaagggccuggucuucucuucuuauuuguagcugauugguggggagucacuuucagaaaacagaggaggcuguaauuaacuugauaggggugguuucuggaguguuuuuauucgucgucugauuauuaaacagauuuauggcccugcccacugcugaaaagggaccaaggcauuuaguugaaauuaaaagugcagacagggcugccuguuuagauaauagcaucucuuuuuuaauagauuacucaucuucugcaaaauaggagagaggaguuaauuugugugaugaagugcuuucuauuucugggagcuggcugguggaugugacugcuugaagaaggagaauaauucauucuuaaaaucaccaaaggcauguucaggccaaauaccugcacccgaggaguagguuaauuuguagcgugauaccuaagaacaggggggccugugguuucaaagcaaauauuuggggaagguguacaaucuuucuuuagguugcaagucauuccagccacucauuuucagaaaaaaggccagagaaauaaacuuaacauguuaaucuaagcaaucaguccaggaggccuugauuguuaagggauggugaaaagagacugacuuagacuugaauuccagagaagccaacaugagcuguuugaucuugggcaguaaucuagaguccccugaaagaacccacgugcaccaaaccaucaucaaggaagacuuuaaacuuaacugagcacuugauggaagaggcagaguagggguuuuacaucacauacucuauagcagcccacucgcaaucucucuagacauuccugcucuccaaaguccccuaggccacaccgcuggggacugucugcccucucacccuuccuuccacaccacacucagccuuacugguuccucucuccuuuuuucuaaauuuuccccccagaaauuuauuuuguuaauggaacauguccauuagcauuccacccaaacuccucuucacuuguugucagcuaccacccaaaaccaccuagaggcaauacacuauucuuuccaagcugaacucuagugaaaggaauugucuccaucucuuugcugucuccucccaugcuugccacugcacugacuuguccaggaaggcauguauaucaagagcagauaguacucguuuugguuggaacuccaccagcaguuguuugcuguuuuagacaaucaugucaucaacagcagugcugcuuagggcacuugaguugccagcccugucuguuagguaaaauaauaugcaguccaauauauggcacuuacaagugugagcauuuggcuucuucucugucuucuuguagucagccuaagcauuuauguugaaacacauauuauuuuauuauuucuccuuuacaucacaauuggaacauuauuagaauuuuuggaaauggguguuaggcagguuauacuacauauuaauuuuauuuuaagguauuaaagggugccauauaaaacagcuguuucauaaaggggcauugaguuggagaagguugaaaaccccugaauuuuccuuuaaacuggagcuacgagguaaaaauaaaaauuuuaaaaaagaaaaagaaaaccccugaauuagagggugagugagucagccggauguuggagcuauguuggucuuugacuaaggggguuagguccaauucccucagaucugcuguguccuugauguuuuccagcugcugagacaauaggcccauagauaccaaaagcuccaauacacaccuuuuccuggcaacucuuauggugguaggaaagacaacuaaaaaaggcccucuggagucuuugggagaaggaaauuggcuauuugggaauaaccucuuccuccaccuauugguacuucagagaucucaagucaacagaaaaugauucugguaaugaucuauugagguaagcaaugcaaugauaguccuguguauaaaacccugggcacauuguuguccauucucagaaggcuaguaacaauagcaauaguaaccaugguaugucaugcagaguacuagccuugggucaggggccguggcagaggaccaccugucucaggaucaagugggccaccuuuuaacauuauagguuccaggcugugcccuaggccaggguuuuucagaugguaggaguagacucauuggaaggucauaaaaucaguuuacagggucaucauguccaggauuuuaacaaaaauagaauacaagaggauagaauagaaaaaaauaaauguaucccagugaaucacaccuuguauuucaguuauauguguguguauacuuuuguauauauuuguuucaggucaugauguaaaauguauuucuuucuaugagucacagucaaagguuugaaagccacuguucccagacauguagaaucagaaucugugagacuaccucagcaucuguguggaaaccaguuucccuggggguucuuggggcugagguuugagaaccuuugcugugagcccuauugggauauguguucauuugucagaccuuuucucacuugaaggugagaggacggaaacagagcagccaggcuagguggggaccagugugaaucugagggcugugcucagagacaggaggagggaugggagggcacccaagccagcacccacccgcucgcagguuugcugggguagggggcagaauagucuuggauuccuuaaagaacuucaguuuuggccaggcacaguggcucacaccuguaaucccagcacuuugggaggccgaggugggcggaucaugaggucgugagaucaagaccauccuggcuaacauguugaaaccucgucucuacugaaaauacaaaaacaaaauuagcugggagugguggcgggcaccuguaguccccgcuacucaggaggcugaggcaggagaauggcaugaacccaggaggcggagguugcagugagccgagaucgcgccccugcacuccagccugggugacagagcaagacuccgucucaaaaaaaaaaaaaaagagagagacucagucucaaaaaaaacaaaaagaagaacuucauuuuucuauuauucuagcaggaaacaugggauucugguuuugaucauuuagaguuccuaauaugaucaagauggccuagguugauuuuucuaaacucaccuucggcauuaugucacaccagugaucugauccucaaaccuuuagcaugccuaggaaucacagggaaggcuuguuaaaauccggcucagugggccccacccaucugcuucaguagguuuaaggugaggccuaagaauggacauuucuacuaaauucccaaauaaugcugaugcaucuggucuggacucacacuuugaaaaccacugugugagaucaccagaaaggaauguacccagcauagauccuggcacagcaggagcucaggaaaugcuuucuugauuaaacuggacugaauucuccucagcagagaugcucucgcugagguucagucggcucucugcuuucaauggugcaagaaauggcugguugauauugaauuguaugcuuuaaaugggugaauugcauaauaugugaauuauaucucaguaaagcuguuaucaaaaagaagaggaggaggaaaggaagggaaaaaaaagaaauggccggcuuuccaagcugcucaucaaaaguguccauuaugccugaaauugucuuacaagcggacucaugucaaaggaaaacaaagguccucuagcugaacucugagcuuccuuucagcucugccacucucuaaaauuccuccuggggcucugagccagaaaaaguaugucuuuccugaagggcugaucuguuucccuuuuccaaacaguaaaugaugcuuaaaugccugugcauuucaccugccaaaacccguccugauauaaacauagcuuuccuucucaacuugucuuuuuaauuuuccugcuguuuauauuuaccugucuauaaguuuuucaagcaagggaaagccuuagacauccuagaggacuaggguuggaaacugguauuugccaggcagaauagagagacugagggcauugagaggugguguaguugcaugguuaauaauaacagcuuuggaaucagaaauaccugcuaugauuccuggcugucaccuaccagcugucugaaaacagauucacacaaaacuucuaugagacucauuuucucuuugucuaagaaaguugucacaagagaguggucacuaagagaguugucacaagaaugaaaugaggccagguacaguggcucaugccuguaaucccagcacuuugggaggccgaaguggguggaucacuucagaucagaaguucgagaccagccuggccgacguggcgaaaccccaucucuacaaaaaauacaaaaauuagccaggcauggugaugcaggucuguaaucccagcuacucaggaggcugaggcaggagaaucacuugaacccaggaagcggaggcugcagugagcugagauggcaccacuacacuccagccugggugacaaagugagaccucgucucaaaaacaaacaaaaaaaaccccaaaaagaaugaaaugaagcaauguguaugauagacagcaacagggccuaggcacgugguaagcaccugacaaaucuugacgaugauaaaggugagggcccaccucaucuuaacauuuccuuugguuggaaacaccggaguaucaaaacaggauaaaagaugaugcuguuuacuaacguguacccuccucucucuccaaauggauugccaguaccuugugacacaccaagauuuacaagugaauaagucuaucccaggaaacagaugaacuauggugcuuuaagagcagaagccaagcagagccaagauuugacaagacccgggacaccuacaggucccagagccaguccaagccucugcaagguuagcagcaccccagcagccagagaaccaaugcuggugaugcugcugacucaucugguugguggcccccucccugcuucccuucugcugcuccuccucuucuucccucuugggcugcuccauggggugcucucccagaugcucugcguccugccagagcaugggacaguagagcucuucuacuuuuggcgcuccucagugcuguuucugcaaggcucaguggcaucagagauugaaacucugaaauauuccacuugggaauugaucugauuacacagaguagugaagauuccugaacgaagcaaacuauaucugaguccuaucuucagcacauaacuuguuagcuguguagccuuggacaagaaauguuuucuggaccuugucuugaagugaagguguugaacugggaccugcuucccucacaggguugugaaaaucagaugagaugaagguucgcagacgccucuggcuugggugcuaggcacgaggacacccuggugagaggagcauucacagaacuugcccucauaagcuuaggguugagugaaagagacagugaggaauuccauaaauaugcaggguaaucugagcugagugccuugaaggaugaguuccaggccuuugcaaggggcugaccuaggaaccugcugugguuuggguacaucaggaaaggcuuuguaaggaguugaauuggcacugggaucugaaggaugagcaggaguuaacugggaggaauuguauggaggcuuugggaugucaaccaauccagguagaaggacgagcacgggcagagaaccugaggcugaaggagacauccuggggccuuugaacaccagaaauaagauaguaagggagggagcaucguugagggagggggcaagacgaggcugaagagggaacagagacugacugugcacaccuugccauaugaccuuucuuccaagagccaggggaagccauugaaggguuuaaauuuaagcaggagaguggaagagugacaagaugcaauguacugcugcuuuuaaagacugcucgaacugcuacaaacagacuagacuacagaggggcgagcccuagccagugcaguaggccguggagugcagugcuccagaccaggcucagcagaggcugccagcaggcuguauuccugccaugucacugucacagugccagugugugagaaucuuacugcuccuaucuuaguuuccuagggcugcuguaacagagaaccaaaaacuggauggcuuaaaacagaaguucauucucucacaguucuggagccuccaaguccaaaaucagugccaugcugucucugaaguccucgggaggauuccaugccuguucccagcuucugguauugcuggcaagccuuggcauuccuuggcucauagacucacuacuccagucucugccuccaucaucacacaguauccucucugugugucuggguccagauuucucucuucuuaaaaauauaccagccauuggaugagugcccacccuaauccaguaugaccccgucuuaacauaacuacaucugcaaagacccuguuuccaaauaaagccacauucacaacaaccagggguuaggacuucaauaugucuuuuugggggacaugauucaagccacaacaacuccuccuuaugccacaguccacccgguagaaccaucaucagaguccuaagaacccuucagaccagacaggagggagaggcuccacuuuaagacaggaaucaagagagccagaggccccagacacaccacaguguguguguguguguguguguguguacacacacacacacacacacgugugcacacacucagggcagcauguagagagaggacugugggaagcgugggcccugaguucuggccucacucagaccucaccagcugagagaguuggggcaaggcuuucccuaggucucaguuuucucuccaguaauaucagaagugauguuaccugccugccccauucuccuugcauuggcucugaggaguccuugggauaaucaaguauuuccugagaaguuacugccugcccaacacugagauaacuuacugggaguguucuuggcagaggaacaagaguuacacaaguugaaguuguuacauccuucuccguuaauccccugggcucuucucuuacagcuuggugguuacaaguacagacuccauucgcuuccaaaucaucccgugggcagggacagagaugaaacaagagacauaaagcuaaaggaugggucuauggaagguucaucauucuauucuacuuuuuaaauauauguuugcagugauucuuaauguuuaaaguuuaacaaagaaaacuacagacucuggagccagauugccuggguuuuaauccaauaccugccacuuacuguguggagcuuggaaaaguuacuuaaccucucugugcccucaguuuccucaucagcaaaaugaggguacuaauuagugacuagcaucauagagguuuugugaauauuaaaggauuaaacagguguaaagcuucuggggcugugguucgagugaguacuaaaaaacguguuagccauuguuuggagaaagugggcaccgaagaacuacauguugcugugcugaaguaaucacugugagcuucauggaaucaugcauucagcuuuggagaucuucuaagucaugccugcuacuuggaaucugaguuuggguuuucugaagcagauccugggacagugcaaauaguuuauuugggaggagaugccaggaaauaucagcaagaaaguacauaaguaagaacagaaagaggggccaccaggaagagugccugugacaggcagcacugcaggacaggcagcacugcgggcggcuaugcaugguccacugagaauucugggagccagcauggagcaugugcucagugucaucccaccugaggggugagggagcuccggggguuguuggccgagguccgacacauggaccucggcagccccuggggcagaauggcagaugcuggcagguugcaggcaggcaggcaugagaccaaaugcugagaggggguauggguggggcaccagaugugugugccacagaauccaucugucagcucugauaagugcucaucuaacaccuguguaaugccuuacaaugaugggcuuucccaccuucagaaucagccucggugucuauuggauggcucugagucauuauuaaauuagggguaauaaggauaaaaacaguucugugcuguuuacaaucagggcagccccuagaauaggggugaugaguauguggcauuagggaugcugugucagacgcugaggcaucucuucucaguccugacacuuucauacugagccaggauacagccucagaaucuuucuuaacagagcuuuaggugucccuuccaaacccaucaguguaggcacuuuggugaaggcagguugucagcccugccuuagggcuuaugaagcuggcguaaaucugaggcuggaaaaagcucugagcuagguuauaaucaugcugugucaaggacccacuguuugauucuagguacauuuaacuucucuggcucucccugcucuucucuggguagaaugaagggacuaacuaaagcgaggcagacaugaaguuuggugcaguagcaagagccugcucuuuuacaaucaagcagggugaaucuuagaccuuggcaucaucauuuauaaacuauguuccuugagcagcucguaucauccacucugagccucggcaucuccuucuauaguagccaguuuguggugguggugugggugucagagauaauauagaugaaauagggagcuucgcaugcaagcaggggcucuauaauuguucccuauaauugucaucauaaucaucaucaucuucauuuaaagucccccccagcucuaaaacucuaugccuuuaugaaauguccucaucuaggaagauggugugguaaaauagggcaacggcccgauuuuguguaaaugugcugucuaauaaggacaagagaagcauaauugccccuaaauaauugcucugacuuuaccacaagcugucagaaggccuuaauuggucacucuguaaugacuguggccaucugcauucggggugauuuagcgauggggcuuugcccaagcaggggccucaaugauuagagccggccagggugauauuuaucccucugaugggaguaguggugugugguacaggagauuaucucauucucguuguaaugaccuaucaguugaacccagccaagaagaagcgguggucacaaacaaugacuauggauuuuuuucuuuuuucgaacauaguguuccugaccaaacagcagcauauuuggagugugaucaugccucuugcuuucuugucuuguugcccaagaaagucucuuuuggaaagauuuagucccucaauuagggcaaauugauuucugcuuucuacagagucacuguaccaaagagaagugggaaagggcgagggaagccauauuaaucuuugugcacaagcaagaaaagaccuggagcauuuuuuagccuucuagccucugguuguauguauguagaucaucuuuucucuguauucuaauuucuccugccuacaagaugccagacaacauaacacgaaacacacuucaucucaaugaaguuccuggugacaaaaaucaaagugauggaagcaguguuucccuaaguguaccagcacaaaagucauuuuuuucacucauucauucauucauucauugagacagguucuugcucugucauccaggcuggagugcaguggcucgaucauggcucacugcagccucaacccgguucaagcgauccccccaccucagccuccugaagugcugggauuauaggcacagugccuggcccagaagugaguuuaagucacaccuaaaauauuacaggugguucagagacuuugcauuaaaaguaacacuggauaacguggagggaaagccuucucuuuucaauucuuuuucauucuucugaucaccucaaaugaggagccuugguugguuuuccacagcucccuccuugaugaagagagggcagacuuuaagcucauaguuguggagaggcaggaguaucugguagaaaucuaaaaucuuacaacaaauucuuauuuguuggagauuuuuaauuauuagcucuuuauuagaaaugauaccaauuuuucaucuaugguguuuaaaguuuccuuuuaaaauaaaguuaauaaaaaguuuaccuuguaaaauuuaguugacuuuuaaaacaacuaaguaaauuguaguaaaguagaugaauguggcaaaaaucuagaugguaguauaugauugucagaaacuggggaaacacagcuagaagaaggaaaccaucauguuuccacagcaaacccaggaauuuacuggccguaugucuaauccuuaugccuuuucuuuuucuuaccaguuacacuggcuaggaauucuaguacaauauugaauagauguugugaaagcauacagcuuuucuccugaucagaggaggaaagcauuccacauuucgucauuaaauaugauguaugcuguagguuucuuuugcagccauccuagagucuucauaaaggaccccaagccugauuaaaaucaagagacaccaacauugaggcugagacuuuuaggagaaagagacugucuuugauauuuauucaaaacaauuuauccagacuuggggcagaaauccagcccacauuaggauaagcaaggagaggaauuugcugucuuguguaauaagagcaucuaggagucugucugcuucaggcacgugagucuagggaacugaaaugucaucaggacaauguuucucucucuauccaugucuugacucguauuuuuacagguuggcuucagucucagcauauucaccuaccaccucucaucaccucauuucaccaaagaugucacgaguggcuccaaacuuagggccaaccagcuagcaaaaggaaagggccucauuuuucaauaaugcugcagaauauucucaggacccauuauuugagccaaauaaggucacaugaccaucccugaaacaaucacuguggccaagggaauggaaugcccugacuggucaggccuauacuacauguuggacccagggaauggggucagccccaccaaagucugauggacugagaagggaaggggcagugucccagauaaaaauaaaaauauuguuaccagaagaugagggaaugguucccagucaggcauaaaccacaaauguucacacccuuggacagaagaucucucucuguuccaggucguggcaccuucacuggaccucuuuaagccuuaauuucuccaucuguaguacacaggugaugagaacacugcccuucuucucccugucugaaaggucuagugaggcaguguacaggaaagcugugucuagacugugaagugcaguucacauguaagggaggagucauaaggaugacuacuaagcaacuguucucacucuucuguccucuucugucucauagagcaccugaagaagccucuugaagacuacauggcccuuuuccccagugugaggauucuucgaaccaagaaacgggaagggcugauaaggacccgaaugcugggggccucaguggcaacuggggaugucaucacauucuuggauucacacugugaagccaaugucaacuggcuuccccccuugcuugguaagggagccccucccacuuggagggaggcaaacugcaaugagccagugccaguggcccccuccugcugcagggagccauccauaagccuucccuugccuguucgagaugcccccagcacaaugccaggugccaugagggauucagaaguucaggagugcucaaaauuaaaauccagccaguccugucccuucauuucacagagaaguuaagacucagagaggcgaagugacuuacccaaagucacacagcacaugagcaucuagugacaugacggcuuuccucagaugacuucauuuuauugcaaagcaagcccgugcuguuugcuguuaauagccaaacugugggggacaucaucauaucaacuuagaagaguuaccauagacugugcugccacugugagccaggcaguuauaagcauuaucuaauucucacaaaaccaugcaggucaaaaguauaccccuuauguaguaaaacaaacuaagauucugagauacugaagacucacuuguccccuugagccauaagugucaaagucaccaucugucgggcuccaaagucuauucuccuucgcaguucuacauugccucccuguauucacuuccuuuuaaauaagaguuccuggcagauaucagggaagggcuguagagagggcagcgugauccacuagcccuccaccacagccuacagagaggagggagaugggaagacuggaggcugggugaaacaugccugaaucaggccugaaucuugaggaguucgguuuugaugagggcagugugcuggugcugagaggcagacauggaagaggaacuguccuguugagacugggagucaggugagggacacagccagggcuggaggcagacuggggaagagucaucauucuggagagaaaaaugaacuuaagaaaggauggguaagcucugcacuacagaaugcuuagggagcaaagagaacugaaguuuagggcaaacuugagcgugcaucagaaucaccugaaagacugugaaaacacagaugcuggccccuauccacaauuucugauccaggaggcccgggguggagccucacaaguugcaugucuacccagcuuccagugaugccaguguugcugguccagggaccacacuuugagaagcacugguuagggaaugccaccauucaggggagaggacagaaagcagaacccacacaaacacacagaaagauaaucccgcaaaucuguaacacagaucagcaaggaacuuucuuauuagauucugugcuucugaccccaagggucuacgaucucacugggcuggagaaaggauauaacccagaauuucugguaaacuguuuauuuaauuaaaccaagagauauucugcauuuaccucucauuacugaaagaaaaaaaaaaagaaaaaagccucaccauaaauugccuaauuuauaguccugaaggaacaacccauuuguagggucauucagugacucauaaagagaaugaagugguggggcucgaagcugagcuuguagucuaaauagcccuuaacucuguuucuauggaaauauaugagggcaguuuucauaaucugcagacauacauggaagaaacauccccuuguugguuuuuguuguuguuguuuuguuuuuugcuucuuccaauagaaaugugaaccagugauguagauuuaaaagucugucccugcuaaugucagcagcugacagagcgcaucauggcuuuugucugugaaaccauuaacaccuccaugcauagcucacucugccuccuuuggagaacacacauuucugagacugagaaggauucauccucccuaugggaagccacuguugaucaucauuuccuuuuuuaucaucaucaucaucaucaucaucauuaucacggcucucauaaccccuucacuuucucagccacauuaacauuugaauuugaccauugccugguaaggcaggcagaccaggcaucauuauccacuuuuugcaaacgagaaaacugagaggcacagagugagggagaugcucagccuuccacucccacuucugagcugcccucaguaauccuggucauggagagugucgcugagugcugacuaugugccagaggcugcacugagugccguggcuccaucaucccacuuggaccucacagaggccccaugagauaggugcugucuuccuccccuuugucagcaaggaaacagaggcucagagacaucagauagucuuaucgaagauuauacugcuaagaggugaaaaaaccaaccaggauuugaaccugggcauucuguccccaggugggcacagugccuuagaacacugccuuccgaagcuaccuugaccucaugccucccacaaucagccagcagccagcagggcacuguguccucagccccagcccuccuuggacaugaaguccgcugaacggccaugaacaauuaaaugggaggcccuacucuaaaucuuucucuagaggagauucuuaagcuucauuaagaauccccagggaaucuguccacaaggcaaauccaagucaaccuccagagauucugauucaaugggccugggucgggggcgggcacgugaguuuuuuaaacacacccccaggugcaucuggcacugauggccccugauccacauguggggguauacugccaaaaacaguauuucucaaacucuuuaaaccaugugccccaguaagaacuaccuugggcaucucaauccaguacacagaugaacacacucaugcaguaugacugaaacauguuccugaaagaguaucaccugucacaguaucccuuaucaccugaaaugcagccugauauuuaguauuguuuuuugguucauuacaaaugcacuuacaaucaauuucaugaccccaccuauggaccgugccuugcaguuuaggaaaaagcaaaaaugcuguuuucuuuccuggaagaaaaaugugcuaucacuugaugaaggaagcuugggccccaggcagcugcuggcugcccuggcccuaccaggcucccauuucugagccucgaauuugacuucuggcccaaagcaaccaggcauugagcacagcccacuugucucccacagcagauugucugacccaguagcucacuguuaccccccagcuguggucagggcuucuuggcacaaagaagaagggcagagcaaaccaaagcuggaauuguguugguagguuggacagacucgauuuucuagaaucagcuucucccaggccuaaaagggaccauaagccaucuaagucaagaccccccauuugccuuuggaaucacccagccuauggcaucccugcaggguguugguccaccaggcucugcuuacauaccuccagucuugaggaacucaaacuuccuggggcaguucauucccccauccauaguuccgaugauugaaagaguugagcugaauucuugcaaggagggccguuugcucacugauuacagccuagggugccagugagcuguuaggggcacauagucugcuaugaaggaaagugcuggggugccuacugcuuugggccguaaaucaagcucaggacuuggaaugaggagccucgcaggacuagagcaggggccuucccagaaggaaaucaaucuuuuuccauagugguacugaucauuaugcuaauaauaaggcacguaugcuaagcauuuucaaacauacuguguucaguccucauaaccuaugaggcagagccucuucuuaacccauugcauagaggagaacacugggguuuggagauauuauuugugcagcugccucagggccccauggagaguaaaaggacugagaugagagccucggucccucuugcuuaaagcuugcagucucccuuccccuccauggauugucaaacugaggguucagagauguuaaaaauacaaguaagcugcagaacaggauggugcacuuagcugcuuccccauccugcuucaucugauaggcaucucuuggcuucuucagaccgcauugcucggaaccgcaagaccauugugugcccgaugauugauguaauugaccaugacgacuuucgguacgagacacaggcaggggaugccaugcggggagccuuugacugggagauguacuacaagcggaucccgaucccuccagaacugcagaaagcugaccccagcgacccauuugaguaaguaugaacaacccuggcuggucccaguggcuacccagugaccacucccaacacgcacacaacucaggaucgccaucucccuuaaaagcccaaugcagaggguccagcuucccagccccacuuaguaccaagugucagauauccccagccaguagcaccaucccucccagcuuguaacaaccucagcucauggcccaccaggcuggucuccaccuugcccacuucugcacaguuugccaggauugucagcaggggugagugggucucucaugcucucuuccucaagccugccaugcaauuauaaccaucaucgucaccaagugcccagcccaguacuaagcacauuacccucugauccaauuuaacccccuacaacuauauaugguaaaaauuauuauccauguuuuccaaauggggacaccaaugcuccaagaggcuaaguaauuugcccagguuacuagguacaaaugcaggucugucugucugccucuggagccaauuuucccaucguacugcuauacccacuuggaaguguaaggaaaauagcaguuugucccacagcagaaguuugcaggcuaggggagggugaugggcuggacucacagcauccuagaaugugaaggcuggaaggaaccuaccagugaagaacucagccccuugcagaugagggacuaaggcuccagaaggaggagcucugugaguggcuaagacagaaauagagcccagccccucucuggugcuccaagcucuggaaggggcuucuccccaacaguaggcucacugucccugcagcuguccugugagcuguuccaguucuccugcgacacguguggaaaagaucucuggauacaaagccgaagcccaagcucucccgcuguauuaguuuccuauagcugcugugauaaauuacuauaaacuuagaagguuaaaacaacacaaauuuaugcuuaaaacucuggaggucagaagccugaaaugagucuuacugggcuaaaaucauagugucggcagggcugcauucccucuggaugccuugggaagaauccauuucccuaccuuuccuggcuucuagaggaugcuuacauuccuuggcucauggccccugccuccaacuuuaaagccagaaggauagaaucuucagaucucuguuuccuucuccuugcuuuccuucauaccucugcuuccuucaucacaucuccuucugacucugacuuuccugccuccuucuuucacuuauaagcccugugauuacauuaaugauaugugauuccaucaggcucgccaagauaaccuccccaccacaagauccuuaaccuuaaucacaucugcgaagucucuuuugccacauaagguaacauauucacagguuccggagauucagacacugccauaacuggggagucguaccucucaccacaguuuggccuucagugaaccacauuucucuaugccuuacucuccccaucugagaagcaggacuguuggaagcucagccaucuucaugggcauggugcauacccagggcuccugagaggaaccccuaacacuaugagccccagggcaggcucagagguagaaagaguuggguucuuugaggaaaugaaagguggccaggacaauggaccagccugagccaagaguggagagcaagaauggauuccaugucuccagcagcaggucaaacauuuguggucuucucuuggccucuugaacacaguugaucacuacuauuagaucccuuccugguccaaagauaugauuuagccaugaucacauuaugcagucugccccaccuucuguguaccucagaaucaauccucaguugaccuaaauccuuguagaauaauaccaacaccaggaguaacuaacauuuggccuguguuggcaaagcaauuucuacugaccauuauugugcaugauccuuauaauaauguaggauccucaggucuagguagaauuacccucauuugacugauggaggccuugagguucagagaggaaacaagacuuguccuaguugacaugacugcagaagcugagguuagaauaggcugcuccagaaaauggaauuuucaggguaaccaaggggguaauuagaaccuccuuuauuguuugaaccuuugcaaugagcagacucauugaaagguacuuaaggacaggucuuggcccaucguuauccucauugcacaguaaggaaaggcuaagaccaggucauacagcuggcuaguagcaaaggcccagcuagugucuucuggggcuucagucuccucaucuggauauugaagugauuggccucaccagagagcacuggcucuugacccuagccacacauugacaucaccuggggagcuuguaaaaacacaaaggcuucccucaagagcaguuacacuggagucugggggugggaugcagguaucaucauuuuuuaaagcucccaggugaugcuuauguguggccaugguuggcagucacugguguagaugcuuucugaagggcccuccauccucucccaugauuccuuccagaagucucucuucugcuuuuuacuuggacagaacccuaggaaguggccacuagagaaauucuggucauuuucuguacagcuucccaccuucccacuugaugguagagugcccagcaagugggcaaucuacaggcacagcauggugcaaggauguuuaaaagacaugguuucaguggcagaccccacuuucaguaauagcuuauccacucacuaugagcagauuauuuaacauuucugauuuucaaauaucuccgucuguaaaggagacuaauauuagagcuuugugagagcuggagauggugucaguaaaguaaguagcacacacuggacacucagaauuguuacuaguauugccaaacacagcagaaaccagaacaggcugggcagagaggccucucucuggaggcaaagccucgagcaucccaaaugccuuagagcugauauccugccuauuccaugcagccccucagccccggccccugcuuugaccgaggcugauuuucaugugcaaagccuugaguucagucucccaugaagcaccaagucagaaacacugucagccuuuccaagcgguagauuuguggcuccagccaaaaaaaaccaggacccccucaaucuccagaagacaaaggggagccaauacuaauaacaccuuauuuucuuauaguacuggguacuuuuagaaauauucuagcuguauuaauccauucucacacugcuauaaagaacugccugagacuggguaauuuauaaagaaaagaaguucaacugacucacaguuccacauggcuggggaggccucaagaaacuuacagucauggcagagggggaagcaaacacauccuucuucacaaggcggcaggagagagaagugcugagcaaagaggaaaaagccccuuauaaaaccaucagaucucaugagaacucacucacuaucaugagaacagcagcauggggguaacugcccccaugauuccauuaccucccaccaggucucuccuaugacaccuggggauuacgguaacuacaguucaagauaagauuuggguggggacguagccaaccguaucacuagcaacgugggauaggaaguauagcuaucacuccauuguuuagauggggaauagggcucaaagagguuaaaucagcacuguccaauauaauacaagcugcauaugugauauuauuuucuaagguaaagagaaacagguaaaauucaucuuaauaauguaucuuauuuaaaccaguauaccucaaauauuaucguuuuaacauguaaccaacacuuuaaaauuauuaaugaguucuuucauacucuuuucauccuaagucuuggaaaucugguguguaucucacacucacagcacaugucaguucauaccagucacauuuuaagugcagagucaucaccuguggccaguggcuuccuuccuggguagcacaggguuaaugguuaaacgcugcaucucaggucacacagcagguuaaggaaagcagaaaugagagugaggguuccgaauuucucacgcccuguucuuugcaugcaucaccugcuucucgaguguuccugccugccuggaggcaguauauugugguggcgaggggugugaacuguggcuuagauuagagauucacaucccagcagugcugcuuuuuagccauggggccuugagcaaguucccugucugcacuccaguuuuacauguguaaaauggugaugauaaugaggccugccacaugaggucgaggugaagaguaaauucauuuuauuaauaaauuagcuccguacagcacccggcauauucaagcccucaguaaauauucaggggcuccccuuuuaaaggaguccugccugugcuguaaaggcucaucugcuacuggaaggaggagcugcuugggcagcuuuuggguugacuaagagcuuauucgaucagccuacuucccaugagcuugcacuuccagggaccaggagggggaauggagguugcugcuggaauguuuggauuugaggguuuggaguuuuccagugcauccagacaaggaugcagccacucugauagcuuuucacacagcaaacgcugguuggccccuaccaggugccagucuugugcgagauacccugggggacgcugacagucagcagcaugacguuuccucacuuagcacggugccaggcggacuuccuguucccguggguacugcaugauuugucgucucuguguccuugcugacguuuuauccuccccucagugccuuucccucucccaaauuuccucuuguccaaacccacuuaaaugccaccuccccugagccucauuccuugacccuugccccagccauccuccuuaccccaaaagcuggaaacagacacacuccuuucagauuccuguaaugcugucucuaccucccggagucccuuaugcacccucugucuugagggggcugccccacuacaccaacaucuccugaaggacucucauugaccucgagauucuuccagcaccucccucacaacuggcaugggaugaacaaacucauuagagaaugaaugaauggaguuaaucuuaucucccaguuuaacugaaaagacagagacaguggcuucuucuguaaacaccacagcagaacaaacguccaugcuggccuacugaguaauaguugucaaaggagcauguucaaaaacacagagcccuaggcugccucccgcaaggauuguuucagcaggucugagguggggcccagcgagcuguauauuuuuucaucucucuaagagauucuacaacacagacaggcuuggagagacccccaacuuggaccauuuaacuagugagaggacuaacauguacauauuuaugaugcagcuacagggcccauguggacaaaguacugugauuucauuucacaaguacucuuagguguuaauuguguaaaggaacuucgggucccauuugguuaaaauguagcucuuaugaaaggaaguuguaggaaagaaagggggaugccuggaagggccuuggauucccuggaagacacuuggacuguguucagggagcagcauggaacaccgccgcugggggaauggcauuaucgggccacaugagagcauguggccaggacaucugcaccuucacaccauguucuucuucucugacaggucucccgugauggccgguggacuguucgccguggaucggaagugguucugggaacucggcggguaugacccaggcuuggagaucuggggaggggagcaguaugaaaucuccuucaaggugagccagcucuccagacgccccguucuuggcacagccuccugagugccugucccaguaggugucucagcuucugccugagcuuggaaagacuggaggccucaggguucuguagcccuucugcccaucaggugaagaagacaggggcucaugggccacucuuuguuguggggugggggggugugggagggaaggggaguacucuccagcugccaaaggcugguccucaccacagcucugacuggcauuugccuugugucuucuuaagauguuggaauaaggucuugcuucuacucagauggcaggucugagauugagauguccagcaaauaagcagugggccagagaagcuaggaaggccaaacaggauacguaggccuagaggaguccucucagucaccccaaguuuucccuuuguaccuguugcucuaggaguuugacaaagaccagugagcauaagcuccaguuguaaaguuacaaaggccuggauucagaucccagcuccaucaucaggagcuaucugacuuugggcaaguuagaucacccccccgagcuuucuuuccucaucugaaauaagggaauaauaauacuaccuagcuuacagagcuaucgugaagauuaaaugagaucaugucuagaaagugcuuagcauacaaccugggaacaugaccagcaauuaauaauugguagaaauuguuaaaguuucggugaguaaauauuuacuguaaccuacuugaccagccuauggacucuggaagcuuucugacaguagugguaaaggaguuacuaguuaacuaauaacuaauuaagcacccaaacuuccaaggcuacauucuccacuuuauuugugggagucugucuuguucucaagugaaagcuuggaccuucugaggggaggguuagcuugucccaugcccuuguggccugucagagucagcuucuaacagcuuagaccccuggcuaaggcauauccccagcccacaagggacagauagcaccauuacugaucugaccccugugaacacacaacucugaugcccccucaucgggccucaacuuucagugcaaaggaccauugucaggcacagugaauuaaggcuuugguauuggugccagagugccacgaucagauccuagcucugccguguccugccagcugugugaucuugggcaaggaauccucaccucacugagccuugguuucuacuuccauaaaguggguuuaaugaaacguuaauccucacagaguuguugagaggauuaagugagaccaugcuuauuaggugcuucuuaauaaauuauccuaaagauuauuaucaauacauuaauauuauuaucugcaacagugguugaguaguucagaacuggagaacauaaauucuugauuagcccaaaaaaaaaaaaaaccuacaauucuuuugauguuauuuagguuugaaaagcaguuuauauccuuuuuuuuucuuuucuuuucuuuuguuuuuuuuuuuuugagauggaguuucacucugcugcccaggcuggagugcaguagugcgaucuuggcucacugcagccuccaccuccuggguucaagugauucuccugccucagccuccugaguagcugggacuacaggcgcccaccaccacgcccagcuaauguagagauaggguuucgacauguugaccaggcuggucuugacccccugaccucaggugauccacccaccucggccuuucaaagugcugggauuacaggugugagccacugugccuggccaguuuauaucuauuuuaaccaccagaguucugaaguugucucccauaaggagaccagcccccuaaauaaaauuaauauucacauaaggguaauguucaaaauauguaacaacugugauaacacaagcacauccagucagaacagauaccagcuauaaacaauggugcauccacuccagcguguaacaagugaaguucgguccugaucauagcuaacaggacagugugccaagcccuucauacaugcugacuuguuuaauccucacaacaaccuuaggagaguuguaucauuauuauacccguuucaccaggaaggcaagcaaagcucagaccaaggccucgcacagccggaagaagcagaacuggggcccaaacgcaggucugcuugacuccaaagcccacgcucugaccugcuauuuuuguuguuguuuaaaucauacccagacuguucugaaaaccugccauguuuuauggaccucugccucacccuuucugggauuuuuuuuuuuuuuuugccucuucugguauuauuccuaguuuacuuggauauucugcaauuucuuaguuaauggaauuaauaacaaucuaagucggaaguggcaaauagggccaggaaugguggccgagaugggaggaucucuugagccuaggaguuugagaccagccuggacaacacaacacgaccccaucucauuaaaaaaaaaaaaaaaaagaaggaaagaaagagagagagagaaggaguggggagggagagagggagggggaaagggagagagagagacagagagagagacacagcaaauagguuucuacucccugccaggccaacucugauccauugguaggggcugccccagguggguguugauaugcauucugaggcugcuuccaagcuuaucagcaaagaguagucagugggggagggaucuuuuuguguuucacucaccgccauaucccaaguaccuaaagccugguccaacacagaaaagacacuaugagaccaauuuuuaugagucauaauuuuuauuauuguauuaaaucuuuucuaaaauuauauuuauauaaauaucuuauaaauauucuaaaaauauguaaaauguauaaaagucuaguaguucugauauaacacugucagccauaauucugguuaucauguuaaaauacuacauauaauaaaauaacuaaauucaagaccagccuggccaacauugugaaaccccaucuuuacuaaaaauacaaaaauuagccaggcguggugguacaugccuguaauuccagcuacucaggagguggagacaggagaauugcuugaagcugggaggcagagguugcagugagccgagaucgugccacugcacucuaaucugggcgacaaagcgagacuccaugucaaaaaaaaaaaaaaaucaaaaaccuuuaucaaauuuuaacugggauuauucuauuuuucucacuuauuuagaauuauuauucuaaauucuucuauaaaggcauuuacaauaaauucuaguccaacauugcuuuucauaaaaaagacuccaauaaauauaaguauaaaaaauaauacaauuaaaaguauacaaauauauauuccaauuuuauuaaauaucauauuuuuuccagucuacaacagacuuuauuacuaugaagucuguauuacuguauagaaucuauaauauccucauaauaauccuauuaaaauauuguauuaaauacaaaaaaaagacaccaucaaaaacccccugcauccuacuaaugagaacuaaacucaguccaaaacauauuuuccaagaaaaggcuaaaaaacacacuaggucugauacaacuacaacuaaaaauuaccaaccuuccuaaacaagagcccuucuaacuacagauggcaaucaacauuaauucuuaccaacacaaccaaacaauuuaugaccaaaaacuucgugaaacaaaguggcaaauguaagaggccguguuugcccauuucccuuugcugggagaauuucacaaagccccugacuccgggacacugugcagcucucuggaaaaauguuuuaaaggcaaaacaggauagaacgcauggccccccaugucucucgccugagucacuaauuccaucaaagauaaaugacccuaguccucgccuuucucuacucauaaaauaacacccgacaagaauagugacuauguuucuguaaucuauaaccagauguacucuaacacccaaaccuugauguaauuuuucacauacuaaaucuucaccaccuauguauaaacuaaaauacuacguuggaggagucugagagaaccuuucuaaaagccuccucccaggcuacaggccuuggucuauaauccucaagaagacuucuaaauaaaacuaacuuuaauucuuuaaaagcuucguuuuuuuucuuuaguugacagcaguuaacaaauauuggcugaauacuccaaguaagugugucccuggccagaaucagccuccaagcuccuaacuggcuccuugcucuagaagacccucuucagaacccccaccauggagaacagugaauggagaaagauuugcacaaaggaauuucuaaaccagcccaaaaugauuucauucuauguguuucaaagacccaucuacugaugcucaucaggcaauuauggcagaacaaauggcauuuuucuccacaguuauuuacaauagacuugguaaugaagccauauuggaaguaucucauccgggagggggaaggaggcuggcuuacauuuccauuugauccaauuauguccgucacucuccagaggaaaugagacaguguaaugaggaggcuccugagguccggaagggagacuuuucucccugggcuuucucucuccuggcuuggaaaaggagaguuucuggagccagcaacagcccaucugccagugcacugucucccaggacccuguggaaagacugccugcagggcugaggggaacaggugagcccauucaucccuggcagcgcccugcuggaaugcagguguucucuuucagccagagcuggcauuuacgaaggaccgaauucccucugauucaucucugcuaagaucccuuuucuuggugacagagagaagccuggucugaaaggcaugaguguauuuucagaaauuaagaucaaucaacacguaccuucagggcugagggcugauuccagaccggauucucuauccugaugagaaaauccccaaaaagugucccaacagcucugaaauuucuagaaaagucauugacuuucccuuucccucccuccuucucugucugucucucucagcagagcaaaguucucacguggaagucagaaucuuccuaguucuagugguuggacaagucuuuaacuccauagccuagcuccagcuagguucaugagcuggcccuacugcucucuccuuuccccuuuuccucuuaucccauugcauuagucuggauucuugcuuacagauaaccaaaaccuuagucaaucugauuuaagcaaaaaccagaauugauaggcucacauaacugaaauuccaggguagacccuaaggccgggcuggaugcagggacucagucaucucacucgggcuaggucucucucaaugccuagucccuauuucaucugaguuggcuucccucucaggugggcuuuuucucauggagauccucagcagcccauggaaggagaguguuuuucccaucaucuuguacaaguccccagguugagucucauuggccugcuggccccaugcccaucccugaacaauacugcaauuggucaccugcagucacaugcccugugacugcaggaagguggggaugggcuaguuacccaaaggaaaguccaggugcugugcccagaagggagaauggauguggggcagagcaaaccguagaugucuaccuuacccagccagacaagacugcauguaagaaccaggcuuacgggccagccccucucugcaggcccacacuguacacuccugaaaugccauuccuuagucuggccaacccucauucacccuuccaaucucagcuuauauagauggcuccccaugcugccuaggaacuaccccacauugcacucccaucucugcaugcucccuggaggcagggaggagguuuuguccaccucuauauccccagucucuggcccacaucaguguuuucaguaaguguuaguguguuaguggcaucacuuccaacugauauaccuccuugguacuacccuucccagacuuaggaggccaucuuuggacaaugguguauggugggaaagugcucagcaaggaggcucuccuuccauccuaggacccugggccaguuguuucaccucugguccucauaccccagacugugcugauacgguuuuccuuccuaccccacaagauaggaucaaaugagaugcuguguggacagcccucugacauacacagauaugagggguuguuuggauuagggggggaggcagcaggaugagcagaaaggaaacugcacaguguccccaggaggccaugguuaggauaucuccaacuaugagauacgggagacagaaaguauccaaccaggacaaugugaccaaacuaaagugagaaaaauguaggcuuuggggcaguguaaguggguauaucuucugugaauagcaauuuggcaaaauccauuacauuucagagcaagcacauucuuugaccugaaauuccaugcccaggaguuuauauaagagagacagugaugagcaaagauuuauuugcugaaguguuacuuaccauagcagaagauugaaaaugacccaaaugcacguccuuuggggauaaauaaguuagagcauaucuaaacaagaaaauauuacguaaaauaaauuggaggucuccacaaaaaaaaaaaaaaaaaaaaacccauuuuuuuucagacaggaucucacaccguugcccaggcuggagggcagugacgugaucagagcucacugcagcuucaacaccccagggcucgagcaguugucccacuucagccucccaaauagcugggacuacaggucuacaccaccacucccggcuaauuuuuuaauauuuuguaaugacagggucuccauauguugcccaggcuggucucaaacuccuggccucaagcagucuuccugccucgggcucccaacaugcuggcauuacagguaugagccaccgcgcccagcccaucucacuucugaaaaugacucagugccaugaacccuucaucccuaguggccuuugggggugggaggucuucaaaguacagccgucucuuucuaccuaaugugugucugcaacaucgaacuuguucaucauaaguacguauuacuucuguaaccaggaaaaguuacaagaagaaggggccaggcacaguggcucaugcccguaauucucacauuuugggaggucgaggcaggaguauugcuugagcccaaaaguucaagaccagcuuugggcaacacagugagaccucaucucuaaaaaaaaguucuuuuaauuagcugggcaugguggugugcugcgugccuguagucccagcuacuuggaaggcuaagguaggaggaggauuccuuuagccuggaggucaaggcugcaauaagccauguucaugacacugcacuccagccugggugauagagugagaacuugucucaaaggaaagaaaaaaaaaauaagaaaauguuggguucucagcacuuccagcccacccccauccauauacauuccagcacauuguuggggccauuugcaagcucugagaugagauucugcacaagucagcagugcagagacucccagggaaggccugaggccgccaagagcaacucugcagggucugcuccaagaggcagaggugggccccaccguccuuggcaaaauggagauuggucugaggguuccaugaggcaggcuugcaggagcaagggagugauagaaagccaugugaggggacgagagggaggacacccuccccugcagaagucaggaaggucuuugagcuuguucugagaggaaaacccauucucuggguagaggaaugaagacucagaggagacugggguucgcuuugugugauacugauaugguuacugaaaggcuagcccagucccaggcuacgugaacagacuuaaaaaaaaaaaaaaaaaaacucugauuuuuuuuuucccauaaaacucaguguuaucaagaagacuaagugaaacaggacgugugaaaagaaggcaggacacacccagaagcugagcaagggugauauugcaaccuggcccagagcgguuaggugacugggcagggucccuccaccggaagguggcagugccaaggcuaaaucccagaugcccuggcuccaagcccagugcucaucucauuccgccuggugguaggaguagagaaaagguguauccagucuaaagagaggcccguguuccaggaagggcccagaggucaggaccagcccugagagggguuaaguugccacacaggagggagaaaugauugccaaaggccagcccaagcaccagaaggauauccagggccaccaucaggcaacuauauggcaauacauuuccccauccuuuucccugccccuaccagcacccucugccucggacagcugcagcauggcugccaggaaccugguccucauuucuuccuuucccuguguuauccaaggaugauggaaauaugcucugauacaugcagcauuuucguccuggggccacauaugcccagccuuugcaagagccgucugcuagaaacagggaaggcauucugcucaugacucucggcaagucauuugaaauuccaugagugucccugccuguggagccugcuucucccaccacuccuccaaggagacggcucaaaggcccgagggucgccuguguguauguuacucccuaaccagcacacaccuaccucauggugccuuggcucuuucaucccuaaaagugguaauaaaauaacuucuucaaaaguuuguuguaagaacuaaaugggaugauauguauauuuggccuagagcuaaccaaagaggaggcacucaauaaguggcagcuguucugaucauaacccucagguaaggaggcagaacagcacaguauuacacagaugggcuucagcaucaaacugccuggguucuagugcaaauucaaugagcuagcugcugugugacuuugggaaagugacuuaaccucuccucuuuauauuauuuaggggauggaauaaucuuuacuucauagugcagucgugagcaugauaugagccaaaauauauuaaaagcuuagcucagugccuggaacauaauaaauguucgcuaaaugauagcuguuaaugucagcaugguugugguuauugugaucgggcugugguugcaggaagacaagaguggaaagaggcuggcaagacaggucaaaaggccuuggcucuaggcccuguucuggaacaaacucucugugagaucuuggacucaucugcccuuucuccugaacuuuuauuucgccaucuacagaggggcaccaaucaucccaaauucacagggcuguuaggaaauauagugugaacuggcaggcacagucaccugagacgcugucaccauuccaguacgcgguggcucccaaggugugaacccuggacgagcagcauuagcaucaccggggaacuuauuagaaaugcaaauuaccaggcuccaccccaggcugcugagucagaggcugccguggagcccagccagcuguguuucaacaugcccugcaggugcuuccgaugaggcccaagguugaaaaucgcagcuguaaugaauaggugggagguugugcagagaggaugcucaggcguggguguggaaggacagaguaaaugggcagguugguuggcagguuggccaacaaguuccaauaccuucacccggcuuucaaggcucuguaucuuugguccacccuuggcaguucguuucuguuccauuuuuuccagcaugguuuuuagaacaaaccugaccaaugaccagaucauguaugaaugaaugaaugaaugaaugaaugaauuagguaauuaauguuuguuugggguuucaacagucacagaaagaaaaauucacaagcccccagggcagaaaagugaaugcauugcggccaguugucagcagcauccacauagggaguccagcggguauggagaggguaggaggugauaggugggagcagguggcagagggccugauugcaagccaagggugaccccuuuguucugcagacaauacaagugcuguuagggaucuuugaggaagaccaugauaggguggguccagaccuuaggaaaacacagucucuguggaacucucagaucugccuaguucugacccaaccccagguuccauuuuggguucugccauuuaugcacugggcaacccuggggaaaguguuaauuaaaccucgguuuccucauguguaaagggugugaucaugccucccucgcuggguugcugugagauugcuguauuuccaaaucugagucaaaaccuaauguaaaguaaccaucucgcccuuguuggggaaguaacuaacuauaaacacuuaaggauauuguugagauaguccuauguuuaauuuauuaauuuagaugcacauaugcuuaaaacuguaucauauaaaaauacuaggcugggcgcgguggcucacaccuguaauuccagcauuuggggaggccaaggaggguggaucacuagaggucaggaguucgagaccagccugaccaacauggggaaaaccugucucuacuaaaaauacaaaaaucagcugggcaugguggugggcaccuguaaucccagcuacucgggaggcugaggcaggagaaucacuugaaccugggagccggagguugcagugaaccgagauugugccauuguacuccauccugggcaacagagcaagacuccgucucaaaaaaaaaaaaaauacagcuuaaauuuagaaguaaauuuaaaacuaaaguuguucuuuucuacuuuuuuuuuuuuuuuuaccagcugcauccaguaaacauccaaaaccagcaugacugagguuguccuuucaugguggugauacuucuugaaacaauaucuuguugaaaacaaacuaauacauucaaaauaauaugaguuucuuuucagccgggaauuguguagcauucaugcaacgcccuccaccaguagcgaugggccacgugcccacaggacaccauauggauagcucacgguguccucugagcuucuacauuaccucauuuuagccucaccacaacccuaaggagguaggcacaguaauuuuucccauuuugcagaggaggaaacugaggcuuucagacuuauaaaacuugcuuaacagccugugugggaccucaauucuaauuccagaaccaagcuccuaacugcuacccuaugugccuccuaagcacacagugaaugcugaaugauugguggcaauuauuaguauagucuuucccccaaaugcaacugauuaggguuugaacuucauagggguccucagcugagaugccaacggcaaaagccguggccagcugccagucuuuuccuuaucucugggcaggucgggugccgugccauuccuggcuagcuuccaggcagccauuuccucaacagagagaagcucugccccagccccugcccucucggguuccccuccauggacaaucccuuccacugcgcccuucuuucugggucccauuguguuuucccaaugcacaucaccacucguuucuuucccccucaguuuaggagauaagagcggguaauugucuuuuauaggcacuguaaugaagccugucaucacacaaaagaaguuugcuaauaaaauaaaucaaagcagcaaugaaaaugaauggggaacaggcuuucacaauuagauuuguacuugucuagaggcauggugcuucuaugagaagacugccacaggggcagugaaaggguccuggaaacaagcuagcaggauauguuugggaacuccugugcugggaacuccugcgguggagcagcaagggacccagagcagacagcugcaucccccuacaggggugggaguugaagggacagggcagggagaaagcugacagcaacacaaggagaggaacugcaaaaugucaucucaguggccuguauuugucugcaucucgaacaagauggguuccuggucaaagaugauccagcugcugccaucccuggagcuccccuucucuuuguccccagcuggacucugcuccugccucuugggugagaggacagugcucuuggguggccaggccccaaaugguauacagggacccugccccaccccaccugccccaacagaguaugucugggcuggggauggagauagcaggaaguagugggggacaaaggaccuuuuaggagccagguggaagagcagcccuucuacagccccugaacuaaucaagacaugaagcccaauccccacaaccacauggagcaguuccaacugaaaagagcacuuuugcacagaaucuggguugcagauguccccauuccugcccccuguuccacaaaugagagaauaugguagcgagauucauaauaauaucauucucuuggucacuugcagguuuugccaccaaguuaguuaagaaaaaauacuuccucucuuugcacuucagucucuccauuugggaaaucaggccauagggugaaaaaacuugauguuguuuggcagagggcaggcgcucuguaauuucaggguggugguguuucucguccuucugcaaguagaaaugacuaacauucaucugguucucuaagagccagguaccaagcuaagagcuuuucacacacugucuugugccaucucaacagccaucaucauccccacaucacaguugaggagagugaggcucccagguucaaugaccugcaggaggucacauagcaggcauuggugguaugaggacugguaugaggggagucaggcugcagugucugcagugucugucugggucuuggauggucacuaccucugcugugaagaaagggaggagccuaaagauacaaaggacaagugaccugggccaugagcagaaccacagggccugggaucuguggccagcaccaccccccuagcccguccuuggaaggagaguccccuccugucuugggauccugucucuccguggcagaguugagagcuguuugucacaagagggaggugagcaagccaggagcaugacggcgaugcucucucuggccuccuacaucuguuccacuucaccccagacaaacccagccaggauccagcccgaaagagauggcaauggugccuucugcccgagaaacaaggaaaccucgggcucccugcucauggcuuauauuguugcuaggauuacuggaagcaaaaaagacaguucaucccuggagccagugacugaagaauggaugacaaaaugaggucaucuuucucucuagucaagucccuaugcucaagacuuugaaucagucuugauucaccuccucuuucaugaccgagugccucuuacgggcagagcacugugcuaggcacuggggguccaauggcaaauacaacagaugagacuccugccaacacuggcccugagucuggcagggcacagagggguugguaaggacucuuaauguuaaaagugacagaaaggcugggugcaauggcucaugccuguauuccuagcacuuugggaggucaaggugggaggacugcuugagcccaggaguucaagaccagugugggcaacacagggagacccccaugucuacaaaaaaaaauagccagguaugguggcacacaccuguggccccagcuacuugggaggcugaggcaggagggucacuuaagcccaugaggucaaggcuucaguaagcagugauugugauacuguucucuagccugugugacagagggagacccugucucgaaaagaaauaaauauaaaagugacaaaaucaucuuaaacuagccguagccgagaaaagccauggcgggggcgggggugaggggcugucuucaacaggccugcuuccaggugcucaaacaggugucucuuucccucucuugggacugcccugcugggugcucgcugcauucacggacaggcccucccuuacuguguggugcagaggugaucacuggcagcugcaguguguuguccacuuuguucuuccccccagagaaaguguguggccaucacaucaagcaccagcauguguggcgaccauuaaauauauaccccauuacccugcccuacaccagcuccagagcccaggagguugggugcuccagcuggccauccugggucacaggccccagguggagcaguuggaaggacaguccccaauagggagaaggugcacuggacaggcaaaaacaacagaugcccauugcagggagauuagaccagggacauaauccugugaauaauuaauauuucacuucugguaaaaggcaaugaagcaagaugcuguguguagguauaaaagggugagaagccccugaggagguggcucuuaaggggaccugaaggaugaguaugagguagccaggcagagggaggagucuaugaggggagucaauggguguggugagcaagaagugaguggaaugaggugaggguggagggcugcacggggcucuuggucaggccagaggacauucugaagugaugggcguggccugcacugggaugcucucaaaggacccaggagugaagcagcuucaucugagcagaugucugucuuccugaggguaguucacauucagagucggccaccagggcauccugugcugggcagggaagccauggaguaaacccacugaccaaacccuccagacaucccaggaaucugagggcauccuggaugccucaagccucccgacauaucagggucacccuggucccucaggaaccuucaggcugauggccagcaugauuggggccaaagaaaccagaggucacagcaaagagaaggauuuggaaauuuaucauccaccugcauaaaguuaggugccucugccaagcagagcuggacacagagccucauuagcuaaugcaaguuuaauaugaagacaaggaagcuggaugccgaccugaucaacugcccgggagacguucagaaauagagcaggguaaggugucccaccugcucagggccacugcaccaccugaaaggcagagggcagcccagcagcgaccugggcaauacccgccaggcaaaagcaucacuuccacaucaaucacuuuguauaaaggaagaguuauuguuaugggaugcuggcgccugaucaauaucuccugcuuugaaaauaaacuucuugguuuggccuugacauuaaucuaccaucaggagcccauuaucucgagaccaauguucuguucuauugacuggcuggauuuuuuuuucucccccaagaucagaauauaauugcauuucuccaggcagcacuuccaauaauugcagcccugugcacauccccucucgggagggccagaguacaucagggcuggggauggagacagcaggaaguagugggggacaaaggaccuuuuaggagccagguggaagagcaagcccuucuagagccccugaauuaaucaagaugugaagcccaauccccacgaccucaucgagcaguuccaacugaaaagagcacuuuugcacagaaucugguuugcagauguccccauuccugccccccauuccacaaaugagagacuaugguagcgagauucauaauaauguccugaauccagcuguguccccccaucgccucagcaccccucacccagggucaggacggucucauaucaggacgacugcaagagccucccgggccuacucucccugaggccugccccaucaggcuguucuccaccccacuggcagagucaucuuuguaagauguaaguggauugugugucucccucacugaagaccuucugugaagacuccuuguucugccccgugagggcccugcgggagcccugcccgcgucucuggccuccccucccaucccucuuccccuuucucccucugcuccugcccuggcuuucuuuuugauuaugccaagcuuggcccugcccuggugccuuugcacuugcucuucucccacccguucccuugccuuuacuuucaccuucuugguuccaccucaaacaucccuuccgaagugaggcuuucccugacuggggagcauaaaguagcaucucucacaucccauacaccccuacaacgaaucuaugcaauggcccugcucugccaucgccaccugaaaccaucucccauguuaguuaccuaugccaggaaaaauuacccccagaauccaucuuaacacaauacacaguuaugauggcagcgcuucccuaggccagggauuugggaguggcuugguuugauagcuccaccuugggucucgcauaggagaauagucaggccaugagccagggccgcagucaucugcaggcuugacugugaccacgaccucugcuucuugguggcucacugaccuggcuggcaaauuagugcugugggcaggaggccucagcucucaccgcauggaccucuccacagcauggcugggguguccucaaacauggcagcuggcuccuccaaagccagcggucccacagagaaagguggaagccacggcaucuuuaugaccgucauuucugcaguauccuguggguuacacaggucaguccucaugugacucacugggaggcaucuacacaggggcacaaauacgaggaggcagggauugugaggccacuucggaggcuggggccucggcugacugauucacugcuguguccugaguaugcaccagaucuugugcuaaacccuuuuacacacaauaucucaucuuccaguccugccuccucuauuucuuuacaggaaacugagucucagagaaguuaaguaccuuaaucaaagucauaaaguggguaaguggcugagccaggauucaaacccaggccugccaaggagggucuguguaggccaaagucaucaaguggguaaguggcugagccaggauucaaacccaggccucccaaggagggucuauguaggcugggccccucaguggguaugagucaguauuggcuguacauguucacauucccaaguugcuaucagaccagugggcaaacucaggagcucucugugaugucaaauacuccucccugggagagggaggcaaagagaaccaucagaucccacacugcggcaagacccagcugcacagccuagcaagccagacucagagaaggcagggcagggaggcugacggaacugcucagggagacccagcgagaggcucauagauccaggaggaaaauaaauaugugacaguaaaucuacggaaccugugugccaccuugacuacuuaugcuguggcugaugucacuuugugaucaccauggucuuucccacugaucccccgaugccacccuagaauucucaacacagcacuccauaguggauuagagcucagauucugaagucagcuaaaacaggguuuaaauuuuggcuccaccacuuacucugugaccugagucacauuucuuagcuucucugagccuccauuucagcaucuguaaaauguuacuaccuacuuuauagguuuucugaugaggcuuaagugugguugugcaugugaccaucuuagcauaguguguggcaaugguaagcacucagugcugucagcuguuuuuaccgcuguuauuauauuacuguguuuucccaugucauuaggucugugauccaggcuucagcagacaauccaggcugaugcuuuugcugagugcacuaagggaugcuggccuggcgggauggugaacuggaagcagaaacgucauccucucucuuccuucuugccaugcagguguggaugugugggggccgcauggaggacauccccugcuccagggugggccauaucuacaggaaguaugugcccuacaaggucccggccggagucagccuggcccggguaaggugguggcuuuccuuggcggguagaagggguuggccuaggaccaucagcugcacugaggcacccuggggcccuagacuguguuaugugaucucuggguuugaggaugugccucccauucuccaggugaaaucugauuuaaaagaacucccuuaaaucccuacuuaaccauucauugcuaugugaccuggggaggguugcuuaaguccucugaaccuguguuuccuccuuuguuuaaagagagcuaauucuuuccaacucccagcauugccaggagaauuaaggaggugauacuguuucccagagugugacagaggagacgaucuuaggcagcaaacacaggaauguuuucuuguucauguguuuaaguuaauguggauucuaaauuaauguguauucguguagcuaaccuguaauuucacagauauuauuacuuagcauacagcuaaaguaggugcaaaguuagaccagaggugauguaaaaaaacauguuagauaaauauuaauacaggugguguggugugguguguuugggaaagcuugcguacuaaauuucuggaggggaagugggcuucauaaaugucagugucuuucucuucuccucacccccugucuacucuuacugccaaaaccucugcaugucaaacuguuucauugccuuaaaaugguuucuaucaaucauugcuucaauuaaauuggccacuggcugcaaauggaaaucugucagccagaguuuguuuuugguuuggauauuaaauguauucggaaaaaaauaaauaaauccaggugaccacaaaagaaaaaugaagaggagggaggguccccagaggauagaaagagccuugcggggaagcuggaaaggacccccgcacagcuuucccuccggggagccugugagccccgccccggccaggagaccccggugcuggccggguuggcauuagaccgcacugccuccuguccagggcgcugccuccuccuccacuugacaaccuugacguguagaauugcagcccccgggaccuagaagagcguuguccugugacuuacaaggaaagccgagaggcucaaagaggccgcgcgucucccugagagccaucagugggugggagcugagcuccgggaagugucaggggccgcguggagggaaaggagagccggcagugcccuccagugguagcagagccuaacgacgcccucaccagccauccgcgcugcccacagccccauccgacacgggcgggggguagguucuagguucagucccuugaagcaggaaucgcguucuucugaaaggccauuuggcgaucccugaggagggagccaggcaggaaaagcgcacgcucucucgguacgcccaagacugagacucuuccggcuacaagggaccauggggacacuccaacuccagaccaggagcaacccuaaagcauucuuuuccucugcagagcuguuguugauaaggcucaccuaaaaauaaaaauagccgggcgcaguggugugugccuguagucccaacuacucaggaagcugaggugggaagaucacuugggccagggaggucgaggcugcagugagcugugugugccacugcacuccagccugggugacaaaacgagaccaugucucaaagaaaguuuguuguuguuguuguugcuguuguuuuuuuuuuuaaaaggcccaccugauaaagagacauuaccgccuccugcuuguuauagaaccauuauuauagauuaauucaguggauaagagcuaacuguaguaauacuuauaaaaauucccuucgagccaggcaugcaaagcauuuuacuuaucucacuuaauucucacuuguuuuuaaccccauuuuagggauggggaacaugaaacgugauguuggcgauggaaacauuaaguaacuagugccagaauucaaaccuguguaggucugacagguaccuggcacauagcaauuguuccuuaaacagugacugcuguuauuaguguuagcaucaauauuaacaauaaagacuggaacauguauuuaaaagucuuaucuaaauucuguguuuaggcauuuuaacguauuucucuuuuaccuaucuguacugaagcaucguccuguguuuggcuuuaagccacuuaacaaucugaguggugccucauggcuucuuccccagggacucugugauccaucaggucugauuauguguggguucgcagaaccacagagaugccugaaucaggugcggccuuuuauuauggugacuaacaacccucaauuacuugcagaccacauuuaaaauauuuguucagugggccgggcgugguggcucaugccuguaaucccagcaguuugggaggccaaggcgggcggaucaccugaggucaggaguucaagaccagccuggucaacauggcaaaaccccaucucuacuaaaaauacaaaaauuagccaggcgugguggugugcgccuguaauaccagcuacuagggaggcugaggcaggagaauggcuugaacccgggaggcggaaguugcagugagccgagacugagccacuguacuccagccugagcgacagagcaagacuccaucuuggggggaaaaaaagugcucaauguuuuaauaaccacauccuaagccuucuagagcauuguccccuagaugaucauuuugauagauuugagaguuguccuaauagcuccgagagagccagauagagagagaaacugagauuguacggacuccggaaggacaaacagccagacagccuugagguagaagcaguucaggaaggaugagcuguccaccagcuugccugccucaggaacaaguagccagucuuacauuguuuacuaaacuugcugaaaucuuucuuaucuuugccucuggaaaaaggaucuuagggaaggcaauaacagaaacuacucaaacuuggugaaacaaaaauggagacuuacuccaaggauccaggcaaaucucuguaauccaagcacaagaaguacaguugggccucagacgggacugggacucggaaguaggaagguguugagaguagagguaugaggagcccgaagcccacugaaaucccaagguccuuuuuaugucucuaacaaggggagaugugagagaaauaaguguaaagucauuuccuuuggugcaaacagugaacuguagcaaaaaaguucaaaaucugggagaaagagcuuuucaagcugugucuggaagauacaauuaugcaauauuaauuaaaaugguaauuauaauuagaauuaaaauaugauguuauucaauccuuuaagaaugacacugguaaauuucaguaucauucuuaaccagucuggccauggucagaguguccagacuuguuuucaguuggagugaaacuacccucauuaccucugugacucgagcagguuagacagugagccaaaagagccugguggacauacuggaaaaagcagaggaaauauuguguuucagaguguucauguagacagucucuguuaggccuucaacuuccucuagcacaguuuuaaauuaaacacagccuuuucugugcaggggccugguggggauaaacacuguuccugagcuguuuucuaacccacuguggacucuucagcacucaggaagaacuagguagcaacaaggaaauucagcuguuuccugguccccaacucagagccagcaaaaugggggaacuggugaauuuugucuucagugcgggggccucccucauguuggcuuccuucuccauuacuccagagucagcagccuguuuuuguauggccugugaccuaagaaugguuuuuacauuuuuaaaucauuagagggaaugggaaucaaaagaagaauauuuugugauacaugaaaaucaaauuucaguauccauaaguuuuacuggaacccagccacaccauuuauauggugucuauggcugcuuuauagcuacaucagaggugagaccauauggucugcaaagccuaaguauuuacuauccggcucuuuauagaagacauuuaaacauuugggaccccugccugaccuucugcuccuagagcaauccuucacacugaggugcaaaugacugauaacagcuuaaacugcuaacuccccuuuaaccuuucagaggaaauuuuagauugcaauagggaaaaaacuuacgaaggagguaaaaccgaagaguuaaaauugggguggggggacaacagccagggguugaagaaagauguuuuggagcggagaauuuccccugaacccugaaguuuugcucucagauauaucacauaucagaaguucucacuggguggggucuacacugcagauggaaucaggaauuuucaucacauacauaagaauucccucuuccucuguccccaagucuacucacaaacacuuuccucaccugcugccucugcuugccaaucauguggcugucauuuuuuaaaacugauuaucuuugugcuucaugaugaaaguagcagcaaccuuugcaccucaaaggauuauuagaaauuccagcugcugauggaauuacaccuuuugguuucaaauuauaauuugccuuuaucacauagcuuggucaaaacucucaguugaaaaugacaaaaagccaaaucaaauuggcuuagcgaagaaagaauauacaggcuucuguaacuggaaaguccaagguagcucuagcuucagacauggcuggauucugguguuaaaaggcggaaugcauuccuggauccagcccuccgcucugcuucauucuggguugauuucauccuuggacaggcucuccuugucucuccuuggaggccauauggcccagcagcucuggcuggcauccugucuuacccagcaauccaagcagaaacagaacgauucuuccaauaguuccugcaaaaaucccaaggcugaugccuguugguugugauugguggggcuuagggaaugggucugcuguuugaccagccccugcaccgggggcgccuguauucacauuagcuaggcuggguccaugccuuuccuccugccacaugagcugacagggagacaggguggcuccccagaggaaaaucagugggggcuaucgcuagaagaagaugggauggaagaugggcaggcaaaacaacagcagccuaugggccaacuauaagcugugaagcccuuaaaacaugcauaaugauaaauagaaacacagaaggccuaaacucacgguggggcugggauuuuugauggaacauaaaauaagaaggguugaccucgaccugccaggacccuuuucaccccacugccuggcuuuggcuucuuggaaagacugaccccuccauugcuucuugccccauagaaccuuaagcggguggccgaaguguggauggaugaguacgcagaguacauuuaccagcgccggccugaauaccgccaccucuccgcuggggaugucgcaguccagaaaaagcuccgcagcucccuuaacugcaagaguuucaagugguuuaugacgaagauagccugggaccugcccaaauucuacccacccguggagcccccggcugcagcuuggggggaggugagucuggagggcagggcuggcuccauaauuuaaugggugugcaaaaugcaaaugcagaucccauguucaaaagguagaaagucagugcagggaggaaaggcgugaauauaaaaucguuuccuuucuuuccuggucucucucuagccuugucaugguguauuuuuacuuguuaguuaguguucucaguguagaaaaauuaaaacuuuaaguuauuagcaugaauuuuaccuuucaucuuuauauuaugcagugacaauuuaaaauucagauuaacagcauguaacucauguucagaaugggugaaaugacaugaucuguauuucccaccugcugcaugcauaaguauuucucaccagaacaaucuaaacauggcacacaacaaacucagcuuuuuacuucacuucuugauaaugugcauauucuuccaacacucuccaccuuccauuuacugaugaguaagaaagggcuggaaggcaaaggaacuaaggagccaggcacaguggcucaggccuguaauccuagcacuuugggaggccaaagcaggaggaugacuugagcucaggaguuugacaacauuuuccuaugggaaacauaggaagacccugucucuacaaaaaaaaaaaaaaaaaagaaaaaauuagccaggcguaaugguaugugccuguaguugcagcaacuugggaggcugaggcaggagaacugcuugagcccaggaggucgagguuccagugagcugugcucgugccacugcacuccagccuggugacagagcaagacccugccucgaaaaagaaaaggaacuaaggguugcccuaucuuucccuuuccuucauaaguucuuggcuaacacggggcaguaacgcaaguaagaaagaacaugacaggacuuguuggucguuccugcuucuuaggaugcuguugcccuucuuagcacacccagagcgaguuccgguuugaagggaaagcagggccucugggacccccagcgccccuauuuauucagugucuucgcacaugcugcaugcagacagggcagagaggaacagcgugcuucucugcucaugcacacgcuccagugucccaucagauuucacuuacaaaacaguucaaagauaaaauuauucagaauuucaagacaguggcagcagagcuuuaaaucaagccaggcccuccugagcauggggaccugugaacugcgcaugguguggcccgugaggcccaugcuggccgaggcagaccagucuuugcaagcagacgagcaugccaccaugggauccugggucucugagcugagaggaccuacccauucauugauggauagguuggagcuuggaaaaggggagcauaagaguuggggcucuuucagaagaccaauuuaaaguaaaaaaaaauggggggaauauauuguguuugacucacauaugagccugggguagcuauggcuuaagacaaccuggauccagggcuucaaaugaugucagucucuucuucuccugcugaacucauguuccuuuuguguuggccucaugcugaagguaucaaaauggcuuccagaagcuucaggcugaccaaccccuacugcuuggccaacccagcagaaaguauaugccucuuucccaguauaccaguaaaggugcaggaaucaagucuuauucuuggauccugcacccaucacuggggccaucggggaagacgaaaagcaaggguaggauggacacuacggcuggccacagggcgcgugaggagcaguagccccauggaaagucagggugguguuaccagaggaaggggagaggcauggugggcuggcaggaacaccagcugugauuugcucaaauucacacagcagucacagagcccuugccuggcucagcugccuggcuagccuaccccaacaucaccuccaguuugcaggagcacugcuguguggacuucccucaugaggcucuuuggcucuuuacuaguuuguuggcuuccucacuuguguuaguucaaguccuccaagaagcagaugccacagugggauuagacacgcaagagauuuaugguuaaaacacuugagaggaaaaaugaagacaccuggggagacuaggagagccaugagaccacaacaguggucuuacaucugugaaggggugagggaaggaaggagagccgggauaggaagaguccagacugcaguaaagcuguaaggaagcuuuggccagguugaugaagaguccccaagccaaaucaccagccagaggaguucaacaucucgcaagagugggucugccucacccauuggcugggauccauccauggguggacacagugguggauucagaauacaggaucugggugcaaugagacucucugcaacaggaaauuggguggugcauuuucauagccaccacagcccccuaucccucagauaaaguaggauugauaucuguaagguuggaacuacaugaugugacgcuaugcaccuagcacaauggccugcccacaguaagugcccaaucgguauuuguuggcuaagcaagugagcagccuagggcuucagacuccuagcccagugcucuucccaccacacccgucuucaugguugaaggggaagaggcaacuauuguucuuuggaucucagcagggggugagggggccuccugccaccucuugccauucaccuguccuaagggacagagacaguccaugacauacagcaaagguuucauguccuuuucuaggcgcuuucaagguauggucccuggaccaccugcaccugagucaccuggaauggggguaaaaucugguuccuggaccugucgguucaauuucuccaggaguagggccagggaguccuuuaccaacuccucaccuccacucccccaccaccaacccaggacucugcauacucuacaauacuacuuacagcagugcuuuaaggauuacauucuguggacugagucuuccuucauugagaggcucaagguacuuccaacagcccagggcaagcuuuaucaagacgauuugaagguuaauccagcuaaugucucccacuugguuuccccuuucaccuggcagggacccggugggcaccuuaaggcaccucagugguccacuucuucccucuuucccuuucagauccgaaaugugggcacagggcugugugcagacacaaagcacggggccuugggcuccccacuaaggcuagagggcugcguccgaggccguggggaggcugccuggaacaacaugcagguaagggccgccccucagggacuggcagccagguucucugaaacaucugcagccuggggugcugacacggccagcugggagggagaggcaugggucagugauaaaugacaagagucagccccggggaugaguuuuaagaucuuccugaacaccguggaaaggggauuccuucacauugcaauaaaaccaucagucuggaccauuuugguuacaaaugauggacacucagcccaaauggccuucaacaaaaagugcguuauugucucaugucccugaaaagccuugaugauguugcuggaucucucaagagagugcuucccucucugcgggccucauucucaaccuggcccuuccuauauaguagcagauguggccaucagcagccccauggauaggcaugccacuuccaagaguucuggaaaagcccuggggcucccaugaauugugucccugagcugauuaugcaggaagugaggaaguccucauauugaugaggacagagccgucacuuuugagaggugauggguguguucauuaccuugacucuuggagccuaggggcauggucagccucaccugcaggaugggugggaugcagaggguaagccagccugcaggaagagccacugcucagacaauagugggcucaugccugcaaucccaacagugugggaagcuuaggggaggcuugcuugaagccagguguucgagguuacagugauugugccaugcacugcagccuggguggagugacauugggauaaacaauuauauuuuagauacaacaacaaaaacacaauccauaaaagaaaaaauugaaaaacuggacuaauucaaaaugaauaaaaagcaauccacagaugggaagaaaauguuuguaaagcauauaucugauaaaggacuuguaucuagaauauauaaaugaaaggacuuguauccucucaaacucucaaaagucaauaauuuuuuuaauuuuaaagcgggcagauacuuuaccaaaaaaaauauaugaauggcaaauaaacauauuuaaaaugcugaauuucauuaguuaauagagaaauagaacuugcaauuacaaggaaauuccagcacacaccuauuaaaaagacugaccacacugaagauuggcaaagauguggaugaacuggaccuguaugcugcuggugggaguguaaauggcagagccacuuugggaaacuguggcaguuucuuagaaaguugaccauugaaccagucaucccacuccuagguauuuauccaagagaaagaaaacauguguccauacaaagacuuguacacuaauguucauagcagguuuauuuguaauagccaaaaacuggaaaccaccaagauguccuguaacaaggaacuggagugcaaauucagcaauaacaagcgaugaauuauugauaaaugcuguuaggacauagaugauucucaacaaaauuauguugagugaaagaaugacacaaaagagaauacauacuguaugauuccuuuauagaaaauucuagaaauugcaaacuaaucucuagaaacagaaagcagaucaguggcugaccuaaggacauggggguugguggggacaggaggaggagauuacagaggagcaugaggacacuuuugcgggguaaugguauguucauuaccuugauuaugaugaugguuucucgguguaaacauaugucaagauguaucaaauuguacacuuuaaaugugugcaguuuauuguaugccaguuauuauucaguaaagcuacugaaaaguaacaaagguuaucaaccaaauggaucuugacucagacuaacugugaaaagaaauugauaagaauccugagcaggcacgguggcucacgccuguaaucccagcaguuugggaggccaagguuggcagaucaccugagguuaggaguccaagaccagccugaccaacguggugaaaccccuucucuacuaaaacuacaaaauuagccaggcgugguggcacacaccuguaaucccagcuacuugggaagcugaggcaggagaauugguugaacccaggagguggagguugcagugagccaagauugcaccauugcacuccagcauggacaacaagagugaagcuccgucucaaaaaacaaacaaaaaaaagaaucccaagaacacuugaacuguggauauuugaugacauuuuggaccuuguaguaacuacuuuuagauguuauaauggcacuuacugaaguguuuauaccugacaugauaugauagcugagauuugcuucaaaauacugugaggguaaggauagggguggaaguagagcugcaacaacguuggccuugaguugguaacuuauuuuuuuuuuugagacagagucucacucugucccccaugcuggagggcaguggugcagucucggcucacugcaacgucugccuccugggcucaagugauucucauugccucagccucccgaguagguggaauuacaggcauacgccaccacacccagcuaaucuuuguauuuuuaguagagacgggguuucaccacguuagccagccuguucucaagcuccuggccucaaagugauccacccaccuuggccucccaaacugcugggugagccaccgcaccuggccaaguuaguaacuuuuaaagcuaggugguuagaacagguuaauauauuauuauuuggaccucugaguuuaaauuuuuccauaauuuaaaaaaaauggagaaaaaaagaaaguccuuggcuuugcuaucccuauuuaugaugccccugugcacagguauucaccuucaccuggagagaggacauccggccuggagacccccagcacaccaagaaguucugcuuugaugccauuucccacaccagcccugucacgcuguacgacugccacagcaugaagggcaaccagcuguggaaauaccgcaaaguaagaugggaugcggggggagcagggcaccugcuuaauuuuuuuuuaaggcaauacagugcuucaccccuucuuucaacagagcccauccacuuauucauuugugccacaaaccuaccaugccggauuuuguagucauucaagaguagucagaaaucuagacuucacugugaaauccucaagucuuaaauguuggcaacugauuccauuuaaaaagaaaagugcagccgggcacaguggcucaugccuguaaucccagcacuuugggaggcugagguggguggaucaccugaggucaggaguucgagacuagccuggccaacauggugaaaccccgucucuauacaaaaaucagccagacaugguggcucaugccuguacucccagcuacucgggaggccgaggcaggagaagcacuugaaccugagaggcagagguugcagugagccaagauugugccacuacacuccagccugggugacagagugagaaccugucucaaaaaaauuaaaaaaauuaaaaaaauaaaagauaaaaggaaagcacauacacacacacacacacacacacacacacacacacacacgauaaggaccagugaggucugacaggaggugggcagugucuaggucccaggccuggaagcugcgugcaucacuucuggccacaucccagcgggcagaacccagucccacggcaauaccagcugcaagggaggcugggcagcauccggcuugugagcucaggaggaaaaccaacagguguaugaacagcuagucagucagucacuuccucacuuucucauugcugguauuguugcugugguuugacuggccacaugucuccagugcugucuggcuuauuaccuccauguuuuguaggacaagacccuguaccacccugucaguggcagcugcauggacugcagugaaagugaccauaggaucuucaugaacaccugcaacccauccucucucacccagcaguggcuguuugaacacaccaacucaacagucuuggaaaaauucaauaggaacugagcccucauguccccuuggcaggccccccagggucuggcacucacugcagacuuccucuuucaagggaggcagggccccugugggcacuagguguaaaaggugcuggccaaaugguucagggugaagagggcucuugauucaggggcuggggucugccugguccuugagccccugaguuguggggguagggugaagagcauaucccacaagaggccccacagggagcagagacugcuuuaaucccugcugacaucacggaaaagcaacagagccuuuucaacuuugucacuauguccccuugaacauuaugugggagaacaccaagguagccuaggccacccaaaagugaguccugcgagguugcccagcccucagauggcucuccuacaugauggugcuuuagaaacaaagguaaaauuugccuguuuggggcagcuuuuaguaucgaugccacucaucugcagcagaagagaaagaaguccucuuggggcuuuuuaguuucugccguccuggggggaacauugcaguuacugcacagcuucuguucucugucacaaccccaggugauuugguccggucaaaggccauacuuggggcccuaagaguguucaguauugaaugcugaucagcugccaggugaggagucagaagagggagccccccuagacauuucuuugcagcuauggacaugcgggauaucucccccugcucucuggguauuugaaaugucaauuuuagcacucuccaggcacaaggacagcccagcaccagcuuuacagggcaguguuucagauggcccugagcccacggaaaaggccagguagaccuccaaacuagaaaugcuggcugauuugcccugauccaugcuuccauuucccugucucucuuccccaggcaauuacuggccucaaaagaggaacagaggugcugcgaggugcucaccucacagagucuggaggccuccaggaucaacugugggcaaagugccugccucugaccucaucaugguucuaguucucauacagaacuccagaauuuuuaaagaacucuauaauuggauugcaaacuaggaugcuacauaggauucugguauuccacauccaauauggauuucuagaaugcugugauuaaaggagccagccagguguaauacagucaaggcagcccccagccuagagacaaucugugaaauccaaaguuggugguguugggaaagcagggggacaugugucccucagcucagcagaggcugugguacaacaugguccuuggugaagaccugcaccccuggaaccucccaccaucaucacaacuguagucucauuugcaguggagaaaagaacccgacgucccacagccagauauacacccagcuccaugccagcccuucauguuuaccuuuugcuuuguuaauuacaugucagacuccuagagggccuccagacuaauaggaagcauuucuguaaccaaccugccacccacugauucagaaauggaaaucacauuccacaaucuauggcuuccaccagcuagcccaggaaauacuugaaaucagcauuccaauuaguguugagucucuugauugugucauuuaccaauuaaauaacugagaccuaagucugggaacagagccacgaaucugccuuugagaugcuggcagaucucaaggccaucaauuauugggggagggagggacaaacacucccaaucauccaccagucagacugaauguguagcuggcgaggaauuacuuccacuucuggcccagcacaagcccugcuuuggccaccugucugcaagagaggcggccccugugcuugcaacgcuuacguguugaucccaguguccuuuuccaaaugagugcuguagcuuuagaaguggcccucuauagaaagaagucaaaagaugaggccccuucuagaaucuaggauaacaagaguguugacaguuugaggagucgaauugagauucaucaucaaagagcaaugcagcgucguuaaaauaaaaacugugccuuuuaaaaagaaaaaugcaaauauagagcaaaucccuaaacuugaaccauuuccuagugccuugcuagacaaacauaaaggggcaggguuguggggaggggaacguuuuugguggugugugcaguuccuacuggaugaguguguguuucuuaaugucucauuucaagcaggagauguugggucuggagcaagaucugagacugagaugucccccaagggugacaggucagauuuauuucagucagugcaagucacacuccaaacuaaaggcugggcagugcguuuagucuguggccuagaagaccucaucagcccccgagaggaggccuugcauuaccucacugggaccuguuugggggccaucccugcgguccacccucugaacccccagcauguuuguccuguuucucaccauuggguuaaggggugccgagcacuagcuagacuuccacauagucccaccccaagugggcggcaguguuccuggcaugaccaggauuccugugaaagcaggagcagcagcaagccgucccgggccugccuuucccauccuuugguucuccuuuccagucuggguucacacccugaaaagggauggguguguccucugagcacucuggcauuugucauugcugagcccauaucaguagguccugggacuugacaaaguaugugggaggggaaggaaggacagaacuugacuggcuccauuucauggaccaacugaucaauugccaguacuaagccacucauuguuauggcuuccuuuuugaaaaccaccugucucaaggauucagguuucugcucacauccccagcugaugcucaauaaaacucagccaggagcauauggagaugcugacagccagguaaugggugagacuguggggucccuuuuccucuaaagccuuuacucugaggauaaggucacaaaguagggugugacuugaaaguaucgugaccauguggcccaccagcagccuuuccaaaggggaacuccagagacauuucauaaugcaaacagcacuguugcuuuaagaacaaggccuuuggagguggcuaaacuugcacgcacgugugugaaaagccaucccaucuucugccuccaguuggagcuuucagcuguuaaaacagucagaaacuauugauucuucccuuuaggaaaaaaugcucaggcagaacgggguacauccacaggaggaaucggacgagaggaugugacauucgguccaggagagaaagagcaguuucuguuaaagauguaacaaauggauuuccaaagucuacaugacauucacuuuucaaacuucccaccaguugaauuucuuuuuuuccuuaagaaacaggugaugucuuggaaaacagcuccuuaugucucucugugcaucuccauuuuccuagucucuggagucucaaaaagaguggcaaagcacuuuacaguaguaacugaggaaucagagucucugcuucagcgauaucuaguuuguacaguugggugaucuuuuguaauuccuaggagguaaugcauuuuuaauguuuucugaagcuuuguaagugugagagagggacaagaagugcaguucuguucuggaauuccuuauugcuuucaacggacacucuuugugaaaaauccaaguaauauuuuaguucaaacuugaucuugagccaaggcccacugccaccucugggaugggagucggaccuacauaccaagugacaaguucaccuuaacaucugcuuccagaauggcuuugauucagccgugccaggcaacagaacagggucagacuccugcucuguuauuggcuugaagacuaggaucccaaagggguuggaggcagggaauauuugaaaauucagacuggaauuccaggccaaaagcucaagaccaccagccucuccuccugccuggaaaaauaagccuuugugaaagacugauuuaccauguacaauugugauugugaacguuguugaguaaaccuccagacuuucucuaa

SEQ ID NO: 192237 - RNA, 496 nt, Homo sapiens
uagguggcucugaaaagagccuuuauguccaucaaaggggccccgggggcggcgggcggccucacuugcccuuggccuugugguggcucuccgucuucuugggcagcaguacggccuggauguugggcaggacgccacccugcgcgauggucacgcggcccagcagcuuguugagcuccucgucguugcggauggccagcugcagguggcgcgggaugaugcgcgucuucuuguugucgcgcgccgcguugccggcaagcuccaggaucucggcagucaaguacucgagcaccgcggccagauagaccggggcgccggcgcccacgcgcuccgaauaguugcccuugcggagcaaccggugcacgcggcccacggggaacugcagccccgcgcgcgacgagcgcgacuuagccuuggcgcgcgccuugccacccugcuuaccacgaccggacauuuccgagucaaggaaaaaagacaacggcaaccgaaaagcgag

SEQ ID NO: 192238 - RNA, 8948 nt, Homo sapiens
uuccugguguguagguauggauuuagaaaucgguccacucagaacgcaggggcuuucaaaaguuuccucuaggaagcaucugucaguauacccucuuaauguuugacaguucuaaucacaauuauauuuagaauuugagaaaccccccugugugucuaauggcugccagcgugaugccagagaacccuggcagguggccugcaguaagcagaaggcccacaccuucugcagagccaggagcagugcccgagucccccggucugugucuauccuuucacccacauggucacuguggagaugaccaucugaccagacuucggagcccccaggcagaagaaaggcugcagggggccugggaagguggccugggaguaggugugcaggugggacccaucgcuuacacuguagaaggacacuuccccggcuucgaaguccaggaagaugcccauguggcugggaggcuccaucagcaugaccgggguuagggcagagaagguggauaaguacuugguccccuuggacagcugcaccacccagaagccguuuucggggcacuuggggacccugucuuuccggcucacguugucccugcacacacccagggcccacaacgcguccccggugauguucaugcccaccucccaguagugccucccagaggagaaggccgucuggcccacagcacagggguaagccacaaaucgguccuugcugcagaacccacugcccuccggcgaagagccgagguagcgccucuggcggcucucauacaggaggagguagggguacgcggagguggcaucaggcaccacauccucuguagaugggcguggugguggagagauggggagagguguggggcauucagggucaaaggugggaguccccgggcccuagugguggauguggccaaugguccccuaacuccgcagaggccuccccugcugugaaucugggguuacuugaugcuuccacacaccaauugugugugggccuugguggcaauaagguacagggggcugggcagagagaccacugggaacucaacaagauucaucccaugaauuagaaccaccaguaacgccgcccuacgaaggcacagugaauagccagugaccgucaccaggcagugcacuuguagaaccccccccauugguggcuuccgaggcuaggggguacaguggggcaucgccaagagauccugggucagagguccuggcccugggugcccacuuaccuagaaagccucuuagcacuucaaucuguccgggaacucugcacacaguccugggucugguugggggggcaaccucugggcacugcacacucacguuguucuuccuccggugggcacacacaggggagucuuauugacuccccuggcccgacagucuuauugucccccccgcccaccgcugccacugcccccgccccugccugaggggaccacauaccugcucagggguuccuucauguccugcaaaagacagggacggaggguggggagugagccaagcuccuggcucaccucaaugucccugcucccuucuuguccgugucuuagggcaagacccauccuguccccugggcauucccuucccacaauugagcuucauggcacuccugagccuuccccacugcccuagcucccacuaccaccagagcccccagugccucaccuaagcugagcuacccugucagcccacggccacacgccugagguccugcaacucaggagaggcggagggaccccuuccaggcaaguggccacucaacacugacccuccucucccauuucaggugggugcagcccacucagcaggaauggggugggggcgcaauugggugcaguuuggggagggagggggguggguaagagacugaggcaccuggggauuuucuguagccucuuuagggauucagaguucccuaaagagaucacuguuuacuucucuggccuggaagcuacaagggacuuguuuuccaaaggccauauuucuaguugccagagcgugacccuaacucuaggcagggacucucaugcagguggcgcgcuuggcccucugcucauaggagcacccuucuaccagcugcaggggcuuuucccucaguuggucagcaaaccaauguaguggguugugaacaggcugcuuuguuuuuccuuuuccuuuuuuuuuuuuuuccuagaugugaucucaccaucacccaggguggagugcaguggcgcaauagcucacuacagccuugaacucacgggcucaagcagucuuccugccucagccuccugaguccugggaccacaggcgcacgccaccaugcccugcuaauauuuuuaaguuuuuguagagauggcgucuuaucagccguaaucaagcccccucuccagggccauggcacacaggcuggucccggcagacaggcuggcugcuucaccuccccacugccguugccacacaacucacuccugggacagugcaccuccuccacaccgagacauggagucccugucccaaagccacaccuggcugccaggugucccaagccaccucucuggacuuggaaggaaauggggacacugucucagguuggaaccuguaaggggcugacuuguguccccacuaauucacagguugaagccugaacccucaggaccucagaaugugacuguguuuggagauagcaucuuuaaggagggaguugaggucacuggggugggcccuaauccagucugacuggugucuuuauacaaggagaugauuaggacagagacgugcauagagagaugaugccaugaggacgcggggaggagacggcaucuucaggccuaggagagaggcucaggaggaaccaggccugcccgcaccuuggccucagccacccagccuccaggacuagcagacugggagcuaacagcccuuucccguuggcugccucuuccccaagcccagcgcccccugcccaugccugucagagcucacaucccacccugccugccaagccuacuggcucaccugcagcaucuggaggggccccugugugcuccgcuccuccagcugcagcagcagcagcuccagagagugacccugccgguccaggcaggccacgcucucccggagccugcuggcagucuccucuucuuccgucuccagagccuggaggagccucugcucuucuuccaccagguagagguucaucuucucaaacuccagcacaaugcguucucuccgcuccuucaccuugcccugcaggaguggagaagcccagcauguugccagcagguggcucagcuccagggaugcuggcaccucuccccagggcccuggugacccacaagaucaccagcaacuggagcuuuaguuggggaccaggaacugugacagaggcccccaccucugccauccugugauacacugaguguaacccuccgagccccgaacugcaacuucuacacauccaaacacccaugcacccuugcucugaggagguucagaauguccacccccagauaagccucuugggcauguuaaacaaaauuuauggguggccauuguuuuuuguuuuguuuuguuugagacagggucucgcucaguugcccaggcuggaaugcaguggcacuuauugcaaccuugaccuccugggcucaagucaucugaguagcugggaccacaggcaugcaccaccacauccagcuaguuuuuaaauuuuguguagggacagggucuugcucuguugcccaggcuggagugcaauggcacaaccacaacucacugcaacuuugaccuccuggccucaagugacccucccaccucagccuuccaaggaagugggacgacagacaugugucaccaccaccaugcccagcuaauuuuuaauuuuuuuguagagacagggucuugcuauguugcccaggcugggguucaguggcaugaucaugguucacugcugucucagacuccugggcucaggugauccucaggggccacuguuuugaacugggcuccugcgcuggguccuagaagaccagacccaaccagaauggagucacuggugcuaaugaaaccaagggguucacugaucaggucagccugcccugauugcuuuuuguuauuuuguuuuuccuuuuuccaugaagcugaaggcugugccucugaaugcugacgcccacccuucacuggcucuuuauagauaauauucacaggucaccaugggacuggucgcuucaggaauguggggcagcuccuguccagcugaaaccaguugagaccaucugcccuucaaguggaccugucccagugcccgagguggccuuuugaugugagagggccaaaacuuccaaccucagaucaugcuaaggcugccguuucugguaccuguguccugugaaaugccaugcaccccgacgacaccugcacagaaugggccugcuggaccacccugccuccguaguucauaaagacucccaagcuguaucacuugggaggcagguuuaagagcuguucucccuccucuucacucaguggccuugcaaauaaaucuuuucucuuagcugggugcaguggcuaacgccuguaaucccagugcuuugggaggcugaggcgggaagauaguuugagcucaggaguucaaggccagccugggcaauagcaagaccuugucucuacaaaaaaaaaaaaaaaaaaaaaaaaaaaagcuggucuugguggcaagugccuguagucccagcuacucaggagguugaagcaggaggaucacuugaguccaggaauuugaggcugcagugagcuaugauugcaucacugugcuccagccugggccacagagcgacucugacucaagaaaaaaacaaaaaauaacaacaaagaucucuaaaucuguuuuaauuuuguguuuugacaggcauuaggauuaagguuaacuaaaggccauugagaacccgcagaagcaggaaaaccuguuugccucccccauuagcugccuaaaaaaauaaagugccuggccuggcgcgaugacuuaugccuguaaucccagcacuuugggaggccgaggcaggcagaucaccugaggucaggaguucaagaccagccugaccaacauggugaaaccccaucucuacuaaaaguacaaaaguuagucgggcaugguggugggcaccuauagucccagcugcuugggaggcugaggcagaagaauugcuugaacccgggaggcagagguugcagugaacugacaccgcaccauuggauuccagccugggcaacaagagugaaacuccaucucaaaaaaaaaaaaaaaaaaaauuaaaaagugcccuuucaugaaggaauuuccaguggucaaggcaucuauaccagaaagagaguuccaaaaacaacucuucaccugagacacuuguuuaaauacuuaaccaacaucaccugccuccccagcccagaggcccccaagcccuauuccuuuguggugcugaccuacgccccugcccucuggcugccuccuuugugguauugagcccccaccuucuggcugccuccuuugugguacugagcccccgcccucuggcugccuccuuugugguacugagccccuacccucuggcugccucuuugagucugauuuuugaggccccuucucuccacccuaugugugcaucuguaauuuaaaauugccuuuuuaucuuuuucucugcuguucaucugucuuaagucaguuucauucugaggccagccacagaaccuagaaggguagaggcaacuuucuucuuuuccugccacugcggcagcauauccccacgggcagacacagacguggaaaugcaggaagauggagcagcagcaggaaagggacuggacagcccugggcacccaccugccacucggcuaagcucugcuccucccuggccugcagauucccuguccuggugaucugcucccgaagguacuccauguccuccuccagcuucaacugugggacacacaaaccgcaggauuugggaucagcgaucccccuaccuccugccuagaguccaguugugcucgcugaaacugcacccaccccagagacccuccucaggaggggcaggggaucaaaauacgucacccagaaugugccaccuuggauuauuuugagcugaaggcacuuaaaaaagggcagguguaagaauugcugugacccucggccuuccuaagagcagaaggcacagccaccaugccagagaggacugcccuaggccaggaggaaagccauguucuuaccaagggcgggaaagccgaaaccagagaaaucugugcaaagggacccugcuaaacuaacccucauccuccucagguacauguuuggcucuaacaugcuuccaugggccucuggcuccuugggagcgacuccugggucauggaaagcuuacagggaaugaauuucagugcuuugcuucugcuuaucugucucaaaucaguuugguucucagagccacccaaaauacucugagaggagagguaagauuuugcaaugccugcaucauacaguguaggcccacauuguccccagggacaccccuacccagccacaggccaccuuguccccuggaugccuccuccccagccccugacucgggccacuuugucccuggacaccuccucccucccccaugaucugggucaccuugucccccuggaugccuccuccccggccccuugaccugggccccgauguggccuaccuuguaccccugcacugccuccucggcgggcagcacccugugcagccggugcucccgggacucccugcacaccacacagauggggcucugguccuucuggcagaaaagcuugaggggcucguggugcuccuggcacaggucuugcuucugcagaccaggaugcugcugcgccaucucggccaccuuggucagcagccgguugggcagcagguuccucugcggggacaucucucugcacucggggcaggggaaggagcccuuccgcuuccgccuccccuucuugccccucgccuuuucccagcucagcuggaugcaggcucggcagaaguuguggccacagguggucaucacagggucugugaaguaauccagacagauggagcacguagcuuccuccugcaguuuucuggcgaguuccacagccuccauggcuccugggagacacgaggcagguucccgcuugagggacucuggagagaguuggagggagcagcccgaugaucugggcgccggcagugugcaaccguccuguacagccucccuuuacagaggagggcuaggacugcaguccaguuagagaguccagagucaucauuuuuagccuugucaacaacagacacagaugccuccccagaaacuacacagacccucccugaccaaugcucugcaggccccuccgccucuccucuccacugggccuggacccuacccguccacuuccgccugcugcuggcuacccccagcuccacaucucaucagcuccuccuccccgacagaccguugccggcuaggccuucaaccugccuuucuggagaagccugcuaggucagcuuagggagaagccccuacccuuggagccuucccuuaaucacuuuccauccacugaccccacccagauccccacuccaacucccccauacauccccagcugucuuugcuggcgcaacucucccauugcaaguagccugacuaaagagccuuucaaaugucagaauuuuuucuuuaacaaaaccccguacaccaaaggaagaagggaugggcuaucagaggaaaaaagcucucuuccauucgguagugaggugggguucagaaaaaacacgcgugugcauguacgcacagacgaacacccauacacauacccauguauguauacaaacgugcaugugcacacacgcauacccacgcauacacaccacacaaauacaaacauguacgcacagaaacacugauccacaaacacagcacacacaggcacagaugcacauaucgguaaacauacaugcauguacacacagguacacgcgcgcacacacgcacaggcacacaagcaugcacauagaugcccccugcaaucucaacacucgcgaccccacgcaguggagaucuacagacuuucgccuacgccacgggguugcuauggggaccgaguugcagaaggaguugaaaaucgcgucuacacugcaagcacgauucuccccuuccguucugccauccccuaaagcgagggcgucuaggggucucagacuuccccggcucugucccacguccaguuucucggagcuuucugcacgccaaccacccggcgccagcccuccgacuccccccaagagcccuaacggaggcacccagcccacccugaccgaagccgggcagggacagcggcagcgggccuggggcucuggcucuggcugccgggauggcuguccuucccgcucugguccgcuagggucccgguagaguuaccuuguugaagcgcgcuagccccuccagggacgcggcggccggcggaggcgggaaggccgggcguuggagggcgaggaggaccggguuaggcuuaggucguggcccaggcgccacaggaggguagccuaggcggcggggugggggcuacucaccgcggggaaggggggcccgcacagcgccuagugcaccuggccgagcgcucgcugccgggaaaggcugggucugcccccacgaagcccaggaggcugcggcccggcccggggcguggggaccuggggucgggaggccuagggacuuuguggcgucagcgggggcuggggggcggcgggggaggggaaugcugggcgagggaguguucggcggccgggacuggggcggcgccucuuaggagagguuggggguggcuuggggaaggaaggcggcaggggguggaaggcucuggacgagccggggacaggcgcagcgggugcugacugggcgguggggaggauguggu

SEQ ID NO: 192239 - RNA, 8727 nt, Homo sapiens
agucucgcgcgcgggcggaggugggccggugcggcgcugucacguagguucagugggcggaagagguggccccggaugcugcggcgcccgcuggccgggcuggcugcggccgcccugggccgggccccaccggacggugaguacgacaagcgcgaucgcgagggugacucgggucgaggcggcagcggucccugcgcuuugcggucgcccaguccacgccgccuccggaucuccuccuagccgagacgcccugugccgcauucaacugugggcccugagaacgggggagcucuggagggcggacgggcuggcaacgcagcggagcccgggucccggagggcggggcgcuccucaggagcugggcaggccggcaguuaucgcagugucgagcugcuccccgggcguauaggagcgcucggugucuucccgacaccugggcgcgccgccaaagagagcagcugggagucccuaccgcuggcccggcgcggugugcgcuccgguucccaccucacccugcaagccuugggguccugggcggauggagccggcuauuccggggcucccaggauucugccuacuccgcggcacggcgcagagacggggacuuggggaaacagcaggccuucccgacgcauggguguggcauuugggguucggauucuccaaagccagaguccggguugggguucuugaagcugcccugcugccauucuugagcgucgccuuagaaguaugccccaguaaggacuggugugggaagcaggugccucaaaguugauuuugacccugcguguggugggccucgguuucgucuuugcaugaaagaggucgguccugaggccccgggcuggguccugcucugcugucuuugggcucauggccccuuccugucucaggcuugcucugcucuuuaccugggguugcugucgaggacccugugcaagacucggccgguuuuucuuucucccugauggacagacccaaacauagccgcgcagcaucgugaagggcuggggccuucacuccucuguggcucuggaagagcccgauuuccucaggagguaaaggaauguuccugucccccccggggaaagaaagugaaaaugaaagcgcccuggcugcuccugguguggucccauuuaaaacgagguugcugaaggccaggaugcgugcuacccggaugugugcccagaaacccugcagccaagagcagccgccuggaccaccagccuccccuucauccaccuggcccagcccagagcccaggcccacgucuggugguuugugucuuacgagaggccaggcgggggcugaauucucucgguucucagaaggucaagcccucuguuagcaucuccucgaacagugggccgggggcaagguggugacucuguucaguccuuaggauggcuggaagccagaaggaggagauuaugccgccacagcagggagugccuuuccaggaaagcggcugcuggggcagcaugggagcccaguccagggagcguucuggcagagaccauuccggaacauggaucugcgccggcggcucccaggagaccuuccaucucggagcuccuguggagaccacgugccuggcagguccuuacaguuguggguuguguggcuucuugccaggcagcugauuggaguuugcgacuguggguuggugagaguggagagcacagaauguuugcuggaaugcuucccucugcccacaggaagacaccuuuggcgcauguguucuggucagggcaaaggcuccgugguuuccaccgcaagauugcaggagccuugaggccugggccacaguuuucucccuugggugugcuccauggaagguggcuuuggugaccgcccugccacuggucucuccccaggcaggcaggcagccugugccuccgcccugucuccagcgguggugguguggcugugcuucugcaaggcccgcauccacucacugucugcccucugcacucucuggcuggccagggcccccaguagucugcucauugugcccucacgcuugggcagagccgaacucaggggacccaggaagagcggaguguuggcccguccagaguucuuggcaauuggugugucaugugugccucgugcccugugcugggcgagagugggcacagcugcgcagacaacgcccuuggcgaggcuggagccuggaccccugccuggcagcagcugggugaacuggugucuucugccugcgggcccagccucaccucaauagcuuacugcucccucaggagggaggaggggaggccugggagccugggcuuggcgggguaaggguggugcaggggcaacaccuguggaggaaacaggcgggguuggggcccaccagcgucugcugucugcucugugcuggguugcaucuguuggugucugaucguugucagggcccuguggugaagagacacaccugccacuugcugcuugcgaggaaagggggagauccccaacccaggagccagaggugggacuccagcaccccccauuccugggaguuggaagugaggcacgagcuccccaauuccugggcaucggggaugggguuuggggccgaggaggggauggagaccagggucuugugguaguuuggugggauccucagaagguguggcucucccccuucugaggacgcaaaaacucccagaguuuuuggcgauugaugugccacgugugccuugugcccugugcugggcgaguguaggcacagcugugcagacgacgcccuuggcaaggcuggagccuggaccccugccuggcagcagcugggcgaacuggugucuucugccugugggcccagcuucacuucacuagcuuagcgcucccucaggagggaggaggggaggccuggucaguggaggucaccacuguguuuccuucuguguggguuuauagucacguagcaucuagguucagacccgaagagcuuggagccaggggcuggggggaacagggcaggaccggccuuggggcagcccugucaggcccaccagugccaugcugguuguggguuggcagggcagagugaccuuaagaagggccagcucaguggagcaacaggacagaagcucacaugggguccagcccacaggaccauuugaguagcucucccauaucggguccuucgaagcacaugauuuagcuuuacuuuuucuccuucguauuagaaaagucaccauaauaccaucaagucauaauuucugugaucucagugcuucaaguagguguguagcaauugcuggauguguccugagaacuguaccccuuccacccuggcgagaagcaggggccagaaauucacacaaguggcauggcucauugauugugggagacucuggggggcuccuagcuagugcauuaugggaaccaggcuguggagguugcagggcucgcuggcugggagaagcugaauggauaaagaacccuggccacugcagugcgugcugaugguuggcuggcacguagaggagguggcagggcugggugagcagcaggagccagguuaguggggaggcccgagcuaagcgcaggggcaaauucugcgggugggagagccaggagggcauggggugcauggugagaugaaaacgaugugugcuugugacaaaaagcccagaagaggcaguaaggagggaggagucuaucccuuauggagagcacauggacuucuggguggguguccugcaguucccuuccucuugagucuuuuuaacuggggguccgguguguuugugaucaaugacauguaugcgugugcauguguaccuuugcagguacacauguguggugugugugcauuugcuuggugugcgugcauuuguguguguguuugugugugcaugcauguguguguguuugugguagguuugugcacacauccugcauaccuuugugccugggaguggcauguguguggugggugucgcugugcaugauggaguugcagccguggugcauuugugagauuaccucgguggccuaaauuggggauuaggagggcauccucagguccuucccacugucugcucgucugcccacaggcggcugugcccuaaacaggaggaggccauucacgccucgccugaguuguguccaaggugugcguguggccagggguccauccgcuucccucuagcccagccccugaacacagcugcagugcacggccccacuccucagcucugcuccccaucccaacucgaagacgcugcccuggcccugugugugcagcucauguggacugggagggcagggcaggugcaggucuuggggcaagagcuggagcugucuuuuccuuccugcacagccgcagagcagguggauggggcugcuucccugcaagggcccagggccaggcccccuggggauuuauucguggcuuagaaggguggggccagaagcaggcguaguggggauuagggacucagcacccccagcucucaguccagcagacagacccaccccaggcugacuacagaggcugcaccucagcaaacagguaggcccuguucuuggggaggauucccaccaggcaaaggccagcucccgggcccucaccugccacguguccaagcuaggauccuguuugccuuucccuugggggcugggagggaggccuccaacccccucuggcauuaccagcaucacagauaggagucccaaguccuaugagaaguuccuggaauagguguagauucaguagaucuuuacaagaccauaucugcagggcaagguaccagaggacagaggcggggacagggacacuuccauuccagaccuagcagcccagcacucagcaccaugcaugggagcaaauggcuggacuccuggguggggugggggucucagagcaggcucccagagggcuuggaggugacuccaccagguggggacggcagcucccagguagggugucaucagaguagacagcauugcuugcuagggaccccuggggaggcugacagggucaguggguuucaguuggggggcuccccugcugagaacccaguaaagccggccuuccauucgucucccgugugcccagagccuggucugagggccgcccugugcaugccggcccuuccaacguggcagagcucagggggaagaacacccaggcucucaggagacucucaggccaaugucuccaucccugggucagcccuuuccugccaugaauucaggaaggcagaggcagcucagcagauggggacuagaggccgcacugcuauccacagccucucuucucacccccaggcaugucgggccccaggccuguggugcugagcgggccuucgggagcugggaagagcacccugcugaagaggcugcuccaggagcacagcggcaucuuuggcuucagcgugucccgugaguccagggcucucguggaggggugcguagaccucaaggcugcugaguaguccuagcaccgugagcaggccaggagcccaaacccaacaggcacacccacccugcagacuguccgaacucuugcacacucccccccacacagaaccugagguuaucacacuccugcuguccugcgugccugugucucccuucccugggucuguugaguacugauaacugggccacaguguuucuuucugggagaacccucgccuuguaggcuccugcgccuucccaguggugugcuucacuggcugccugcauccuggggcucaagugcugucgggacugcaagggaaacgcuggguggggcauugggcuccgagcagcccccgaugggugacaggucucucugcuagauaccacgaggaacccgaggcccggcgaggagaacggcaaaggugagugggguggggcccuauggcuggagcacccccagugugggcagggcugcugggcccugcagcuguguuggcugugcugcccgucuccugcccccaucaaucccuaaucugugagauggguccuugccuccaagggccggugaacucaaucagggugucagcgccacagcguggugucgccuuccuuggguacagugugagaggccggccaaggccuggggcugucuuccucccaccuuggaggcggccacagugcugcuguccccagcccuguccuggacucggcacuuaucagcacuuuugagcugucuucuggaguccugguaaaaagggcuacucugccugccugauucaagacaagggacccccuucccaacagcacccccgccccuugccgugcaacccaguggucuccagucaccccaccacaucguccccucuguaaccugacggucuccaguucccccaccaccuucccccagaaccuguuggucuccaguccccaccccaucaccaccaacucccaacuccccacuggaacccagcagucucguaucuccaucagugaggacagugugagaaauggugucuggcucaggcacuuggcagcacuugagggguccucagaugucuccugcccagcaaggaucugacuaaagcagucgugggugugggaggggccugcaggcaugccuggguugggggcagcuggcccugggcacccuggugcagguccagucugcccucuggauggccccuccucuuccccagauuacuacuuuguaaccagggaggugaugcagcgugacauagcagccggcgacuucaucgagcaugccgaguucucggggaaccuguauggcacgaggugggccaugcgugggugugggugggcucccaggguugcuguuggcaacagggauccagguagugccugcugccugcccgccauccacaccacccaccccaugguuaugaauguggccagguuguggcccagggccaggcucccacgucuguggcccacaguggcucuuuucaugaggcugcugggcccgguccugccaccgugcauuguccuggcagggugaagggugcacaggacaccucaugcucacuacaggcaccuuggggaguggguggccucuguucccuguaggcggggcagggcguggggguagcagguuugagaugcugucgggugcuggguccaggccaggccuaggcucagcugugggaggagaacgcugggcccgggagggccugggugucccugaagcuccuguaggccucagagagcccuggcaccccugcugaccuggcaccucuccccagcaagguggcggugcaggccgugcaggccaugaaccgcaucugugugcuggacguggaccugcagggugugcggaacaucaaggccaccgaucugcggcccaucuacaucucugugcagccgccuucacugcacgugcuggugugugcugggcaggguugggggcugggggccagggcaugccaggcucugauugccacccccuuuuuaggagcagcggcugcggcagcgcaacacugaaaccgaggagagccuggugaagcggcuggcugcugcccaggccgacauggagagcagugagugugccgugggaucaccagggaaugccaggaggggagucaggguucugaggucuguggcaccagggacccuguggguccccagaccuccugacaccuggagucccugugaggguccucagaccucucaacuaccucccaacaccuagaguccccgugaggguccccagaacccacccccagucaccaagggucucauugaggguccucagauuucccucuguuacccagagucuccgugagggcccccagaccccccaucgcccagggucccaugagauguccccaaccuucuagccccgggggugucaugugcauccucuuacagcuguugccucuucucugggucugacugcagcccacaagaagagggcauuuaauguucugcuguguguguagaggauaguguagccccuaaccagaguccugaugggugcugguguccagacccaaguucuggggcuccagagagagcaggaguggugccugaggacugaggcccagggggcggcccuucccuacccugcacaggcccggcugggcuggaaagcugucccacagccgcagugaggacagccgcaggccagugggcugcucugggggucgugugggaccugggguggggcugcaugggcucacugugcccugaccccaggccccacccacaggcaaggagcccggccuguuugauguggucaucauuaacgacagccuggaccaggccuacgcagagcugaaggaggcgcucucugaggugggcccauccuugugccuaccugggcaaggcccaaggggaggccugggggccaggccuuuguuguccaugaggccacugagguuagaugggacaguccuacccaagcacuggcaugagacaccgagguccacgguggagggagagcaggaagcccagcccuuccuggauaccagcccucccaacucccuuucuuccucacuggcaggaaaucaagaaagcucaaaggaccggcgccugaggcuugcugucuguucucggcaccccgggcccauacaggaccagggcagcagcauugagccacccccuuggcaggcgauacggcagcucugugcccuuggccagcauguggaguggaggagaugcugccccugugguuggaacauccuggggugacccccgacccagccucgcugggcuguccccugucccuaucucucacucuggacccagggcugacauccuaauaaaauaacuguuggauuagaaacuccauaa

SEQ ID NO: 192240 - RNA, 2595 nt, Homo sapiens
ucgggccuggguccgacgguaguggguagcgggucucggguugcggguugcagguugcaagccgcaggccccaggcaacugccuucccggcgccauguucggcuccagucguggaggcgugcgcggcgggcaggaccaguucaacugggaggacgugaagacugacaagcagcgggagaacuaccugggugggugcgcgcggugggcgggcuccgggcuccgggcuccgggaucccgggcgggcgcuggacucacagcgucuacguccgcaggcaacucgcugauggcgccgguaggccgcuggcagaagggccgcgaccucaccugguacgccaagggccgggcgccaugcgcgggcccgagccgcgaggaggaacuggcagccgugcgggaggcggagcgcgaggcgcugcuggccgcccugugaguguccgcggacggcagcggucggugccugggacggcgcugccggggcaggguggggccggggccggggacugggggucgggcugggcgggagcggggcugcggggacucgcgcgggcgggacccugaggacgaaggcuggaguggugaggaccuguggugggaggagguccguccguccugacgccugccccggcccucucgcaguggcuacaagaacgugaagaagcagcccacgggccugagcaaggagguaacuccccgggguggggggcgcguggagggccguggguguggggccgacucgagcgcucccugugcucucgcaccugcaggacuucgcggaggucugcaagcgggaaggaggcgaccccgaggagaagggcguggaccggcugcuggggcuggggagcgcaaggugcgggcggguuuccaggggagggcagcacugggcucgauugcucgggugaggcggaccccugccguacugucuucaucgccaugucccugcaguggcuccgugggccgcguggcgaugucccgagaggacaaggaggccgccaaacuggggcugucuguguucacgguaaucccccgccccgccugaccgcagcaggggcuaacagggguggggcggggcgggggcacugaacggagcuccccggggcgcugcggggcgugguguggggccggcccgcagacuccuccgcagagcucgcuucucccgcagcaucaccgcguagagagcggcgggcccgggaccucggcagccucggccaggaggaagccgcgggcggaggaucagacggaaagcaggugaggcugugccaccugggcuagcugugccccgggguggggggucucgggaggaccggagcggcucccacucgggcagguggcagcuucucuuggcgcaccggcccggcggguggccugcccuacuuuacuuccugucccaguuacuccuagguuuuucucuaggggaguuucucgggucacccuugaagagagguccuaaguacuggcaguggucgggcgcugugccgugggagggcacucaggaccuggggcggggccuuuuccugccguggguggcaccuccagggcuucuccuggauggugagccugggccugacccuaagaguggccuggugggugcagguaggaaggugucaaccugccaagggcacggcugggguggggcaggggcgugcuguggagauggggauauugcaucuguuucuaacccacguagccacuggccacgugacuacguaacugaggaguggaauuuguaguuugauuuaacugauuuaaagacgcacuugugggugguggcuucaucuggauggggccugcuuguguucacucucuuggcuugcaagacuagggucugaggcacaccuuguauccuccuuguaguugugagagccacaggaaaagcaagaaggagaagaagaaaaagaaaaagaggaaacacaagaaagagaagaagaagaaagacaaagagcacaggcggccagcugaggccaccuccucucccacaucuccugagagguaugcccugguccauaucugccucuugggggugggggccugguugacuccuuccgagugacugacugccauuggucuccccaggcccaggcaccaccaccaugacuccgacuccaacucccccugcuguaagaggaggaagcggggacacaguggggacaggaggagcccgucucgcagguggcaugacagaggcucugaggccugauggcuggacccugcucacugcuguugugggacccugaacccucccuucaccuugcuugccuccugccucggaagcuccuugggugugggugaagcccgaggcugcuccuguggaaguggcucugggcaccagccuguggggcuaaagacuugacagcuagcucuggagcagccggcuuccuggaaaaccuccagguuucgcauaccagggauggccccuggcuuggccugcgaaggugaaccugcccagauuuaucaguagaggcuggacucccucuguguccugcccaugguugcagcagccaugggccuaugagcggucuaacuguggccaaguauggugaccucuauuuuucuuuauauugacucuuuguauuucaauaaauauauuuuaaaaggaaggua

SEQ ID NO: 192241 - RNA, 21740 nt, Homo sapiens
aacuguccauucagaugggcccgggagaggagggcagggccugcgccucccuacggagccuuuguuucuggcgaccguccccacccgggcucgcgucuccguuucuccgagaggcccaaggugucuccgccgcagccucugucgcgccgugaccuguacaggucgcgggagucguagggaggacgccgggacaccuggaagccgagaaauggugcgugugaggggucaggcguccccagaccugggggaggggcugguuggaaccggccggaaccggcuguggagggaccuaggccucccugcggcgacuccggggucugggacccgaguucccucggccgcaagguggggcugggccaggagcugggaccccggucguccugucccgucccugcgcgacgccugcggccccgcagccccgcgucuccccacauggugcgggggccgcgggagggucauggggguaucccuccucggaugugguucguguugcaggagcugcggucuguggccgccccccacagucccgccuuucucccguuaaaaauuuagaguuuauuugagcaaacagcggcucaucgauggagaagcucccggucgugguuuguggcuuggggauccguuggagggaauggaaggaaaggcuguaaggugcaggaggaagcgaaccaaauucaguacuugguuggugacaguuaugcagucgccuuauuugcucuaucuagguggacauuuucugcuuauguagucagagguggauuggugguugugguuuauuaacccuaaauuuuauuuccuuauaaacugguaauuuauaagaauuucauuugaggcuggagcgcgguggcucacgccuguaaucgcagcgcuuuuggaggccaagacaggaggaucgcuugggcccaggaguugaagaucagccucgcaauauagcgagaccccaucucuguuaauuuuuuuuaaaugaacauauucagacugagaccaaaaaacuacuacaaauuuuuaaaauauaaaaucaaauaaaagaauuucauucgacuuagauuucuguuuccuuggguaggaaaccaggacaccauagccacagcccucuaauugucuccaaauuaauuauuuuaacacuccccagggggacagggucccaaauccuugaccuuguuccccuagccugacuccucuggcgcuugcaaauaauucuugauaccacuucuuucaccauauucccaaaagguaacuccagucacgacauuaucaacucuuuguccuuuauugcacauuucaaacuaauuaauuuguauuauuuuuucaaggagcaaucgauuggucuuuuaaaaauauuugcuuucuguuucugaacauuucacaggagaggaaagcagagaauacauguaugagacccugcugugaaaaaaccuuugugccucuucuccuuuucucucuccuaggcacagggauguucucagaaugucuuuugguuggccuggugccauggcucaugucuguaaucccaacacuuugggaggccaaggcgggaggaucaccugaggccaggaguuugagaccagccugagcaacauagugagacccggacccuaaaauaaaaaaaacaaaaaacagugucuuuggguugggguuccccuuuggaaacuuuaaacugugauaugucuucagagcauccuccuuuccugguccugggcuucagggcuguuugggcugacacaggaugcccacagcagccagaucuguugaagggucugguaucagccugcucccacuggacagccugaaguacgggguggggccucuuaguggaggagcuggguguccuggggucggaggaaucucuugauauccccucccucucaaagcucaccccugggacacucagcuuuucuuccccuaauuccagaucccauuccuugggggacacauugguguccagccaaauggaugaugguauugaggggaaaaacagauaugauucuugcccucuggauucuuuuagacuggugaagugagaaaacuuaucccaaggacaggaaaacccaucccacugaggugaugcaagaacuugaaaagcaaaauguacuucaggcagauggaggcaaaaugcagugucucuuggaaggguggucacugagcccuucagugagcagguuaggggguggacgauaucccaggugauagaaugaccugacuuaggccgggcgcgguggcucacaccuguaaucccagcacuuugggaagcugaggugggcggaucacuugaggccaugaguucgagaccagcccggccaacauggcgaaacccugucucuacuaaaaaauacaaaaauuagcugggugugguggcaggugccucuaaucucagcuacuggggaggcugaggcaugagaaucgcuuuaacgugggaggcaaagguugcagugaaccgagaucacaccacugcaccccagccugggugacagagcgagacucugucucaaaaaaaaagaugugaaacuugagucagacguaccucuguuccagguuagcgcagccccuuccuggguuuguccccugcaaaagauuuguucacuuauugcaguuucaguuuuuuucuuuuuuaaguaacuauaaauguauuucaucaguagaccuugaaauauaagacaguuuugcaaagaggcaagaaggaaguggauuucagaaaacauuaaauaucuagucuuauguuuguuaaaaauuauuacuuauggcugggcgcgauggcucacgcauguaaucccagcacuuugggaggcugaggcaggcagaucacgaggucaggagaucgagaccauccuggcuaacacagugaaacccugucucuacuaaaaacacaaaaaauuagcugggcaugguggcgggugccuguagugccagcuacuugggaggcugaggcaggagaauggcaugaaccugggaggcggagcuugcagugauccaugauugcgccacugcacugcagccugggcaacagagcaagacuccaucucaaaaaaaaaauuauuauuuuuuucuuucccaaagcaaguguaguaaguuucucaaguauguuguuuuuuuuugugggggugggguguggugauuuaaaauggaauuccagggcuuaguguugggaauacuaaggaaaagagagagagaaaacucucuucuaucaugacugcagaaaaugaauacauuuccacaaguaaguguagcaaauaaauuggugaauuacagagauucaccaaaacaucaauuccucugcuuugcaggguggcaaacuugugacaguggauaacuguucucuuccuguuaucuagacaucagaguuuaaugcgaaguccuaguaggacaggacuugguaacuccuagaaguguuccaauaugauuuaguacaugauuuguuaccauagaaagaauaaauaacauguuuauugucugaagaggauggauacuuuuacuuuuccuguuaagguaugaaauauaagugccuuacaauuuccuuccuugcuauaaacagugaauuugagugauuuuacuggaaucuucaaacccuggguauuuucucauugaaaauuaaaugcauaaccuugacugggaaacagagacagcagacuagugacuugaaacuaagaccaaucuugagccuucaaagagaggacauuacaggcccagugguucuugcugaggagccuccccugcagugucccagcugcucacaacugacuuuggguggagcccuuuauagugagagaagcucagagcccuggaaagcuggggauucauaggcagaggugguugaggugaugccuuucugagaauguacuugcuauuaucuugggucuguuuguagacguuucuaaugaaacaaaucuggauuuagguaaggagugauuuauuuuauuuuuauuuauuuauuuuuuuugugugugacagggucucacucugucuccuaggcuggagugcaguggugcgaucauagcucacuguagccuugaucuccugggcucaaggaauucucucacaucagccucccaaguaccuaggacuaaaggcaugugccaugaugccuggcuuauauuuuuaaaaaaguuuuuuuaagagagacaggacguuguuauguugcccagacuggucucuaacuccuggccucgagcaauccucccaccguagccuccccaaauuccaggauuauggggguggggcggggagcaccaccacaccagacaggaaugacuauucuaaaggauaaucgaaaggggagaaggcaccaaguauaaaaucuucaagcaucucaggcugggcgugguggcucacgucuguaauccaugcacuuugggaggccgagguggguggaucacaauguuaggaguuugagaccagccugaccaacauagugaaaccccaucucuacuaaaaauacaaaaauuagccgggcaugguggugcgugccuguaaucccaacuacucgggaggcugaggcaggagaaucgcuugaacucaggaggcagagguugcagugagccgagaucgcgccacugcacuccagccugggcgacagagugagacucugucucaaaaaaaaaaaaaaaaaaaaaaaaaucugcaagcaucucagaguuuaugcagaaaaggauuuucuuuuguagggaggagcaaaugaugagaaagaaggugggagguggaaggcaggaugcagggugcaaaaucccaccuagauccugaaggcagucucuucuuaggagggucaucagagggguuguauauaggcucaggcugggggugggucaaaguucaggggcuggaggaagaagagaaacuuaaccaaaguuuuguuaacagguacuuuguucugacugaucacugaagacagagcuguucagcuaaucaauugugaggaaaauaaagggaauuucuagucuguguauggcuuugucauagguaaaaaagcagugucaucuaagucauaaugagaagaguguuucuuugcguaaccugcuccugcagaauacaaaagacgggggaguuucuuuaaccauagcuauuuccaggauuacauaccugcccaaucuucugccgccauuuucccuuacauccaucccuuccauuucgccauuucugauuuauaugcaguugcugagaaguaugggugaucccuggggcuugugacuggcaucugcaguggggcacuguuaugguaaugagcccugaacuugugggguccccguuaacucuggguagugucagaauugauuugaaugcuuaauugguguuggagaauuggagauuugguuguguucagcaaacaccacacauuuggugucagaaaugguauaugaaaaaagacacuagagaucagaaccuucaccuggcucuggguaaguguucgcuggugagaauugagacccuggaggagggagcauuuccacacugugaggagaggagaguggguugugugaaacaccuguggacucacuacccagguucauaaaugggcauugggcauuucugguauguccugaucuugucucccgucuguacccacaggugaccagguccucauuuuuaaaaggugguucuucauaguuuuaccaucuauuuaucauuaggcugaauuuugcuuggcucuuccucuuuugaauuuuuaguaaguuauuaccauuaauauuaugccaaaaagaguuuuuuuuugguuucuuugccuguuuguuucacgcaugcugguuucugcauuuaguuuggggguuaggauuucagcaaaugaaaguuugggcaggggauggugguggaauacaaacauucagucuguuaacaauccuaacuguauuuuguacgacaucuuggcuauucuuagccuuuuuuuuuuuuuuuuuugagauggagucucacuguguagcccaggcuggagugcaguggcgcucuuggcucaccgcaaccucugccuccgggcucaagugauucucccaccucagucucccaacaagcuaggacuacaggugcacaguaccacaccagcuaauuuuuguauuuuuuuuuuuuguggaggcgggguuuugccaugcugucuaagcuggucuugaacuccugggcucaagcaguccacccagcuaugccucccaaaguguugggauuauaggugugagccacuacgcccggccuuauuuuugucuguuuuuuguggaagugauaucauccuauauguuauauuguaugccaucugucuauuucacauagcugugaaucuuccaugaaaugguauuuuauucacuauuuuacuuaauaaacuuuauuuuuuagaccgguuguaguuugacagaaaaauugaacagauaauacuuagaguuuccuuauucuccuccacaggugauuguuuuccccuacuuuucuuuuuuuuuaagagacgaagucuugcucugucacccaggcuugagugcaguggugcgaucacugcucacugcaggcuagaccuccagggcucaagugauccugccgccucagccucccaaguagcugggaccacaggugugcaccaccacaucuggcuaauuuuuuuuuuuuuugguagaugggggucucacuauguuguccaggcugaucucuaacuccuggcucaagugauucucccauccuggccucccaaaguacguaaauaugauaucauauauaucauauaauugaugaaccaauauaucauauaugaugaugaucagaauuggugagccaauauguuacuaacuaaaguuuacacuucaucaaaauugguaauuuuuguucuucaaaggacaccaagaacuugaaaagauaauucaccaaguggaagaacgacuugcaaauccugugucugguggggcaucuuauccagaagcagccugagucucaguccccuccaucacacuccaucagggugggggcugaauuggcagccaggacucccagguauccugucccaucacuguaggaggcagucuaccuccuggaccucucucugggcaguugugcaccugcaauccuggaucucacccagaucauggggugacaacagggaguggccauccagagagaaaucugagccugguguuuuggguuugugggugggagguacucucaggacacccucccccuccauggauucagacuugggugggcccagcagaauggcaugugugguucccagcuccuucauccccagugggagggagccugucauccccuaugcauuucagauaaaugaaccagggucucaaguuuacagccuuguucccuguuaaagagagauugcacuggaaacuuguuaagaaugucaaggaaaaguuuauuaagcacaauugcagugagucaugacagcuguaauaggggagggagauugaauucagccuugaaugcagcaggaauauuauuggauuuauagccaauguacaaggugagggagagaauggaacuugguugggucucauaggugggagaaaaagaacuugauuggauauuaagguaggaggagucucuauaaacuaccuuagauggauucuugcugaaacugacuucugcaggccagugccaagcccuagucaaaaagagggcucugaggagcuugacucaaguuuggugaaggaaggaguacuugagaccucuucagccuaguuuuucuuucuuucuuuuuuuuuuuuuuuuuuuuugagauggagucuugcucugucacccaggcuggagugcaguggugcgaucauggcucacugcaaccucugccucccagguucaagcaauucucugccucagccucccaaguagcugggguuacaggugcccaccaccaggccugacuaauuuuuuuuuguauuuuuaguagagacaagguuucaccaucuuggccaggguggucuugaacuccugaccucaugagccaccgugcccagccucuucagccuaguuuuucccagggcucuguauuagucuguuuucaugcugcuaauaaagacauacccaagacuggguaauuuauaaaggaaagagauuucauugacaggucaguauggcuggggaggccucaggaaacuuacaaguaugguggaagggaagcaaacauguccuucuucacauggcagcagcaaggagaagugcagacuaaaggugggggaaaggugggggaagcccauuauaaaaccagaucucaugagaacucacuauuaugagaacaacauggagguaaccaccccaaugauuaaauuaucucccacuugcucucucccaugacauucagggauuaugggaacuacaagaggagauuuggguggggacacagccaaaccauaucauuccacccccagccccucccaaaucucauauccucacauuuuaaaacaaucaugcccucccaacagucccccaaagucuuaaaucauuccagcauuaacucaaaaguacaaguccaaacucaucugagacaaggcaagucccuucugccuaugagccuguaaaaucaaaaacaaguuagcuacuuccuagauacagucauuggguaaauauacccauuccaaaugggagaaauuggccaaaacaaaggggcuagaggcccuaugcaagucccaaauccaguagggcaguaauuaaaucuuaaagcuuugacauaaucuccuuggccaggcgcgguggcucacaccuguaaucccagcacuuugggaggccgaggcaagcggaucaugaggucaggagaucaagaccauccuggcuaacauggugaaacccugucuguauuaaaaauacaaaaaauuaggcaugguggcacgcgccuguaaucccagcuacucgggaggcugaggcaggagaauugcuugaucccagaaggcggagguuccagugagccgagaucaugccacugcacuccagucugggugauagagccagacucugucucaaaaaaaaaaaagaaagaaaaaaagaaucuccuuugacuccacgucucacauccaggucaugcugaugcaagaggugggcucccucaaccuugggcaccucugccccuguggcuuugcaagguacagcccccacuccuggcugcuuucacagcuggcacugagugucuguggcuuuuccaggugcguggugcaaacugucaguggauugaccauucugggguucuugaggacggaugguggcccucuccucacagcucuacuaggcagugccacaguggggacucucugugggggcuccaguucccacauuucucuucugcgcugcccuagcagagguucuccaugagggcuccgccccuguagcacaccucugccuggacacccaggcguuuuuguacaucuucugaaaucucggcagagguucccaaaccucaauucuugucuucugugcacccacaggaccaacaccacauggcagcugcuguggcuuggggcuugcacccuccgaagccaugacccgaauuguaccuugccuccuuuuagcaauggcuggaguggcugggcacagggaaccaagucccuagggugcauacagcaaggggcccuggaccaggcccaggaaaccaaccauuuuuuccuuuuaggauucuaggccugugaugggaggggcugccaugaaggucugugauguguccuggagacauuuucuccauugucuuggugauuaacauuuggcuucucguuacucacaaauuucuguagcugguuugaauuucuccccagaaaauggguuuuucuuuucuuuucuuuuuuuuugagacagaguuucacucuuguugcccaggcuggagugcaauggcgcaaucuuggcucacuacaaccuccaccucccaggaucaagcgauucuccugccucagccucccgaguagcugggauuacaggcaugugccaccacggccagcuaauucuauauauuuaguagagaagggguuucucuauguugcucaggcugcucucaaacuccugaccucagguuauccgccugccucagccucccaaggugcuggauuacaggcaugagccaccacgccuggcuggguuuuuuuuucuguuccauugucaggcugcaauuuuuccaaacuuuaauguucugucaccucuugaaugcuuugccgcuuagcaguuucuuccaccagauaccguaagucaucucucacaaguucaaaguuccacagaucucuagggcaggggcaaaaugccgccagucucuuugcuaaaacauaacaagagucaccuuugcuucaaguuaccaacaaguuucucgucuccaucugagaccaccucagccuggacuuuauuguccauaucacuaccagcauuuuggucagagcuauccaaggagucucuaggaaguuccagacuuucccacaucuuccugucuuuugagcccuccaagucucuaggacguuccaaacuuucccacauucuccugucuucuuccgaguccuccaaacuguuccaacccuugccuguuccccaguuccaaaguugcuuccacauuuucagguaucuuuacggcagagcaccccgcuacccaguaccaauuuacuauauuaguccauucuugcgcugugaauaaauacauaccugagacuggauaauuuauaaaggaaagagguuuaauugacauacaguuuagcauggcugggaaggccucaggaaacuuaaucaugacggaaggaaaaagcaaacauguccuucacaugguggcagcaaggagaagugcagagcgaagaguggcaaaagccacuuaugaaaccaucagaucucgugagaacucacuaucaugagaacagcauggagggaaaugcccccaugauuaaauuaccucucaccgggucccucccacaacauguggggauuaugggaacuacaauuuaagaugagauuugggugggggcacagccaaaccguaucagggucaaaauaaguuccuaaguuucugguuucccuugccacaaucccagaugucaacuuccccucuccaguugacauuaucuucaauuaugucucccccaugcuagguuugaagcagcuguaauauuuuaguuauuuauaauuuuccauagaauaauaaauaacaauuuuaaagauuuaucuuuuugucaguguauauuuuacaugagacaaaagcuauucaaguggugaguagccauuugaaauuacauuguguaaaaucugugucccuaaugauucgugguguugagcauauuuguaugugcuuauuggccauuuguauauauccuggagaaauguccauucaaguucuuugcccauuuauuauuuauuuauuuuuauuuucacuuuuuuuuggaaagagcuaugaugcccaggcuggauuugaacgccugggcucaagauccuucugccuuagguuccugaagcugggauuacagguguguuccagcaugcccagccaauuuugcccauuuucuaaucaauguguuuuuugcugguuuauuacaauaacuuauuauuauuauuauuuuuugagacagggucuugcugcauuacccaggcuggagugcaguggugccaucucggcucacugcaaucuccgccuucugaguucaagccauccuccugccucagccuccuguguagcugagacuagagggcaugccaccaugcucagcuaauauuuguauuuuuuguagagacaggguuuugccauguuguccaggcugaucuugaacucuugagcucaagcugugugcccaccucagccucccaaaaugcugggauuauaggcgugagccaccauguccaacaauuuauuauuauuaauuguggcuauaaaaacaauuaaaaaucuaccaucuuaagcauuuuuguguacaguuuaguaguguuaacuauacucaccuuguugugcaaccaaacuccagcaauuguucccauucucucaaauuuauuuuuucuuucuucaaggugguuaauuuuaucuucaaguuagcugauucuuauuuugcuugcuugaauuugccauugaacaccuauagagaaauuuucauuuuaguugugcuuugcaucuuccagauccguacuuccuggguagucuuuuaaaaaauuuuauauauauauauauauauauauauauauauauauauauauauauauguauuuuuucccccccgagacugagucuugcccugucgcccagagcuggagugcaauggcaugaucucagcucacugcaaccuccgccuccugauuucaagcaauucuccugccucagccucccagguagcugggauuacaggcgccugccaccaugcccggcuaauguuuguguauuuuuaguagagacgggguuucaccauguugaccaggcuggccucuaacuccugaccuugugauccgcccaccuuggccucccaaagugcugagacugcaggcgugagccaccgcgccuguaauuuuuuguugauauuauugcaugcauccuuuucuuaguuuucuuuauuucuuucuccaugguugucuuuacuacuuugagcauaguuaaggcgguugcuuaaagucuucguccagugagcgcaauaacuggagauucucaaagaugguuuaucucaauuuuuucccauugaugagccauauuuuucugucuucuuuaugauuuuguuuuuguugaaaagugggauuugaauuuuuuuuuuuuuuuuuuuuuugagacggagucuugcuuuguugcccaggcuggagugcaguggcacaaucucagcucacugcaaccuccgccucccggguucaagcaauucuuuugaauucaagucuuuugaauucuucugagcccagaaaaggucuuuucuggaaaugcguucuuuccuggacaugaagggggcauucucaauuccccagcauaccuggguuuuucugaguauccuaauuucugaaagaaauuuuucuccucagcuuuucuucccaggcuuuagauggucuaucauaugucucagccauaaucuguuggcucagguagcuucaggguuuuuguuuacuuuaugacauuucaagcaguugcugcccuuuuuuuuccucaaaaaauaaaaauaaaacagucagaugugguagugugcaccugcagucccaguuacuauggaggcugaggugggaggaucaucugagccuagggaggucgagguugcaauaagucgugauuacgccacugcacuccagccugggugaccgaguaagacccugucuaaaaacaacaacaaaaccuuguguaacugcugcuaauuagaguauauauucagggcaacuugaaucuguacuccugguuugcaguccucagcucuggccccaauagacuguccauuuguauugauuuugccuaaguuucuuccuuuuagaucaacaaacuuauggagcgccuuucuguuucauagaugggaugcuucuugauucgugacucgcuaauaauagccaauuagaucacugaacucuuuguugaaauauuuucuuucuuuuuugagacugagucuugcucuguuggccaggcuggagugcaguggcgugauuucagcucacugcaaccuccaccuccuggguucaagcgauucuccugccucagccucuggaguagcugggacuucaagcaugugccaccacaccugacuaauuuuuguauuuuuaguagagacgggguuuuaccauguuggccaggcuggucuucaacuccugaccucaagugaucuguccgccauggccucccaaagugcugggauuacaggugugagcuacugugcccgaccccaaauucuugaccuucuugccaacacuuguucuuuggagugguugauuuuuauugugagucauaggaguuuuuuauauguucuugauacuaacaccuugccagauauaugauuugcugauacuuuuuacaauucccugguugccuuuucccaguguugauagugucuucugacacagaauuauuuauuuagagacaaggucuugcucuguugccuaggcuggagugcagugaugaugugauccgagcucaccccagucucaaccuccugggcucaaggaauccucuucccccagcugccuggccuacacaaguuuuuaauuuugaugaaauaaaauuugucuuuuuuuucuuuugugaaccauguucugguguuuuauccaagaaaucaaugccagacccaauagaaacuuuugcuguguguuuuuguuuaaaaaggaaaauuagaacagaguuaaaagauccaguuggcuuuuauuugcaauucaugaauugggguaccaucccauucuauaaaauagaauaagagcucccgcugggcgugacagaaggguggguuuuguaaggaacaagagaaacagaacaacaacaaagcagacugguuaacaucagguuacuuuuauugaaaggguaaagcagaggggacguccuuauuaugccagcugagauugacugggcccuuuccuauugguugcugugagucuccuguuuuggggaaaaacuggguauguuugaggaucuaccugcuucuuuaaaaauuuuaguuugauuauguggcacuuagcaugagugacuccauuuugguuuggucucauuuguuggggacuaguauaggauuuuaguccaaaaaaauggccugcauaauuuuuacuauuuucuucuaagaguuguuuaguuuuagcuguuaccuuuaggucuuugauccauuuugauuucauuuuuguauguaaguuaaggguccaacugcuuuuuuuuuuuuuuuuuuuugagauggagucucgcucugucgcccaggcuggagugcaguggugcgaucucagcucacugcaagcuccaccucccggguucacgccauucucuugccucagccucccgaguagcugggacuacaggcguccgccaccacgcccggcuaauuuuuuguauuuuucguagagaugggguuucacuguguuagccaggauggucucgaucuccugaccucgugauccgccugccucggccucccaaagugcugggauuacaggcaugagccaccgugcccggccugcuuuuuuuuuuuuuuuuuuugagacagagucucacugucaucuaggcuggagugcaguggggcaaucucagcuuacugcaaccucugcgugcuggguucaagcgauucuucugccucagccucccaaguuucugggacuacaccagcccaccacgcccggcuaauuuuuuuguauuuuuaguagagaugggguuucaccauguugaccaggcuggucuggaacuccugaccucaggugaucugucuaccucggccucucaaagugcugagauuacaggcaugaaccaccuugccgggccucaacugcauuuuuucacauguagguauccaguuuucccagaaccauuuuuuuuuuucaacuuuuauuuuugguugagggaguaccugugcaaguuuguuacauggguaaauugcguguuacuggggguugguguauuucaucacgcagguagugagcauaguaucugauagguuucuuuuccacccucacccucuuccaacccucccacuucaaguaggccgcggugucuguuguucucaucuuuguacucaugucaucaccauuuuuugaaaaguauuuuuuuccaauaaugaaucugggcacacucgccaaaagucauuuuaccauuuaugaauguguaccuccccuccccucccucccuuccccccuccccuccccuccccucccucccuuccccccuccccuccccuccuuccccccuccccucccuucccccccuccccucuccuuuccuuuccuuuuuccuuuccugacauagggucucacuugguuucccagcauggucuugaccucuugaccucaagccauccucuggucuuuggccucccaaagugcugggauuacaggcaugagcuaccaucccuggccugaaggugguaucuguuaagagcaauucccugagcauauuucaagaugacuacucuuacccucuuccugccauaagcaggaagcaauuuuucuaugaucuucacugugagaacugaugaaguuucuggagguagagcucacacauuucugggggcccccuaugacuggauccccuggauuuuuaccucuuuuuuuuuaaaaaacagcuaauuaaaaaaaauauuuaguagacaagaggucucgcuauguuuuccaggucagucuugaacuccugagcucaagugauccuccugccuccaucucccaaaguguugggauuacaggcgugagccaccgugcccagccagauuuuuacacuuagccuuuaguaauucauuaguugcaauuuagguuuuccuaccccuguacugcuucccacagagauuuugcuaugggagucuguucuaguaaguuaugacucuuuuaucaguuagguuggugggauccugucuaaaauccaguacccagauacugucaaagcucaaacuuugugaacaagcauuucuaaagauacacagucucaggguggcuaauguuaacucuuuuuucugcacucuaguuacuagauuuuuuuuuuuuuuuuuuuuuuugagacggagucuugcccugucacccggucuggagugcaguggugcaaucucagcucacugcaagcuucgccuucuggguucacgccauucuucuaccucagccuccugaguagcugggacuaugggcacccaccaccgugccuggcuaauuuuuguauuuuuaguagagaugggguuucaccuuguuagccaggauggucucgaucucuugaccucgugauccacccgccucggccucccaaaguguugggauuacaggcgugagccaccgcgcccagccacuacauguuuguuacaacaggugcuacaggccuaccuuacagagagacauuagggguggcccaggcaguacauacuucucccaccagagaggcaugcuccuauucugcuguugcuaguucaguucuagcagcagaauugcuuuguggaaggaagugagucuagacagaggguaaguuugaugacuguggaaucuugaaauaaauguuuggaaagcauagcauccugagaacuucuugggaauaaagucuaggcccccagugcugucugucucaaccuuccuccuccacacaugggggauguuucaggauucaguggccuuugaggauguggcugugaacuucacccuggaggagugggcuuugcuggauccuucccagaagaaucucuacagggaugugaugcgggaaaccuucaggaaccuggcuucuguagguaagggugacaauauuccuuuccucagugaauuagagaacaaguguuucuagcuccuuaacacuuuggggaauaaaccaggcauggguacagggaauuaugaauauagaaucuaauacuuuuuucauaauuuuauacuaauucauaaugacuuuucugggucuaaauuuuaggaaaacaaugggaagaccagaacauugaagacccauucaaaauucccaggagaaauauaagguaauuugcacucacaaaagaaaguucuguuccuugagagcauuucguauuguuaggaauuuuuuuuuuuuuuuuuuuuagaugaagucucgcucugucgccaggcuggagugcaguggcacaaucuuggcucacugcaaccuccgccucccagguucaagugauucuccugccucagccuccugaguagcuaggacuacaggcacgugccaccacgccgagcuaauuuuuuguauuuuuaguagagacgggguuucaccauguuggccaggauggucuuguucucuugaccucgugaucugccugccucagccucccaaagugcugggauuacaggccugagccaccaugcccagcaggaauuuuuaaaagcaagcaaacaacauauaagcccagcuucaaacuguuuuguuuuuagaaaaucuucuccaagccaggcauggugacucacgccuguaaucccagcacuuugggaggcugaggugggcagaucacgaggucaggagaucgagaccauccuggcuaacacggugaaacuccgucucuacuaaaaauacaaaaaaaaaguuagcugggugugguggugggugccuguaaucccagcuacucgggaggcugagacaggagaacggcgugaauugggaggcagagcuugcuuugagccaagauggcaccacugcacuccagccugggugacagagugagacucugucucaaaaaagaaaaaaagaaaaucuucuccaaaaacauaguuaaguguaacauagauguucaguguuugcaaaauaguucaauuauagauaguauuaagaaacuucauacgaauaucuuuuuuuuuuuuuuuuugagagggaauuucacaacucguugcccaggcuggagugcaagggugccaucuuggcucacugcaaccuccgccuccuggauucaagcgauucuccugccugagccucccgaguagcugggauuacaggcgccugccaccacaccuggcuaauuuuuuguauuuuuaguagagacaggguuucaccauguuggccaggcuggucuugaacuccugaccucaggugauccaccugccucagccuccgaaagugcugggauuacagaugugagccaccacaccuggccaugaauaucauuuucuuucuuucuuuuuuuuuuuuuugagacagaguuucgcucuuguugcccaggcugaagugcaauggcaugaucuuggcucacugcaccucugccuccuggguucaagcaauucuccugccucagccucccgaguagcugggauuacacgcgugcuccacugcgccuggcuaauuuuuuuuauuuuuuauuuuuaguagagacaggguuucuccacguuggucaagcuggucuuaaacuccugaccucaggugauccuccugucuuggccuuccaaagugccgggauuacaggcauaagcuacugcgucuggccaugaauaucauuuuuugauaauagguaugguugugaccuauugcagaccauuuaguccacucauguucaaacaguugagacaggcauaaaacguacacuuucccugguaauguuaaacaugugaauccaaggccaggcaugguggcucacgccuguaaucccagcacuuugggaggcagaggugagaggaucccuugagccuuggaguucaggguucacgccugggcaacauaguaagauucugucucuguauuuaaaaacaaguauauguaagucuaauaccuauuaauaaauauaaaaucauuuauaaacaaaacauuaauaauguacuucucauuuuucugacaagucauauuccagagagacucugugaaaguaaagaagguggucaaggugaagaaaccuucagccagauuccagaugguauucugaacaagaaaacuccuggaguaaaaccgugugaaagcaguguguguggagaaguuggcauggguccuucaucacuuaauaggcacaucagagaucacacuggacgugaaccaaaugaauaucaggaauauggaaagaagucauauacacguaaccaguguggacgagccuugaguuaucaucgcucuuuuccaguacgugaaaggacucauccuggaggaaagcccuaugauuguaaggaauguggagaaaccuuuauuucucuuguaagcauucgaagacacauguuaacgcauaggggagguguaccuuacaaauguaaggugugugggaaagccuuugauuaucccaguuuauuucguauacaugaaagaagucacacuggagagaaaccuuaugaaugcaagcaaugugggaaagccuucaguuguuccaguuacauuagaauacaugaaaggacucacacuggagauaaacccuaugaaugcaagcagugugggaaagcuuucaguuguuccaaguacauucgaauccaugaacgaacucacacaggagagaaacccuacgaauguaaacagugcgguaaagccuuuaggugcgccaguucuguucgaagucacgagaggacucacaccggagagaaacuuuuugaauguaaggaaugcgggaaggcuuugacuugucuugcaaguguuagaagacacaugauaaagcacacuggcaauggaccuuauaaauguaaggugugugggaaagccuuugauuuccccaguucauuucgaauccaugaaaggacccacacuggagagaaacccuaugauuguaagcaaugugggaaagccuucaguuguuccaguucguuucgaaaacaugaaagaauucacacuggagagaaacccuauaaauguacaaaaugugggaaagccuucagucguuccaguuacuuccgaauccaugaaagaacucacacuggagagaaacccuaugaauguaagcaaugugggaaagccuucagucgauccacuuacuuucgaguacaugaaaaaauucauacuggagagaaacccuaugagaacccuaacccuaacgcuucaguugucccaguucuuucaugagcaugaaaggagucacauagagaaaccccaugaaaguaagaaauuugggaaagccuucaguccuuucuguuucuuucaacuacgugaaaggauucacaguggagaaagacccuguaagauaauuggcuuuaaauuacgagagacuugugauaggacaguaaaaccuagaguuggaguuggaucucuggauuguguuaugucaguguugguagguuaggaacuagauuucccagaauccauuccauuugugauuccaugauacaauucaccaguaaccuaucuuacaugagauucggaaguaaguuaagaaggcauuagucaugguuuggaagcaccauacagggagacagcugugugaauacaggcuguauggacacuugcuuccaucccauuuuccugcuucuuuggguugccaaucaagaguauccucaaaacgacuugacuuuaauuuucucggaggugauaggcuuccacacaggucuccagaagcccugcauugaauauccauccacacuuugguuuuccuucagacauuauuaugucuguacuaggcaacuaauucagacuguccugguugggaauauucugugaugcucugacuccccuagucuguagacggaauuggcauacggucuaauuuguguaguaagcaccuuuguucauacuaguagugacuguauucuugauucagccugauagcuaccaugcugcugucaaaaccaaccagaggggagcuuguucuucugcuguagugugcagugacuggccucacccaggacuuugaugugagaaugagcacuuuccucuaucaggaaauuucaaguguuuccuguuauucguagcucaauguaaugccucaguucauuuucaguuguuugauuauaugugacuaauauguauuuuuuauucaaacaagacuucuguacauguuucuucaaaacaguuuauuaacugucuucagucuuggauuacaucaaguuuauaauuuuggcaaauuguuaagacacugugaagucagcguuaaccaugugcauacaacuuaaggaauuuuuuccuccucauguaaauuuuacuuuucaugcuuauauaguuucaacuuuuaucuucauaguaauuucucaucuacucauaauaccaaaaguuaagucaugcuguuuugugugcucucuugcuaaagaccgcagagaccauaccuguugucaaagaggguguaauaaacuguaauaauaaucaugaccacaaaccauaaaggacugugugauguaucagu
